United States Patent 8,067,671 (METHODS FOR GENETIC CONTROL OF PLANT PEST INFESTATION AND COMPOSITIONS THEREOF) - sequence listing, part 6

SEQ ID NO: 4293 - DNA, 2458 bp, Heterodera glycines
cgacggtaataaatttttaaaagtcaaacaaattagtcatttttttaactaacaataaactgtttcccacaatttcagttggatttgcaacgacgtgtggatggatattttgccctgttttgaccgtccccaactcggcctcaaattggcacttctttcgccacgtttcaatgcgttggtggacaaacatttcgatggcaaaagcgaattgacaatttggagaccaatcgaaattcacaagggcaaaggaccagaaccgaaactatctgtgcggatggatcacaaatttgtggaatttccattgcccgacgaccgtccgttgccctgcaaaatccgctttaagcgccttcagattgagtaattaaaaatcaaagctttatggcaataaaagcattcttttcctttttcagttacattgatcactccgtcatcgcttttcttcgttcaaatcaccaaatttttgagaaaagaggcatcgatttatatttgtggattccttattcacataccacggatggccagcggatttgggatgtttttgttcgtgaattatggccaattttttcgacaaacattcgctgtttgggctttttccgtggtgatcatttggacaatttgcttcgtctcatttcaccgacaattctcaccgatctcaacaaattgaattcaatcaattcctatgatttgttgcccgaggcgattggtgatgattttgatgtgccaaatgcaacaatttctgctggccaagcattgtccaaatggttgcactctccgagaaaagatggccaacccaagcgattgcgttgcgaagattacaacgcacaagcgaacactgattggatcaacaatttcaaggaggtgtggccataatctcgacaaatcactgatttttgttttcaaattgtttagcattttctttgtgccaatgccatttcttccgtcaattacgaaattcgttttactgttcgtgcgccgtcaatacaaatggtgccattcgaattggtgaacgaatggacaatggaaaagctgacattgaccaaagaaaacgaaaatgaatgggacaccatttggataatgaaacgaagcaaaattattggggagacagcggcggtcaattggaaagacggaaattgggacaacaattgtaactgtgtgttcttttggcttgatagtgacactaattgcattgggtgagcaaataaaaaagtcatttaattttgtttaattaattaaaatttcgcttaatttagtccattgtctccgccaccgaaagaagaagacgaagcaggacaaagcagcgaaaaaggggcgtcgtctgctgacaaatgagtgacggacaaaagaacaaaaacagtgatcagccgcagaagtagaaatgaattaattaagaatgatcgatcgaccgatcataattcatccgtgatcaaattattaaaagtaattatttggaacgttttcgccactatttttgccactagttaattattttgggatttttgccactaaaaatccgatccctacttctaacatgcatttttttgagacttttttttacactttttcggatttttatgacttttttgagtttttgcgacttttgttcgtgatttttttgacttattgaggcaaagtttgaattttacagaagaaaatgccgaaaaataaaattttcggtcgataaaaaggcaatgaaacctggatgaattttttcttaattattggaagattagaagtaatcattaagcagaagctaggcgatgaatcatctcaccaaaaagctatgatttataagacttaaaaattcaagaaaatcctaattttttgtaaaattttttaagtagattcttaggggtgtattttttgaaaaaaattttaggtcgtttcttaggggtgtattttttggttttattgcatttttgttgagaaattttccaaaaaatgtcgaaatagtaaaaaaaaaaaatgagtcggggtcgttttggcgccgacgttttggcgcccacgttttggcgccagggtcaggtttttaaattttgtctatgtttgaataaatgaaattatgtattcgtcagttttctgagtcgctaatcacgaatattgtattcattttaacaattgcgaagcccggacttgatttaaatgaatacaatttttgaacatattagatcaggccttctatctgttttgttttatcaaatgttttaatatggtgggtccaaatctgagaaaatgatttaccagattctgatttagggatagtgactattatttattaaatataccgttaaggttatgtttataatcactaactcttttgaaatttcaaccgaaaaaatttaagagtttaaaaatattcaaaatgttttgacattttttgaagcatagcgaagagaaaaaattcttgctaagtcaatttttcatgttgaccaacaaaatgttcacagcaagttgatcatat

SEQ ID NO: 4294 - DNA, 3952 bp, Heterodera glycines
tccaaactgtttttgttcggctcgaatggcttcagctgatcactttcgacctttttcggccatcttctttcaatgagttctttgaccttctttaaaatgtggtcttttgctgtttcactggcaatcgattttgcggtgacaggcagcgagtcgatgttttccacttgtacggctctcacttctgcactgtccaaatcaatttttgctatctccggacatggtagtcgcgatagaccatcggcatttccaaattcttttgttggacaatattcgatgtcaaagtcgaagttcattaaaatgagtgaccaccggtgcagccttctcgccgccaccacgggtatttcactttttggcccaaaaatctttttcaacggttcgtgatccgtctgtaacacgaattttcggccatacaaaaattgtttaaacttttcgactccaaaaataattccgcggccttctttttcaatttgcgaatagtttcgctccgccgcattcaatgtccgtgatgcataggcgatgacgccttcctttccattttgttgacttttatgggaaagaacggcaccaacgccataatcagacgcatccgttgccaagtataatggctggtcgggatcataatgaacgagcacttcggttgatgacaaaatttctttaatcatttgaaatgctttctgctgttcacttccccaatgccacttttcttccattctccgcaattggtttaatggctcggaaacggtagccattgcgggcacgaagttgccataataattaaccatacccaaaaaggattgaagctcctttaaattttggggcggtggcattttgcgaattgcttccagcttttcctctgaagcatggactccgtttttgtccactcggtgtcccaaatattctatgctttcacgcataaattcgcatttgtcccgtttaactctcagtccatttgccttgagccgctgaagcacctgcgtaattcggcaaagatgttctgcctgtgttggtgctgtgatcagtatatcgtcgagatacactgccactcattcaattccttgcaaaatttcgtccatgacctgctggaaaatcgccggtgctgacgctacgccaaaagggagtctcgtaaattggaacaatcctttgtgcgtgcatactgccaaacacttttttgcttcatcatccaacatcagctgcagatatgcgtcgttcaaatccacttttgaaaatttttgaccgccatttagcacactgaataggtcgtccggtcttggtagtggatattggtgcacgtccaaccattggttgacggtcactttgtaatcacagcagagccgaatttttccgttcggttttggtacaatgaccaaaggtgtggcccaatcactgttgttcgtcggctccagcactccctgctgtacccacttatccaaaatcttctccacttcggctttgagctcaaatggtacaggacgagccttacacctttttggttgcactccaggcttgaatttcaatgaaatttgacgggtgcatcggcccaattcgtctcgaaatacttcttgaaatttttcgagaattttgtccacctctttttgatcattattcgtggatccgatttggattgcgttaatgccgaatgctttgttcaaatcaatgcgcagtctgcgaatcacatcacgaccgcacaaatttctcttatttccttttaccacataaatatccgtgttgatttgcatgccattgtattccacatttacatttgccatgccgaagacgcctttgatcggaatgcccccataagccagtagtccttgactttccttcaattcgggctttccaatatggttccaatcttggctaccgatgattgttacatctgcaccactgtccaattcgaattcggcatttcctttatgcactttgagttggatgaagctcggcggaacagtctcagttttagccgactttcgctccaaactcgaaattactggtggcttctcattgcactgcagctgaatttgcttcacgtgtttgctgcttttccatagccgactttccactctggccgggtttttgttgccaccatttgtcctgcatacaatcgcccaatgtccgactcttccgcatttggtgcatttgtcggctttgccgggacagatattagcccaatgtccgcttcttccacaacggtagcatggcttactgtcggcacttttgctattgttggttcctttggcgcgatcatatcctcctcctcttcctgaaattttggccacattgcctttcaatgagtccgatccaatcgcttgagcgtccacatttgattgctccagcacaactgccaattcgacggcatctttgaatttgagatctttgtccccttttttgatcagttcggcacgaattgagtcgtcgacaattccattgacaaataatgcgcttaagcacatgtcgatgctgtccttgccccactccgttttggcaataagtgaacgcaattgaatggaaaagtcgcgaatcgattggccggaatgttgcctggcggtgaacagctcgtgcctccttgccacaattgactttgcttcgccgtaacgctcgcacatcaatgccgtaatttccgcaaaatccatatcacggatgtcgtcaggctgtgccatcattcttaactcatcataaattgggccaatttcggtgaaaagcaatagctttttcatctccgggtcggtgatccccctgagcttgatgaaaaaatcgaatctttccgcccaagaatcccatgacatttccggtgaatatgctcctggtcctttggccgatttgattttgttgtcttgctgttgttgagccatcgctgcgacgttttaaaccgtatatcacggaaccttacacaacacgagtgtttcggtttttcggcgaatctgcgaaattgaaaagtcaacacgagacttattcaatttcccaacgaaaattgttaacacgaaacaattttcgtaaatgttgattgctgtttgtgtcgcttttatgctggctttgttccttttgctgactgcgccaatttactgttgtgtccgagcaacagttaaagggaatattgatttattccaaataaataaagaacagaaaattgggaggtcaaaggacaaataataaatgcagataaattaaatgacaaatgaatggtggaaaaagcaaaggaaggggaaataattccatatttatgggcagtaaaatgggcgggaaatgtgggcatttaaaattcaaaatatccacttaaacactacaacagtaaagcaattgaattcgcaattaattaactattgaaaaaaatttattttttataatatgcatttcttgtgtgctttttcagattgtggtaccttccccggcttttgcaacggttcagtctccaccgcgtcctcctccaatttctctgtggccaccgtcccatccgatttttgcaacggttccttctccgtgtcaaatatggccattggtctcttctttgccagcccggcgccgtccaatttggcctagagtgtgggggaggggtcgaagggtttaaaaatagaaaatttgggtttttggtcggttttcacagaaataattaattttatatttatttcttttttatcctacacaatttttaataccgtatacaaccgtttcacatgtattttattaaaatttaatgaatttgaataatttttggaaaaatttacccttcaattttgatccaatggcaccaaatttacatccaatttccgactgtaagccttgttctacctttttcggtgaggtgccgttgtcgtcagtgccaaggaggcgttttgatgtgcgcggcgcgtaagattttgttgcaggcatttcaggaaccttttgaaaaaatgaatttatataatttgttaatatttttcggtctgataattaactttttttaacccaatgaaatgac

SEQ ID NO: 4295 - DNA, 1333 bp, Heterodera glycines
ctgactgcgccaatttactgttgtgtccgagcaacctctaaagggaatattgatttattccaaataaataaagcacagaaaattgggaggtcaaaggacaaataataattgcagataaattaaatgacaaatgaatggtggaaaaaagcaaaggaaggggaaacaattccatatttatgggcagtaaaatgggcgggaaatgtgggcatttaaaattcaaaatatccacttaaacactacacccctgaattgttttaccttgttccccccattttcgaaaaaaatgaaaattttaaaaagtcgttaaacccagggctcggatcgacaatttttcaaaatcagaacagattttgttttgcgaaactgcctccaaattagttatttttaaaattattcgatcaataatgtattattttttcgcctccgattgtcgaatttaacgatttttggggaggaaataagcaaatcgtaaatttcagtgcattcgggatcaaacaataagatttttaacaatttttgcgggtgcagtttttccataaaacttctggtgaacgggcgaggggagggggtccggcgtcccacggtcaattgtatacggccttctctcgggcaacagacggaaacaatgtccgtgttcatgctcccaaccgggaaattgatgcccaaggccgagccaaagtgctgaatattgtagctataatatgctcaagttacaataattggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgacgtgcaacgttagggcacttccggtttccattgcattatgcgatgtgtcaactccaattattggaggaaaccaagtgcatgtcggctgacgcaaagaccctaacacaaggcctaggtagcgaagctcccaaagcgcgaagcgctttaagcacccaagaaacatgtaagcacacacccgctagtttatatccatataattacactccctagtaatcatcaaaaatagtttggttctcgtaattaatagagtgaatttgttcaaaattttttgtaaatttattaatatatttgtagatagcattttttcctttattcaaaaaattattttcattttttgaaaaaaagttgtttatttgaatttttatatgtaatgaaatgctatcgtacaaatagtttaaattta

SEQ ID NO: 4296 - DNA, 2243 bp, Heterodera glycines
  misc_feature (2188)..(2189): n is a, c, g, or t
  misc_feature (2196)..(2196): n is a, c, g, or t
atagtcataaaaatttattctctggggtttttggggtccccgatcacgaatccttcaattattttgatcaattccgatttcctaatctaaatttgaacaaaaaatcataatttgaaaaattcaaaattccgatttttattcgagttcgggttagggattagaaattagtcaaaatacatgtcagattcgtgattagcgacctttaaaaccccggataaaaaattatcatggttttttatcttaaaaaaattttgcaaaacaaaagggtccccccttttgtttcaaaaaggcccacttttagtatagcgccatcattttcatgggagcggggaaaaggcgggaatcgttcccggcatttttgaattcccattttcattgttcaggtgttttttttactaccgggctctagaaatgataatttaaagtagcagaatttatgcttaaatttgattttgttgtacaatacaaagcatttcccgttctttcacaatgaatttttctcttcacataaatatggccaattaatcagccatttatttttttaaataatccgccttttttcgttcttttcctcgacaaaagcaattccacgcgatcggtggccaacaacggaagtgccaaatcgcacgtgagaaattggatgcttctcctgtttatctgaaaataaaatgccaaaattgctggccagaggctgcttccgcttgccctacgttcagaattcggtcccctggctgcaatcgtccacttttatcggccggtccgtcttttaccactgatttcacgtaaatgccgccctgtctctgctgttccctctctccccttgccgtttcgtcggctgtgccatcgcaaaccgaaaaaccgaagcttttcgtgtacgggcaacggcacaattgaatggtgaacacttcgctgtcgaattggtcctcctcctcttcgttcgcctcattctcttcctcctgctcacaatttccatcatcctctgttggtgaagtgatgaacggaactactgaagagcagcgaactcgctgatgctcttcttcatccgcagacggagcgaaagtggacgcattgtgagaaggaatgattggtgggacggttgaggacacttcgccgactttgctgttggagttcagctgtgtcagaagcgccaacgcattggaggcggcccggggggaaggcatcggcgggggcaactcaaccacaaaagtgttgccgttgtgacacatttgttcgcctctaaatcttcgtaaatatggaaaggtaaaacgagtatttggcaatacttttgcttttcccgggaaacgggcgtttgaggccttggcagagttacgcttgcaatgtttctgacactttcaccggcgcggtaatttgtggaggccaaaggcgttttcaggctgttcatccctttgattggaaaattggaaggaaaacgacacgaaagaaagccattttgagtaaagttggcaaagtcgttactgctgagaggaacaaaaatggaattttggcattgtgccaatgtttccgaccatttcttcgcgcctctgttcgtcgtgtaattggacgcttgccccgacagaatgcactcctccaacttgcgcagcatctcctcctctcccactgtttccaatgcgtccaaaatgcggacccagtcctccttgtcctccttttccgtcagtgtcgaccattcgggggaagttgaagccgttgttgggcacgaccgctgctcgtttctgcaaacgcaacatcgttcctccagcgatgttcttgcggcatccgtcgactgacaagtggccgcgttgtgctgctgctgccctctgccgctttgactatcagtcgcagcagccgaactcagtcccgagtcccaaccagcgcagcactgctcggagagacggtcgactgaaggggcggggggagagaatgaaggagggggggcactgccaaataaatgatgccttgctggaagttgtttgaggtggaagggcggagatgggcgagtcgggccgtcccatgtctgagattgttctgtttgttgccgatgggtggagagtcctttcattgagattttcattcgttgcaaaatcaccgagcaaatctcgaggaaacctccattgagtccacggcactgtccacacttttcaggggagtgcccattttgggggtgtcatggtaattctcctcaattccattnnaaaaccncaacttatgagaggaacaccaattagcagctgaatagacaaattagc

SEQ ID NO: 4297 - DNA, 1291 bp, Heterodera glycines
aatttttttttttaattttgctaacttataaattgttcaagaaaaaaatcttagttttttcataaaaaaattctaagaaaaaaaatttttcgagaaatttttatgatgaattactaagatttttcaaaatttttccaaaaatcgctgaaaatttctcggggcgaaccgagctggggggaaatgaagtgcatctgtggaagacgactgcttgaaaaaccggaatttcacatcccggtcccgacctattctacattaaacaaacgaatttataaaaatttctagttttcgatttctaaattagtgcctaccgttccgccaattcccctggcattagtcgagagatgacaattgggtccgaaatgcctccttccgaagcgatcgttaccccaaggggccgtccctttcggcacatttccacggaataaaccaccgaatgggaggtgcccaacagaaggtcctgagaatgtcgcgtggattgttcgcctctcccctcgctttacctgctcctctccgccgcccttcgctatgcaaagcttcacaatcggagccgacctgtgcagcaaacggacggactcctccacggtgcacgcgcccaaagggatgtcgtcgatggaatgaatgcgatcgcccgcttggatggagccgcacctaacgcagagggactcaacaaaacaaatccaaaaacaatcgaaagaattgggttctttttctgctacctgtgtgccacacttcccattcgaatgtccgaaataatcagcggctcgcctttggctgcccctttgtgctcacttcggcacacaatgccaagcgaagagccgcgcttggcgagacgaacaacaaacaaagtgccggggccggggggaagcacagactaaaagaagaagaagaagaagcattgggaaatatccaataaacaagggtacttcaatgacgctgaattcaacgagtaaaatgacagaacgggcggacgaaaaggagcaggcacaaagcaaatgcaaaaaatgaacaaatgaaaatggcgggatgcgaatatccgacttattataaggtaaaacaagcgcaaaagccaaatgtcttggtctataacttgacccagcgttgcttgccgtggcatggttttgtttgacttggcttacctgtgcctcttccaccgttccgtccgccgtgttccattcgttgatggaaatgattctgtcgcccggctgcaacactccgcttctgaagttgatgaagccatgacagattggcattgcattgctcaattaatacttttcagctggcgacccccgct

SEQ ID NO: 4298 - DNA, 5453 bp, Heterodera glycines
tagtgatttttaactattttagtgacgaagtcgccaaaatagtgatttctagtgaccgataatgacatcagaatcgaaaatttttaatgcagaaatgcgttttttgagctcctttcttcaaaacaattgagcaaaaaaaaaagttttttcactaaaagttgcgtccctagtgatcagcatatttgtttaccccaaattcattgaaaagaaaatttttacagaagattaaaaatttttgaaaaaagttaataagctaataagggcactaaagaatacaccaaactacacaacaaaatggcgacaacaacagcagcagaaatccccagaaaatcaccacaacaacggaagcgcgaagaaatggcgcagcttctagagtcacgaaaagtgggctaaatgtgaacgaagctgatggtttacatgatccatgtttaggtggatcaaggtgctaccttcgtcgagccaagaaaaccttcaggaacagccggacaaaaggggaggatgaaactcatcacaaacgtttgtcttttctgtagtgttcaaaagagccaatactgtgattttaggcacacattctcaaactactgggtacgcaagccatctaccactacgaggtgaccatcaacgcagtgagcagtcgttcggaccggaagttttgcgtttcagagccgagcggtccacgggatagggacgagtaagtatgacgttgatgttaggtctaacatcttctgtttagtttcccattactcaaccgtcgtgacaaatgccgtgaggtcttctcggcattctacaggaccatggaacagtcactgaaagataccgggaacttactctactacgatttatcgaaaacaatattcacattgaagaagctacagatcgaggtttatgggctttggatggcattttaataataacacatcgtttagtcggaaggaaaattcatgtttaacatcggcacggtgccaaccgctgaacgcccagacgcggcacggttcaaacattatgaattcatcatcaggccagcgactggcttcgaggttaacgacttgtccttcatcacgaacgacgtgtcgaaaatggaacgatcacttgagcaattccttgacattgcaacggcgcagaaggccaacatggacgggtatggatttaatcgaaaacaataaatatataattttaatatacctaatcatttgaattggactgctgtcagtggatttgggaaattcagagttatagaacaaaaccaaatttcccgacagaaattttgaagtcatgaattcagggccaaattttaaatatttgattcacctaactgttaagaactcaaaagtctattttcaggaagcaatttatcgggtttacttcgtctcgtgtttacttattggcgccaaccgactatggcttcggagccaacgagtgtcctgtcttcgattccaaccactcattcttaggtgtcggagtgaacaagggatgtcgaattgttgaaggtttgttcgttttcgttcaattaactcattagaaaatcaggagatcaaggccctggccaaatgacaccagccatcgtcatccaaacgaaaaaggtttatttttatgggttccatcagtcgtcccataattattttttaccatgttccattcattgtccttagtccgctttccacattccggacatgtgcattttggacaaggcaaaaacgctccttttccgagagaatcagggaaggttcgagacaggtgactttactcaaagtgactacgaggcgctttgcaatggccttgtcggtatgttaatataatgcgtttgaaacgaattgttttatacccattctctaggaatttatgctgaaccgcgctatggaacgtcgggacgatttttccgcatcagtgacattacaaaaccaaacactggaaatggtcttaactcggagaacacatacatcacacaccaagtcagcgggaaaatcagcgtcaaacaatatttcgaggatacctatcagaaaacgcttcagtgagtttatccaattcgattgttttcttaaaagaaacattttagtaattatttctccatttcaggtaccctaaagcaccactcctcgtcaattatcgcagaattggggacccggcgtattatcccatggaggtaaaacggacagcaatttattgtccctttttaaatttaattaaaacacttaggtttgctttgttttggatggtcaacgcgtcaaaagttctcaacaaaatcccgagcaaattcgtgtaggtgtttagcgatttaatttataatcatcattctattccaacattaacaatatgtgtttaggaaatgatcaaagagactgccattccgcccaccgttttgcgagtgcacaacgaaagggtgaaggagtcgcttcagttggtcaacaacgaatacttgacaaaagcgtccgttcactttgacacaacgccactccatgtcgattaccgtgttcttggtccgccagcaactctctatcggaacaaccatcgtgtcactcctgccgcgtcaaactgtgaatggcgtccgggtgacgctttggtgaatgcgcaaattggcaactgggtagcctatgcgtttgggaaccctgcgggtgactcggtgcgacgattaggcttaaccgaaacgatgtggaggtaattagcgctgaaattcctgattggttttaatgtaccaaaaaaatttatagtaatatctgtcaactttaaacaggaatttcgtggacaagtatgcaggtgaaatgcgtaacaagggcattgtttgtgtgcctccggtgcgtgtctctttttgctggtttacgtccgtgaacgaggtcttgaatgttttgcacaaggaagccctgaacggcgttgagttctgtctcattggtcatgcgaaaggctttgagggtgatgacgtgcatggtaccatttattagccgttgtaaaatttaggctcctgattgtgagttatttatttagttacgatcaaggcgtttgaacaacagactgaaattgtcactcaagcaatcacatttgacgttctcaaggatgtgctcgataaaggcagcccattgactgttgcgaattgcattcacaaaacgaacgtgaaaatgggcggtctaaattatgctcttcatatggatgatccatcgtacgtctttttttcctttttccatatagccaatacaattggtttcagtgtggcccaattgttcgacggtcaaacactgtttcttggttttgcaatgaacttcccgggtggattcgctccttccgaatctgctgcccctatcaacggtgcgaacggttctgtgccttcaggaagtaaagctggaccaactctgcagaatggtgctaacggcgtcgccgctactggagcaaacaccattcctctcggctcaaatggaaatgtggttccgagtgcgcccgtgccacgagttggctcctcattgcctcctccttcgtgcattggggtaatacaaaaaggagaagagctcattaatcaattttaaaggtgtaagtcaatttctaaaattccagtgggccgcgacaatcggaaaacgacacaaggacgaatacattggtgactttgtctaccaggctccgcgacgtgaggagaaaattgatgtcattgcaagcgttgtcaggagatgcattgagtccttcaaaaagaacaggaacaaactaccgtaagttttggacaatttgcaatttatttgttcgcaatgattgctcagactacgcgtggtcattttgcgcaacggatgtaccgagggacaattcgaatatgtcatgaagtaatttttcaaattgatgaaattatttgaaaatgaaaatttctattaaaatagtgacactctggctcttcgaaaataaataatgtgccctactttaagatatgaaattccgctggtcaagaaggaactggaggaattgggttgcaccgcaaaacttactgtgattgttccaaaccgacttcaggtgcactttcccacacatcaaaacggcaccgcctcatgtaatttaacgtttttatttatttcaggatgtacgctttctgcgtcaagatgccaagccggaggacaagagcaatgagcaaaacatccccccagggactgttgtcgacactggtgaatattttactaatttattgccctaacgagttacaattttcagtcgttgttcaccccaaacgctccgagttcttccttaacagtcacgtggcgatcaagggcactgcttgtacgccacattacactgttctgcgggacgagaacgatatgtcgatggacacacttcaaacaatggtccattacctctgctttgggcatcaaattgtcacaaagccgacctcattgccctcgccggtgtacatcgccgatgaatatgtgagccaattcaaataacaataagaaaacatagacagagaatcgaaatcatttaggcgaaacgcggtcgaaacatctactcacactacgccaagaacggtattgacaacagcaaaaatttgcagctcttcgcaaagaacaaaggggtggaatggccgctgcgcacttatgcggacatgaccaaagtcctttctttcctcaacaccacctacctgagggagctgcgcatcaacgcctgataagttagtgatggatggattttgattgattgtttttgttttccatttgattgtttttctttttgtttagttttcgtttttttcttcggtttgcttagcattgatacttttctcttctaatattttgctcaatttgattgtttaactcccctcacctttgcctcttcaattcgtgcatttgttttcgtttcttttggtctttcttcgtgcattctcttttctttttttgaatgattttttccttctccgttttattgtaccaatccttttgttgtttattatattctgagctttaataaattgaaaattggattttttggttttaaaagaaaggtggtaactcctcttaaaattgtcaattaaggatcggaattatagataataagttgaccgaattcgcggcattgattttataaatgcgatttatctttccatggcgaaaaccattatgtttattgggtaatactggagaatctgggctccacccaaaaaaattatttttctgctaggaaaagtccaaccctggggtttacggggcttctgatcacgaatatgatatcagagctgcaaaaatcattgattttatcatgattttgaaaatcttagatttttcgaaattttgatcaaatgaagcgaaaaataatgaaaggcaaaaggtttagccactagaccacacttgaacttgaaaaaaattctgtaaaaaataaataatttaattttttttctcaaaatttcttctccaccagtttccttctcttttctcacccagaccccctttcttaccagtgcttacttagtcccgccgggaccggtactggcaaaaccggga

SEQ ID NO: 4299 - DNA, 2098 bp, Heterodera glycines
  misc_feature (81)..(81): n is a, c, g, or t
aaatcaacaactgatgaagaaaaacgtcaaattattcaaaaattcattgaaatggcaaatgaatataaacaaaaaagaaanatattcacgaaaagaatggaaacaaaatcataaagaaatttgcaagaaaattggagtaagcaaagggacaattatcaaatggaagaaacaatttggcataagcagtaaaagaataacgaaaaaagaaaaaatggaaaaaatgaaaatttattgggaaataaaacgagcaaatccaaaaatgagtcacaaagaaattggaaaaattgtgaacacttctcaacagaatatttccaattggaaaaaacaatttggagatgatgaataaataatcattcaatttttttagaagtgcgtaaaaacaaaattttattgaaaatcaagaaaaattatttgttgataaattttattttaattatataaatcattttggttttgttgtattttaaaatgccgtaaacatgacatgcagaattattaaatattcaaatcataaataattttccgaaagatttctaagaggttttttgaaaaaattagagtagtacgggaccgggaatttttgccaaaaccgggacttgccgtgacctgagaagccgggacctcgatttttgtccgagaccaaccgggaaattttccaagaaaaaaaaaaattaaatttttagtttatttaaagtgaaaatattaaataattaattttttgtttggttttttatttctaaaacccaaaagttaacgcacaattaattataatataatttaatcaatatttcaaaccaatttgtttcaattatttcaaacaataatcatttggactaaatgatcgaatattattagtaattcagatttgcttttcacatcactttttttcggcgcgctttttccaaaaaacttagcggaagaaagggggaccggcggtgccggtaggcgccgccgggggaaaatttgaaaatttgagtgtagtttgttaacagattttcaacaaaaaaggctggttttgagattattaggctcaatttgtacggaaacccatgggtatacaaaaataaaattcaaaataatttaatttctgtagagggattgaacaagtggaaagaagaaagggatgccggcgaagggccattgtccgcgggacagaccagatcccaaaatcagccaaagcagcccgagcaaaaagcccatctaaagaatttgtggacagcagcaattcatccgccgattccgattaattatttttgccttttatttatttacactttgataattaatttgtgaatttatttaacccggaaaaggatgacaaataaactttcgggtttcactctctcttccccctccccgcgcactgtctttttcattttaagcggggtaacccatgggttacttttgactccctcacattatattccccgtcgatttgttctcagaattcttagggactgtctttaacgttgcgctttgggtggcagatgcaaattaaacatccgcttttggcggtgttcggcagcgctcaatggccccgctgggatcagcttttggcatttcttttcagtggccaataatttttggtgggtctgactgaagatattgttgttcagaagaacgtacgttggactatacgtcacaaaagggcaattgcactttgttaaagccaaattctaaatttggcgctgattcgaagggcaaaagccgtgccgacgcgagccgatgccgcaaaatgaatggaacaaattggtggcggagggacaagtaaacgaaaagagactgaaggaaggcaataaatttgggacaatttgggttgagggcgcattgtttgtccgattgagtgtggcacggcgaacgatttttcggtgggtcactgaaaaaaggcacggcaaacgccaaagaaaggaatggaaatggacggagggagggaattccatcccaaagcaaacaaaccaaactgaaaaggacgcagaatacaaaagcccccccccctcccgccgcccgaagggatggccttaattaagccaatggcactcactcccaattcgcatcaattttaggtaattcaaaagcgaccgacggacaacaaccactg

SEQ ID NO: 4300 - DNA, 1637 bp, Heterodera glycines
atgctatactttttttatttgtcagttagctttagccaatctggcatcatttgaaagctctgtgtgtgctctatatttacatgtaaaaatagaaatgaatgattcaaaaataaaaaaagttatgccacgcggcgccgaaaaagccaagaaaaagttaatttttgaggttttttggccataacttttttgtaaactgacgaaattttttgaaattttacaggctaatagagaatctgaagagctatcgaatgataacaaaaatttttaatttggttgatcaggaaaaaagttgttagcaacggcgcccgaaaaggccggcgccgaaagtgggcggttcccatttatagccctagttatttgatggaaagaaaataaactgttttatttattaaatatgaaaaaataactgattttttgtattgttcattttgatcagccataactcgcttcattccccactaaactgaacaattttgatatgcttcaaaagatattgaaaaggagaaactttataagcaaaagctaagcattttgaaaaaatatctgggtgaactgtagtgaaagccccttgaaaaaagggtcaaatgatataccaatcggttcgtctcaaggagctaagcatggaaaaatatgtctcagttgcggaaatacaaaaaaaactggtttttaaacctgttcaaaactcgaaaaattgtgagatttcgcacactaactttttttaaacgatcgaatccccacaaatttgggggaccagagcgtttgggcccccgtttttgggcccccgcgtttgggcccccgtttttgggccccggggtcgtttgggcccccgtttttgggccccggggtcgtttgggccccaacccaaaaatcgaaaaatgtgcttttttaaaaattaagattctaaaaacagcctgagggatccctcgccacttggcataagctaggtttaattaacattcgctcatttttcacaattttacttattccaaatcctattattttttaatagttaaccaatttgatgtacattctgatttggacatttttcagaatggctaacccaattgcaaccaaaaaacaaaaagtaaaattgtcttacaaaggccacctttaacccttcgctaaaatgagttctgatgggatgacaaaattttggagatgagttcaaaaacagcactgacaaatgcaacggccgttcggaaatttggcggttttccaaccgctgattgactggtgtgtgaactttttttttaaatttaaaccccactgaaattacaggctattaatcaattttactgtggtcggacagttgaccatgcattttagttagttttaccattcgctatcgagaatatatatgtattatataggtatattttgataattctacatctagaagttttttttatcttgtatctcatgtgtgtaaattgaaatttgatagtataagataactcaaactacaaccgaaaagaaaaacaatatttttgattgaaaacaccttaaaattaggtaatttttataaattatttatttttgctgcgacgctatgtaccggcccggcgactttttgaggtgtaccatataatacctaaaaatatccaaatttttattacttgccaacggtgggtcccttt

SEQ ID NO: 4301 - DNA, 6854 bp, Heterodera glycines
tcgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgccccctaaatttgaagctttttagcaattatgttcccatatttagaacctattttggggtttttagaacctgaaaactaattattttggcagtttagcaactaaaatataagccctaataatgaaaatgcttcaaaacgatcacaatttatgaatttttgtccatcaaacatcaatcaaatccacaccatcgtttccgcaatgttgttatatcattggcaacaacaaacagcataaagtatttttttaagggcaaaaggtgtacagatttttacaattgataatgatgatgatatgatggaaaaaacagagaagacaggcccatgtcaattaggtagttttaatgaggcgtttgagattgtttgcacttaaccatccgagaaacaaatcatttcaagagtctcgaacgccaaccaacaaaatttggataggaattagaaatgttgaacacccagcccagaaggaataaagaatacaacgatttaaaacaattttgacaacggttgatggatggatggcctgcattttttggccaaaaattttgtatcggtaaatcaaatttatggagaacaattgaggcccaaaatttgttcgtgacaggttatagtgcgggattaatctcgaaatgccggggttttgcatcccgtaaaatcctcaaattataattccgtcgtcaaaatttaaaaaaatcgaacgggaaattttgaattgacattgaggaaaacagcctggtaaaatactttctgtaaacaacgaaggcacttctatacaacggaggggtcaatgatataaaaaaaaacttgcaaaaaagcgactcgaaccatcgaaacccgaaaaattaaaaaaacaaactgaaaattttcgataaaattttcccactagcccatagagaattgatgtttgtttgcatgttcttcttggtcctattacaccagtcaggagttcaaatttttgtaaaataagacaattaacaaaactttggactccgcctaaatcgtagaagtgccggaaaaaagaaataattaaatttctgttggtgatttgttaggaaattgtgaaacaaatggatggaaatgaatggacagagagaacgaaagagtagaagttaaagggaagtcaaccaattatcggtcatcatcatcatttgttcatttaaatgtgtatccagtccaaatttcccgccaaacaatgcgccaatgacaacaccaagaaaaaaagaaacactcgtccgtccgtcagtcaaaatgccaaacacacacatataatcacactgtgatcagaagcccaacttcacgtatcggatgatctgagatggattggggagatttagagggattatggaaatggaaatgatttttcaaaatggatttttgtgggtttattgcacttttacgcgtccaatctgctgaccagcctcaattttttaggccataacttttttcttatttgaacaatgtccatattcttggtatcaaatgaaagctttaagcctcggaagtttaaaaacttacataagaaaaaatacagtggagaaaaaaataaattcagttttttcggcgattaaattcaagcatttttttatttgtttaaaccatttgttttagcttagaatttatcatatagattttaagctttcgtttgatgccaagaatacagacattgattaattttatggcataagaaactgggcctggtcattgattgggcgcctaaagtgccatagcgccgggttttctataaaagggctaatgaaatttgaattttccaaaattgcaaaagatccttttttcgcaattttttccaaaatgattcaaataacctcaaacactgctgagccacaaacgacgaacacctgcaaaaaaatcgacagttagaaatgataaaaaaattagacaatttacaccttttgagagcttttaggtgcccatttaagctctcactgtcttatttttggttcattttttcccaaaatttgccctccaataaagcacaaagtctgttttggcaagaaaacccggaaaaaactgacgaaaatgccgatcagccatggcgcggccgggtactgattttccttgggcttcaatgacttggccacctgaccgcgggccaccacatttttgctgaagtgttggttggccacactcatcctttgtttgggcgccatttctttcaattcttacgtgggggttatttaatgggttggattaaataaaccgatatttacctgaaaaggataaaggaaaaatgggaatgaaaagataattaaaaaataaattcggtttgaatttcaacaacaaaagaaacaatgagaaaacggaattaataaagtcttatttgccctaatgagaaaaaaacaatgaagagcaaagcaaggaaagtggaagaaaatttaaaaaaggtcaatttcggatggatgaaaattttatgaatttttgaaaaattcaatttttaggtctgttacagtttatgagtccaaatgcaattttttgcaaaatgtcattggactaatctttggtcattaatgtttcaaagagcaaaagcacccaaaataattttgcaaaattcggaaaaaattttcaaaccgaaatccgccggtgataaaacaataggcaaagcatgaactacacttattaacacggactcgaaaaatagaaaaaaaattgctatttggaatgtctgatcacagctgctgttgctgctggttatgaacgttctgcaacagatgcaaagtgccaaaagtgagctgcgaattgatgaacggaatgtagaaggcacgatggatgggatgtgattgggcgggaagcaaaatttgtctctgatcaatcgatcggaacattgccttaaggggaaatgggaaacattaaatattggttgagataatttgcacataaaatactaagtgtaagagcatttaaattgaatgattgggcgtgattaatattaaaaaaaacagaaataatcacacctattgactattaattacctaattagtcaaagggggcaattatgaggggataaatttaaataaagatgaaaaagagcgggggaagcaaatccataaaaccattgaatgaatgaatgtgtgtattttaatatatggatgaatgaatgcatatgaaatagagaactctgactgaaagaaaaaagccacaaaaatttgcgacgtggaataaatgggaaagggggagggaagataatgtcgcagtaattgaatgtttaggggctggaaagcaattagttattttattaatgatggctggcgattgctgggtgtgtgactgattttctctttatctctcttctctctctacatatttgtgcagcaccgcacgacaagcagcaaaaattaaaaaaacaacgactaattaagccccagtcagtcagtaattagctaattagtgatcaattagaagcaataagtgatcaaagaaggcaaacgggaaaccttcactctttaatgcttgtaacaccctcttctgctgttgtgtgtacacagcaacaaataaaacaccaaagttccaacacagcagtgcgacgacagcagacaattcaaaattgtcgttagcaaaatgtttcttggcgaaatgcttttgaatttaaaattcttgaagttttcaaattgaaaatttcttttcctctagatttcattctcaattaaagttttcttatgtcaaattgttaaaacactaaaaacttttttgtattcagttcaaattaaaagttcctttttttatgtataaattttgaaaaataagccactttccataaaaagggaattaaatggttttacatacctagattagagtgttcgaacccgtacgttcaaacacgaaaattaaaccaacgagacattttcagccctgcctgatagattaaaaattattcttcactccatttgtaaaagtgctaaaaaagaaattaccacacaatttatacattttcaagcaccactgttttttaaagataaatttcaaatttaagtgttgtccccgaacaaatgttgaatcccattccgtcaatgaccaacagagccgaatatttgttccgcttttttgaaagtatgccagaaaaagagcttcgcgaagaattgcgcaaggctccattataccaagggtattgaagcaaaaaacaaaaaaaaaaattttttttaattcagtggcacaaggaagcaaatgctcaaacggctgagggatcatcaccgaaaagagctgatagagcacaggaagaaaaaccaccgcaattttctcactgaaaatctctacgactatctgattgtaggtaaaataggaagatttttcgattcaaaattggcaaaaaaaatttttttttgaaaatttcagaaaaatgcaaaaagtcaccgaaacccaatttttaggtgatcgactttgagtgcacttgcgaggcgggcaaatacgaatatgacaatgagatcatcgaattcccagctgtgcttgtcagtgttaagggcaggaaaattgtaaatttgaaaaaaaaaatttttcaaaaaataaaaaattttagattgacacttttcatgcggtgatccgtccaaagatgaacccaaaattgactgaatattgcaccaaacttacaggttataatgttatttttttatatgatttccgtttcttgactaaagagtcggccaggccaaaaaatcgcaaaaaaaaaaaaaaaaattgaattttcagggtttgtaaatttttttcatttcctcacaggtataacccaacaaatggtggacgaagcgtgcacctttcccgaggtgcttgacatgttccgggattggatggccaaacacgggctggacgggctccacagagtggggggaagttgccgccgcttttgctacatcacggacgggttggtaaacaaaaaccagggtcgggttcagggacgcatcacggggggaggggaaatagtattttgtgctgaaaatttttttattggtaccccctccaagacctcaattcacccaattttctaaaataaaaaaaaatccacaaattaccaatcttttagtgaaaatcttaaaaaaaattttttttttcccgcggtgccaaacccctccttttcttctaaaattaaaaaaggctcgccgtaaaaacaaaaaatgttatttaatagccaaaaaatgtgaaaatgtttcaagtttaaattgtaataggggggggggggtgacaaattatgtaaaaaaaaattttcttgtatttgatagtgtgttttccaggccttgggacattggcaagtttttgcagtcggactgcctgcgctgggccatgccgttgccgcacgacttccgcagctttgtgaacctgcgccgtgcgttcgtcaacttttattgccacgcgcggcccggccagccgaagccggcacgtctgcccagcgcggagttgagcgaaatgctcaagcggttggacatgcaatttgtgggccgtgagcactgtggcatggacgacacggtaatatcataataggatgtacgggacaaccattggcaccaaaaaatcggattgggttgaaaaaatgttcttaaaaattcaaatccggggccctaaatttagcctaaatgtgggaaaactgaaattcaagggaagaaaatggaaaaaaattaaattgataccaaaacaacaattttcagattaacattgcccgaattgtgatccaaatgctgaatgaccatgccgaattgagggtatattaaaaaaagtatttgttacattattttttttaatttttttaggtgaatgagaagttggtgaacggtgctctacttttgccatgggtagaattttaacaaataaattttaaaaaaatttatgaatgcatttgttggcatatcccccccccccttaataaaaatttcgttagtttctctcacggcactcaagttttggtggtaaaatacatttggaaaagattttcggtgccaaggaacaaccaagaaatagtgtgccaaaaaactcatttttctgttttagaaattaacaaaattaaatttttagtcacccttaaaaatgtatggcatttcactttcaccaacaacaacaaaaaaaaaatttgtaccatattttccctcaaattttcagcatcagaaacagttgattttcacggaccaaatgtgggaaaagcggcagaaaaacggcaccaccaccaataataaccaaagcaaagcggcgccttcgcccccactggccgcgttggaagcgtcgcacgcggcgaccatgtcctttctggactcattcggctcgtccacctccgcctcgtcgtcagcggaggacatcatttgcgcgggcatggcacggatgggctttcgggatgtggacgatgacggatatgaggaggaggaagcagcggcggtgaatggtggcggtggcaccagcccgatgaatggtggtggcaacaacaaattggcgacagcgacgacgacggcaaaactcttccaaaatggcatcaccaccaacaccaatggcaaaaagggcggcgacgacgacgacgatgggcaggaggaggaggcgaatgacggcgacaccaccatcaccgcgcatggaaatggtgggtgtgtggaacagcaaaggggttgggtgcgcaattacggcgggggccagc

SEQ ID NO: 4302 - DNA, 1977 bp, Heterodera glycines
tcatctgggctgatcgggcttttataattattaattttgagagttacaaaccggtcccaaatcgttcaatttttgttttgtttttctcgccaaacatgctttaatatactcacattgctctctcctccatcattttcttccaaaagacatttatttattcgcccgtttcttcatatgactcttttttgattgctagaaaattttgtttttcaatttatttattctctcttgacttccgtcgggtccatatttcttgctcacaacaacagctctagagcccggaaaagcgggatttgtgttcggtactgacaatgaatgagtcgagattttcgacttacctatttctaagaattctcatataaaattttgaaaaatatctcacttagtctgtccgggctctactcacaatcacaaaaaaccaattctgactgactacacttatacttatttttcttccaagtttttggtgcaattcacttttacgattctcttcattggacagctttataaagcaaacaacaattcacattacacaacatacacacactattatagccactcaaaatgttaaacggtgcaaatttatttgttataccggcaaattgttgatgaataaaatttatttatttacttaattttaataaaaatatgaattttgggtgggtttaataaatttaaaaataaaaaaacactgggaatttggggatcacttaccatttttgcgtagttcggctccagctcggtctcctgtccgtcctccagatggaccaagaaatcgcaactttcaaccggcacatatctgaattatgtataattaattatatggtaaattgttgaaattgaaatccgccgggcgtacccaattctcccgggtgtaaatccctaaaaataaaatttccaattaccggtccatttcttcccgattcgcgtcattcatccgtcccagcggtgcgtgtgccgtgctgtgccgaagtgtggacgacgtgccgtcgtcagcgctacccgcaaaatgggcgggcaaaatgccgcggaattcgctgcgcacaaattccatttcgactgctgggcgctggcgtggtttgccaccactcgtgccactgttatttgtgccgttgtcgtcgatgataatggcggcactttcaggcagaaaaaaggaggacggaaatcggtgccattctttgccaacgcacagtcgaattgggtcctcaatttttttttaatttttaaaaaaattttttttttcttacccgcatttcggcataatctagcaattgttgccgctgcagaatctgctcattaaaggccctgaaaaggggaaaacattgtgtgacatttatatttcgggcatttatgcaagggatatggggtgacgtcctcaaaaaattacggcattcgaaatggaaattctgatggctcaaaaaatttcggaaaccggtatctcgatggctgaagtttcggcaaccgaaattatgaaatttccactccggacctgtacgtgtccatcagtccggcatagttgcgccgaactgccgcaatgcgtgacacactgaacagcacgaagagcgcggcgaccagcgcacacagtgcggttccaatgccaaactgctgttgttgttgttgaccacgacggatggtggcaccaccggcggggcggcgaacagaggaggacgaagacgaggacggcacagcagcggcagcaatgccatcgtcccgattggaaaagctggcttggcacagtcgtcgtagcaggtcaaagcctagagcggccagcacacaaatgtgcgggtagacggggaacagaaagcgttcctggcacggcacaaaagaggaggtgttgaggattttcattaatttttttggaatttttattgaaaattttaatttcaaggataaattgacaactttcatttaatttatttggattttttgtcgaaaatataaacagtgtttcgaaatttttttaattattaaaaatat

SEQ ID NO: 4303 - DNA, 1758 bp, Heterodera glycines
  misc_feature (15)..(16): n is a, c, g, or t
  misc_feature (122)..(122): n is a, c, g, or t
  misc_feature (125)..(125): n is a, c, g, or t
attcaataattattnntttttggaagaatgaaaaatctcctctaccagagaattttttagattaaacataagacgaaataacttttttaaatttatttattttaaatgagttcatttacagnttngaagaaaaatcaaatgatttactatttgcaagaggaaactttaaattattatttatttgtttaatttattttattttattgtttttattttaaaatttctatcagaaatttttcagttaaaacataaaaaccaaaataatattattttaaaatttatattattttgtatgggttcaattattattttaatggaaaattttacttattcgtaagaggaaaactttaaaatatttatttgttaaattattatttaattgattttgttttttaattatttctttaagaaattgttcgcccccttctcggtaatttccggtgaggagctgaacttggctgccaataagctgatgcaacagaatattggcactttgatggtccatcttcaacccatgcaaatacgcacttttcgtcttcaaattgaggcaaaagcagcagcgcaataaatgccgaaaaatattttggcaaaaatctcattttatgcaaaataatgaaaataaattgtaaaatgaattttaaaaaaggaaaataaatatgcgacacgagacacgagaaaaattttctttaatttagaaacaaaaattaaaacaaaatctatcttaaaatttaaaaaatcaacaattaattgaaaccaatttattttcaaataaattaaaaaaaagaaaaaccaatttatttaaattttaaagttttcaggattccttattttgttttttagcagagttattgttttttgaatatgacccccaaatggatataaatgagcgcattttgtttcagaaaaattggtcgatttttaagaaattgcttgttaaatatgagtgccaatgtgggggaaatggcattttacgcacattttttggtccacgttacaatttgtcaaaaatggcacttcaagaattgggctggtgaagttttaatatatccgccgatatggcacccagtgactattacttgtttgagtcctcatcaaatgcccttgcaggcaaaaaactcgaaaatgccaaggcattcaaaaattggcttgattaaattcacacatttattgacaggtttttacaatttttggcaattaataatatataaagcaaacgtaacgataatgacttggattttgttttaaagactttaatttagtcgtaaaattatttacaatattataattttaaatactttattattgcatcattagaataaaaaatagcaaatcacaaaatacaattttctgtttagataaaagtttttttccggagagctcagatgaatattttttaatattttgtagtttgttttatatagaaaaaggcagttttttcatgtataaataaatgaataaataatggccatcaacaatcaaaaaaagaattttatatttttttaaaataattttaagaatattttggaaaatgaatatgttattaatattctattttattttaattgcaattttcctatttaatccatgtgaatcgaaaaataaaaaattattcggctgttaaaagtaagacccggggcggggaacgggatcccgcacgggattttgcgggatcccagtccgcaatcccgcattttctggaaaatgcgggatttgcgtgagtagtcccgcgggatcccgtcccgcaatactatcccgcag

SEQ ID NO: 4304 - DNA, 6897 bp, Heterodera glycines
aataaaaataaattttgaaattcaaaaccataaggggacaaaaaagagaactgaaatcattagcatattaatctagattttttttttgtttttttttgtcatcacaacaatgggagggattacgaaaatttttaaaattaaaagttgtcaaaaaaactcaaattaattaatttttgtttcggcttagaaacaaaatggatacaaaaagaacaaataaatttgttaactcaaatatcaaacaaaaagcatcgctttcgtcctcacacaaatcgatcttttaaatttccataatattcggctgttaaaagtccgggttaatttcaaaattgtttgtcccgttaagcaatgaaaatcaaaactaattttattagccgtttctttggtttaccgtgcttactaattagtaccccccggggcttctatttttcaacccccctcgagaggggtattctaatttagagggggggggggggtactaattcagtaaatacggtatattgattatgaacatttcaccgcaacatgtagaaaccgtaattttgaaaaatacggactcggaccaggacctgaatatccgagttcgctggcaccggcctggcttagaacaaagcccggcgggcatatttcaacttcgagaaacaaattccgacaaagtcaattgaaaatggaatgaattttcaaacttgttctgattttcacatttgtcctgagaaaatgaataaaatgacgattttttttgttattataattaatgtaaaatatttctgttttggatgaaaaatttgttaataaatgtcctgattttttatgtttgtactgacttttttataatcgatccaagcaataaattctcatttcttcatttaataaagataaaatttcctttttttttgaattgtaaattattactaatatttattgccaattgaaaatgaaattctgtattttattatttttatttttgattgccctaattattccaattgaatcagaaaagaaaaaacttcagcagaaatcatttgatgaaatatttggagaaaaatgggaagaaaaagaagataaaagggaaataattgaaaaatattataaaataaaagagaaaattaagcaaaaagggagaaaatattcaacaaatgaatggagaaaaattgaaggaaaaatagcgaaaaaattggggacaaatcgccaatatatttataaatggattaaagaatttggtcttcaaaaatgcaaatcttacaaatcaaaaactgatgaaggaaaaatagaaattgtactaaaattcattgaaatgacaaaagaatataagcaaaaaagtaaatattcacaaaaggaatggaaccaaaattatgccgaaatttgtaagaaaattggagttagcaaaactacaataataaaatggaagaaacaatttggcattagcaagaaaataataacgaaggaagaaaaaatagaaaaaatgaaaatatattgggaaataaaaaaagaaaatccgaaaatgagtgataatgaaattgctaaaattgtgaacacttcaaatgcgaatatttgtaattggaagaaacaatttggagaagaaaattttgaaagattgaattgatgcttctaaaaattcgataaatttgaccaaaaattttaaattgaacaaactaagacaaataatctttcgcttaattatttaattttattcgtaaatgatttttatttaaattctgtcataaactgttgctttatttcaaagaaaaaaaactgttgaaattttaaaaattgtaatttacaagaaattataaattttttaattttttgaaacaaatcaagtagcaaagataggccagatttaaggccatattgtcatattcggattcttctggtcttgttcagaagaacaatttgagaagtcgcttttgttgtatcagttttcatttttgacgattaaaattttgagaaaattagtggccaattaccaattttggcatggtcgtaaaaaaattgaaaatggttttcgcgggacaaaaaatatgttacaacctaagtatttttagcagaataattctgtgttcatggttttaaacaaaaaaagtaggatttgaaggattggaccaacaaattttcgaacaaaaaaacaacaaaaataataattcaattcaaaaaccaaatttcgcagaattcgtttctcagtcttggagcaattcagtcaactggtcaaataagcgacagtctttgagcaatttcaacagcttttttgtaaacttgctttttattgaagtctcagtctttgagcaaccttcaaaacgtcggcggcttatttgcttcaagcgataacagtgagcatcccaagagccaggagcgccatgtaatataaaatcagctttatattgatgaaccctaacttaatccttaacaactttacactttaattcaaataaaaacaaagcgcaataaaagtagtccgaaacaacaaaaataataattatagcagacaaacacacaaaaagataatgacgaactcacaacaaatgaatgaatgcatgagggaaggggataagtcagtcccaaatcaataagacaaaagtagagaaaaatagacatacacacaaacaaaatgccaactaataataattataaattaaatcatataataacacatccacgcccactgtcaagaggtgatgttgtctggaattcagcacactgccattgttttgaaatccgcgttacaatggtcggccaccagcacaatcaactaaaattacttacaaaattataaattttaaactttattattatgataattttattaaaaaatagcaaaacacaaaatacaatttctgttcagataaaatgttttttccggagagctcagatgaatattttttaatattttgtagtttgatttatatagaaaatagcagttttttcatgtataaataaatggccatcagtaaagaatttgtattttttaaaaataattttgagaatttttggaaaatgaaaatattattaatattctattttatttttatttccatttttctatttaatccaagtgaatcggaaaataaaaaattgtaacaacaaaagtcgttttacgaaatatttggagaaaaatgggaagaaaaagaagaaaaacaacgaaatgagcagaacaaaagagaaataattcaaaaattctataaaataaaagagaaaataaaggaaaagggaagaaaatattcaaaaaaagaatggaataaaataaattaaaaaatagcgaaaaagttggggacaaatagtaattatatttataaatggatcaaagaatttggtcttcaaaaatgcaaatcttacaaatcaaaaactgatgaacaaaagttagaaattgtgcaaaaatttattgaaatgacaaatgaatataagcaaaaaagaaaatattcgccaaaagaatggcaccaaaattatgccgaaatttgcaagaaaattggagttaatctttcaataattgaaaaatggaagaaacaatttggaattagcaagaaaagaatagcggagtaagaaaaaattgaaaaaaattaaaatttattggcaaattaaaagtgaaaatccaaaaatgagtgacaaagaaattgctaaaatattgaaaatccaccaaaataccattataagatggaagaagcaatttgtagaagaaaattttggaggattgaattgatgcttctaaaaattggataaatttaaccaaacattttaaattctttaaatagagactaataatctttcgcttaactatttagttttattcgtaagtgatttccattttaagttcagtcataaactgttgctttatttcaaagaaaaaaattgttggaattttaaaaattgtaatttacaaactgaacaattataaattttattattttttgaaacaaatcaagtagcaaagataagccagatttaaggccatattcggattctactgctctaaacttttcagaagaataatttagaagtcggttttgttttatcaggtttcattaatcaataaaatacaatcctgtcgatacataagaatattaaataccacacattctccatcgcttttttctctttctttgttattctctctttctctcggtctcttttcttccctttcgcacgctcccttcctcaactataatcccggatgtctacagtaattcaagaaattgattttattaagaataatttaacaaaaaattggaaaatagccgggaatatacttaaacgatcaaataatcttgaaatctttgcaaataaactttttaaaggtgtgaaaactttctacataacaacatttagtgcacctggaatcgaaaacttatatttttcattcttagaaatgctcaaaaaaattcaaaaattacccggtcttattatgggtgaatataggaaacaggccttagctatgcggaaactagaaattggcatcaaagaaacagatatatttaaatgtcaagaagcagagaatatatcggacctttgtttttcaaagataaatgaattcgaaaaacaagtgcaaaattatcggtttaacatgagaatgttatacaataaaattagaataacagcagtaaagcatttgtttaaacccgaaaaagaaatattttttagtccttttagaatagaaagaaatagagaaatattttattctatatctaaatatatttaataaaaattcaatcttacaaaatcaaataattgcgactaattaaattatagctcgcatagttttgtgtaatatttgagcgctactcgtgcaaaaaaaaaggggttaagcgcgctgcgaagggcacaacactctcccacaatggggagggagggggcgaccgccggcgcgcgctgcgaagggcacaatgtgagggtaaaatttaccaccacatttggtgcctgatactactaaccagaattattgtacagtttggagattattttgcttcagttcgaattagactagattttgctatcacatttgctcataagaacatgaaaaatggtgttaggtatttacaaattcaagtcaatctttgcatttacgataccgtcaaaaattacaaaatgaaaaaatgccacattgggaaaatatgaccaaatattgttgtataatcttataataaatctcataaaattatgtaccgaacatataccgccggacatattgcctcaaaaaaccaaaattaataaaaacaatttcttgttggatttatatgggaaaacaaatttgatcggaatttttatttctttatcgcgttaaatagcctggatcattcttttttcgacgaagtttcttctcaaaactgttttttccatcttataatgctattttcaaatttttttcaaaaaattttctcttgggaaaattcccggttggtcccggtcccggcttatttgttctccaaattgtttcttccaattgaaaatgctctttagatgaatttcaatatttttgcaattttattatcacttatttttggattttcactttttatttgccaataaattttcattttttctattttttgttcctccgttattcttttacagcgaattccaaattgtttcttccatttgttaattatgtctcggccgactccaattttcttacaaatttcgacataattttgtttccattcttttcaacatttttcggcgctaaaatttcatttttggccattttacaccaattttctgatataatgaaatttcataaaatctctttaatttttctaaaatctctttacattgtgaatttattttatttttattgaaaatatgtttattattttcgaatgagctccagtagaaagtaataaaattttattaatcattaatttaccaattggcaattattttgtcattaagataaaattattattattatttctttgaaattaaacaggatttccttattttattaagtaaaataatgatttattcagttttttaatcagaaaaaaatcatttaaatgcctcaaaaaatgaattgccatttaattgaagaaaaataaaacaaaattatttcgagacgacaaaaatgaaattatttccgttactattattaattattttatttttaattgtcaaaattggatcagaaaagaaaaaattgcaacaaaagtcatttggcgaaatatttggagaaaaatggcatgaaaaagaagaagaaaaacgaaatgaactcaaaaaaagagaaataattgcaaaattcaacaaaataaaagagaaaataaagcaaaaaggaagaaaatactcaacaaaagaatgggataaaattaactcaaaaatagcgaagaaattggggacaaatcgaaacaaaatttatgaatggattaaagaatttggtcttcaaaaatgcaaatcttacaaatcaaaaactgatgaagaaaaatttaaaattgtgcaggaatttattgaaatgacagaagaatataagcaaaaaagtaaatattcactaaaagaatggcacgaaaattatgccgaaatttgtaagaaaattggagttagccatggaacaatttacaaatggaagaaacattttggcattcgcagtaaaataacggagaaagaaaaaatgggaaaaattaaaaagtattgggaaataaaaaaagaaaacccaaaaatgagtgacaaggaaattgcaaaaatgatgaaaattaatagaacgaacatttcaaaatggaagaaactgtttggataaaagaatcgttgaagattgataggatgattataagaaaaattggataaatttgccgaaaaaattatcagaaaaactatgacaatttctagtttttttttcaaattttttgtatttgtattaaaaaaattattttaaataccctaaattttgaaatttttctaagtgcaaataagtgaaaacagtcaatt

SEQ ID NO: 4305 - DNA, 5253 bp, Heterodera glycines
gatattttgaactttttcgcattttttgtacatattttgcaatttttgaggattttttaaggaaaatttttttagatgccccaaaaaaaaaatcataaattttgcaatttttcgtgcacattttcatttttttcatatttgagaatttataggaattttttatgaaatttagaaatttttttttgaaaaaaacagatacccaaaaattaatatttaaggtactaaaatgtgatcttaagcctatttttgtcaaactttgttcaaacttgaagaagtttttttttgaaattttgtaggatattagaaaacatttaggactattgtatcaaagaaattaaaatttagttgctctgagcaaaattatatgcagtttttgttagaaatttgtttttgttgattttttaaaacgtcccttttttggctttttaaaacgctttttttgcaccctttttcaattttaccttttgccatgaccttccgcagttgtaagaatacaatacaacgaaagcatattggcccatcgtttgttggatgggaaacgcggcattgaaattggcgcttccatgcacaacccattcgggctggacacgctgaacattgattacaacgatgacccattggcacatttccaagtgcatcaaataaacatttcgggtaagtaaaattattaaattaataaaaatatttagtaaaatataattgtgccaaaaatagtgtcggtattttggtttggatttttcaatcaaaaataaataaatcgaaaaatttttcaccacataattcggatgaatttgtttattttaacaaagtgcaaattaaaccttttctgaaatagaaggcattttttaaatgatttcaggaagtgcagcaaaagtgcatataattgctcccggagacaaactcccattcgcaaataactccgtcgattttgtgatcaattcgcacgtgttcgaacatttttatgacccaatcagaaccattgaggaatggcttagggttgtgaagccaggtcattcaaatatacaatgtttttttaatatttttaaattgaaaaatgaaatttttaataaatataaacattaatttccagtgataattttttttatgtaaatacatgtttttttcctggattctctatagcctaattagtagaaaacactttcttttttgtgtttgcgaacaaaagttgggacttttatttacatattttcggaattttctacatattacatatgtacatatttttatacatattttggactttttagtacatatttcgcaattttttcgtacatattttgggaatttttgagaatttataaaaaaaattatttgaaaatgtgcccctaaaaaatcggtttttttccaaaaatcagatgtcattaattttttaaatacttaaaagtgattctaagcctattttggtccttttaacggcattttatgattagttcactttttacgaggaatttttttttccaaaaaaagcattaaaaaattttttatttacattttttagtacataatttggaggttttaattagagaccggaaatttcaaatttgcggatgccgctgcgggattggtactgaaaatttttgcgggacgggatcccgcaggtttaaatcccgcatttcccaaaaaatgcgggattgggattgggaaaccgcaaaatcccgcgcgggatcccgtcccgcgccggtctttagttttaatacatattttagcattttttatacataatttatttacatatttcgcgatttttcttacataaaaaatgatccctattaattactataataaatacaaaatattttttgtttgcaggaggattcgtgtacatggacattccacataaagaacgggtggtttatatatttataattaattatgggtattgacataatagagaaatggacagctgttttaaataattggtgattaaattctggaaaacctcgggtttttactttttcaaaaatttggttcgaagtgaaaaaatgatagcatttattttaataaaaatgaaaattcccccggcggctcctatcgaatcgtccaatcttcaagtttttctctcggatcaagtgaattaaaaagaattagagaactttttaaaaatttttctgaagttcgtttgccagtttgttccctgaaatcataaaagatgaactaaaaacctttctaaatctgctttcactaaacgttttttgcacagatttttgaccggaaacggaatcgaacaacattggccgaactgctcgatcggcacgaaaaccctgtgccaggcgatgacattcagaaccaccaccaatctgtgtggatcacagaggatttgttagaattgtgccggcatttcaattggacggtggcagaatggcgcgactcggatgacaagcttggcatcggtttcaccattgtgatcaaaaagacatgattagatgaaatactgacaaaattttgtacaacatagcgaaaatattccaattaaccgtgaaagctaaattaaatatttagtcaaaatgtaatttaaaaatttaacattttacttaaatgcgtaagattcatcaaattctaaaataaagacggcacaagcaaaaaatatgattttagcctaagaaataaggacattttgaatttttacgatttcaaattttgaacaaaaaatggcagttttatgaaatagtagatctcgtattttgaaaaaaaaaaacttggacctgggttccattttattttttggcgtgacttttacaaaaataaaaaagtatggatgtgggaataatgggataatggctagggatgtcaaaaatatgtacaaaaagtggtcaagatatgtacataaatatgtaaaaaaaaatcccgaaatatgtaagaaaaacccaaaatatgtaccaaatatgtaaataaaaaattttggattttttttttgagaatttccaaaatttctgtaaaaaatccacaaaatatgtaaaaaatgtatgaaaaagtccgaaaaagtccaaaatatgtaccaaatatgtataaaaccccgaaatatgtaaaaatatgtaaataaaagtgcaaacttttgtttgcaaacacaaaaaagaaagtgtttttcctactatttagagcatggagaatccaggaaaaaatatgtatttacataaaattgccatccctaataatggcatagaatgggttatttcagtcccaaaaagcgatttaaataaataaaattatcattttaaaaacaaaaatatttaaaaactatctttagaatgattttataatttatgtgattttaactaacagcaaattttttactatttcaacaaacctcctttaactaaatgccgaaaactgattcggtcttaactcatgcccggcgcagctcatctggcccgactcatccaaggtcactcgctcaaaagccaaaacgctagcctccgttctgaccatttcgatttgtgcctttctgagtggctctgctccagccaacaccacatgcaagccgaaacgtggaaaatgcccgtcgtcccacgcacagagaggtcaggcgccttcgggcgttcaactcctgctgtcctccagaaaatggtctctgcgcgattgatgatcaagtgcccacaagttccacatggttgctggtgtgccaagccggacaagcgcagaacaactcgtaacatgtgaccgacaaattcttcgactcaacggattttgttgaacactgctcatttgtgatccaatggattgtgccctctgacacgaatacaccgacgaaagcgactatgcatgatctcaattcaggaagctcaagaagcacagagaaatatgccggaggatgacagaactgatactgccgcggggagtgtcggcaaagcggtgccgacgaaagataatttgtattaaaataatttataatttattagtcattcaatgtgatctttgaaaattgtgattttattccctcctttgaaacattttgtccatttagcattagtcactagagaccggcgcgggacgggatcccgagcgggattttgcgggatcccagtccgcaatcccgcattttttggaaaatgcgggatttgcgggattaatcccgcgggatcctgtcccgcaaagaattttgagttccaatcccgcagcgggatccgcaaatttgattttttgtgcgggattatgcgggattttattgattttttgaaaatttttctaagacagaatgccaaatatttttaaataaattaaataataaattttattaaagttaactcatttttcatcgcaaatttcattcaaaatttgtgaaattttcccggcggcgcctatcggcaccgccggataggcttttacttaataatcctgtagaaattgagtcaaaaactgcgtcatttggtcaattttagacaaaatctgttaacaaatcgcattaaatttcataaaacttctcgcagatgtcgataggcaccaggtatggcacggaaagacttccgatttccgacatatcttctttttttcactttaaatctcaggtcccggtcccggtagggcaaccgagaaccgggaaaagcaagcactagtaagaattggggtcggagtgtaaaattagtgatgaaaattggaattaaaggaaaaattaaaaaatataattaatatatactttaaaagtaacgcacacaaaaatcgcgctgtaaaaaacgtgtaaatagtcactccttttcccaaaaatgttctaaaataatgaaaaatgacaaaaaaaaattttaataaaataattgaataattttttcaagcgaatatacaaaaaacatttgtgaaataccttttacttggataagaattaaaaaatttagcctattaaaatatttagaaatttttttattatattgtatattttttgaaaactttccgatttcttgcaccgcaaaaaagtggttttgaagaaaaaaatagtcaaatttatgaaccgttaataatttgatttccgatcaactttttaccgtcggatccaatcgaaaaatcttagtcgacccatcagccccttttaatccatcccgccagcccctaaaaatttatttttcagcattttttgatttttggaaattttttgaattaaattgaaattttttcgaattttccaaaattccgcaatcccgcacgggatcccgcaaattttaaatgagggatttgcgggattaatcccgcgggatcccgatccgcaaaaaattttgagttccagtcccgcagcgggatccgcaaatt

SEQ ID NO: 4306 - DNA, 1693 bp, Heterodera glycines
ttgaaaaatgccaaaatatgggacataaaatatggaccaatctactgaaatatggaaatatggacataaatcgcgaaatatggaaaaatatggatatagaaatccttcctagaagcttcaaaccaagctaaaaacatgtttttcgtgcgtttcaggcctcccacagtccaggaaaaaaatatggatttccatataattggactccctagtcatgacgagagaagcccaaaaatagcatttttacaaactatttttgatttagagagacttataaaaacaaaaaaaaacatatttaggaatttgaaaaaatcttaaaaaattgaaaaatacaccctaataatcaatttttgcaatattgattacgaaattccctgctggaacttattcaactgtacatagccgggaccccttcacaaatcattcccaaaattttacgtcacaaattataatttatttgcatttcgccaccgccaaacaggacaatctttttaattttgttttaaaataaacttctaaaagggtgagaccattgaaattaatgaaaaaattttgagaattttcgaccacagctctgaatctgccatttttgccactatttttgctatttttctcccggtttcggcccattttttcgcctcaaaaaatcatgcaaagttttattataaggatgtttctttattaataaagttttaacaataattttcattttttactgatataaatgcaatgcttcagatgccagaagtttaaatgttaattaagtgctttttaaatgttacttttttctcgtgatactaccagaaataaggcaggcgcttcgcgccctcaaaaagggattccttgtttatattttgtcaaaattttcactattcttacattagacacttagaataattaatggctccctgatgtttcgtcactgaacctttcgtcactgaacctttcgtcattaaaataaaattttaaaaaattaaacactatgccatatatttataaaatttttgaactaaaaaacattaaatttgtgctaatggtatgcaatttcatttaacacacatcacgaaaatgagctcttgttaaggtatttggcaaacaaattgaaaatcttggtatcattcgaaagctcttgatgagaacaagctttttctaaggaaatgctaaccgatttaatgattaatgagttagaaaaaagatatgggcgttagaaaatttgttttttgaataaattttcaaccaaaggttgtttgaatccagcaaagagttgttacaaattgttgcgttgcagataactttctattatggccttttcccctaatcccgttgacagtacattatggtaatcggcaacaatgcgccagtgttcaaattccttaaccattcgcttaacaaatgctcttaacactgggttaggtctcaagaagctctccctaattattttgccatccctcaaaatttctcgtcactcacaataacacacttccagtaatcaacttagctaaatatcagaaatgacccacaaataacggcaaaaccccggggggaggttattcccatgatcggaggttcgaatggcaaaaaaatggacaaataataaagtttgtttgtaaaaatatatttcattaaaatatttattttattctcatgaaaaaattttagatttttttggatttttcaggacctggactcggtttaa

SEQ ID NO: 4307 - DNA, 2790 bp, Heterodera glycines
  misc_feature (33)..(33): n is a, c, g, or t
  misc_feature (75)..(75): n is a, c, g, or t
  misc_feature (84)..(84): n is a, c, g, or t
  misc_feature (111)..(111): n is a, c, g, or t
gaaagaccctaaatgtatatttaaatctgaaanaatgagctgatgccaaaattttacaaaaatttttccttattnaagaatttntaatgttctcatcagatatttagaatnttaaaatgttttcaatttaatttatttttaatattgtcatatctaaatctttgatgccgttttctgctcatttgttatttaagcagtaggaataaaatatttctaaaattttaattttcaataaaaatataaattaattttggtcatttgtgactgggaatgatatcaaaaaattaaaaaaaaacaatttcaaaattaaataaaagcaaaacaaagtgacatgtgaaaagataataattcaaaactaaaattaatattaattatcaataaatttaaaataacctatttttcatagaataaattaaaacacaaagaaaaatactaaaatttaacataaaattattaaaatatttataaacacaactctataaaatattaagcaaacatttttaatgtgaataagccatataaaattgaatagaataatttgaattattatatccaattctatatttattacttcggctattattctttcatttatttgacattaaaattagagatcggcattttgagaaaatagggatcaggatcaggattacggactagatacacatacggatttacggacaaaaatctggaaaatccgtactccgtaaaaatccgtatccaggaaaaatacggatccgtatacggatacggattttttaaaaattttttcatattcgaaaacacaactagcaacaaattggcaacaaatggaagtgagggtaaatatttcagtatttgtaattaatttccggaagtgctttgtttaaaaaaattaacatttcggctgtttccgtgcactcagcttttccttcaagtaatttattgaataaacctatttgccaaattagtgaactcatattctaaatttaaatattttatgcaaaaaatagaaaaaataacaatgacattctcttacactttcaattttttaaatataaaaaaaattatttatgttttggcaaaatgactgcaaaaatttaaaaaatttacacatttgtaccttaaaaaacgtcagaaaaaaatccgtaatccgtgtcataatttatacggatcgggatcaggattacggacttgacatcgatacggattacggacttacggattaaaaatccgtaaaatccgtagtccgtaaaaaatccgtatcggccgaaaaaaatacggattacggactacggatccgtaaaaatccgtatacggatcctgtccgtatccgatctctaattatgacaaataaggcagagtgaagtcccaatggaaagcaaatgcaaagaaagaacgaaaaacacaaaatgttttcgcttcaataaaaaatccattttctcattcaaaaaaagcaaaaattttgggacggaaagacattctcaaataatataatagataataatactgcgagggaatgccaaaaggtttctaattttcttcttatcaacctttcattcaaaatccatttttcgcagtgccagtaatttactaattattttgtaaggaatttttcaaaaatgccttaatagggacgataatagggggcgaataccgatgtatggaagcagcacaacgcccgcccaaaaatgaggacaacttttcttccagatggattaactgaagacgaattaatgatcaaattagaatgatggaattatggcttgtgacttcatagttaagcgaaaataaaatttaaacaaaaattggtgggattaaaaattaaaatttaattatagaacataaaacattctgattttttttataaatgctataatatatagctagctagctattaatgatttatatactacaaatgcagctgtcatgacggggacagcagcagacgacggcacaaaaccgtaaaaatttacggcaatttcgaatgaatggcgcctcgatttttctaattatcaaatatactttttgtatggagaaaggaaagtagcaaatcagttacgacggaaaaatttaatttatttgtcaaaaaattaattaaatgtgttttcatattgattgctttaagaattttgcggtaataattaaaattggtggaaaattatttgatgaaacccattaaaatttattgccaattgttttttctaagtcagaaatttttgatgttaaaaattatgaattttagaagtgtttaataatcaaaaaaattttcaggaaacataattagcgaatttccttcctatgaccggattcataagcaaaaaaacatttgaaaaaacgcaaaaaaacgcattaaatttcgtggctaaacgttgcttcctttaaaaattatttataatatcatttatcaacaattttgccgaatattttttaactttttaattgataaaatgaaaatgttcataaaaattattttttccttggccatttttgtcaaaattggtaaaaacaaattaaaaaaaaaattttattttcaattttaaatttacagcttatgccgctccaataaataagcaaagcgaatcatcattaagcaatggagctacgggaaagcagctaatacgaggtgagaatttttcaaatttatttaatgtaaaaaatttttgtttttcgacgaaattccgccaaaattacgcattttgatcatcacatggcgggaatcgttcaccgaatcgcattatttattgcatagaaaattggctgaattgctcgcatccgatgaacaaaatgtggaaaaagtggtaattcaaa

SEQ ID NO: 4308 - DNA, 6475 bp, Heterodera glycines
  misc_feature (1413)..(1413): n is a, c, g, or t
attttgaaaaatgtattattttacaatttatccaatcaatatttatcaaatatattttttctacctctcattttttattttaaaaagatttttttgcggcgcatttttcaaaaaagcatctttcattttttattttaaaacatattataaaaattaaattttttggccgatccttttatttaaagctgtccttttaaacggtattttactgtatgtattcttttaaacggtattttactgtacgtattcttttaaacggtattttactgtatttatttaatgaccgtatgacgaaggtgtcttatttactttcatttaggtcatttaggtcaggaaacagtctgcagtggcccatttgggaacaggacattgctcatttttttttgccaaatgccaacaatgctatctctttacaacttggtaatgccaaaaaaagtgataaagttgctgttataattagggaaaagaaaacattaaaaatgatttgtttattcgttttccctaaatttggagaaaaaaaagctaaccctaatgccaagaagcttcatttataaaactaatcaaattgcaaaaaaaaaactaataaggaccaaactttttatgattagattttaattgaattttttaaatttaaaaggaattggtggaaagtgcggaaaaattatttttatgcttgttaatagattttgcaaaaaaaatgaatgatttttttttgagtttttttagtaaaacaaataaagaggttaggtaatgcggtgccaggaagaaaatttgggttttttttaattcgggtaattttaacttgaatttttgcagactttttgacaaattgtcacggccttatccaacagttgcttgccttccaattcaatgttggcattatggaaacagttgcatgggacctttcgttgagcatttttcgcgcattgcccacaatcaaaaaatttggcatttcacaaagcgcaacaccgacaatagcgcaatggcacattttgggttatgaaaaaattgttggcgcaatgccaggtgaattaatttggcgtttttttaaatttcggcacctaaaacatttttcattaccaaaatttcgaaaatttccatcttttcttcattaaaaaaatctttagctaaattaaatttaaaaattaattgacattttgaaaaaattttttgggtaattaattaagaatatgttttcttactaagaaaagttttaccgaatttttggtcagaaaaatatataagtcgaataatttcattagcacctcaatttgcccaaataaaaaaatcttttgaataaaataggaaaagatttggcacgaattggtgaccacaaatttgcaactgaaaatgccatcaaagtaaacccgaattattttcgtgaacgcaatgtgaattcgtatataaagctanatgaacaggcaataaaaacagtggtaatttatttttatccttggattttatgggctttgcatcttggacttttcaataaaattcatcaaataatgtgtgatttttggataaatatttttaataaagtaattataatttttaaataattttttatggtatcgaaaatttaaaatttattagcattttcttgaaaattatttttttcaaaaatgccgtttttataatatcataaaatgaacacattttaatcaatttttaattgataaaatatattttaagtactcattttaaatatgtatgctttatttttacaaaaataaaaaattaattgaatttttttttaaattttaggaagaaaagtttttggaagcaattcgccaagaaaaactctcacgaaaaatttttgaggatattcttattcaagaaaatttttctgaatgggaatttaaacatcggatggattttttcataacaaatactcaaccttttctcgattttccaattgttgagcaagaaattgcaaaagaacgatcaattaaacagaaaaatcgtattatttttattggcggaatcacaatgccaaagaatggggcattgccaagtttgagtgaggtaatctcggaaaatcttgtcaaatagtttgaacaacaacctaagaattcataaaaaattaaaagataattggaaaatggattttttggtttcttgaaattgagaaaatggttcctaaattaattgctaaatacattcaaaaaatccaaatagggggaaaaggtaaaaataaaatttccgaaattctctctgatcgaatctgtaaaaatttcaaagtacgcaataccataggcgttgtcggcgaaaatttttgacttttctccagtttttttatcaaatttattaaattgcgggaattggtaaaaaaataggtgcaaaaactctgtaaatttttttaaatattttttttttgagcgtttaatgcaaatcattcacagagttttacacaacaatttcaaaatatttacaattaaaaaaatatttggttcgacggtgccgacagggccctagaaatttttgaaattttcgcttaattattgcaggataacaaacaaatatttgaatctgcgcgcaataaaaatggtggcgttgtgttgctcagttttggctccgtggttccgatgcatgatgacgatgcacatgcagtcgcattcaaaaacattgtggtcaacctgttctccaagcagtacccgcagatgaacatgatcatcaaatggggcgaacggccaccaattggcatgggcgaccaatacaaaaaaatgtcggaaaatatttatgccaaggcttggcttgaacaatcggcaattcttggtattgccaaaatggcatcttgaacaaaatttattaaaaagattttttttttaaatatacaaaaaaaaattttaaaccagctttttcaaaaatatgcaaaaaaaaaattaattcgccaaagatgctttttggcgcctcattatcccaaatcacttttaatgacccataattttttaagtaaactttaaattttacagtcatgtaaaaattaattgtttataatccacagattgtttatttaatataaatttttaaaatttaaaggtaatatgccgaaattgttcattacgcatggcggacaaaacagtataaatgaggcagtgaaatttggcgtgccgcttcttttattcccattttttgccgatcagtttaacaatgccgaagcaatggcggcacgaggggtggcaaaagtgcttggtaaatttataataaaaattatttaaaagatctaaattcgaaatttaagacattcgttccaaaacattggaaaatgagttggctgaagcgctgaatgaaatattcgcaaattattcaatgtacaaacaaaaaattgaagaattgagcaacaagctgagttcaattgatatagctaaagaatttttgggcgcatttcgccaactacgaaaaactctttgacaagaaaatagaagcaaaatttcttgaaaacaattatatttcttagattgaaaaacaaaatttcttgtaatccactatatatctaagattgttcgctagcttatcattattatgttgtaatttgccttacattttctattcatattcataatccaaaataaaaagcaaaacaaatatgaagaaattgactcttaatgatactatttgttgtcgattagaaaaactcaattttaattttgtttttttaaatatattagaaaaatatttaaataatttatttttatattgtttaaatttttttatatattaaaatatttttcattttgtattgtttgataaaaaaaatagttataaaaaattattataaactattttttatggattttataaaatccaataaattaaaaagttatattttaaaaatataactttttggtctttccaaaaataattaatcattcagaatacaatcttaaaaataatgaaaaaaattgtaaaatattacaatggaaaatatttgtaacgcaatgtgttttgaatttttatataatttctaatacaaaaaaaatagaattttccattgtttttggttgataattttacattcaaatcaataaaaaatatacaaattaattgagacaagtttttataaaattttgggacaggtaatggggacaggcaatcccgaaacggaattcttgaaaaattttgaaaaattttaataaaaatattccaaatcgagctggctcaaagttagcaaattaatcaaaatatatgctgtaaaacacaatcccaaatcctaattaccacagttcttttaatattttgaaatgttgatcagtttcattcatcaaatgtttttctggcaaatttcttccgtcaattcgaccaattgtcgggtgttttacattatcattgacgcgattgttacatggaattttcatggaaaatttgttgaaaatttttttcaaaatttgcacggcattttggcgcaagattggatgacgactaaattaaaataaatagaaaatgaaataattactattttaattaccttattatagtgtactcaattaacaaatggtaaaatgataaaaataaataattgaattgcacaaagaaaagaaataaagaataaattattatgtaatacaaaaaattaaagatggaagtccagcctataattgaaaaatgaagtagaaaagttggccataattgatggcctgttcggatgttttcagtcaactaaaaatttcaaatacaaattaactcggaatcaattaatattaattttttttgacctgataacgttcagtcaaattatgcccattgctgtttgaacattttaattttttgttaaacattttttcattgaatttactcagcattgaaaatgtctaaatttaatttaaaaaatttcaaaaataaaaaactaaaattaaataaaaaatgattacaaaaatttcaagaaaactgatgaccaaagataaaaacgttgaaatagtcgtaaatgttgataatgaatttgtattatttgcttgctccaaaccaataatgaagctgtaaacagtctaaaataaaaaataattctttaataaataagtacatcaattaacaattaccaaaatgatgaaccaactggcactgaaccaattgtttttgacactttcatatttattggccataaatgtggccattgtacgctcgacaaacagaatatggccaatgtaaatgatgtatgtatgaacaaaaatcattgtgaactaaattaacaaaattattattattttttatataaaaattattttaccacacaaaaaaatattatattattttcttttcaaatgatagtttgaaacattttgtttgcaagccctttgattgaacttaaaatttatttttgtggctttacggctcaaatggtgcatgcacaaaggatccacggacaaaaggacatacgacaaaagacccacagaggcaaaagtatctacaactaataattttaatttaaaaagaattaaacgaaaaaaaagattacagtcagggtttcaagtcggaaattaatttaaaaaatggatacatctcataatttttgtattttctcttaaaaattctcttattttaaataatatataaaaaatttaaaaaagtggaaattattatgacggattgtgataatccatatttataaaaatattttttaattaataatttacgagtaatggtgtaaaagaggcccattgttgtattccataaaatgcaataatcagaaactgaacgcataatgtcaatgcgaatgtgcagaataaaacactttgaatgaaaagaataaatttcaaattgcgatgcaaaagcgatgttcggcacagaatgccaatgttgagcagagaaagcggaatttggacgacaaaaacgcaaacattcaaacccaaaacaattgggatgccaattttgatgaattgagatgcttctccttggtcatcagcagatgaatttgacattttttcctgaaattattttttggggatacaaattttaggacttatccatttttttagcttcatagcaattagagccgcaaccgaccgggacttctaaaacttagggattttaagtatattatcattgtttttcagtgcaacattctaaattgtttaaaatttccactaaattttcatgctttaaagcataatcacataaaatttcaggaattttgctcttgtatgaacggttttataaaatcaacatgttcaccacgccattcggcttggaccatgtgaagatgtgttttataaatccttaaaattatcaaaaatttgacaaaaataaaaatttaacaaaaatacatgttgaaagatatgaaggtataaaattattctgcttttaagttaacttatagatagagaccgcattttgaggcatatgcctttttttctgcgcactagttccagatttattaagcataaaaaacacattttccgctttgtttgaggcttatgcgttgaattatattgtgcctataatgccttttttggcattttgtaccttttttggccttttttcc

SEQ ID NO: 4309 - DNA, 1485 bp, Heterodera glycines
aaaaaattccataaaaaatgtattaaaattacaaaaaaaaaaaaattttttttcccggtggcgcccgcctatcggcattaccggggacctcaatttagccttattttttttaaattttgattccaaaatggtaaaaaaattagtcatttttggcgaaaaaggctaaatacaaattgctgttttttgctctccggtgctgaaatttcgagaaaaaaacttcgacccgaggaagaattagccctacgaacttttttcaggttgcgttcttggaaataactttgcgagaatttatgctaatttaaagttttggttttaaaaggtcttaaaaaatgtgcgttgaaaattttaaaggcctttttcatgcctttttcgggattttcgtgccttttcatgcatttttttcaattttttggtgcctatttcgcgatttttggcgtgtctttttttgcggtctttacttataattgacgatttttaaaattttaaaaaatgtatatcaaaaaattcactttctcaaaatgaaaaattctcaaataaggcaggcaaaaaatggatatggcgagcgccatccactgacattaacaatgcgcaaatgctaattaatcaaaagccaaaaaaccatggtgcatgccctagacagaattttcattttattaatttataattcaaatgtaaacagaatgaaatgcaaagtggtaattactgacgcagctgaatattccaattttcagaattgagattaaaagaaaattggccggtaaaaacacgttaattaaaatttgaataaatataattattaatttgagatcagtgaactcgattttttttttgagaagaaaacgaataatcgaccaaatcagacaaattactttatttaaaacaatttaaattaaactatttaccaaacaatagaaacaattaaaattattaaatcaataaaatcaaatagggaaataactaaaaaaaaaactattttaatccctgtggcaacaagcttcactaataaatttttaattttctttaaaaaaatttttataaagattagataaattttcgatgcgattgcaatactgaatttttttcattttttataaaaaattaatattttccttttttgtgcaaatctgttaaaaaaatcttgccggcgtgatgacagaagacccagccaaagacaaagatcgacattttttagatttatattttactttaactttttttttgaaaattttgcaaatttttaggattttggaatcctttttacaactagttaaatatttaaatttattctgacagaagaaaaatcaatccgtcagggggtaataaaataaaaaataaaatatataattaaattttttcaaccctataaattgtaatacagcgaaacattcttgttagcattcgataacccttacattagctttttctaataacgcataaaatttcatacagtagaagctctttagattttgtgataagagctttgat

SEQ ID NO: 4310 - DNA, 6421 bp, Heterodera glycines
  misc_feature (1976)..(1976): n is a, c, g, or t
tgaataaagcactcccaaatataaattacaaatattaattttcattagctcgcaattttattttttttctggtcaaaacttgttaaatgttcgtaataaaatttatagcaaatcttaatttgattacagtaaaaaaagcatgtttttcttgataaaaaatattttcaaaaaaccctgatccgtatacgggtccgtatttttcctgagtacggacttatgcggagtaagggttttatgggtttttagtccgtatgggtgcctagtcctgctggtctgggtccgcattttcgtaaaattctgatctctagtcatgacccaaacagaattggaaaaaataaataaataaactaagatcacatcttattgtttagggaaacccagcgaaaattgttttttcgggattcacattggcattagcataattactgactggtatgtacatatgtgattgacattaatatatgtaattgtgaatacttggagacaagattgttattgaaatcgtttagcgattgatgagatgcaatccgagcatcggcacccatcacggtacttcctttgcttttgggaccacccgccgcagtttagtaggcaaataaccttggtcatcttgaagacttggagttttgtttaactgcagttggagtataagttagggccgctcagaggcaaaaagtaaaaattaatttccaaattttcggggattaaaattcgtataattatctgccaaaattaatttgtaaatggaaaatgatcgttctacgtcgcaatatgtcagaggagcaaatttgtaaaatactgaaagatcggactgatcagtgaactttgaaaccggcgattgactgacggcaattcaaaattccaaatatttttacaattcgggcgacgaaagtgccgggtcggaaaacaaagttttcgacatttggctttcgatttgccgaccaaagtgaatccaaaggatcagcgagagaagtaaaaagccgagcataaggaaaagtacatcaaaaagcgcaaaaggaaacgaaaggcataggcagggaaaggagaaaaagcgaattcaaagagaaaagaaatgtccagaaaagcttgaaggcaattgacactttggccggacggacattccaacggacggtgccgaagaacgaccggtgtgcgcagcggaaagaagaagcgaccggccggagttaattggcaaaggcactctccggcaatggtcggccattatcggctaatttacttgtcccgttgacttgacaaatgcaatgcccaatggcacactctttccctttttctctttggttttccattttgtcataattatgtaattagcatcagcaaatgaatgtgtcgtaatttccgttcttcccaaattacatttgcattttcttcttcccttttccttttctcatttccgcttttttcccttaaattcgtttctttggcatttcatttttgccattcccttaattttccctcaaattcacacactttttgtttgttttttcattttcctctttgcccctcctccatttttgccctttcctctcaattcaatttattcgatgagtttcaccgcactttggcaagcgaacctaacaaatgccatcaaagtcaacggggcaatgattctccccctcttcagttcaacctaattcgatttctcttttagtgcttctgaatcggcttcttctccaatcgcttctcaatttgtccgcttttcctctgccatttcaattttcctgcgaattccttttttgcctccctctgccatcctttgcctgttaagttgtgctctcggcttcttctcctttttggtctttctttcaaaataggagacattccctcttccccctctttccgtgccgtgccgtgagaagcaaaagagggcttcgctcattcttcgcctttttcttttccatttatctttctagtgagtgtttcatccgaatgtttctccgtcccctctctctctctcncctctctctctctctgtctctctctctcgctctctatccgtctctctttctatgctttctctgctacttcatctccacccctctctttttctcgcccattattacctcagtcattccattttttgctcataattgccacttcctttacatcctcttttccttgttaagtccattaaatttccgatttttaatttctttatttttaacgcccaatcttataattgtttaatgcgggaaaagagagagaggcaaataaataatttggtgaaaattggcattggatatgaatgccattggaattacaattttaactcaccggagcgccgtttttaaaagcatttataatggaagccttattccctcccccccccccccccgcttctcctctttttatgttgcttcttcctcttttttatccgttcgggagagcgcaaaagaaaatctgacactgtgaaagtgtgtaaataaaggtgccctttctctttgtcccccattgttttggcctctccccggggggcgcggggactgatcgatgctttcaacaccccccgccggctgagtgttccgtccctcactcttccgggccctcctttctgcccaaaatgtccatccgtcgcgaaactgtcacggccaggacggccttcgctaaaagaatcactcccggcgacagatccaagtccttctcgggcccctccttttctgctcgttcgttacgtcgcaaaatgattgaattggacgatgacctcgtcgtccccggcatgcatccgttcgggcaaacttcgggcggcgccgattgggtcgactcgcccgggcccgcggacgccattcgctgtgaagagccatgttcgcgagtgctgcttaccatcacggccaagtgcttatcttagcctttgtttgtcccgactcgtttggttggcaaactgttggaattaattgatttgcctcaagggatttgctggacttggaccccgacgagtgcatcgacccattttgtaaggtcagtgtgtgcgaggcgtcgtcgatggcaccgcaaaggcaatgggaagtgcttggccagacggaagtgatcggaaacacttgcgatccggaatggagcaccaaaatttgtctgacattcttctttgaggagcaggtaattaagaagaagaagtcgtgtcgaaaatggtcagatgaacgaattcgaaatgaatcagtcgcgcatttacaatttccgtttctgatcagcaaagactgatgttcgaagtgttcgacaagaacagagagggactgaacccggcagtacgaatatacccaaaacgaattggccaatgcacaatgtaacggacagtcaattggccaacattcctttgcttttgttggacaggttactgcacgaaattgtgggcgcacatatgaacagattgaacagccagctgatgtgactggccagttaattaaaaccgaaaaccaaacgcattaagggaggagggaaaagccgtcggatggctaacggtgacggcggaagaattgagcgtaggacggcaagaatcggtgtattttgtggtcagcgggaccaacctggacaagaaggaccttttcgggaagtgcgaccccttcctcaaagtgagccgaatcaacgcggacggcacgtgagcagaacagacggacaaataatgggctcgacagaatggtactgatcaagtttcagaatgcaattggcctaccgaagtcggtaccacgaacagaatctgaaccccaagtggaaaccattcgaaattctcacgcagcaactttgctacggggacagagaccgaccatttctgatcgaagttggtcttctggcattctgacaaggaccaagccaagcactctgagtgcatttcagtgctttgactgggaccaagacggcgaccatgatttggtcggggcatgccaaacgacggtcaaccgactgatgtgcgggatggacaaggaattgccggtaaagatcagttgagggggataagaagaaggagagcaacgaagggggggggtgagcaggggaaggagaagcttagggctatgagaaacggaagagataaatgaggagagggagtaggaaagagggggaatggaacattgaggagaagaaaaccggggaaaggaaggaggggaagagaagcggggggaggcgggggagtcactccgcttgaccacataaaatgaatctttttcagctgatcaacgaaaagaagttgaagaagcacaagaagtacgtcgactctggtcagattcacttccatcgcgtgggtccttcggccgatcactcgtccattggtccggtcacttttcgctgatcactttaggtgttcctttggcaagactacacttttcttgacttcatccgtggcgggtattatcccttttctcatttttgccgttttctcaattcgccgttaggactgagttggatttcaccgtcgccattgacttcactcgttccaatttgcccatgaaggaccaatcgtcgcttcaccgcttcgaccacagcaaccgcccaaaccaatacgaaattgcgatcggagccatcgccgaaatatgccaacattacagcaaaaacaaagtccgatcgctttttggcatttccgctaatcacttttttcagcttttcaatgcttatggcttcggtgcccgaattccttctttggatgacaaagtgcactacaacttcccgctggtaaattatcaaactaatgataacaaaagtgtaataacagacgaacattaacaaataccgaaactgatcgatcaatcacttactttatcagcagtaattacattgttaatccaaattgttggtccatttatcaataagaaactgaccattgatcatttgttgatcaaacaaaaactgatcacccatcaaatccatcttatgtctgtccgttcctcgcctcgtgccaattcgtttcgttcagaacttggaagtcaatgacccgcgctgtcgcggcgtcgacggacttttggaggcgtatgccattgcgctgtcacacgtggagctcaggtggaccaacccacccgcttctgttgcttttcgttttcgcttctcactgccaattgctttcagtgggcccaccgatttcacgccgaccattcgtttggccgctcgccgtgccgcggcattgcccgaaaatggcagtcgctactgcgttttgctgatcgtcaccgatggggcgatcaccgattttgaggagaccaaggaagaaattgtgaaggtatttacaggctgtttacctgcacggtttctcctttcaatcatattcaccgtatcactcatctctgttaccgtattttctgctcagcattcataccgtatgccctttccccacttaccgtgtcctccccccatctttcggcttctgctcttcccctgtccattattgtgatcggcgttggttacgacacctttgaagagatgaaagtgttggactcggacagaagacttctctcctcccacaaaaaattcgcaaaaagagacattgtccaggtgctccccaacttcgatgaccatttttggcatttccctcagtttgtacaaatgcgcaagtttttgccgccccatcgatcgctgactgagcaggaattggccacagcgaaggccaaactggccaaggaagtgctgttcgaggtacccgctcagctgatcggctatatgaaagtgaattggcaaaagggcgacaaaagagacagaaaattggaccatttcagtcaaaaggcatttgtccgcgaccgcccgacgaccctttcactgcggtgaatcaatgcgaaacattggcacaacgatttatgaaatgggaaagtggtgaaagtggcggaacagaggggacggcacaacagcaaaggagaagcagcagtctgaagagcagcaaagagatgctgcgggcaatgcaacagaaaagggcatccgccggtgagtgccccgagggacggaaaaaggaaaagcggagaaaatgccgaaatgagaatggcataaacagtggaggagggagagagagagttgagggagatagtgccgaaatgggattccctttgtttcccatggctttttccatttcaatcccccccccccccctccagcatccaccgtcgattgctcgccacggacttcgccgcgtgttcctcgccgcattttgccgacgcccccggatgaacagcagcagaccgatgagagtgaggaattggcggagggaatgcgcgggacgcgtctcatcggatgaatgatcaaccgatcgatcagtttgatcagccgccattcacacatttcctttccgctttctcatttttactttttttttctttggtacattttgaaaaattttcaatcagaaaatgttcgatattctttcctttcgtctaattggcccattgattttagtgcgtcccatttgcttgttgtgtgcgtcttttgctttatcatgatgctgaag

SEQ ID NO: 4311 - DNA, 2411 bp, Heterodera glycines
ttccgccccttccctccccgatttccttcaaattctcgtcatttctcatagaaatcattccctttgtcgcgtccgtccatttctttgctcttcccatttctatggagtcccgcacctcaaatttgtcagcttccatccatcgccacggcgattatcagctgcgattggcccgctcttcggcctatgtgcgggcgaaagtggcgccaaatttgacgaaaaattttgtaagaaataacaaaaagctgaatatttttagtttagcaaaaatgtccaaaatgtctggtgatggtggacattcgactgcacgccaaatgcccagcggatgcaatttaccaaccgtaccaatgggttttggacccggaaagatggtatgtgtgaagaggaagcggacgaggcaaagccggacggacggaagagggaggtgaaaagaaggggaagaaggagaaggagaagaagcagcagacgatgtttgattactttttgggataatcaataaaaaaacacactgatcactcttggcattatgttttattgccaataataaacattcattcaaattgcacgaggcgttaaaaagccaacgaacggttgttgatcagctgatcaacagcatcgaagcggaagggcagggggaaacatcaacaaatgctaacagaaaagagagagaaagaaagagagtatgacaaaatgagagagaaagtgagagaaagaaagagagagtatgacaaaagagagagaaagtgagagcaagaaagagagagtatgacaaaagagagagaaagtgagagaaagaaagagagagtatgacaaaagagagagaaagtgagagaaagaaagagagagtatgacaaaatgagagagaaagtgagagaatgaaagagagagtatgacaaaatgagagagaaagtgagagaaagaaagagagagtatgacaaaatgagagagaaagtgagagaaagaaagagagagtatgacaaaagagagagaaagtgagccgtgaaagcgtttaaacaaaatgacagagtgatcattgactgaatgattagtgttagacgcttcttcccgaaaatgtgtgggcgtcaaaaaggcgggaaaagagaacagcgattttgtgctccgttggctgatcgctcttccctgggccaccgggtgatttgaacgccctttccgccatctgttcaaaggcatgcattcgattggaatttgaccccggggtcaataagcacaattctttcaccgatcgacaatcaatctcggccaaacttttccttttcggcttttatttcctcaaccattcccgggatatgccaaattcaatttaaataattgtcttttttcgttttgcgttcattttgccctgcctttgtcccatggtcacttcccccctcaccctttaggggtctctccgcgtcctccgaccacaaaatgtgcgattacgcgctcgtccgtacgcgttccgcccttgcgctgtcttcgccctccactttggtccgcacttactccgtgcccaatttgagcgtgtccgttttccctctcctcgctttgtgccgtcattttgctctttcaggactccctactactcctcctactattacccctactacagttggcgcagttattggccctaccgttacagagactactcttacgtacgttttctgttgggttttcctttcctaccgtactggtaccgtttagtctgacctctattcatacgatcgctacagttacttctccccgacgtactaccgttcgctgttcccttaccgtcgatactattacaggtgaggggaaggggggggggcaaaagcaatcggacggcttcatcaaacactgcctttcagcgactacatcagcaacccgtactattggtcgtcttcgtactcctattggggccgctacagaagctatttgtacaattggcggggatatcgtaataaattgcacataccgtacacttaaggtccgactacgattggccctcctattacaatcgctggtcagttccatttgaatttctgttgcttaaaagtgtgttgttctctttcaaaaggtactattattggtaaaggtacgacccctactacgattcgtattcgcgcacctaccgttaccgctcttggcttctagacagtatccaaatttagcggggggggggggcactcgagtgaacgggtgaatttgtcctttcccaaggtatggaggacagcctgtcgaagggattggcacagtatcgtcaaggggtcggtccacaaaattcgaaaatccgccaatcgaagtccgctcaatgttcagaccatcaactacaaccagctgtaccgcaactggataacttccaacgattgggacaagcgaccacaaagactgggggcaattgtacgcgtgggacagagacagccgaaagccggagg

SEQ ID NO: 4312 - DNA, 1648 bp, Heterodera glycines
tgctgatcggataaagaaaataaataaatgcaacggctgtcagctgtgatttgtgctgactgaatgcttcccctgtcttttgctttgcctcttctcttccactcactctctcccctctatttctctccttcactcccctctctctcctttctctcactcccctctatgtctctcttcactcccctctctctctcctttctctctctccccctctctttttctctcttcccaccctcaaaatatgttcgtttctttctccctccctctccattctctcccattttccccgtttatttgttctttcctttttccctcttttcttactacgagttcaatagcatttctgaactgatttgatctgctgattggatctttccgttgattttgttctcttcctccaacatggtgttgatcgccagccgcaatgttttggccggggtcccggaaggcggcgcttccgcggtgatgcgctccgaagttccggcaccgcacgcggtgagtgactgttaccgtagtgcaggtgcctgttttttcgactgtcgcacgccctctctccccttctctctctacttctctctctctctttcccccttctctctctctccccttctctctctctcttgtgctctctctctctctcttgtgctctctcatacgtccgtctgatcagctcggccgttcgcgctcgcttgccgatgtgttccgctccaactcgcgctattccgagtcccaattttctcccaccgttgtgcccatcggaatgccgtcgaagccgatcagtgtccatcgaccgtattggacttactccgcctattggccctatcgataccatcgaaatttcaacacttacgagtcggttaatattattgaccattgctttttgttcaattgggcaacaaattcagcaatcaaatcaccgattccttctattggcattaccctttccgcctttggacatcctacaaacacaattggtggccaatttggccaattagtacaattaaatggcaattttaaggtaccaatacgacagcccctattactatcgccgttaccatgacaattacaacattttctacaacactgaactgatgtcatacggtaacagagggaaacggttacaaaaagaggaaaatgcaagtgactttcaggaaatcggtcaaaactgatggagaatttgtaccaaggaacgccgatcacacaatgaaacgattggaacagagaagaagagacagaagagagagagagagagagagcggaaaaggaaattataagacaaagaaacaaaatgccaacatttttaaaaagattcaattgaaaaatatagcagaatattgaggatgaaaagaaaaaaagaaagagtttatgttaaatgaaaataaccaggaaagtagacagaagaaaacccacagcagagacagagaaaaagaaagagggagagagtagagagatgagagaggaaggagagagagagaaagagcgaagaatttcaatttccacagtgatcaattgagccagtgagagaaaattccctaagacataatcataaagcagaatgaaaagccgagagagatattgcgtatcagaaaagcaaaaaccaacagaatcgacgacggggaacaacccccccccccgtaaaggacacttc

SEQ ID NO: 4313 - DNA, 984 bp, Heterodera glycines
caggctcacaatgcatcgcgttttgatggccattttgtgctaaaatatctaggcgaaacaaaacggcgcccagatgttgttatgaatggactaaaaattttcgaattccgcctacagcattcgcgacgccattcgctgctcacatggcgggactcgtgccttttgatgccaattcgtcttgaggatatgcccaaaaccttcagtttggactgtgatgacaaaccgttttttccctactcattcaatcggcggtccaaatttgtaaagttgattattttaatgatttaatttagagaaaactatggtgtacgcctgcaacatttgccgcaaaaggacgactattgccctgggtcaatgaagctggataaatatgaaaaatttgaaaaatggtatgtgttggttaggtaatttggaactttgtgatatcggcccacacaggtacgatatgaacagaaacactccgttttttttgccgcacgaacttcgtttgtactgccaaaacgatacggaaattctgctctcagcgattgttcaatttcgacgcataatgatggatgaggttacgaatggatttgacgtgctgccgctcagcgccacaatcgccaggttccgtcgttaacctgtttagcgttcagcgaatctgagtttttctgttcagcgtgtgcatgactatcttcaaaggacaatttttgaaagaaaaacagctggccattgtccctgaatgcgggtacgagcgaaacgaccgtgccagcgtcttcgccatcaaatacctcgattggcgctcaaaaaaggacggcattcgaatacaacatgccggaaacgggcttgaaaagcgctggcggcaattcaggctggacggttgggtcgaggaacataataaatgtattgaggttttgggttgctattggcacggttgcgaacattgctttaacccgacgacaagctggccgacggaaaaacgtgcagagaactcaacgaattaac

SEQ ID NO: 4314 - DNA, 2627 bp, Heterodera glycines
  misc_feature (2576)..(2576): n is a, c, g, or t
caagggacccggagatgtgtgaattttttgccttcttaggaactgaccgagggccgattgaccctcgtcacgcatactacggtggaaggactgggccgctgcagctgattgctgagccgaaagaagacgaaaaaatttctgtttttgatataatctcgttgtatccatgggtcaattattccacagactatccggttggcataccgtctataatctacccaaccggtgcggaaatgatagtcaattggacacggcctgaacagctacagtttcttggaatctaccgcgttcgagtgataccccccgaggacttcgaatacccgttttaccgctcaaaattgacgatcgcctccttttctgctgctgtcaccattgtgcctcaatgtttcggaaggccaacacgcgtctgatccataagtgcaaacatacagatgagcagcgtgcgtttgtcggcaactacacacacattgaactagcacgtgcactggaatcaggctacatagtggacagattctggagagcgtggaattatgaggaatggtgagtgcgtgtgtgcaataatggggtttatattaatgatcaggagcgaccaaatattcaaggactacgtccgactgctgataaaacttaaggtcagtgcttcatcgaccctgaaattatcttaataatgtctgctgaagattgaagccagcggttttcctgacggtgtggttagtgttgaacagcaacagcactacgcagaagagtaccggcggacatatagcgttaatttggagctcgaacgtgttcgaaagaattctggactacggttcatttcgaagcttatgctgaatagcctatggttttctttgcgctctattagctaatttttctttcttcatttaggggcaagttcagcatgagaaatgagctgggtacgaataaagtgttgaccaggccacaagaattttacaacataattttagatcataaaattgtgagcattaataagagatagtttttttctcatagtgtcttagaaagggaaaaatcttttattttatatcttaggaggtgtcagcaatcatccctttatcggatagtgctgtacgtgttctttacaaacacaaaaaaaatttcgtcaccgaacactcatccagcaacatcgtcctaagtttatggactacaagccgcgcccgccttaaactgctcgactttatgactcaaattgagcgaactgaaggcgcaaaattactatacactgtttgttctttatttttcaattctggaaaaacagaaaagttataggataccgacagcgttgttgtgctacacaagcgtgacattgtgccaatacaaaccggagaatatttaggtcaaatgagtgaggagtacctcggctacgacatcaaaagttttgtatgcggaggtaatatttttgatacttcaactttaacagaagcgaatatgttctaggcgctaaacaatatggttttcgcatgaaagacaagcgaactggaacaattgaatacatcataaagattcgaggcataacttttgatgtcaacaacagcaaagctctacagtttgagagctttcagcaaaaggtggccaattacggtaggaatgtcaatattggccacacacaccgttgtaacgatgccgatgacaacgagaatgacgcaaacgtaccttcagtatttcactacaacaaaataatgccgacacgtgatagtcgtgttattacacgagaactgcgcaaaaaatatgtgccgatatgccaaaaagggataataaatgagcagtatgaagtcttgccgtttggatatgaataaaaaacgattatgattttgctcacaatttcttcatttactgtctgacctcagcaaatacattgaacataactcgaaaagttatatctatttttgtttgaaatcacagaagaaatgtccgacaaaaatggcaacgccgggaagagcgacgacggcaatggcagcaagaaaaacgtcggaaaggaatcgaaaagtcgaaaaagaagctacccgcttcctctactttcgtgtcgagcgcggcaaacttggtattggatgtcataaagaatagccaattcttttttttgctgtagggcagaagcactcgacaatatagaaaaaaaatattcaaaaatggaagaggatataggcggtgaggagagcgacaacgacaccatcgacttttttgcggacagcgttgacgaaattatggaaaagtatgtttcaaaaaaataaattggctttgtgataaaaatattgtttcaacccttaaaagaatccatcgatcggaagagaaggtgaaaaaatggatgactacgcacggccgcggtgaagccaaggcgaccaacgctgagcttttgcctgctgcggccccaactgttgagaaaaacgattgggattccagcaatagtgagaaggatgaggatgagccaacatcaacggtttacctagaccgcaaaaaatcttagaaaggaaatggatctagaatctccctgttgttaaccatgaacaagtacagtgtattcaagtaaaatttattctgcaactatcgtatgtatgacaaantggtgtgataaggcaaaaaagatagacaatttatcttttttcgttttgcat

SEQ ID NO: 4315 - DNA, 7269 bp, Heterodera glycines
  misc_feature (5538)..(5538): n is a, c, g, or t
tatgtcaagtaaaatgttattgctcgcaactactcttatggatgacaaataggtgtgataaggcaaaaaagatagacaatttatcttttttcgttttgcatttcggcattagcgactcgtaacaattcaatgggaaataagtcacggtgatagccaccgccaaattggacaacacagggtaaacccggatactttagcgtgacacgatggcgagaatagagatgttgctgaacagtgattccgaggaatccgcgataggcaaacacccgattagcgccatttggacacaaggcgtccgggataactttgatattcttcctaagatgagcagtttcaatgtccagttgattaagataagtgagattctccatcctccgtttctgtagctgtttagcgagtcggtagggaccacagttgttgaatcggcacagcactctcaccaagttgtagtctcgttttcgcgttcgtcgtcgctccaatagttggatagatccagctcgtcgactatcaggttcatgttgttgttgctgttgttcggtagttcgaaatggcgtgatagacacagcggcgagtcgcccggacaaatcttcaggtccttcagctccacatacagaggttcgctccttaaaaatgcataatgacaaaaaaaataatgtttttttgtttagttaacttaccacactattccctcgaacttcctcttcggataacatgttgagtacagctcaacgtcagcaatcaattcaagcgagccgtcaatatgcacaggttggttcggatagtcttcgtttgaaatgtgtacgcagtccacagcacaaagggggttgggatagagacaattcccaccttcaggcccacttttaatttcctctttcaaacaggtgtacagatcgtctacactgctcagaccgtaactgtcgatcagataacggattgccctttgcatgcaataaccaggtaaatatattgtgacaattatggaaatgaaatagcttttcttaaaatctaggaaacaaatggccaactgaatccaaacaacaaaaatcgttctttaaatactccgagtacgggctccaccactttgatcactcgctgttgcagttacatacggtatattcaacaattgttgatgttgggatgaataagcgtcgtcaatgaacgggctgctgtaataatcggcgctatcggacacgttaagcggactctttcggtccactcgtcgtagctgtttaagtatgtatgtgcacagtactattaggaacagattgaacaggtacgatatcggtatccaggcgtccgacatgcgtagatgagcaaaaacgccgcgactagcattttggtctttgggtttataaattagataattaaagcggacgtcatttgaattggttacaaaagttagcgcacgattcccttttgcatagtcggcaatgtaaaatttatagatgcgctggtctctgatcacaaacacatggttgtccaccatagtaaagtcgcttttatctggtggaagaaaagcgacaaagttgctcttcaagatcgtatgggcggaagattggttttttcgaagccaccaatgctccaggtattcaagctctatttcgctaatccgcctctgatacttatcgatcagaaacaatcgacccgaaaggtgatcaaacacaatccgtccatgtttggacagtcgttgcacaatcttatgctggtgaccacggaagatagtagtctcaccagattcgctgtcttcaaaaaaggtaaaactatgcccattgtattcaaaacaggccaatggtgacattttcaccaatgatttcatttcgaaaaacacactctgatagctgtgtaaagtgtacacattttgaagtgaaacggcccattcgctgtcacgttcacatttctctattcggcacgctgtattccaactataaccaaaatgttgtgctgctgtagcatcttttgaaaaggtacgatatttgccgctatcgaaatagttttgattgtcaaccgtcaaatccacatttatcagctccgattgcaatagtgacggtacacggctgaggactagacctgcgtaaaaaacattcataaaatgaaccatcatttttctcactgttcaggaaacgtgagcttttatagaccgctgatcaagtttctgacaaaccatttcacgaggtaatctgccatgcctcgagtcttacgcaaagtctcaatcacacggcagaaaggaacgccagaacatcggcttgccaaaaaatatacacaaaaatgtccacatgtatcggatatgggaaattgaatttgctccctagtgaccagtacctctttaaatgtgttgaggtaggctgctaaatcggggtttgggggctcaccaagactgtcaaaatattcaacccttctatggcttaaagcatagcaagccacccaatgttcacctcgtgtcccttctttgtccgtattcacgaccatacaatgagggaatttggaaacccgcttcggaattcgatcagatgggaaaacaccaatgaatttgttcttggtagggtgcaatcttttcagaattatttccaattgagctgaattcattgttgcttttcagtgtcaatcagtttcagtcagttacacacttccgtctgtactcagaacccggtctgcgttaatggacaacacagaatcgaattcaccaaggacaagcatctcatatccatccgcttttataggctgctcaaattgtacctttatcgtgcatgtgccttgcctgatcagctcaaaaccaggtgtgtcctccagagtggaagtcagcggaatgacgaaaaaggcccaaccgttaagaaaacgctgcatcccaatcgagaccgtttttgtgtcggagtcatccaaacccaggcctgcgtacatatcgacaaaagcacggacaaagcggggctgtacaccatcgaaggacagcaaatacggggtgctgggaaaggtctgtccgttcgcctcaacactaatcgaacgtacattggcgtgttcaaacttgtagggtgacatttttcggttaccggaatatgcatcggttgaaacgaaagtgcaaattaaacgacgagttaacgtagaagtgaacacattgtgtgccagctcggtccggcctgtgccaagaaaaatggacctcatctcaattttacgcagcggatattttgctgaagtggactctaattgtcggctaatggcaaggttaaggcttggtgttacgtccacagtgcgtacatagagacgcatgtcatgcacacggatgcggtactctttcttattttcctgctgtgtaccatctggttttttgtatggaggtgtaagcaggaggaatgaatcattgttgcggtgaatggtgaatattacatcctgattgttcaacatcaatgcactttgacgtgccaaatcaaaattcagttttaccattgtctcacactgtttaccacctgaaaagcgtgccgcacgtgcggtaaaacctgggtttgttgcgctgttctggtcatcatcgtctgcgtagtagcacgatgcctcatggaaagccttgcgaatttcctgtgaatagcccaactccttcattatgtagtcgcggtagtgataataaattgaactgtcaaacacctcaatgcctgaaatattgaccttcagcgagcggacaaagctgctagcaaagttttgaatgacgccaacatgtttatcgtttgggtccgtgtcactgagtgctacccattctcccgcgtcattcttccgttcaattgagctgagcaggtacatataggttttgctcaagtcacaaaattggctgtccgagaacaggcgaaacaaatagggacctgtctgattaagtgcagacagaggcaacaattcacggacgtttgtcttatttatggccacattggttggcggcaaagagaataatgacagacttccttccagaccctcaacactgtctttgtcaatctttttaattacgctcattttccactgagttttttggttagtatgtttctctcaaaatatttaatgtatgttgctgagagtgtagtcgttagtggaaaaaattaaaattatcctacctatttataggcttcgtgtggtgccgaatgttaatgtgcaagtgttagctgatcgatgatctgtcgtttccctctcaatgtaccagtttttttattttttctatgagtgattgtcttgtgccgttgccgcccaccctttccgcattggttgagcttttcggccagattctcaaatccttgctttgcctgagttttgagagactctttaaacgcctttccctgcgcgagatcgtcaagcatccgtgtccctgcggaaatgccctcttttgaggcagactttagcaggtttgtggctacaggcatcaggaaccgcgaaatattttgtaacagaccgccaccacgctgaaatttattgcctacaaaatactgcagctcaccgcttccctcctgctgctgctgtaacgcaaggaacgcggaccaattcacgttgtccgggttaaaaacaacgtgcgtcataactatcgttttttgttgctaaaatagtttttgtctaaaatgtaatgtgattacggtagttccccaaccaaattttacgtaacgtccaaatgctgtctgaatttcaatgttaatttcagaaatgcgtttattttggagagaatgaaaaatttcattggtatatataacctctggcatgtccaaccctggtgtccctgacacgttgacaactcgcagcaacggtgccatgcggtcacctatgatggaatcctccaccagtttaggcgcgtaaacgtacagctgacggacaccaccagacagatcaggtggatattttgccgactgattgttgtaaatgcgtgttttgcgatcaaaccccaacacataggacagctgtttgctcaaatcaacgtgcattactcctgggcccattctaatgccgaatcgctgagttatttcattgtaagcaaattcagctgccattttcgattcacgctgttgcgacattagctgtccatgctcaccatgtagcacttcttcgatgagtttatatgttgaaatgcggtgttgactctcgttctctttaccttcttcctgtagcatcttctgctgtgcatgtgttccatcgaccattcggtccacttgttcgtcgatcagcttttcaattattttctccttccttctctctgtcgctaccgttgattgtttagcaacaatttttgggttattggaggtcaacgcggctgcttgaggtaaatttcgaccatcttcaacttgagtcactgatgtagcagcagcatcggactgtcctaatccacttgatggcggcggcgtacctgcttcgtctttctcatcaatactattatcttgatctgctaaaatttgctcagctggcgtctcggatgataaagtagcggtggcagtagtagtgatgttttgttgggtggttgtttttactattggtagcattttcttcgtctgggtttgcgggctcatctgctggtgaaaaggagtctggtgnggtggaactagtactatttgacccctcagctacagcactgaggcctgagttagttttccctgtctgcgcatctctttttttagcctcgtattccaaagcggcaaaccgtttacgcctgtagtcaatcagacgttgaatgctctctatttgtcgctgcagcgacttcctttccgttgcgtcagtttcaaattcaagcttttccctcaattccctcttcttggtgtactcaagctgaagcgcttcataatttttctggattgcttgccaataattcacgggattggtttggaagaattcctggacgaaggtcaggttttgttcatggcttgtccgttcaaactcctcttgagaccttttctggtcacgttgcaatgctgcgttgtttaatatttccatctttctttcaaaaacgtgtatggaatttctcattcgttcggtttgcgaattgagctcttcaagccttttcaaatctttaactccttcatactctcccatctttgtttgtagatctagcacatctcggaggtaacttgacctccattcgtccagctgctctctataattgtcggggtatcgggcaaagaaacggtcaatgagtctttgttcattggcttcttgctgctcaccgtcccttctcttcgcctcttcttcaatcaaatgcaaacgttctttcagaaaagtttctcgcccctgaaaaaccccaagttccgttgagagaaatgtttttcgttcaccatccactgttgaattgtactcctttgccattttttcaaccctttctctgagctgatagtgcttttttctcagttctccaatctgttgccagtagtcaaaggggtttcgagtgaagaaattctctacttcgataactccagcgcctgtttctgacaattcggtttgtcgtttggctcttttgttggttgtaccatcatttaatgatgatgagccgccaaactttgtatcgtaagcattctggattatctgattcagtgttttttgtaaactttgtacactttggaattgtacatttggaatcttcactgataaattgataaacttttgcgattcctcgtcagaatttccggcatcttctctgtagttaggattaaccagtttgacagagatagagtcatcctcgtccacactgatcgacgggaatgaatatggatagattaatgccgataatgcgacggaccatttggagtcaagctctaaagtgtgcggaagtctaaccgtaaaatttgaagcagtatttcctggaccaggtgtgttcgagggaagtacaatgtaaaaatcttccattatttagctttattcaaatgctcgacgtttcactaggtctgagtcacggacccagctgttgtatttgtcagacaagccaacccaacggacgaaatgttctttgactccgtttcgtgtacgcgattttagcacttctgcgcgatgggtaccgttttccgttgtctttacaagttcttgatcgtagaaaattccctttatgtcttctccgttcaaatcacgtattctgtacgagtgcgggtctgtgttgtttacacgttggaccctaaaaagttcgtcggtaaaattgggatagtaaccttttgaaaattggcctttctctttgctaattcttacaatatcaccaaatttgaattttgtgtttattttgatttccttttcatcagtgtgttatgtatataggcgttttcttaacgtcggagcattcttaaa

SEQ ID NO: 4316 - DNA, 5350 bp, Heterodera glycines
ttaaatttccacctgaagtgcattgccttcatgcaattttcgcgccccaaattaagcgcaattttggcaacgaaatttcgcgaattttaacattgtaaatgagcaaataaccggtgatctgaaaattaaaataaatttttaattttaaatgaaatgtaagtgatcaaaaatacgataaatattaaatataactttattttttaatagtaataatggcaaaattttccaaaattcccaacctcctccaaatgctccaagaaatgaaatggcgcgcggtcggtgagacgctgcgcgaaagaagcagctccgtctttgtccgacgcgctttggttgttttgtcgctgtacgtctcgtcgtacgtcgtgctcgtcgacgtgcgtcagctccaaattgccaatcacgcgcctgcagcgcgaatacgacttgcgcaatcgctcatagtgtcccatgccacgtgccacgctgattgtattccgaccattttccgagccgagacaaactgtaaaagcaaataaacacaaagcaatgagtcgtgataatgttcgacatatcggtctcggttttcgagctgggaaatttttcggattttcgatgcccttttgtcggtgttttgaagcataagcctgacaatgtcgaacccatcgtcctatgtcaattttgggcaataaacaaagacacgctaaacttttctacgaacaatgtccggagagcaaaactaagattttgtgctcaaaaaataagattttacaaacaaaaggttgacctgttttgcggcacgctttttcaaaattttaaaatcaaaaatttgtctgtgttttcccttcagcgatggtagccaagtgagaaaatgtttgttaaattcgcatttttggaggtcctgtgttcaaatcgacataaattcggctggtttccttgtcagtctcgggctcaactttcattccgactctcgagcatctctaatcacaaaacaaaacctctttatttttttgcctaatttaatttaattgcccacaattgtcgccaatgatttttttaaatatttttgtgccttttttgcttttattagtcgcgcatttatccctgcttggttttttcctaactcaccacattgtttttgcactttttcctcagttttagcatccgataagggggacagatgctgccgattttgttggtcaaaaaaaagcgaccgtaaacggaaaaatgacaattactgtacccccgccccattttgttagtacggtaccgttttgtatcggatcgtatcacagagagacatttaaatgagggtgatgtgattattttgtttgtaaatataaaaagcagaaataatggcacactaattgccataattaatgcatcagaaataaacttgtaaatattctattaaagttgcaaaacgtaaaaaaaaaactttgttgtaagttttttttcgaaaatcgatccgatagtctgacaaagatggcacaaaagataagaaaacattttgagaaaatggctgatggtggccagcaaaattatatttttaaaaatagattttttggattacaattttttcttgggcaacaaaataacatttggtctaaatttaggccaatagcgcagaattgtaaagtttttattgccaattgaacaaaaatgtgctgggcttatcccactcgctgctgtttttaagccccgaaaataataaaaatttaatttttcagaaaaataatttaagaaaatttataaaattaattatctttaaaaactgactaaaaaagataattatcaaaatattcaaattcaaattttcctggaaaaataagaaattttgcattattcgcaatatgtgacccatttcgccctataaaattggacgatggaatgaatgtgggagagtaaatcgtcgccaaatgaaaatgccattctgttcggcactctttaagcccgacccattaactcacaagttctcaattggtgccgttccacttcttccgtgccgcccttccgcgctaccgtacgacttgcgcctccagcaccgtacttctttgttgtgagtttttggttgccttgtttcttccgctgtgttgtgcttccaccgccgcgacgtcgtgccgcatttgatgaccaatcagtgatgatcagaaaaatgattagggaatggacaaagtgtcggtaaaggaccaactgcagaaaatgccgaactctcatgctaaacagaaacctaaaaaacaaacaagtatttcggttttgaaaacttttaaattggagtttgggcaggaattatgagaatggaacgatgagtttggcatgcaaaagccgagtgccgtattccggccagagacgcccgggtaagtccaaattcggagtatgccacggactcttcaggacgctcttagataaatgtaaaaaaatggtgatcgatacacacaaacaaacgataaatttgtgcaacactcacaatgacaaagtgtaataaaatgtttcgagaattggccgatcggctgattgtgtgaggtgactgagtggggaggggagagaagggagggggcagtggctgctccttgctgccgctgctttacgtattcattgttagcggttggttcaccgccgttttccgatggatgagctcatcgttcgcttccgcaaaaggcttttagcccccccccccccccgcccggcaaatttaacggagagcaaagagcgcccgaagataaaagcaaagaaacaaattaaaatatcatcggcttctttttggaatgaatgatccttacaaaagcaaaagaaaaggccgtttgaaatttttgtaaaaagtgccagtaaaatgaaactgaaatataagtagtctttctctgttttggtcagaagtgattaattttctttttattttgggttgaattttttagtttaatttttcgtcctgttactctttccttacgtttgatagttaatttggtttttggtcattgttttaaacttttagttcttttttttttttaacttttttttttcctttttttttttattttaatttttgattttaatttgccgagtaaaaagtgaggcatacattttgaattttaaatttaaacatcgttttacagtgaaacattctccaaaaaaaaaacccccctaaaaaagtgtgttttaaatatgttaatgacggcattacggaccgaatgtttaatgccggtaaatgcagcccatgaaaactgtccattggagtgtcaaatggaccgtgggaagatgggaaggtcgttggagtattatccgcctaaatgggcacaatgggcgcatttaccccccacgggggaggaaatgagatgagtttggcagcattcacctggggcgggggcgggggggggtgatggaatgcaaaataccggaaaacggaacggaattccgacaataagtcagacaccaaacaacgggtacggtaatcgggaaaaaagcgacagtcagcagaatagtacgaatgtgtaaggaaaaatcagtgatattgcgcttggaaacagaaaatgcaatctttacaggagggataaattaagaaaaaataaaatattttattaaagatatttatcgacaaataaaaaaaaattgtccattgatttaaaaaaaaaccccattaagcccatcggccaaatgaaggcggtggcataaaaaaggggcggaagatctggcccgaaaaaagtgaatttaaatggggaagaagaaaagtcgcccgcggggagaggcgggcggggaatgacatgggaaaggccaaatttatttgttttgtttggggaggggggaaatatgcaaatttatagcaaattaatctcagagtccgtttcattttgcttttgttttcagaaaaataatttaatttaatttttcaaatttgtgggaaaatttattttaaaaaaattgaattttattttttttttaatcaaattttcgctatttttctcaatcggttggcatccaaaaatgaagctatgttctgctgctgctgccgatgatcatttttgttgaacagttttctcagggtgacttttggaagtgatgaatgatgaatgacggacgaccgatgttttttgttttgtttttcccccaatgtttcccatccgcagcggcggtggcgttgaaaaatcatcggaaatttttcgttttcatttgcgatgggtccattcactcgtccgtccattcattgcgtccattttcgaactttttggacggcgaggagagggaataattagggagaataattagggaccccactctaagccaaggacaattgggcggggggggggaggacattgacaccaatgctgctaacacaaattgtctttggttttggacgatttggacggagaaagatggacggacaacgaactgtttttggagggggggggggagaatgaagaaaattaagaattaatacggcacagaaacaaattcggacaacacagaatagaatttgtggggacattctgcgaaagggaggccaaagacaatttgtggccaaatcaccgagcatcggtcaagaaaccgtttaataaacttaaaatcccatcccaaaaatgagcatgctgaaaaatttcaacaatttgtagtgcagagctaaaactatttgaaaattatttatattcaaatatcgcatttaattttaaagttaaaaaaatcgtaaaaatatttgaaaaaaaaatccgtgcaaatccaatcattataaataactgctcgctcctccgccgtcacatgacaccaaaagcgaaaaattgttcatttcctccacttttatgggcttatttatttatgacgcactgaccaacaaaaagtggatgaaaagcagaaaatccattcaatattattgataaataattaattcaatttttgattaattcatgggtaataaaaaaatgattattaagactcaattatgtgatgagaggatgaaaaaaatgaacttaaaaaattcgtttgtcaagtgcactgaacaaatgattttttcaaccaaattgcaagttccttaattaagtaattgaccttttcgagtttttatatgtacgaattcgtatggaatatggagcgaacacatgtagaaatattgggtcaaaaaatggaactatttgtaacaatactgaaaaatcaaacagagaggaaaagcaacaagcaaaatgggataaattcaaatatttttgactgaaacaaaattaaatagattttcattgattttacatattattcataatttgacgatttttattagagaaggattaaaaatataattaatgagaatatattattgactccaaaaagcaccgttgaaatacctttgaaagcatagttgtacgattgtgccaagagagtcgctggaagcaattttgct

SEQ ID NO: 4317 - DNA, 2956 bp, Heterodera glycines
  misc_feature (69)..(69): n is a, c, g, or t
  misc_feature (2171)..(2171): n is a, c, g, or t
  misc_feature (2208)..(2208): n is a, c, g, or t
tttcacgaggacgtcaaagtgattagtcctcctcccctactagcggattgtcacgctgatgaaaatggnaattattcttacgaatatgctgttgccgatgattcaccgccgggcgttgaattcattggacaaaaatttgatgaaaacgaggcaaagttagatgagaaaaatgaagaggagaaggaaaagcattggatgcgcgagaaaggttgggatgggactagagcggaggaatcggaagaagatgaagcggaggcatttggccaatcgagaatgattgggtgtggacaaacgatgtttcacagggtaagctgttttctaagagtcagtaatagtgagtggtttatttcatttgaaattataagcatgttccttgatttttaaggtaatttcatttccgcttatttgaatgcaggttgagtatggtcagcaatcgccaactgctgattggccatgggcagcgtccgtacggatagcttgcgaaacaaaaggctcgaacaaatctgaagttcaacaggtgtgtaccggcgttttggttgataagcagcacattgtgacagcggcgcattgcttttaccttccgattcatgaggcaaccaaatgcaaagggaatgaaattggcggagcagtgcccgagggcaggtagagttaattttatcataattcaattgccgtggcaaaagctgtggttgcattttgttggccaaaattaaaccatggtaatatatggtttaattttaatcaaggttttaaattataaattagaattgtataattattaatgtgtaaatattttatatttttcttattcagctggcaggtcccgtttgaatatgtgaaggtgaccctcggcggcaaagattggcagcactcatccggactaagcataaagtcattctcaaaaattaaaagctttcactcacatgcgctgaacgacgacataggcgtaattgaggtgcttaaaaattcaattaaattttaataatattttttctttttaaattcatttgaaataatttaatataatttggtttcaaaatgaaaatttttatttttaaaataatatttacttaaaaaaggaataaattgttaatttaggctcctattacatttagttggctgatccggtcgtgttcgatcaccgagtgaatcgcatctgctttccggcggcgtacactgcgcgaactggacatttggcctatgtgttaggctatgggaacacgttcgggggtaattttaaagaaaaatttctaaatgggaatgtttcttttgaattaagcacgtgaaaatcacggcactaagcttaaagagacgagctctcttcgggaagagctaattcagctccaaattaaacatccgtgcccaaagaaattgttttgcactcaacatgcgacacgccaaacggtgccggttttataaaatcactaaattataattaatgaaataattcaaaaaattttgtacattctgattaatattttagggtgattcgggcggacctttgatgcgcgagtacaggggtcgcttctatttgatcggcattgtaaaaggacatcggacggaatgccaaagccgaagtgagcatcgaaacatcaaataatgcaaaggactaatatattcatagtctttttagcttgtttcactcgtgtgatcccgcattgtctttggatcaacaaagttacgaagggccaaaccatttgccaaggcatcatccgctaaatggagggacggaaacggaaaaaacactgatcaaagaccgaaaataaataaaaataaatttgattataaacaaaataattggctataattttgagatagtgcttaatgtcctttaattgaattcaaactatcaaattaactttgtaaaaaaagcagaaaaatatttaatcaaataaatcgaaaatgagcctaaaataaatttattttcatttttactgagttcaacaacggagcagaagttggaactggtttaaacctaaaatgtggtgaatgcgtgcggccgatctattgggctccgctctgctgaccatgccaaatatgatttataaccctagaatatgtttcctcatcataattattcttattatattattactggtatgatgaatgctctgattcaaaatgcatattgtccataaatccggtcccagcaaaaaataaataatgcgccngaggcaataagcaaagaaagaaaggcggcttactacngatcaagcacacattgcagaaatattttgggtgtttcggcgattaacaaaaagcccatcactaagccatccaccccaaaacaggaccacccccgggggcgtgaggggggaggggaagaaagggttcgttgtgtccattccatcgcccattttaagccataaaaagtggcgcgcgacgggcgggacggacgccttttgctgcttctcttgcttgttttattagcagcgaatggatggataaagcagcagccgaagcagcacaactgatggacttttacgggtgctcacataaaatccgccgccgtcgcacgaatacaacaaaaatcccttcgcccgtcgcccgttgcactttacgagtggcgcgggtccaaagactcccgacgacggtgagccaacggccgacgacgcaacggttaatgacggaattttgggtgcgtttattgtcccgcctccggcggccctccctttaaaagggacggagtggcgacgcaaaggacgggcaacaaaacaaaacgccaaataatgctgcacaactaaccacaaaagaaatgcgacgatttttccgttataacttttcccgaataaaccgcacaaactcggaaattaatgaataacggctaattgctgtcggaaacatttcaaaaattaaattaaaatgttctatcaattttttttctctttgcttttaaattttagggcttttgttcagatgtatccagtggattaatcatttaactttaggctaatat

SEQ ID NO: 4318 - DNA, 6601 bp, Heterodera glycines
  misc_feature (4149)..(4149): n is a, c, g, or t
ctttttaatgcttttgttgaggggcccaagccaaattgttttttttatggggccgaatggacagctccacccgtcaaggatgtcgacgggctttatggccgtatctacagtctcatgggttctctatctggaatttataaaaaaatggttagcctctctggtcctggttgttaagcaaaaatgtgtggattaagagcaaaccgcctgaggacgctttcgtgatccgcggcatctgcgctccaatcggcacgtccgctttctgtatgcatagggaggaagagcactcttaccacctgaattttaattttggtccctccccaaaggtgaatttttgagttcttttgtttctcctgcatttttggcttcccaattagttgtggttttttgtggcggccgagctcgagggcaaagtgcgcgagctgggtcagcggttgtttggtgctcagtgggcgaagtgtgccaatccacttggacacatttcgtatcttttctcgcctgcccaatttcgagatgccggaattccgttcgaaatgcagttgcagaagccaggggaggctattctcaccgtggggctccattccggaatcaaccttggcccttctgtttgccttgtggctgaatttcaaagtccacgttcagtggcacgtttcaagggtccgattttgtaaaagatagagaaaatgttaactgcctaattcagaggtgggaagatggactcggtgcagttgcaaggatcgcgaggcttatcggttcaccaagcagcaggagaccgagtacttgcagttaactcagtaaatctcatgttttgtgtgccataaatagataggaaaaaaaaattgcaggtccttggtcgcttccgaacgtgccaccatggcctggcgaaagcatgatggttccggaaaacggcaaaaacccgatgccaaccgtctcgcagagctcgcggcacggaagcgggaacaaagagcgagacaaaagaaagaggggcatgtgccacaaaagaaaataaaagaaaaggataccattattaatttggatgacattgattttgattgagtaaagggaagagaggaaaaacaaagtgaaaaaataaaaattgaaaataatcaattaagtttcaataatttactaaatgtttccaagttctcgtcctttttctaaggtcatactttcttggttccatatccgttttttcattgattttctccgcctcggcttcaatttctggtcttttttccggccctcgggcttggatttggtctaagttctcatcttttcgggactcggggtccatttcattcctaatttcagacctttccgaactaacatcctccacgctttgtgtatgttcaaggcacttttgctcttcaattggttgcattggcgtagtgcacggggggcccaaaatttcgaagcactttttgatttgatttaaatgaagtctttttgggttcgaatttggcgaagtgcaactgatcacagtaacataaatgccctcaattttgataacccgaaaaattccgcgccacggtaattgaaattttttggatgttcctacccgtccgtcgtagtttctgatcagcactcgatcaccaattgtgatttgttgtggccttgcctttctgtcatattgttccttcatttttcgctgagcttttgcatattcatcagctgcagcgtgccacgcatgtcttattgcgacgaccagcttctgtttaaattcattacggtccgaaatggctatcggatcacgaactttcggatcaatgatctgatcaacacaaaaaattgggtcacgcccaaatattagaaagaatggagtctcacccgttgaagcatgcactgacgtgttgtagcaaaaattagcagcatccaaaaattcatcgaagtcgggctgagtcttagaaatgtatttggccaagatgttgtgaaatgtgcgaaaagttgcgtcagttgacgcattgccttgactccaatgaggacaggcatactttttgtcaatgtaaagcatggagcaaaattccctgaaaaattcggaagtaaaggcagaggcattatcggtgattaattcaacacaaccaccgtattttaagtaacaattggtaagaaaagagtgggcaattgtttgtgcttttgtgtcggggaccgggacagaaatcacgtatttggtgaaccaacaaacgatatttaaaatgtgtttattccctttttgagtgattggaaaggggccggccaagtccagcccaactttggcaaaaagtgtgttggctggcaccatgagcatctcttcacggtacgcgggtgttggattgtgtctgaattggcaagtgacacataatttgacccaagttaaaacgtcagagtacattttaggccaaaaatattttttgcatttggcaattgttttcctgtaatttaaatgaccaccacccaatagagaggagtgaaacgattcgaaaatgagcccacgtaatgaaattgggacataaattcttgggggggaacccttgtcctcaaaataaagaattcccgaaattaatttgtaattggcagtgcctacagcaaataattctttttctttttcatccaaatcagctggaaattccccatccctgacaaacgcaatgtaggctgcggcttctggatctcctgcctgctcttccaacaaattaatttcgtaagtgtttccatcctcgtgtcggatggtcaaagtatgcaaaaatgggtccgcgaccaccctggaatgtgctgccaaagcgagacagaccggaaatgcgataatgtcctcgagttcatccacattgtatatttccgacaagggcttgtcctcagcggcacgagaaagtgcatcagccaaagtgttggcttttcctgccacgtggacaatcttaacttggtagttttgcaattcaatgagccaccgtgccaattgctgattggtttcggattttttcagcaaaaacgcgaggggtttgtgatctgtgtgaagttcaatgtccgacatgaaaatgaatggtctgaattcccttaaagcataaataatggcactcatttcaatttgaactgccggccacttcctctcagcagcagagagggttctgctgcaataggaaatggcagaaaatgtgcccgtcacgtcatccttttgcattaaaactcctccttgtccagtcgatgatgcatcagtgaaaatgtgaaatgctttgtcgtaatctggaaaaattaaactcggggcttgcgtaagtaattcttttatcttgtcgaaagacttttgttgttccctgccccattcgaatctattgccttgcctcgtaagtttcagtaatggctctacgaccattgcaaagttctcaatgtgccgtctgtaaaagcctgcctgtcctagcactctttttacctctttaacatttaaaggcactggcatttctttgagaatttcgattcgacttaagcttggcttaaaaccttcagctgttaaaacaaatccaagaaaattcatctcatttgaggcaaaaatgcattttttcgggctaagtttcagattatagagccgaaaacgctccaaaactttccttaccgccgttaggtgttctgaaaagtttgggcttttcgtgaaaataagcacatcatcaacgtaggccaaggaagtatcctccaatccagacaaaacgatagccatggcccttgaaaatgctgcagttgcatttttcagcccaaatggcatcgtaatcatttggtacactttgtcttcagttataattccacattttcttgacgtttcttcactcaatttaatttgaaaatagccactggccaagtcaagagagctgtaaaattggcaatttccaaccctttccatgatgctgtcaaggcgtgggagagggtacttgtcgggcaccgtaacttcgttaagtttgcgaaagtctaaacaaggacgaattccaccgtctttcttctgtacaatgacaattggagttacccatggggtatcggactcaaccatgactccggcttctaaaagctgattaatgtgcttcttcagttcctctttgtatttgtacggcattcgccttggcgcagatgcgattggttcctcagttgtggttgtaatgtgatgttcagcagctgtgaaaagcccaagatcatacctanacttactaaaaacgtctgaaaattcttcaattaatgccttcagcttttccaaatttttgccttcaaccattgccttagaaaagtcgactacaaatgtgggtcaatttccattttctttcgttcagaatttaacgtaagaatttcttttgtgctattttccttcaaaagtccatttcggtcacataacagttcgttggcaaatgccaaatgtgttcctttccaaatccattttggttccatggttgggttgaccaccgccacttttatttgtttctggcccgcaggcgagacgctattaatgactgacagtccctttttaataagacttatgtcagggcgatcaatgcaaaatgaattttttgggtttggggttgattcgattgaagcatcgaccaatatttgggagtcggccggaatgagtgtgtttttctctgctgacacgcgcaaatcgttcagtaaaagaatcgaacgatagcacaatttggattcgttgtccccaacaaaaaatttcccgtttaaatgatcgaattttactgggggcaatttttcaaagacatcccaaccgacaattacactgtaatcccgggccacagtaaattcggaatcatccacaaaataaattaatgaacggactgtgtacccagcaatgttcaaattcacctgagcatattctttgaggcgaatgacatggcctgaggcactcattgcctccagatcagatgaaaatgttcgacaattgagttcatccgcaactgatcgtggtgcaacagtcaaactggcgccagtgtccattaagcagcggacgggtgtggaattaatcaatgtctgtaccacggcgtgatgcagcaaaatcgcattcagatttgggagcattggaaggtctgaattccgttttgagcagagcagtactgaaatagtgataaaaatcagaaatggaatgataagcagataaatcattgatggagaagtgaattgaattgaaatttggttattcacatcgggatttgcaaaagcattgggaagacaaactactaaaaacccaatgagtacttttggcgcccgaaaactgaagcgagccctttttaccggtctctttcgttttcctgcaattttgtatgcctgggtttgggcgggttcaatgagcttaacgggactgagctcaatttcgttaccaaattctacagatgcattcagatccatcatattgaggcgtgctggagatttcacaattttctgcgttttatttccaccaaaagtcatgcgtcgtgttgttcctctgccaacgtattcatctctaatcattaatccaaaccggatcaaaaagtctgtaaaaacaatgattatcattatagacaggacgattttgccaatttgttcccaattcccaaacattttgctgcgaatggactcactcacctgctcccattgttcagacagagtctttgttataaccgtgtcctcacttttaagttggaatgtgagttcactttctcttgcgaaattggcgtcgtaaaactggccaataaagtcagacacattcacaagggcaagatgaagaaaagaatggcgagcataagtcggtgccaatgatagatttaggctaaaaccgtcaatgcgattggcattcacctgcttgacctgagcatcaatttgatcaacttcatgaagagaaccacgcacaaaaatgagctgtttgcggtattctgagcatggtgccagtctcgcatcagagctcaaaatcattgttcttgggtcaataaatgccattcttttgttgtccttcactcggaatataattggaatttttgtcaaagcattcgaattcggagtccgctgagtttccaattttggcaaattcgtaatcgtgcgcttgcaattcgatgcatggccacactttaatcaattcaggcccagccacttttgccaccagcttaccggattggaataattttctggcaaaagttgttggatctgagagaagtgccgtcgctgtccatcttctcgtctccaacatataatcacaaatcgatttgattgtctgagaaaaggaaagagtcagcatttctcttacttgttcatccaaatagcccaatttggagttcatttccgattcagtgacccagctctcaagtgatctcgtccttctgcttttctttgaggattcattgctatcggcggatggcaagtcctgtacagcaaatccttcctctgattttattaaattcaggccacatgagttgactttctttgtgttgttcaaaaatgtcaatcgaaaactgacttcatccgaaatccaaatattgtcaagttgtagtcctttccatgtgccaatttttgaaaattcacaggcacgggtagtgttggtatcccacatgagcaatgttttgtcttccatctcacattggcctgccttgaattggcaattgttcactgacccgaggggactttgcat

SEQ ID NO: 4319 - DNA, 3215 bp, Heterodera glycines
aggtgctttcgaatgattaattgacagcttggagcagcccgtcacttccggcaattgccaaactctccccccattttgggtttgacagacaaggggatgcattggcagatggggcatatttccagcagtaaagggcaaagtcattcccatcagcattaatgagatgagcattagtgaagcgactttcgatcgcacacttggccgttcccaatttgacgttttaagagcgtttgtttttgtttccggcccacaggctggggattcactagaggattcttttggtaattcagtttctacctgacaatcccttgctgttgtttcgggtttgatgcgtgtgagcgcattcattgctcccgatctcggctcttcgtttttgtaattgcgattgtcctggattttgaggtcaagcaacgactgggccaagttctcgaaaaatcctggtgaagcgttgtaagaacttgtagcatccatcacgttaacaggattctgccgattttgccattgtccctgagattggcgtggttgctgatttgaccatcttccttgacggaacgattggttggaatttcctctaaaattggcgcggcgttgatggcaattgtacgcaaaatgtccagcacggtcacaataatggcatcgagggttgcttgaccagtttctttggctaaattgctcctggcggcctcctccccaattgcgagagcggcctcgtcctcctcttcctctttgttgttgtctcgtcgcatttgatccagaaaaaggtctaaacccacgtacattgttgcctgacgaccattgtccagcacggtcattgttcgggttcgctcctgtagaccaattcgactgtggtgactgattgctcagcgcatggactgcctgagagaggcgtgatgcttcatcacctttgttcatcaacagtaaagcttccagctcctctgcctgtgctcttaccaagtccaaatcttttgcccgtgacagtcccaccagacggataagaaaactaatgtttggcttcaatctatccagaaattcttcgcaaattttctcttttcgaatttcacctgtcaatgacgaatttgttgcatccaccaaaggcgtcaggcgtctcagaaattgcgccactgtcttatcctccctttgtttgcacagcgataaagttcgttttgcaatttcccgacgctgaggggagtccaatttctgtcgaagttcactcaatgctgagtcaagagtgtccatttgtgcgggcaataactccttaaacagtgcccgaggagtgtccctcagagccaatttaagtcttgtgactttttcttgttcagtgtaagccttgcctgacacggacaggtaatccttgaaacgttcagcccaatcgtcaaatgcaaaaacagactcctcacaaaacatttccaaacctgaccccactgtgggtccgctcgagagcatgttcaggccaaaaagagtcggcccgtcatcttcgtcttcgcttgacaattgatgaattggctcttggttcggtacgacttggttgggctgtgcattgcccattggcgtcacaaacggcgcacgcgacgctctattcaaattagtaatgctaacagtcccacctgaattcgtcccatcactgtcttgttccaacatatcaactctttcggttagggtctcgaattggactttcagagtctcaaaattggcatttgtattggccacgacatctttcacccaattgactttttggttcaaggaacgattcaggtagcgaaaagctctgttcactccatcttctaatttccccatatcattttgagctttttctaaatcagagatttttatcgtggtctttccttgccaaagtttcctatcaatagccgaaatcgaggactcatcatcctttccactcaaaaacatctttgtttcctgcccgaaggcttgggatgtaccaaaggggaactcatttgatgagccccctgatgtagacattcgaagtcgttcagttcgtaataagattttgttttattttgctaaaaaaaaaaaaaattatttggtaatcccattatgcattaattgagagagaaaaaaaaattaatgaatgatagcgggtaatcgaatggatgcgaacgccttccaggaatgggcttatctgctccatctccgtttaaacttcgcctaacaagaacaattaacaattctcaggcgccgcaaaaatgtgtaaagtggatgatctcgcccaatgaaaaatgcggcggcacgtgattacgtgaatattcttatggcgtgaaaacgagagaaaacaaagagataaaatgaactttggaacttgtaatgatctcgcccaatgaaaaatgcggcggcacgtgattacgtgaatattcttatggcgtgaaaaccgagagaaaacaaagagataaaatgaactttggaacttgtaaaaactgtaactcatactgtaagcaaaatgatagggcctaattttcattttttaattggtccctctttttaattagctaaaataatgtccctttgattggttatcagcccgggcctttttgctctcctcaaaaaaaaattgttctattttttttgtctcacttcttctctctctctctcttttttttgcttctcaatcgttgatatttttataaattggtccttattcgtttgctaccaggacttttttttggttatttttggcttctttcactctcttttcttattctctctctctcctacaaataattgtcaaatttgtcaattttcgatgcagtcagcccctttagcatttagactagcccgggcaaatttcgttcttcttttttttgcatttttaaaatccctttagcttttcactagcccggacaaatgttctcacctcttttctcttcgtttttaatgtccctttagttttcgactagcccggacaaattttctcacctcttttctctttttttttaagtccctttagtcttcgactagcccggacagaaatttaaaatgtcagacttctttacttgcgtgtacacgtctttgtttctagccctcaggccagggagatctcccacaaacttctgccggcttacccaattctcagcttcgtcgtcaatgatgggtcgtttctcaaaatgggaaccatttagtgctaccagtgagtgatgcgcactgtgccctaagaccaactatgcaccgtaatcccggatggagtttgggaggaaatggggaaa

SEQ ID NO: 4320 - DNA, 7801 bp, Heterodera glycines
aagatggaagtggggcagcagcaccaaaggcggtaaaatgggcaaaaaacaaagggagacaaaaaaaagaaagggaaagggggcgggagagagcggcgccttttgggacccatcgaacgatcgtaaaaacaaaacacaactaatctatcttatcaacaacactttttatcaattgaatttgaagaataatattttatccgttcccttttccgttcgaaattccaaattttaattgcccttttccctttccaatttttcttttcctcgtctcgtttattttaatttattaaattattccgaatttcatcatttccattgcgaattctctcaccttcacacagaatgctgttacaattgcccgctttaatgccaacatttcgtccgtcaatggacagaaggccagagaaaaggtggggtaaaagattgcaaaaatatcaagtaaatatagtggatgagagaatggaaatgatttgttcagggatttctacgaaaaaatggcgcgcagaataagacgggtcggactgattcggcatcaccaggtgtggacactgtcccacgggatcaagctgtacaaggactcgttcaagggggaggactttgtgctgtggataatgcgctcacagaatttgagtgaggcaaatcatcagtgaaatataataaatatatattaattttgggttaaccgccaaatgaaaatgggtttttgttttcacaatcagatggaatataatacatataagcaagtcattcattcactcgtctttgatgatcagacaagtcatattaaaaaacggaaaactttcattttagcttacacacatcccttatgtgtttattatacaaaacatgtgaattatttaacaccttccgtccgcccaatcacttccccccaccattcgcccactaacattttcatttgtgtatgtatataaatgatgagcatgatgatgactcatattgctttttgtacgttggaatcgctctcttctctctctctctctccctcctttcacggagaagaagccgcgttaaatgagggggggggggggggggtggtgtggagggaatggttgatcggtgaagaatcccaccccgtcccaatggcttccagtgggaaaacaaacacacagaggaagcggaagatgctgctttattgttgttgtattgtggtgtcatttttcaacatttaaattcacatgtatttcccccatttactgtcacagtaaatggcgaaacattataggatagagacggatttgtattaattggtggtccaattagctgttacattttctcctaggccgccctgaagcgttggagacgggccagtgtttgatggagcatcgactgatcgagcaaactgggtggaccgacggaggcggacgacaggcggacgccggcgcactctcgccaatgtcaccgccaatcaatggcaacaacaacagtccggcaaactcaatctcgcgatcattcagctcagatcggtaagaaaagccaaacatgtgacactgttggatttttcaagagatgtttctgtctctgatcagcagaagcgatcagctgatatgaaattgttattaaaagactgatcaactgatttggttgtctcatttgacagtaatgatgaaggagaaaatgtgatcagtgatcaaacttacaaaagtgatcagtaagttattggtgaattctggtcagacaagtgccgagtgatccgaaattataaaaggacaagacaggattagctcaatggttaaggaaactgattagtggcctgatcatgatcagcaattagactgaatgactgacaattgtttgtccagattctaccggcttgtggatgacgaagaccaaagggccccgctgaacgcattgaacagcagcagcaacagcgaggaagaaagcagtgcctccaaccagcaacaacaacaacaacacaccggcggcaatttcagtttggccaacagcagacaaacgtcgatcacgatgcccgttgagggcaacggcacaaccgcggccaaattgacggtgggcgtgcgcgacttcaacacgcgactttgcgcagtgttggagcgcctttatgcactggcattgtccgaggacagacgagtaagcaattgaaaagcctattaaaccataattgtcgcggtttcatcgcgcccatttggacttgctggacgactgcgacacgttcaactgcgactaccgcgagctgtcgctggaggctaactttgtggacattggcgccgcaacggcacaggaaaggctggcgctgttcatcaacctgcacaacatgatgctggtgcacatcacgcacaaatttggcctgccgggcacaatttggcaacgccgaaaggtgcaatgggacgggcacataaatgccccattatccatttggaaatatgccaaaataacacactcacacacaccaatggatttacagtacctgtacagcacatactacaaaattggcggccatctatactcgttgcagtccattttcaatggcattttacgcggaaatcggaaaggcattggcatgctgtggaagccgttcggcgaccatgatcccagaaaagaggtgatggcattttagtacaatttaatattttgaaaaatgtcacaaatgttgtaagttcgtcatcgaaggcggcgagccgctcgttcatttcggcctgaacaattacacccggtcgaccgtgccgatccgagtgtattcaaccgaggtaagtaatactgttacagtaaaccggggactaatctccaacaaatcaactattacaatttccccaacagaatgtgtacgaagaactgaaagcaaacgcgcgggaatgcctctcgtccaaggagtttcttcaaattgaccccaaaacgggcaacattcggctggccaaactgttcaagcagtactcggaagactttggaccgtatacggaagacgtgagtttcttctcaaagcaaacaattcattaaatccctttatccgtggtttctgatttaaaacaaccctcaaaatggggattaaaattcggtatgcttatgttagcttgaacatgatcatggaatttgtgattgattgaatgggtaaatgtttggggcaatgatcaatgtgatcggaatattacatgacaaatgaccaggatgatcattacgcaatgcttttcaggtgctttgttggattgtgcgtctgctgttggacacgtccgaggatcggatgcatttggccaaacttttaaccaattcgtccgcctcgttggccaaccttagccaaacagtgtcctatctgccgatggacatggacctgaacatgagctacggggtggcgcccccgtcctccccatcgttgaggacatcgacagaaaatggagacgaaggaaacggtagggttgtgacggggtttgttgaggaagggtgccattcaaatggcaaacaattcaattgcattcagacaatggccgtggactggacggagtcgtcggcggagacatcgacatcgacggcaccaaagccatggcgaaagaacagcggggggaggaggaaaaggaggagtacaaaaatgtcagcaacaacaatgacaatgaggacggaagaaatgggaggcggcggcgggaagaaattgcggaccgggcaaacaacggcaacaacaacaaagacaatggcacgaatgaaatgccgggaaaattgatgctaatgccaacggatgcaatcgaagcagaaatgccaaatggacaactgacaatgaacacatagcaccagcagaagacagaagaaaagagtgaaaacaatgaacatgaccaaaaaaagtgcgggtttcacacaaacgacagaaaaaaaacatagaaaaaccgatgaaaatggaggaaaaggtttttatttgtattatttgaccggggcgtaaccaaaagcatcgagaaaattgtagaaaatccgacccaaaaaatttgggcctgaatctccaagttacgcccctggtgatcagtagcaaaacagcagcagagaacacatcgcaaacacatcacacataaactttcaacacatttttcaacatttccgataatttttaaaagataaaatggatggaaattcgaattcagacaattgccgaacatttcggtccaaggtgtccaccttcaccaattcacaatgtcccataattattaaattttttttgaaaaatggaaatgccgaactcctccgtccctcccacctgtacgcctcggtccgttgccgcgcctccaagtcgcgcttcacaaatgacatgctccgcttggccctcttttgcgggtcctccagcagaaatttggtgcgcaacgccgcgtcctcgctgaagcccttctcctctataagctgcttcatcgcaaagttggccaactgagtgcagtgtttgaagctgaaaacaacggaaataatttcaaaaaaaaacataaattttatttttcgtgggaagacagcccacccactcctttgggtataatgcaaataatacctttcatagtttccaaaattgaatgaatttcatatcatctacaaacaaaagtttctctattagcccaaaaaatttccaaaatttcactaaaaaagctaaaatattcgtatacattttaacccacacttacgcatcggaaaagttcataaacatggagaaaatgtgcgtttggccatcccgtgttgaaacagtcagcccattggacagaaacaacgagctgttgtgctccattttctgtgatgagaattggtcattatgaaattttttgtaaactttaaccaaattaatttaaatattttttaaaatgttttaattggcaatattcaatttattgaattctcccgagaagaaaatgattcatctgtcatcgagaaacggaatttgaattcataaagttgaagcagtacaacaattaaatgatcacaccgcctcggcttttccgcaattgttagcattttttaatttgaattttaccaaaatgtccgtccatcgaattttgatgcgcgtttgactaccgacaatgaatgcgtagaagcacagaaagttgacggacaagtacagtttgccctggaacggcttgttgcccctccaataagtgcaggaataatctgaaacattgaaaattcatgtgtaattgggggaaatttttatttacaattgacgagtttttcacagggcggcaagtcgaacagtttgagaaacttacgcagaattgcggcatttgatacatgttcaagcactgggaaaacagaataatttgttagtaattaataattaacgtttatttaatcttttatgcttttttatgataaatgatacgcattttatgcatttaattattcaacacaaataaatgtgtcgtctcaattgaagcaaaagacgaaaagaattcatgggaccaatataagcaaacattgtattttaaaacaaacattaataatgctaatttttaaaaaatccgaaaattttaaactagtaccaaaaagcctaagattccactttactaaattcattggcgaagttattttttcaaaaaaaatatgtgcgtgatcaataacattatggaattttgaatttaatttgtaaaatttcaccggcagccgactcggcgccatcgtcctcctccccaccgtcggccaccaaatgttcacggcgttccatttcatcgcgcagcgccaaaaacccgtcaatttttgtcagcacaaatttctccaattcgttctcatcggtgcccaatgactaaaaaaagaaaatttaaacaatttattattttttctattattttgaaaatacctccaaaattggcaacagcgaagtctctaaacattgccaattgtccaacacatcgcgccaatcgacggcaattgcaatcactggaaaatattgggagagatgaaaaacggaagaaaaatttggatgaatttttgtaaaatttaaaaatcgcattaatatgattaacaaaattcccagtttggcccatccccaaattttggagtcattagcctcggatgactgaccccacgcaatttggccctcgtccaattctcgctggtaaatgatgcgatagggtggcggacgagtgtcaaaaattgagtcgatggtggacacaaacaaagccgacagtcctccgctgagcactgaaatttggaatttaatttataatttagcaaaatttaaaaaattcattttcaacccttcgatgaggaggacacgtcgctgtgctgtttttgctgatacgaaaaccgttgctgctcatcttcacgatggccttttcgacgttgaagcacaaaatacgggttggcacgttcagaatgcctaataaaagaaaagtttacgatttttgcaatttgtttttttttttaccaaaaactgtgtccaaataacaaccgttcaggcttaatccaaaccattgaccaaacagtgacagctgcctacagaggaattgttgagagaattaaagaaaggcaggattaaacatgtacaatggcttaacatggaaggaattagcagaggaacaccgaaaaaacgaaatgttgccttttggtaattcaaaattccaaaaatattattttggcataatgtttattttatatttggcataatgttttaaattttttaaatttcgtcatgtgactttaactttggctttcttttaaagtcctgaaacccccgccgaattcctacgtcacagcggttcaaatatgtaaactcatatatttctcttgtttcttacgattcttaataaatttcaaaaattttgggttgtaacacatgctgtctattttcttgcagaatatggcacgaaccaagcaaacagcccgcaaaacccaatcccaaaaaggcttttcgtcgagcagtggcagccaacacatgcagagtcaactgcacaacttgagaaaacagttggctacgaagcgtcccaacccaaaacgagggatcggatacaaagaattgcctcctgtcaaaatagcccaaaaacgtcatcataagaaaggtaatttggctctactgcattttacgcgtccaatcgacttttacgcgtccaatcacagttttcgcgtccaatcaaaagtttatgtgtccaatcaattattagaaattatttaaaatattggcattaaatgctttgtgtgctttttctataaaatttaattgaaaaaatggaatatagatggttttgagatggtgtttattcatcaaactaatgtttttccattttcaggagcattggcacttaaagagatccgcaagtaccagaagagtgtgaatctgctcatcccgcgccgtcctttcatgcgtttggtccgcgaagtcacccaggacatgtcgcagtcgaccgacctgcgctggcagggcttggcactgctggcgattcaggtttttgctaatccgagctcattgtcagttgttacccaaaccgggcaatcatgttttattagtaccgaaaatttttttgaaaccagaaaattctaaaaatatatttctaggggtattcgaggctttggtacgaatccggcctcctttttggccaatccgaacccgaattcgaacaaaaactcaaattttctttttttaaatttcatatgctatattcgtgatcagcggtttttgaaaacaaaaaatgaattcgggttcggtattaccccaagaatcggattgagcatttaaatctttggaaggtttcaggaggccgccgaactgtacttggtctcattgttcgacgacaccaatctttgcgcaaaccatgccagccgagtgaccataatgccgaagggtggaaaagggacatgaacatttggctctagtgcactttatgag

SEQ ID NO: 4321 - DNA, 4262 bp, Heterodera glycines
actgttgttgcattgtgttcgcgaatttcgtggcgatgagaagatccgtgaatacgtgtgggcactgatcactccgtcgcatcgcacacaaaaaaaatcggcaacaacaaaaattgatccggatcaaaagcagcagcaggatgaaaaaaagacagcagcggcaactggggactcaaacagccgctaccaccagggatgggccgctttgcctgaatacaatgtatgtcgtctaatgctcatctggaatcatatactttcacgtcaaatctaatgatttttatgctcacatttcccgggtcatctatgttacaaaatctatgatttttccaaccggtccctcttaatgatttttccactgtcactttccctggtcatctatgttactaagtctatgatttttccaaccggtcccttttcccgtttcatctggaatcatatactttcacgtcaaacctaatgatttttccactgtcactttccctggtcatcgatgtcacgtgaaatctcatgattttccaaccggtccccgtttcccatgtaatctggaaatcatataattccgcgtcaaatctaatgatttttccatggtcccatttcccgtgacatcgatgtcacgtgaaaactcatggttttaccaaccggtcccgtgtcatctttttgatgaaatcatatactatttcacgtcaaatctaatgattttcacaactggtccttttttccgcgtcatctatgttaaatgaaatctcatggtttctcaaaccggtgtcatctatgcttattttagccgccttttatctgcgtggacgcgtccttccaacggcatttgcatcggcactccaacaaaatattgaacagaatccaacaattacatttcctgcacacaattatcgtcacgtcgacgccgacttcggcgacgccaactgagtccaaggaggctcggcgccgaactgtcacataaagacgacaaaaaagagtcagcaaaaggtgctcgccagcaacagcagcagtagcagtggctacgagttgaaagtggaatcgcccgacgcgttggacaaacggcaaattatcgccgaatcgggacagggatcgtgatcgcgatctgttgatcggtgtacacaaacacggtaaataatgccaaatcaataaattaattcaatccatttttagtcttagtatcaattttccgttaaaattatcggaaatcggaatcagacggcccaaaaaatttcggcaatcaaaaatcggatttttttttttttgtaaaaacaacaaaatggttaaatacttaattaattgcttcaaaatgatatttttcaaatgcgttttttgttctaaaggaatggaaaattgggagcaattgcgcgcggatgaaaagctttgttttacccaaaaaagcatccaatttccgaacacgatggacctgaacaatcgctttaaacacctaattaatgtgctgcaaagagttgccgtcgagtcatcagcaaaagcaacggcaaaagccccaccgcccgaaacaccaccatcagtggtgtaagtgttgctggggtgtcgttagagcccggacgggattggaattttgtgggattttcccgtggtccccgtcccgatttttttttttgaagaagtgcctggattggaatcatgaaaaattggggtttgaattagggttaagccccgactccgagccccccgacccgacccgagacgttttttggacctattccccgacccgacccccgacatgtcgtcccccgaggtccccgacccccgactttttgccccccgacactaattcgggggattatggactcggagcgttttaaaaaattcatctacgaaggcggaaaaatattgaaaatttttgagattttgaacaaattttcttaataaaattcattaaaaattacaaaaaactttccggcggcgcctatcggcacccggcggcccctcaaaaccatggttccgatcggtaatttttcaaaatatgaacaccaaggccgaaaaataagattttagggtcaaaaataataacattagcaacattttttcaaatcagtaaatttttacaatttatttgatcaaaattcccattataaactaaggacaaaacgaggttaaaacgaagattttggacccaaaaataagattaaaaaaacggctttttacattgtaaaaacagggctgctaactgaaaattttcaaaacctgcatttagccaacaagattcatcatttggggtcaaaatcagcactttggaaattttagtcaaaaaggaaaaacatgcttttttgtgacgcgctttttccgaaaaaaaatttttgtacacaggtgccggcgggagaattttttgaaaatttgagttcattttgctcacagattttcaccaaaaatgaccaatttttgcgcgattttgagaaaatttttaagaacaattttgcggactggcggtgccgataggtgccgccggaaaaaaaaaaattgaaaattgggagtttttgatagcattttttacataaaaaaattttaaaactataaatatatttaagaaatctgaacaattttcgtcgctaccccaaaatcagaacattcttataaataacgtactcttgttggcgctaaatcagatgattaaagtgaaaaaaggaagatttacgagctttaaaaataaaaattgagttttttgttaaataatttcgttgatcactacccgatcggggtccccgacccccgacaattgagctcccccccgacccgacccccgacatgtcgccccccgaggtccccggcccccgacattttgccccccgagggctcggggcttaaccctaaatgttacaattgaaaaattgttttgcaatttattaatggtacggaaaatagcatttatttcgagcagaaatcttttaagaaaaagattgaagaacatttgaatggaaattgtatttagttatttgaaaatttttaaaattattattaatattaaataaaacatattgcttaaaatcattaaatttaaatatttttattgacactgagaccattttcggttcgaccgaacacctacaaaagactttttggaccataactttgttctttctcaaccaaattaaacatacttattgttcgaaaacatttgaaaaaacttttcaaacatttttttatttatgtacaaaaaaatcagggcaaaaaaaaattcgaaaaactaggtttttgagttccttttgcccataacttttaaaatacagtagtacaaatcgaggtacaactagactcgagaccaagaccaaaaaaatccgagacttttctcgagtcgagactcgagaccgagagtcgcgaacagcactaatccatacccatcttaccggtgccgggtcgttactcaaaaaccatgctcaccttgctgaccataatgtacaaagtgagccgttctcgtgccaacttgaccatgggaaaagcacaaattatgagaaaaatgacaaaaaatagcaaaaaagtgttctgaaagcaatcgcgcactttccccaatgacgacttcacatcataacaagcggacaccattttatggtgcaaaagaaattagaaaaaaattggtgaataaaattaaattagatggtcaaacaaaaattatgagattatgtagcagataaataattttaaccatctaaattgtaaaaattttccagtgatttctatgtaaaaatcgtctaacaaggaaactcgcgaactgtgactcggaaattgcatatgttttatataccattgggtagagaatggtcgacttctatagtgaattttaatattacgggccgatagcaagaaaaaaaaagttatggggcctcaaaagttggaattttaacgccaaagagcccatttccagctctgccaactttctattaatttcccaacctttaaattgactgctatttgcttattttcactaaagaaaaaataccatatcttttttttagtctaaagatgattttaaaattatttaattatattatacattaattaaaatttatttatttttatgggtgctgggacgtttcttaaaaaccgccactttgggcgtttcttaaaaccgccaactcatatgattatgtatataaataaatatatatatatatatatatattaaagtttacataacaataaaaaatttaaaatacatatgcatatctagtgacggtaaaataaaataattatttttatccttctttaaaacgttctccaaaaatatgaactgaccagcataatatatt

SEQ ID NO: 4322 - DNA, 3521 bp, Heterodera glycines
ggaggtcgatctccaccgtttaccaactgattgttagactgggccgtagcccccgcggaaaggctccgtcccatcggtaggccccgggatgggcgttccaatggggagtagcctcaacctccaatcaccattccaatcggcagaaaaaaatttttaaaaattaaaggaaacaaaaaaataaaattttttccttcaggaaatcagcaaattttgttttcagtatcacctaggttttcaaaaaaatttaaaataatccttttttaaatttttgcggcaacgttttgagttgtaccccaacaaattaatgccattttcacatcccctatatgggatattattactagagaccggaattttgaaattgccgggaccgggagcgggaccgagacttggaaaatggacccgtacggtatccccgggaccgggactcccgtttttccgggactcccggtcccggtcccaatttagggccggggccccgtcgggacggactttttcaaaatttttgaaattttgataaaaattcgaaaaaatttttacaattttatattttagcttagaattatatcaagcctgtaaattgactttttttcgcttttaaaaagcacttttttgcggcgtgtttttctaaaaaatttagggtacaaaagggggggggggtccggcggtgcggataggcaccgacgtggaaattttgaaaatttgtgtgtgatttgttaacagatttacaccaaaaaaatgacaaagttttgcgatttcaactcaatttttaagaaaataaggatttttatgggcccggcgtaagaatttttatagatttttacattcatattaagtaattttccccaaaaatgctatgttagatctaattttgaatattttaggtggattttatgatctttttaacagtttaaatcgtagaaaatcccaaattccatcttcaaaattttaaataaaagacatttcgccaaaaataattattaaatttttcaaatttggggaagtttcactggtgaaatttagtcccgtttttccgacccaaatggccgggaccgggaccggggccgggacttggaaaatggacccgggcggggccccgggaccgggactcccgttttaaacgggactcccggtcccggtggtttgcccaaaaaacccgggaccgggggtcccggcaaaatcccggcggggccccggtcccgttcggtctctattatttactcgtaaaaagagaattatcagaaaaaacaaattaggtaaatttttcaatttaaattaactacactcaacagatcatcaataaaaaataacttaggtaactcaactcattttttttttattacaaaacactcagaaaactacctaaataatttgttaattggttttttttttataaatatattgaaaaaggatttagtgttttattcgtgctgggacgtttcttaaaaactgccaagtgggcgagaattaaactacaaatataaaacaactatagagaaatatttttatcaaaattttattgatataagtttttatatatccgtatttcttttttaatttcttattctttaaagtgttcaccaaaaacatgaactgacaagcataacaaattctaaaaaataaactagagtgccacgggaccgggaattttgggcaaaccaggtcccggtcccgtgggcactctaaaataaactatttaaaatacaaataaaacagacttttgttaatgaacattcagcacttcctaccttttttaaagttgcaaaaccatattactggtgctataaagcatgagtcaaaaaatgaagtgccacaataagtgctacaatatttctttgcaactttcaaagggaaattttaattataataagcttatcagaaaaaaataaaaataattaatttatcttttgtggttttcttattagttcataatgaccgtcgtgaaagtacaaaaaacttggcagtttttaagaaacgcccatggtggcagtttttaagaaacgacctagcaccgtttttttacgtaactttttgaagccgaatgatataactttttgatgttggtcccggcaaatgccggatttttgagcaaaatagaatccatgaatatgctatgaatttggaggtccacgaaaaaacaggcagtcaaaattttccaggacctagctgggtacagaaaataccaggcccaggtcgaccgaccctagtctttcgacccacggttggaccacacggtcgggcacgccgttgcaaaggtcggcccggcagcagtacaaattagtgcaagtcacaaatgcatcttcatagtagccacgggcacaagccgaccttgtgggtacacaactcattgaagtgaatcgcactttatcaactgaaaaaattcattcaaatttaaaatccatcttttttttaagtgcatatatttatatttaattttgataagacttgtaacatgggaaggaaggccaaaaaattcggtgtcatttaaatgcgtacaattaattagcaacttgtatcataataattttttattttcaatatggtatattttgaacgaatttccataaacccgaaaatttacatttcccacgaaattagggcggtaccagtgcctgtaccgataccgtaccagctagtaattaccgttttgtaccggtaccgatttttccaagtaccgtcattaccaataatagccggtaaaaatttgcactggtaagaatgagaatccgaggtgaaattattcatgaaactttgcgaacaaaaatgcaaatttttcttcgacgagcattctttttttaaaattattattgaaatttattttatcttacgagtaggaatgcgatttataggtgctaaaaaatgccaaaatagttaggttttaggttctaaaaaactcaccctaaaaatgggaaaatagggccaaaaagtccgaatttaggggtgtaaaatcaaaaattctcatcaagaaaataactataaaaatttttgagatgattttttgagatatttttaattcttaggggtatattttaaaagtttaggatcaagatcaattcttaggggtgcattttttgtttttatttcggcaaaacgccagaataggtgaaaataaattttaaaaaaaaaattttaggttttttaggtgctaaaataaaaacctagaaaataggtgctaataactcgaaaactagcttaacaacagcccaaaaaaacatgtttttcgtgcgtttcaggccacggagagctcagcaaaaaaataggtaaaaacctaaaaatcgcatccctatttacgagctttaaaaatgctttaaattttttggcgaaatgtgcattatacaaaaacactaccttttctcaagcagttggccctgtagcaaaagttgaaccctgctcggcatacagttttgttcttgttaaacaaattcttgctgccgctgtccacccaacatttaagtgctaaaaaatacaatggtcaatctctgacccataattttgaaatttaatagaaaaaaagtcttaat

SEQ ID NO: 4323 - DNA, 1196 bp, Heterodera glycines
tggaagagttgaaaaaacgaagcgcaatttgcgaagattaaagcatcaaagtccactttttgtgtgcaattttttcaacattttgctgttgttcattttattatctatttccatccctttttctccttttctttctctttatctctgactgcccgatttcgcttttcttttaaaaaatcaccaacatttttaatgtttggacattttcatatcaattcattagaatcttgactttttgttttttttccaaaagacattcgacagaaatttgggaagtgtgccgggcccgaaaaaaagaaaatcccaaaatatgaatacttccggtacggacggaattttgggtttagttagccctccatatttattttattacgctaattctcttttgctgtttcccttctcccctcttcgttatttttgtcccctttcttccatgtctaatggaaagttgtcgaaaatgaagaaaagttctaaggagtggcaggtggtcggtcctttgtagagcccggagcaggaccggatcctgcgcaggattttgcaggatcccagtccgcaatcctgcattttttggaaaatgcaggatttgcaggatttgcaggattaatccggccggatccggtccggcaaaaaattttgaattccaatcctgcaacaggatcccaaatttgatttttgtgcggaatccggcaggatccgcatacattctttgaaaattttaaaagacggaatgccaaaatttttgaataaatttttaataaaatcaacaaaataaattcaattttcatctcaaatttcacctagaatttgcaaaaaaatttcctggcggcgcttatcaacaccactggatcgacattaatcctgtagaattgagtcaaaaggtgtgacatttggtcattttttggtcaaaatcagttaattaattgataaaattttcaaaaaaaaaaattcagacggcgcctatctgcataggcggacccctttgttcctagtttttgaaaaaataggcgccgaaaaaaaagcatttttgaaaagcaaaaaatagtcaaatttattgaccattaacagatttgatttccgatctctttttaccgtctgacccattcgaaacatcttagtcgcccttaatgcatcccgccagcccctaaaatttcttgtcaggtttttttttttttggaaatttcattgaaatttttcaa

SEQ ID NO: 4324 - DNA, 869 bp, Heterodera glycines
cgaaggacgtcaagacgcacatgaactgctccgtctctatttcgttgtgctgatactgctcgactttctgttcatttgttacatggctttggcactttgtgccaccaaaaaatattacaaagaattgcgaattgaacagacgcgcggcgtttttcaggtggacattcgacattttgtggggaggacaaagcatttgttcggtatttagcggatcggccaaaatgaccccacggcgccgtctttccaaccgccgacaaacccaaattataaaggatcgatcagctaaagcgaacgaagggcaaaagaaaagcgaacggaagaacaaaaactctgctgctgatctctctatcccttttctctcctccatttccctcataaagtcagggaaggccattaagaaattcctaattcggtgaattaattaataatgagtgattccctccagcggatgtcactaattatcccattcttttaatgttcttctttctcacatttcaacattttttagtcttgtcattgtttagctttattcattttttgatttaacacctcatcttagtaaatgattgacaaaatacaaatattttccatcgcttctctaataatccgtgccctttgctaattacccccctcccattttcccccgtttcttttttatccccccccccctcgaatttgtcagggatgaattatcccaccgatgattcgctcgcaatttgtcccctcccacccgggcagacatttgcattcaaatcgacccaattgcaacggaatacaatacgcgccatttcagcacggatgctcacttttgcctgtgtcggcaatctctgagcaatctgatgcgcgtaaagccggtcctttattttgtt

SEQ ID NO: 4325 - DNA, 1915 bp, Heterodera glycines
  misc_feature (1827)..(1827): n is a, c, g, or t
ggtaattgtcgtagttttggctgaattggattttctttaaagttgcattttggtcacatggcccgccagtcggccattgcccgccacgccggacaatcgcaacgtggtcaatgtgtaaaccctttgcaggtccaccgccaggaagatgaacgcatctttggaaccgcaccaacccgttgaggacatgcgagctttgtgtggctaaagaggcgagggaatggcacgcgatgggatcgaatggaaaagcatggcacggaatggggaatgagggtagaagagggtttagcttgaatccgagttccgagatttttttataatcccaaacccagacccgaaaaactttggccgtcccggtccgattcctgatttttttcttatccagcggcaaccctggtatataatggcacggaatgggattgggatggcatggattgcgtttgatcagtgccaaccaagtcaaagtgaaagttccagagcttgcctcgtagccccaaatggttttgtctgagttgtcagagaaggccccgtccggaatgaatccagtggaaatgccgacatcttcgctcaacacacaggcggtgccaagggcacagctcagcgtgtcgctcgggaagggcaaatagccgggccgattgcaagtgaagcgggcgactgcgccctcttcgattgagtcgagatgcgtttgtccgtcgtcgggatgccccgggtcaactgcgaaattggcattaccaattattacatccaattaggcaacaaatgagcttcttcagcccattcactcaccacagaccggtccttcgcatcgcaaatctgagaatggcaatccaattttgggttggtatcgttcgcttaccgcccaaatcccaagtgccgtccacgttgcaacggatcattcggtcgtcgtacgacgacttcccaacgacggaatagggcagtcggcattggaagaggaacgcactgccaactttgaaggtgcccggcccattgttctcactctcgaaatacgctcccgaaagtgccgggggcgacccacaatcgatcaacggacaaatcacctgtgatcagacaatgggaaaaacatgactgggactgagatggcgcgaaaagcttattgtccagcaaaagttgggactcgagctcacttctgatccgctgagccaatactcagtgccatcagtgcgcgggtcgtaaatgcactgccgcgtttcgcccaaggggctgtgcttcgacggacggttggcttgggagcagacaaagctcagattgtgtcggtacggaattgagatggagtcgggacggacgaacagtccgatggccgtgttgtttttgatgccttggcaagtggcggggacacaaattggcacagtgccattccaattgccatcggaaagacatttcaggtgggaaggaccgcgcatttgatggccaaaatcacagcggaactcgaccacaattggaaaggcaaaggacgaattgtcggaggcgatcagctgaccattttcgggggcacgaagcggcgaacaatgctaaagggcgaaaagggagccaaatagtgagcaattaggggaaccaattaattaatgagtcaatatcattaggaacatttgttttaactcaattaatgaataacccaccctcggaatgcaacttttgttcagtctcaatgaatccatcggtccgttgcccgtctcgccctcgcgcagccgcactccgttctgtgttgccgaggtgaacaggtcgaagccctcgtcgcagctgcaccaatgactgccctgggctgttgtggcatcgatgctcacagccgccgttttgcccatccgaacattncgttgatgtctgaacggacggacactgactactgactgatcacccattggtcgaatctgatcagattaagctacacttttgatcattt

SEQ ID NO: 4326 - DNA, 5840 bp, Heterodera glycines
  misc_feature (5819)..(5819): n is a, c, g, or t
tcagattaagctacacttttgatcatttcgaatccctttcccctgatcagtttatttattctgctgtttatcactgaatattcctttatgatcaatctttctttatgaccagtggtcgctgttaccttcacaagacgatcgttgacagccaagaaattccatttttaagcaggcattttccccattgaattccaacacatccattcgaacagtgcgcgcttcaatcggacgagccaatttaagtgtttcagtgctaacagaagcacctaaacattttgtgaagtaagaaagcttcgaatcgaatgatcaatattttttcttaatctcaggccaaagggagagaagctctctgatcactttaggctggttttatcaaacagctaatctttccactttgactctttcaaatgactaactcagatggccactctccaatttcattcgtcccaatgatcggactctgatcactcttctttttttattcgtacccaatgatcgggctctgatcactctctgctgccgttccgccccttcgccctcggaatgactttcgtttgcaaccgtttgttcattgtccgctaatccttctttgtacggaaccattgggacgccctcttccatggaatagaaaagcacaaatcgaattggaaaaacgccgccggcactcaaatcggacggaatgccaagcgaagggtcaaacactttttcaattcgcaacttttcaattatctttaaagggatattggtgattattaatattagcactttcagttgttctttcactttgggtgctgggaaattgaaagtgaatgatgccgcatttgttgtgccattattatcattttcgctgatctgtgtctccattaagctccgatcatcgcaccatccgcttttggaggcgatcagatggatggggatgggcactccgagggcattgtgtgcggaataaggctgaaccggcaccactccactttccgggcacacttaaattggaaatgctttgctattgaatggcagcatagtgattacttaattggggcgtgaatcccttcagacattggcactgatagcccccgggagtgttcacacattggctcgactttgaagcgcagttagccatcttttcggcacattcgtcgacatcacggcactgtggcacctcaaataacaattggttggtttgcctgatcattaaatattgcggccaatttattcaaattttaccccgcttagtgactgattggccaaacatttaactgtctccgcgcccactgatcgaaacccatttcggcactccacccgaagcgattcgccgtacaacatatccattatctgcccagttaatgccgtcctcttccgattgtccggcacttttttgtcctccatcgaatgccaatgcaattcgccattctccacagacggaagatttgcgcattgtaattctaaaaatgaccaattatggcaatagaatgctccctgcacattgtactgtacttttacattgcggctgggccgctgaccattgtccgttggattggcatacaatattttgtgctccgtctcgtctgtacccggcagaacattggaaactgtagacactaccgtatccgatgccgtcgccaaattgaagcgatcgctcgccaaagttaaacacaggcaacatgggacagatgggtgctgattgggatttaaaggaagaaaataagcaacaaattggcattcgaaagtgccaacttttgcatttcggcgtttgggtccatcggccttcgtcggtgcaaaagatttcctccatttctttgccggaaggaaagccgaagccgtcgtagcagcgaaagcgggcgatgccggcgaaggaaacatttgaggccatcacagcgaaaccattagcaatttgcgggatgggggagcagtaaatggctgaaaaaggcaatgggagaattgctaaatcgacgcttttgacatggctttacgttgacagtccgggatgggctccgactcggaccagcgaccgcccaactcgcacacagtctcaaagtgccgaccacgacccgaaacaaactcggcaccgcgttcgcagctgaccgtcacacgcgtgccgtaggcggtgttccgcgtggagagcaacacgcgccgcgagggaagtgacagtcggggacaacctgcggggattggccaaagaggacgatcaatggacaaatgccggggctgggggggctgacttgtggagaaggaaatgttccatccgacgccctggcgaagttcgtcggcacgccaaaccaattccacgcgactttgacgagcgaatatctgaacaaaaagatccacattcattcactgtctgttttttcgctggttcgctagccgttttggggggcggcgactccgcgccgaatcccttttcgatgggatgcaacggacgcccctcctcggcttgtccatcggcggaatactcaaaaatgcgcagggaatcacccgaatcggacacatcccacgaattgacggccaaagtcagcgaaatcgcttctaaaagcattatcaaattgtgttataaattgcaaatcaaattgtgccggtttgttgcgtcctttttccttaccctccgccgccgtccgttcccacattttttcctccgtttgtgccattggcaattcgatggtccaacgacaaatttgtgccggcgcataaggaaaatgggcgttgccggggcttgtcaaaatgccatgcgaacgacggatcacattgtcacaacctgagaaaggacggagtagtgaaattgggcaatttatcacgagagggaatggcactgattattaccgaattttattggcactttccgtttcggtcaaaataaaagaaaaacactgaccctttttgtatgaaattgaaaagccttttctgttgccaaattgactgctgaagaagtacaaatagaggcgagactgagtggacacaatcagctgggggtccgactgaatgaaaaagtttgcacttttattgcttttcccatggcttttggctcactttgccgctgagtttggccaataacggcgccgaaggatgggccccgtcgtaaatcatcagaaaatctttgtcctgctccaagtcaaattcttcaaccttaatggcaattccgtctttatgccgttgattttccgctttcccaacgcactgccaaagagatgagttgtccctcgggtgcgttcatatgccaaacgcattccatgccatttgggtaaggacggggccaatccggactgatcagctgctgaggctgcgactgaacactcagaagacctccgcatgaagcagacactgaaagaaaagcaaaagcagtacccaacggctcggccaacgaaaaactcgcgaaagagtcgactgaccggctctccacgacgcttggaacccacgcgcttgaattgcgtggtcggaacggaaacggacgaccatccgattggaagcggattcaaatgttagcgattggggaggacgcggttggccagacaaagtgaccaactgaacgggcacaaaataaaatgatggcactgattgcccgcgagtattccctccctccgccctcaccgaaatgctggcattttcggccgggcctccgtccacgacgctgaccaagtcctgatgctgttccgtttcaaatgagtcaaagttaagctgaatgagtagtgtcaaatagagtaatgttgtgtgctttgcctgaatgcgcgaattgagaggtccctccaccacccaacggcaattggctcccgcggggtacggcgacggaaaattgggcgtttcgattcggcccgactcgcccttttcataacgttgacaagaagcatcaccatgaactgttgcaaaatatggtcgcattcagtaggcaaattcttacaggggcaattaagctcatcactgaagtcgccgcagtcgtcgatgccgtcgcaacgaaagcgatcagacaaacatttgccattttggcagaaaaaggagcctaattggtaatgagaggggaggggggggggtaattaaaaagggacatttgctgaattaaaaaaacaatttctgattcggtaaaggtcaaagaaaagtatttaatattaaattgaaataataaaagtgcaatgaaaagataaagaattaagagcatttttattggaataataatttatttattttaccattaaaatttaccttttagacaagcatttctctcgcacacaaaaggcaacaaaaggttacaaacgtccaagctccagctcaattcctccgtgggctgttgatggtccgcaaatacctttttttcgattggttttttcttttttattatttttatttcctttttattatttttatttcctttttattatttttatttccttttatatattttttaatccccctccctctcgtcttttttctcccctcccccacctttgtgcagcttcccttcgtctgattgggctgtccctttgcccacgtgccaacgtaacgtgaagtcggcgtgccatcgctccacagaaaaacgttttccgtgccaattgaattttcaccggggcgatggagcaaaccgatccaatgttcggtcggagaagaaattctttaaatattatttagtttttaaattacatttattgacacccggcagaacgttgagggcgagcgaccaattgggagagaaaggcattctcagccgaagactcaacacgggccaacacggcaccaaaacgggcacagaatgacaacgcttggggccacgaccgttcggtgggcaccgctctaaggcatttagcaccgaattggtcccatccctcggcacagcccaattttacgtcggccaacacaaaaagagggcgctgaaatggcaaagtgaaaattggcaattctttcattttttggcactttgttttcctttcccttcagctgttttgcatcaactttgctaagttttgacggttttgaggtggccaaactattcgccactgcttccaaaaaccgctgtttgcccgcctgagagataaacgattcgtcatcagaggaagaggagggaatctcgacggaagaagcagggacctttgggggagagagactttcatcaaaaatggaatttatttataaaacgaaaagaaatgccaaaattaaaaatggccaaaaatttcatttttttatttttaccgcctcatcggacaacgatttgacaacagagacaaatggtaacagaagaagaagcaaaaaggaaaaacaaattattggccaaaggcatcggaagattctcctcacgtggccgaccatccgaagaaaaggacggaaaacgctgaaaatgccaaaaagtgaaaagagaaaaatggcgcagattttgggcagtgaaagaacggaagagagcgaatgcgaattaaattaaatgtttatgggttctttcttctgtgttatgatcagtcgagcaaagtttgcgcgaaatttgtgttgagacatttcaaagaatgcaaaaggaaatgggaacatttggggtgactgaaggaagagtgatctcgatcgaatttgatgctgcaaattgtttgatgcgtgtgggcagcttgatcgccgcggatcgaccacttcgagagtggtcggccttgggcgacagaatgtggcggagaatggcgggggggggggggaggaattcggcagaatgagagggaaatcgggtggatgagccaaatgccaatttggacgggggggaggtgagcaggacaggaagaacggaagagctgatcagtataacaaatcagccgatatatgcccctaatctccaaactttgccaactattcgtatttgtgccggaatatgnttaattgaactaagggaacca

SEQ ID NO: 4327 - DNA, 1666 bp, Heterodera glycines
  misc_feature (636)..(636): n is a, c, g, or t
atagaaagaaatctagatttctatcaaacagacttaaatttctccagtgaaactgcctcaaatttgaaaatataataattattttggcgaaatgcctttaatccaaagtttgcggttcgagatgttgcacaagcgtcagattgaaaaagaaaagcttcacaacaaatataccaaaatttaattttactttcacatataaatttgctatcgaaatttataaagttaacaaaaaatgtatacagtttagaattttttacattcctttttcaccttgtaagttgaaaacataccgttattagattttcagggtcgctggtctcgaatccggcatccatttcaaacaatttgcgaccctggacccgatctcgagtaaaacccagaaattcacttttcactataattcagagcaacgactggtgaactcgattataggcatttgcgtacgcacgcttgttatattacacaaattttgaaaaaagtccggttccggcgggtgcccggcaaaattttgaaccgggacgcccggtaaatgggcgtttcttgaacgggcggcccggctccggtcaattgtctgatcccggttccggtcccgctacttcggtctctgcttactatataagcatttatgaaaattangttttcaaccaaatatttattcaaatatatagtttcaaaatctaaatcacgttagcaattatttaattgaaccgttaaaaaataccgaatccctaaaactctaaattgatcactgcccacatcaaagcattgttcaaggtcgacgccatgttcgatgagaaaatccactgaaaattaggggggggggggaacacggggattaaatttttggcatttttgccacaattttttccaccgatggccaaatgtcctcggctttcagcgcaaatcagtgcagtggctcgctcttggatggtttgttggttgacatctgcggcccactcctccaccagcagatggcacacctccaaatggccctcactgacagcgtccttaagtgtgaaacggaatcctgaaatttagagacaaaatcgtggcatggcatttttgagtactgtaaaatccaccaccgtaatccatctgttcgacatttgcaccatgtgacagcaacaagcgcacaatgtccatctgaattcaaatggaaatgttggaaaatatttcgccaatgaaccgggatgggatcccgggaccgggactcccgtttttacgggactcccggtcccggccccagtttttgggctgggatcccgccgggaccgggactttttcaaaatttgtgcaactttgattataaatttaaaaaatattggtaatcttctattttagcttgggaataggccaagcaatgcaacgaccttttttgtctgtttttaaagcacattttagggcgcgctttttccaaaaaattttgggcaattaacggtgagggtccggcggtgccgataggcgccgacggggaaattttttgtaatttttaatgagttttattaatagattttattcaaaaagaccaaattttgggattctgcgtcaattttttaagagaataaggatttgagggatcggtggggaattttgcagattttacattcatttaagacatttttaacaaaaattgcaatttttgaatagggattctgggatcttttta

SEQ ID NO: 4328 - DNA, 1460 bp, Heterodera glycines
cgaccgggacgaatcccgggactcccggtcccggtggtttgtccaaaataaccgggaccgggagtcccggcaaaatcccgtatcccggtcccgtccggtctctagtcggcaccattctcgatgagaaatgagactgttgtgaaaaagaaaaatgacggataaaaattataattcaaaaattgaaaattttggtctaccaatttccatttgcgatcttttgcaagcgtgcatcagcggcgttgtggcagagtccgttcccaagtccacgttggcaccacgggcgaccagcagacggcagagtggcaaaagtgcattgtagacagcaaaaaagaggcgtaatatctgcacacaaaaaagggaaaacaacattatgtccaaggcagacaacagatatttaatctcctgcattttttagttcaaatttgttaaattcgaaaatttgaactttcgactttttgttcgaattcgtccgggtttcggaatttttcgaaatgggcgaaagggtgccgccggattcatgatccaaaaactgtatggtaaatatttcatcaacaaccacccactctggtgtgcgtcgttggccaccggctcattcggatctgtccccctctccaactgaaatgacatacaaaattagtgtcgaagtattattaaatttctttgatcactaccaagagatcaacaattccgatgtgttttcgaaaaaaggcactccaaagagctgatcgtgatcgggtgtccattggatcaatcgtccaccacagcaaaatgttcagctcgtcggcgtccagcgaatcgatcagcacacgaagttgttggatgttgccatcgttgatcaagtcgaagaagcggcgagcgcgcgtcccgaagttgtccacaacagcagcatatcagcagtgggatgttcagcatctgccttaaatgtggggggaaaatcagttattaaaaaagaattctgggttgaaaccggggagtgggttcgtgatcattgatcagcgaccttgaaaatcccaggtggaaagatgatttttaaaaacaaaaaattggaaaatagaaaggaggcactgaactttttgtaagatattgcaatcacaaccaaaaaatcactgttaaatgatttcatgaaaaaaaactttaccatgcgaatcagcgccgttgaataacgacgacgaatatgcaatgggaataatagtgaaaatggaagaaaagaaacgaatgaaatggcggaaaagggaaatgtcgcaacgcttttatatgcccatcactatgggtcaagcccagtgttagacaaaatggggtcgggctcgttttcgtacgggccgttttcgtacgagcacaagtttttggttataacttttttctttgccaaccaaatccaacattgttggtgtcattcgatagccctatgtatcctctattagcctgcgaaatttcgaaatatttcgttaaggttcataaaa

SEQ ID NO: 4329 - DNA, 2298 bp, Heterodera glycines
ggctcgaactttttttgaacttgacgccttttttggaattttgcaggctaatagagcatctaaagagctttcgaatgatacctacaatgttggatttggttggcaaagaaaaaagttatagttcaaaaacttgtgttcgtacgaaaacggcctggccccgacaaaatgaattgaaacgccaaaaacgatataatttgcgcgctaattcaaaatttactctgatcactgcgttttcgtattgtttatttgctcagtcataactcgcatcattccacactaaacctaacaaatttggtatcattcaaaaggttttgaaaaggagaatcgttttctaagcaagtgctaagcaattttaaatcacagaaaagaagttgtgagactttcaaatttgcattacgttataactcaagtcctaggccactgttttttttttaatcaaaatgcaaaattggttctttttatattctaaaagatcaaattaatagtgacaatggaagacaaagacggaatgaaatgacgaaaatttaaagtgtcaaaatgctttttatgccgcccaatcaagcactcccaaaaaaaggtgcaggatatagtccgaaacttggctaaaattcaaaatcggtcccaaatttttttcgagcgacccggagtatgaaagtgcgaacttgacatttttgcatgccacccatttttattatatgtacgtctgacaatttcatagttgctctataaagtcaattttcgtggtccatttgcgctgacaaagctatcggcgccgccgaaccctaaaaatcttatgttttcttaaaaaataactcaaaaaaccacaaaattttgacagtttttctacaatgttatgggagttgaaaaatacaaaattgggtgtattttgaaaaacggtaatactggagaatctgggctccatcgcgtaaaaatttatgatcgtctcttaataaagttcaaaatgcataaaacaaggagagtattttattgagcattatacatacatacagagtacatataaaaaacacacattccattgtacaaatacataagcatatacagaaaacagccgaacaatgggatacaaatatgatcacaacaataaagaattttttataaatttgaaaaaatttttatttggggcccaaacgtggggggtccaatcgtgagggccgaactgacgtagaccgggacaaatcactatttatcctacggatcatgattcgggcgcccattcgccaaacttcttgaaagatctgatttaaaattgttgatttctttctttgccacctcggctaaaaagtgaccaattgtttgtttatttcatattatttctttattttcggcgtcaagcttttgcgtataaatgattgattcattaaatttataaacattatattattctgtttacatacataattcaattccgtgaaattgcatccaaatgccaacaatcaaaacatacaataatgacgtctaaactgataaaattggcggaagaaattcgaaaacaacggaaatgggtaattaaataaaaattgttttattgattaaacattttatttaaaagcccctttatgatggctgccatattatttctgcccattgattgccttttatgaataatttagcctaaatttacaatttttatttttaaaataaaaatatttaaattatataatagaaaattttcatttttaaaaattcattttatttaatcttctaactaaggctaaaagcataattaatttgaaaggtgctatgacgttagtcaaaaaccatcataatgggcgttagtcaaaaacccatcaaatcagacatttgacattttaatgtcatttactgatttttttttataaaatcaattaagtaataaatttaaatatttgcctttaccgatttcaaatatatttatataaatatattttatattgcagctatataaattccttttggaatctccatcatattagaataaattaattttaataattatttattgtaaataatatattataaaaattatattaaaaatgaaagccaaaaataatatatgcataattagaaattccatttaggagcggatactatttcacttgatgagagcaccaaagtgtagaaaattataactttcgtaagcgtggaccacaatgagaatttttcatgaagatctgtgcaagtatgtactgtattagccattataaatcaaataggtagattgattcaagtggagatacattaggaactttcttttttaaggcggacattatcttttttacttaattgcttagcattagc

SEQ ID NO: 4330 - DNA, 2811 bp, Heterodera glycines
  misc_feature (42)..(42): n is a, c, g, or t
acaccatttgaaacatatcaaagggaactaaaaaaagaaatnttgtaaaaattgaaaaatatgtacatagatttgtacaaaaaaggaggaattatatatgaaaaattatataaaattgaactaattgtgccaaaatatgtggaaattgtttttttcttttttttaaatttttataagaaattctaaaagttctaaaaaccataatttatcggggaaattttaattaaaagttcggttgcacaattgtaaatcaaacacatttcatgcttttcaggcgttaaaatattttaattgtttatcctcctaatcattgccagggcttttactttttgaaaaatcgattgttcgggggtggggcgtattatttgaaattaagtagtttcttagagttgcattttattttattgcatttttcaaaataattttttattcccaaagtgaaattgcaagttctcgagcaaatcacaacttaattaaaaaatattaggagaagtttcaaataaaaaaataaaaaataatctttaaatcattaaaaattgtgaaaacaaattggtttcaagcattttttgattttgagaacgacataaaaattttagaattttattgtaaaaaaatttttaatgtttgtatttgattttgattttttttcgtatttcgtattttatttttcgattttcaacaaccctgttttatagccattagttttgcctgagcgcatcagtatgtcacagaaattatttgaataattctgtcgaattggttttgtgtatttatgaatagataaaatttcgtttttctttttttgttttagttacattttttagtattttattttacgaagtgtgtgttataaaggagggcgatcattgggacggaataaaatcggttaaaaaatttttctgcgtccgtaatttttgcgtgagctgtgaggttacgtatcagacaaaagaacggcacagaatggaatgtaaggaaagatgcaagaagtgctgtagaatggggttcgggtttccatgtgcggatgtgtgtgctgggatttattgcgcggagtgtaatcgcaacttctacaatacggaatgttttgagtctcacaagaagactgcttgtagggagtacaaaaatgcgaaaagtgtggagagacacacaacacaaggaacaaacacacatgtggggagaaattctgccgaatttgtaaaatttatcatccaaagcggggctgtttcatccagaagttaaaaattcgttcagcgaggaaatacagaattgttgcatatgatcttgagacaacattgtataacggagtccatgcaccgaatctcgtttgcgcggcgttgacatgcagtgagtgcgttggagagaaaaggaaatgtgagatttgtgaggaacagaggatgttgacttggtcggcagcaaatgtggaggaccctattggcggatttatcgattggattatgggcttcaaacaatttgaaacggttgctttttctcattatgctggacggttcgactcacatttcgtccttcgtgtgctgacagaaagggggcttaacaccgaactgatgatggcagatctgaaaatctatcagataaaggctaagggtgtgtactttcgggatttctggttgctcagccaaaaaaaattagcggatcttccaaagaccttggggctgagcaacccggcaaagttgtactttcctcataagtacaaccaaaatgagaactttgggaagagattgtcacacctgccgccttttgatgattacaatccgaatgctatgaaggaggaggactatgagaagtttgaaggatggtataacgagaattttgagaccgaatttgagctaggttagagaaataaaattttatattttaaacacgaattttttaggagaacagctcaaggtttactgtcaaaatgatgtggaaattttgatggaggcaattttgaaattccggcaattgtttttggatattactgacgggatggatgtgttgaaggacagtgtcacaattgcgggggtcgtgatgaggatattcaggacgaaattcttgaaggacaggcacattccgatcatgccggagggaggatatgagagagccgagaatcagagcaaaattgccgtgaagtattttgaatggttggcgcactgggaaggcctaagagtcagacatgcggaaaatggtggggagattaaattcggggacctcaaagttgattgcgtcattggtgggcagaaaagaataattgagtttcaggttttttaaatagtagtcattcgtttaatgtcagttcattaaggggtgtgcgtaccatgggtgcaaaaattgttttttgccctgggctgttggaccgaacgggctgtgcatggaagagaattacagaaggacagagatgcggatggaagcattgagagatatgtgtaaaaatttcagagtggatgaagttttggtttgtcaatttccaaatttattgataactgaacaaatttaggaatgtgaggtgaaagcggaactgaagagaaaccgagagatgaagaggttctttgaaagtgtgccggataaggggccgatcaatccgagggatgcttacgccggaggacgaacaatgcctttttgtttgtacgcaaaggctacggaagaagttgagatatcaatgtttgatatcatcagtttgtaccccttcgtgaattatggtaaaaaatctgcttaatttttgttaaagtttcctttcgcttagacactccttatcccgttggtgtcccaaaaattgaggtggagcaggaattcaatgtgaattggacggcgcccgac

SEQ ID NO: 4331 - DNA, 1042 bp, Heterodera glycines
atttgtgcgagaaaggccaagaacgaatttgttacgacgaaggatgtgaaaaaatgcaaccatcgaccagagcaaagagcatttttggggacgttcacttcgattgaactgcggaaggccttggagttaggatatagggttgttggcttctatcgggcatattactttgagcaatttgacaatcaattgttcaaaggatatgtgcggatgttcttaaagataaaggtggaggcgtcggggtggccagcggaggtgaagagtgaggaggaaaagagagcattcatcgagatgtataaggcgaagtacgacatctgcctcgattatgacaagattctctttaacccaggtcttcgtatgatagcgaaattggtacgaaatacataaataatcttttaatcagcaatgaaaatttaaggggttgaacagcttgtgggggaagttttcgatgcgcaacacgctttctacaagtgaggtttttaacagcatggaacggtgggtcgcattgtcacaagacaatacgcttgatgtttcgacgccaatacaaatatgtgaaggagtagagcgtgttgtatatcgtaaaaaggaggagttcataaaggagaataaggtgtcgaatatagttttatctttgtggactacgagcgctgcaaggataaagttgtacgagtatatggagcaggtctacagggaggagggatgtaaaccactgtattgtgatacaggtgtttcattagaaaaaatttccataaaattttatatttagattcactggcctttgctcatcggaagggtcggtgtccattgaaggaggggaaatttttggggtaaaataaaaatttttgaaactctttaaattggttttaagggagatgactcgagaatattccgatagcgagattttggaatatgtgtcagctggtccgaagcagtacgccctgaagctcagaaggaagaaagatggggagatttgggaaaagaccaaaattcggggattcacgttgaataggtccaacaagatgcggtatgaagaattcaaggagat

SEQ ID NO: 4332 - DNA, 3300 bp, Heterodera glycines
  misc_feature (5)..(5): n is a, c, g, or t
ccgcncatagggtcaagtatatacaactgtgcaaaagacggagcgaattttccaggtaataacccaatttttcgtgtgaattctccattcaacaaataacatttgtcaccatcaagagacgactcatgatagccaacagaaattgatgcaaaggccaacaatgaattataaacattttgatgggatagaaattcctttgattcggaatcttgacctgacaaaaatcttttcagtgttggtggaagctccccatacggcggtaaaacaacagatccatgattacagcaaaaacttgaagaaaattttccttttcttttttcagcttcactattaagtaaaagagcgttacaatattcacatattttgtcgccaagatttcctgagtcataatattcggttgtgtgctttactcgcacatcagcacaaggatttcctttgtgttttaaatgacatcgccgagtaatttcatttaatttggctttcggaaaatttttctctatttcagaagactcggaactttgtcttttttgaagtcggattgatcgacgtgttgctatgctcgaaacacttgtggaacgcggtaacaataccacctctggagcagtgtcgaattcaggctctacacaaataaaagctgcatttccatcccttgggcatgtttcatcaacaactgactccacattatacaaaggtaacgacggattttgaaccaattgatgggtaatcaaattgttacgtccaacatgtgccacatcattactatataataacttcattaaatgccaaaggatccggtgcctttcaacattaatgttcaaatttggtaaaaacaatgaaccgctcagcaaatataattcggaatataaaattacaaagacgccgcaattaatgccgtcattctgacgtgtgaattcattatgatttaaggttcgaatattaatatcagtttgtgaaagcccaggcgttaactcgcagattccctttttaattatttctgttttgcggaaatcataaagtggatattgtgtatcagtaaggcgatcgtaatctggcagagaatcgataaacaaacattgaatattttcacgatcagatctatcaaatattataagtgcaaagtgccctgggaaaattattgtcataagcaaaatatcataatcattcgaataattataacagttgtctaaagcattgtaatcaaatatatgcatgccaaaatgcatgtttaagtctgtataaaggggatttacaacaaccacttttttgtttgtaatcactctcgtgagatatcgttgaaaagcaaagatcaaatcctcagtaaacatttccttattgtctttccacatgcttgagattacttccttattgacaccagcaactgtcacacggtcaatatcaatcattggttgactaattggaaattgaatagattcagaagcgaataaattcaacaaatcattagcttgtggatgattaataacttccatattagctttcgaagtcgtagcaatttcagatggagaaattaatagttttttcggtcggcccgatccgctgtgcatgccatgcttttttttgggacgacctcgccgaatctggccacatgaagaagagatgctgctcgaatcggaaaattttgttcgatttgaactcacagaaaccgaagagtcacgagaacattccatattttccgcgtcatttatttttgggtaacgggaatggaaaacgattttatcattactgtataattcgtttatgtgccataaaatttcttttcttttcttttaccaaatctattggctcaagaatcaatgatcgattattgaagagccatgcctcagaaaataaacaaataaagtagccgcaactgtttaaatcggactgctgtgaaatattttcactgatggcaaaaatttcatttatttctgtaccagataaataagaaattgcaaatttaatcaaattaattctttcaggattggaatgtttacttgaatgatccaaccttgatggattttcgcgcaaggaatcgacaaaaaaagccccagcttctttatcaaatattacaagtgcccaatgattttggaaaaacaatggaagaaggaccagctcgggagatttttttggatcataattatagcagccattttttaatgtcgtttcagtccttgtcatacgtacatttggatctgtgaaaactgaatccaccacgactgtttgtttctcagactttgacgcaatcatacagagaaaggcaaatgtgaactcatgattcagccaacaattaagattttggaataatttttcgattaatttggtgcttgtctcagtttcatcttcgtaaacccttaagccagcccatttagcaattttagcagaaaaatgaatgttttcagcataatgaagggaactcaaagtaacaaaatcaattgggttttgattttttgtgaaaaaatgatccatcttttgttttttcgtaagaggcagacgggaaattgtagcccttgaagttcgaggtgtactcaaaccaattttttgaaatggattgatcattattgtctgaaaattttctgacactgttcgttttcttgaatttaagttttgtgatgcactcaaatttaaaaattcagtgaacgcggaagcttcactaagggacgagtgccctaaggaggacagtggtcgatcctcagtttgcgtcttcctcgcatcacgtcttcttcgttcttttgagggcattttttaactaaattcaaaaagataaatatatcaatgaatgcatcaaaaataaaaatggataataaccatgaaatgatgcaaaagagagatttattaatgaattaaaatagacataaacaaaactattatgccttagtgaagcttccatgtacttaacataaactggataaattcaaccaacaatatatgtaaaagaaatgtttatgagtacacctcgaacttaaatagtcccttcaatgaactgaaaacattcattttcaaactaaattttttaaaagagctgttttgggagtaacacatgaattgaattttttttacttttgaatttagtgtgcggcacatccgcgtcactgggttcatctcactgagggggaggggtgttgcggtacatccgcgtcaccgggttcatcgcactgagagggaggggtgttgcggtacatccgcgtcaccgggttcatcgcactgagagggaggggtggtgcggtacgtccgcgtcaccgggttcatcgcactgagagggagggtgttgcggtacatccgcgtcaacgggttcatcgcactgag

SEQ ID NO: 4333 - DNA, 985 bp, Heterodera glycines
ataaactcacaatcagcgcaagtagtgcttcttgagaatgtcgacgattacgcaggcgaacattgtgaggccctcgggaaattgcaaagcaactgaaaaaatttaaaattttcaaaagaataagccaaatttccagatgtgtgttatcaaaattttggtttaaaacaacccctaattttttaaagtaaccttcagaacctaaaacaaaccgaaatccaaaaaaaacaaattttttttttaatcgatattttagctaattattttgaattttgacacaaattttgaccaaaaatggctcaaattttttaagattaaattatccatcttctcacagtttcgattatttttaaaattccgaaaatgaggaaacctgcaaataattgttaaaaaattatgttttgtgtttcaaaccaataaattaataagctcagaatccaacatcaacaggaattttgataaaattaaacattttctagctaaaaaattacaaacacatgacataaattttgaggtgaaaatgggccaaaagaatttttttttttaattgtaaaggaaccaaagccttcagaataattttctggcaagatttagaaataaaacgaagtttttagaaattttacggtgaaaaaaaatggaatttctataaaaaattttgcaacatcggtaaccaaattttcggtaaagagtttttttgtgaaaaactgaatagcccgtcttatttgatggatttttttgtaaattttataaaaacgtaatattcgatttaaaggcccattagaaaatgaacaatttttgtaaaagagagggggggggtggcgtgtaccaactcaaacaaattgagcgtaaaatgacttaaaaatgtaaatagaacccaaaaaatttcacaaaaattgatattccgttggctggcctccttgttcaaattctattttgggtgggcacgcattttttaattaaaaacaaaacaatttgtttttcgcagacc

SEQ ID NO: 4334 - DNA, 1462 bp, Heterodera glycines
aaaccgaaatccaaaaaaaacaattttttttttaatcgatattttagctaattattttgaaattttgacacaaattttgaccaaaaatggctcaaattttttaagattaaattatccatcttctcacagtttcgattatttttaaaattccgaaaatgaggaaacctgcaaataattgttaaaaaattatgttttgtgtttcaaaccaataaattaataagctcagaatccaacatcaacaggaattttgataaaattaaacattttctagctaaaaaattacaaacacatgacataaattttgaggtgaaaatgggccaaaagaatttttttttttaattgtaaaggaaccaaagccttcagaatagaaataaaacgaagtttttagaaattttacggtgaaaaaaaatggaatttctataaaaaattttgcaacatcggtaaccaaattttcggtaaagagtttttttgtgaaaaactgaatagcccgtcttatttgatggattttttttgtaaattttataaaaacgtaatattcgatttaaaggcccattagaaaatgaacaatttttgtaaaagagaggggggggggtggcgtgtaccaactcaaacaaattgagcgtaaaatgacttaaaaatgtaaatagaacccaaaaaatttcacaaaaattgatattccgttggctggcctccttgttcaaattctattttgggtgggcacgcattttttaattaaaaacaaaacaatttgtttttcgcagacccgtgaaaatttctaaaataaaaaacggccttcatttttttcaacgaaaaattggattagtaaattatattttttaaatgcgggggttcaaattccgtttggatggtcccgtatttattttatgaaagcaaaacagtaggatttttataaaaaatggtcattttttcaggaaattttttgttaatttgtaattttgggatggaaaaagaaattcgttccggccgtcaatttttgtgtgtaaactcctcgcctggaattgctggttgatggactgcgtgttcacgtcaatgctgctcagccagtagccgtagcccgggttggagtggtaccagtcgaccacctgtgccaaaaattttaacatacgacaaaaaagccgttttttcaaaaaaaaaaaattttttttttgtttcttttttttgttcgagttttcgccgggcttaaaatttagtaaaaataggtcatgggttagtgatatacaacccacaaaccataataaattgttagaaaaatttctcaaaactattacccttttttcagtgaccaaaaaaccggcaattaatgacctttttaaactcgaattttttgagaaaagggattcagaagcttagctattgcttaaaaaatttccattttcatccccaaacccaaccggcatcgcaaaagcgtccagcgcaataattgtgttggcgtccacccggc

SEQ ID NO: 4335 - DNA, 1935 bp, Heterodera glycines
  misc_feature (1906)..(1906): n is a, c, g, or t
aaaagtcaactaaactttttgcatttttggggttttccgaaggcattgattgtacgaaccgccgcccgaaaaaaatatatgaaaatccgcaataaaaccttaaaatagtgcgggtcctgctcccattgcttcacattgcgtatcatccgttgctcttcttggtcaaacttgaacatggagtcggccatttttaaacgtgaaaaattgcaaaaaatctaaaaatcataagtgaaatttgtgaagtacccaatctgaaattcagctattttcgactatagtcttgaataatcctttattaattgcttaaagcagagaatatagtttgataaaaatttctatagacttcaaatttggtctgatatggtgaatatatgtattataggacctaataaactgagaatgatcattaaactgggcgcgtaaagtggaacagagcccaaaaacccgaatttcaacagttttttaattgaggataaattgactgttgtagtgtgttacgtttttgttacacaacaactcctaaaatgtatccgattaatgtcttgaatgttttgaatgtaagataaaaatggtattgattcagtccccgtccatttttgaaaaataaataaatcagaatatgaatcagtgtgttttttggggttgatgatcacaaatacgaatccattttgagtttattttaaacgcggacccgaatttgaacgataaaacttgaccaaaaattttttcataaggtattaatcaggcgttgggctgagcatagcgaagacaattttcagaaaaaacaaattttgcgattttgagctttttcttttgcgcattttttggaaaatttttcgaaattaaaaacaatcggacttattaaagggaattagagtcaaaaacctaaatgtcaataacaaaaatagtgaacagggattaattatgcaaattagaaaagatatgaaatcaaaagaaatcttgaaaaattttgttaattagtttgttgaaatttgaaattaaagtgaatgaattactgataaaaaatattttgtgggggggggggggactgttgcttatgtatgcgatacggcacgcaaacgcattcggcttttgtctgcgatgtgcacgcgcgcggagatcaccagatcaccacttcgctgctacgaatgggcgtgtcatccaaaaaaggcaataaaaggcggcaaatctgcgcatttggcacatttcggatttccgcaaaattttacatttttttcgaattccccctatcgtgactgcttgtttagtcttgaatttagcaatttttgatcaaatgcctctaattgtcaaatcaacaaaaatatcccgaaagggtggccgtttgccttcgccaaaattgctgaccgaagccgaactttgggagcaaatccgagacgttcgtcgacatttcgtcctgccttcacaggaaattgccaatgccaacactcaaaatgccgatgaatttacctcccccaattccgttgccaatattcagaaccccggcaacagttctcaaagccaagtcagcctggcgccgaagaccaaataccctccgcttcacccgcgctacttttcgccaaatttccgccgtgatcgccgttcgtttcaccgccactcgtcgccacgccgtgctcctccatatcgtcggcgtatttcgccaaaccgtccgtctcctcgtcgccaaccaaaccgtgtttccctttcgaattccgaattgcgccgctttccttccggtcgtttttttccgcctcctccgatgccattgcccgtggaccgttctttgtcaatgatgcctaattctacccctttccaaccaccacatcagtatcatcgttttgaaatgaatttcaacaattgtaccttgactcaaaatttttcaaaaatgtgattcacttatttttcgaanttgtttatttcattttctgttgctttaaa

SEQ ID NO: 4336 - DNA, 3952 bp, Heterodera glycines
attttcgataattgtattttaatatgtaaaaaatgaatatatttgtgccattcttttctttgattaattttagcaaaaaatcattaaaaagaaatcttttataaaattggcaatttatttactaataaaaaatttatttcaattttttttactgatatttaagtaaaaatataattagaaagattttttataaatattaaataaattgcataataaattttatatttttgtcactttcttaatcgatgatatattaattgattgaatggcattcattcacattacaatctatggcataaaaatgttattatttgattattatgcatttattttattgaaataggcatattaaataatccactaaataatttttaattacatttttataataattcctataaaaatgaatgctttatgtaagtacacttttatttatcacaattattttgcattcaattttaatttaaacaattaaaattatattaattaacatgggtttaattgcgttaaattttattcaaaaatatattttgtctacacaactttgcccgaggggcaattcaaaaatcgtcgttttgatcattgatcacttggcggctccattcttattaccgtatccgaacacagtttttgtgccgtgccaatgttttctgagcccgtgccgcgccattttgacacaaaatccattaggaaaacatacacacacatgctcttcaccagagcaatgacatcatattccatgccaatcccagctctatctatcatatcatgccaaaaactgaaaaattttattccaaaatgccatttaatcccttccagagtcaaaatcccagttgagagcggagacttcggcactctgagagtgttagtcacgtgccccgttttaatgagtggcctcaatgttcgggacggccctcaattagtcattttttgactaattaaattttttatttaatttgtgccattggcggcaatttgttgttgttgtcacgtggcggcacggatttttagttgattaattttttcttcagcagaggataaaacatttaaatttttatttgtccattcgtttttttggagagactcattttatctgactttttttaaatggatttttcggcacaaaatgccattcagatttcgatctaagtctaagtaattttccggataaaaaaattcttgagaatacttcttttaaaaaaaaactccgtttattgttttttcattatttcattttaacagtacagagggacatttttgaatatccctccgctgggagccgaacccaaaccctcttttttctcaaaatggtcgaacccactgagccacagataaaccctcttttagatctttcgaatccgatcaagagaattttgatcatcttattccaagaaaaaagccacctgaattttaatgaaaatggcacacattttcacgcatcaaaaattttttcatgccaaagtgtcggattattaattagaaaattcgacgaaaatgatttttccttataaatgacgtcacgtcatcttactcacatttttattaatggcacattgcttttatcacacaatgccaaatttgtttctctgttttttctttaaattttcatgttttccccgtgccaaattttgtttctctgttttttctttaaattttcatgcattatccaaatgccaaatttgtgtctctaattttatttaaattttccatttttaaatttaaatcaatacactttttttccgccattcagacggttcagacatggattgtggcaacaaacggcctaggacaacaatttcggcaaaaagcctggagacgctgaagctggcctaccaggacagcaagaagccggcacgccatgtgcgcgagcagttggcctcccagaccgggctggacatgcgtgtagtgcaagtgtggttccaggtgggtgtgcggcacggcacggcattgaaaattcattttttgcgctttcttaagaatcgacgggccaaggacaaacgcttaaaggtaaaagcaatccatccatccatccattcatcaatttgcctaattaacctagttttgggactaatgaactaattggctttacggactaattgatcaattaattgattggggcggttgggcggtttttgacttttaagccgccaacaccaaaaaatattggcaagaccatgccaaaaaattattgcctccgattgtttcaacaattttttttttctatcatcgaggcccctttttttgcctggaaacccaagcatttgtcgtgtttttggagtcatcatccgtgtcagggatttttccggttttgaaaaatttgtgccggattttttgggatttggcgatagaagcattttttttcttatcatcgagacttttctttttacccagacatttgcaagggtttttggagtcaccgtgccagatttttgacagatttttcccgattctgaaaaattcgtgccgcaatttttttttggattttaacgattttctatcagtttcattgcccccagaaggacaacgagcgtcggttggctgccgcccatcaccagcaccaacatggcggcggtggcgcgggcgtcggtgccgacccgcaccaccggtccggcagcggttcgaccgtcagcagttctggcggcggcggctgcggtggcggtcccggctccgtgtccgggagcagtgggatgccaatgggcactggcgccatgctgtttggacgcagcgggggctccggcggcggcgcgctcggtgattccgactcgggcgcgtccaacgaagcggaaagtccattttacggtacgcggtaggcgagtttttacatggcattgcctactgtaatcgccctgtttgtaccagaatcccgagaattttggcaaaacccggtcctgtgtaccccagtacaaatcccctcatcagggatgccaatttaaaattttggccagacagaaactctgacaatattccctatccggcgttttttttagttcccattctcgaacccatgccacggcaccaattcccaaccctgcggagttctctgatcccggtcctaattgtcgtgccacggcacatattctgatcccggtccttattgcgtgccacggcacggcacatattttgatcccggtcctaattgtgtgccacggcacatattctgatcccggtcctaattgcgtgccacggcacatattctgatcctgattctacggggagtaaatcccgttaacaaatccccgggggcattttccggtcccgagcatcacaagtgacctgaggcgtctaaatcatcatcttattggggtggccaaaactaatttgttttttctgcccttggaccaaaaagtgatcagaattaaaaacaatttgtaacgaataattacttttctttttaaattattttttgtacgatttttttttaattaaaattttttttttacatttttttagcctacacaaaccccgaagcttcctccgatgttgatggtcattcgatgagcgaattttatggtaattaattaaaacaaacatttaatttaatgtaattaatttaattttatccgcaaaaaattccgcattttttttttaaatttttcgttaacattttttttctggctttccgtttccgccaaaaaaaggtggtgacgacgacaacgaaatttcaatcttttaattaaatttgtggtctccccaccgccttttggtgcttctccgccgtccgtcatagtgttattaatccctttggcttaatcgctttaagccatttattttttatttttttagtaattaatccctttggcgatatttttattggacgaaacgccacataattgtcaaacgttgggcggtggcgtaatttttaaattgaaaaacaacgaacattttttttgctgataaaccaatccactctgatcactgatctctaagctaagctgttaaagaatttaattag

SEQ ID NO: 4337 - DNA, 2519 bp, Heterodera glycines
cgaccagcagcagcaacagctcactgcagcaactgtccgcaatgatggcaccgctggtccaccaacagcagcagcaacatgcaaaacaggtagcacagtgtgataagagtgacaaacataatgatcagtgatcatagtgatcagtgatcagagtgacaccagcagcagttatccgagtaaccattagtgataacatggtgatttattgatagcagtgatctgtgatgacaaaaagattagcgattagagtgatgccagccgttatcagattgatccattactgatagacggagatcattggtatcattgatgagtgtgataaacatagtggtgatcagtgattagactgataactttatgtgtgaatagagtgagaccagcagagtgattaattataaagtgattttgataccatatcagtgatccgacacaatgccaagaaaatttttgaaaaatgccaatttaaacgagtgccaatttttcattcagtcccctctccaacaacagctgcacaacggttcaccaccagcagttggccaccaacagtcatcgttgtttttgctggaacagctgagcgggcccaggacgccgttgggcggtggcgccggaggcgcaggaggaggaggtgaaaacaatggcacaaaaatgccgaaaattggcgcttagtggtgcactaagccatcgcaaaatgccaatgccaattttgaatgccaaagtcttaaagtcacacaattaactatttatgtattaaaaaacccatcaggcatgaacggcactggtgccatgccgtcgtccgcgccgccgatgtccagtggcaccaccaccgtttcgccggcaaacggatgtcatgccggtgcgcaaattatgccgtccgccgatggcggcatcattggcacagtgggacaatcgatcggtgccggtgccaccgtcacaaccaccgctggtgtcagtgttgttgatcaccaacagcaacaatatttgatggctgctgcagcaatgaacggatttggtgggtttttgagaagtgatcaggaaaattttggtttcttgatcaataaatttacaaagcaaaaagtgatcggaccgtaaaaacttatgatcattaaaatagaaaaggtgatcagaaatgttttattagtcggcaaatatttaaaaaagtgatcgaaaatgataggtatattttgcgcataaaaactgatcggaaatgttttttgaccaattcaaaatattgcccaaaaatataagaattaaatttttggtcttttttctggccttattacaaaccaatgtttcttcgtttttcaatttatttcatgaaataaatgcattttcaagtgaatatttaacaaaattttcagccaaatttaaatttaaatcattttaaatcattaattaatttatttatttattaattattattctccaccaatttttagccccaccccatcctcatcttggccaatttatgctgaatggtggcggcgcgccgccgaccgccatgccgccaatgcctgccgacttttatggcttccccgggtcggcggcggcggtgaaccacgggccaatgatggcatcagcatttgccggcggtgccatcgtcggcgccggaggcgctgccggtggcggtggcccaccattttcgccatcatttcaccaccaaaatcagcatcatcataatctcctaaatcagcatcaaatgcaagcagtagttgcagaacaacaacaacaacaacagcagttggagcagtacatgccacaccaccaacaccacctgcaccaccaccaccagcagcaacaacaacagctgcaacagcagtaccagcagaataaccatgcggcggcgaccattcttcaatgaaaatttcgcaaaaaaaaaaatgggaaaaaatgaaaattcctaattttaattagacgtcacaattgaatggcatggcatacatatatgtatttgcttatttcatcataaattacctgatcaaaacatcatgaaattatttgaatgtagcgatttcggaaacataaaaaaaaagttacggtccaaaaaatattaatggttaaataaatatacttacatacttagttgattgaactcataaaattttgtcttggactcataaaaggccattggatttctcgaacctacgtttatcgtaatattcttacggtaatttctcatatcaccagtggatgatagataccgtgttgaacaaaaaatcactgttttgatcagcgccacccgaaactatttgtgttgtgtattgattttatcgatcgcgctagtccattgtaatatcacacattaacgatccaatcattcatccatccatccacatcaatccatcatcaatcagcgcaacaataaattgtgattttttgattatttttttttttgtaattctttttttttgcattttttggcattttgtacatttttctaatcaattcaaattttgtgttgcttcactcaccattttccctgatgattattcttttttttgccgtcattatctctattacag

SEQ ID NO: 4338 - DNA, 3253 bp, Heterodera glycines
atggaaaaactcaaaaaaaaaaattattacattttttgatcttgatcagagatctcgagctatacaaataatgcgatctgaacccaaatagtgaaatttttgtatcattttttttcatttaaatgttataacccaaaaaaatgaattattttttttaaattattttttttttgattttaaaaatttgaaaataaaaattttatttaaaagtattaataaattttttaaataaggctttttgggaattcattcctgctgctcattgctgttgtcctccatgtatggcatttcttcgaccaccaattttacggggtccgctctctgaattttttttttttgaattttaaaatatttaactttggggttagttagaattgggaattgtttgtgtttccagttaattagctggggttaattagcatgggtttggttaattaataactaatcatcttttgttaaaaatatttataatatcttttgacttttgctattcatcttatttgtttgtttttttggttaacttttggatttagaattgatttatatatacgaaattaattggattaggctgtttggttaatgatagttaattgagcgcgaccttttgaaaaagcctggacctgtaagtgggcttgggtttctgaaaaaaaaccaggaaaatcaaaggtccaggaaaacccaggttgccaaatttattaaattctttttaaaaaatgctttaaaaaaacttccacaaggaaaggggtttcaaaaatggaaatgccaagaaaattatgtaaaatttatggattttttaaaattttttaatgtgcggatgccatgaaatatttcgttaagatttgtaaagaaatgccaaacaattatttataacccgttaaatatggcataaaaatttgttattaagcatgtgtgtgaaataagcaagcataaagacaattttgccggtaaataattataagcacaccgcaaccaaaaaatgatgccatcgccaaagtgccaattttgagcaaagcggcatcattttattgatcaatgtttttttggtaaatgcaattgctctgatcactctctgattaatccattgaatttttgttatttgcgtttaaaaaattttcagttttttttttgaaaaacggcaatatttcgttaatttttttttttggcgaatgccctaattacgtgagtccaaaaacgccgcccgcataatttccgtaattaagaagcctagccctgatcagtagtgatcagagtttttgttttgctcccagcaattaatcagcatgttatcactgttatcgtcattaatcagagtatccgcatcaacaacaaccaccttcagttgcccattagcgacggcgccggacgatgtcgccggactaattggcgtgggcggagactgttgctgcaggtggttgttgttgccgggttccgatgacgcgtcgtcgcgcgttgcgctcgcggaataatgatgttgttgctgttgcggattatgatgcggatattgacgatttggagtgtcataatgatgctgatgatagcccccatcgtgttccggtgacggcatcgcggcaacaaacattccgctgcctttcaccggtgtgccgccgcgtccgccgctgctgttcatctgaatttggtaatgcaaatcaaatggcacaccaattaggggctaattaataaatagcccctcttcattagaacaatgtaaatacctgtctcagataattgccataattaggcttaattactacaagcaaaagtggatattatactaataagatgaccatgtgaaaaaaaaagttttaagaaaaagctcttttatcgaaaaaaacagaaaacaaaaattggcacttttacaataaaaagaaaaaaaatcggaaaatttttggcacaatttcacttttctttattattcattcactgctcggacttctgtgccggccaacacaatttttatggaaaggaagtgacgccatccggcacaacggtttggcacaattctttcggtgatccgaaaaataaaattttgaaaaacatttaaaattttttgaaatttttgccatctacaaatttgatcaagacagccaccattacagatcacaaatttcctgatcagtcagtgtcttgggtgttgctcagatttggtcatcaggcccaaaaacgatacagtgggtgccgttacggtatttctacagtaccaagtacgaacaagggcacaaaacaagaaaaattctttttctggaggcttgcttgcctactgaaaaaattcaaaatataatttctgcaccgatctatccaaccaatcaataatatacagtacctatcatgccgtagcaactacgccttttatgcaacattttccccgattttttttggttttgctcaccatcagcggtgccgtcgttgacgcagccatgccaccgccgccaccatgcaacggcgtgccaacatgcgtgtgccgcgttgatgttgagtcgaccatgacgcgtggcggtgcattgtccgcgccaccgcctccgttcagcgcggccgcgtgcgctgcccatccgtccaccggccgtgccgcttggtaatggcgatagccgctggtgcttccggcaccgccaggcgccgcagcaatcattggcctgccaaggctcagcgaggactgctccgagtcgtcggaccggtgctgaacacgcgggaggggaggggaaaacggagacgttttgcggtgccatcggcttatgtgtgggctttacccaacggccggtatggtgaggctcgagaatcttgactctatatcccagatcaaaaaccttactgatcctttgattgggcccgaaatttttggcgttttgttcgagagttgaaaaattttagggtgagctgacgaacctctatttacaaatacaatcaaaattgagttatataaaaaaaatatttttatgggaaagtgaacgaatgaactaagtattttgaatttttttttgcattatgccataaacctagtctcattagtgagtggaatttaaatttttgaattttaaacaaaatgccgaaattttacatttagaaaatcttcaattttcgaattttttttttttcacaattctcgagcctcatttttttggttcaatctcttggcaaaatgtgtttacctttttataacttaaaaggatcacctaaattagggaatagtacatttttttgcattcaaatttgaaaaatgttttttaatttaaaattgaaatattaaaaatgccattttttg

SEQ ID NO: 4339 - DNA, 3175 bp, Heterodera glycines
tctagagtcggaaataattagtgacagtttgataaaattaaagaagcatctttctaaaaatttaaattcaaaataacaaaagaaatagcgaataaaattgcacgaaaatttggtatttccgcaaaaacaattcgagcgtggaaaaataaattccgaagttataattaattattttttaataaataatttatttattttttatttgaattgaagggaaacattacggcattgtcgaaaaaaattggcataattaaaagaaaaatgcaccaatgctaaacgagccgattaagaagaatgaatgaaggattgagacagaagaataaatagtctatatttatttagtttttagtatataaaatactttcgctcttaaaatagaaattttatgaaaataaactttttttttaaaagcgaacattttttcggggtttttatacttaatgtgcctattttcagttaaaaaatgcaataaaaacgaaaaatgcacccccaagaaagacccgaaaaatttcctaaaatacacccctaagaattgaatttccaaaatttgatcccaaaaatttaatatttttttcttattaaaaatttttggttaaaaatgttccttattcgaaaaaaaactttaaaatatttaattaaaatttacaattgaagtgtttaaattcttacgtgttttgctacctaaaaattgttaataaaaattattatttgccttttttttttgcctatttgaagattttgtgtctatttaatgcctattttacgactttttgtgcctaaaaaaggaagcactccctactctttaattaattaatttgaatcctaatgtaagccaaatattttgaaaaaatttccccttttttaaattaacaaaatttttgcgaaatcaattgccttaattggaatttacgtggaatttgcaggaaatacgcacgcacattaaggcatatttccttcgctatttaaatcgttaccaattcatacgtcaattaattgcaaaaataataattttttagcttcatcaataaatgccttttttaaatatttattttctgctcctttttcttctcgtcaatcgcacattttgcgatgaaataggtcattaaaaatgccgaaatttatgaaaatatttttaaataaattaataaactttttttttagctcactggattgaatcgtgtaaaaaaattgcacaaaatatacattcattggccacggaattggaccaaattccggatagtctcgagacagaaaaaataattgaaaaaataaacaaattaaagaatttcgcagtgcaattgagtgaattcagaaatgacgaaccaattttgttggaatcgttggtgattgagcatgggcaaaaaattggccaattttgtcacaatttgctgatctgtgatgcgaaggatggtgaagtgatccgtgaaaggttacggcacggaattgaccaacaaatggcacgtgcagtgcaaatccggcaactgatcgacaccatgctaattgattgggaaatttggccaattcttcacaattttgaactcgccgaagacccgtccaatgcggtagcttatctgattgacgagttgggccagaaaatcgggaaaatgcacaagctgttggccaactgcggctcatattacaacactgacccatttgatgaagcgctgcgacggctgctgatggtggccatggacgaggagcaaagtccgatcaaaaagctggaccaatgccgtgccattgtgccaaaacttatggccaaatccgtgcaggaaatgctggagaatttgctaatggatctgttagagccgacaagtccatttttcggcatgacctttttggcagaaattgcaaatgaattaaatgttgcggaaaatatttgtgccggaattttgcgcagttcgaaactttcgccgatggcacagtttacggtcaatgagaaacttcaaaaattgagagcaatggcaaaagcaatgtttttggaacaatacagaacaacaattgaggaacaaataaaaaacattggaacacaattgaaggacggaatgggccgccttatccatattggtatgtaaatggatatttaccagtttaaatgaattagtctcttatttaatgctaatgataattcttttctgtgctcaatttagtttaatgatgtaccaaaaatttacaacagacaaatacattttaggtgggggggggagtcaatctctcccctcctcgatcacaaatgagcttagcaagtcaaggagggggtcgcaaattttgaaattttcacaacaaattcattaaaaagtccaaaaaattttcccggcggtgcctatcggcaccaccggaccccaaagaacccaaaaaattggctaaaaatcgcaaaaagtggctattttggtgaaaatctgctaaccaattcggcaccgccggccctcggttcctgaaattctttttggaaaagcgcgccgcaaaaaaaacagtttttaaatgaaaaaaaggccatcggcggcggaccccttttctcaaaaatcccgaccccgccccctttttaacgtatgacagacagacaagcaagggcattccgacactcagatttttgataaaacccaaataaatctagaatctggcatgtttcataaaacccaaataaatctagaatctggcatgtttcataaaacccaaataaatctagaatctggcatgtttcataaaacccaaataaacctagaatctggcatgtgtttttcggcaccgtgggttctaaactattatttttttagcaaaaaatttcctgttatattgaaatttagtataattcctcaaattaaaaattaaaccacgcattctttagaaaaaggaacaatgaaacgagtgcaattaattgaaacacttaaaaatgttcaaaatttgttcgtaattactcataatgagttggcaatgattgaaatgttggaaacaaaaaaagtaatggagcaaaagttggacgaattggggcaaataatggcacaattgcaggacaatgaaaagaatggaaatggcacaccgaacgacgaagacgaccaagtggcaataactgaacgaattctgagctgtctgaatgtcgaacccatcgaaaaaggcatgaaaaagaaatggccaatttcgcgaccaaacatttgttctaattcctttgatttattgccaa

SEQ ID NO: 4340 - DNA, 5477 bp, Heterodera glycines
  misc_feature (49)..(49): n is a, c, g, or t
  misc_feature (940)..(940): n is a, c, g, or t
ccaaagaacccaaaaaattgggctaaaaatcgcaaaaagtggctatttntggtgaaaatctgctaaccaattcggcaccgccggccctcggttcctgaaattctttttggaaaagcgcgccgcaaaaaaaaacagttttgaaatgaaaaaaaggccatcggcggcggaccccttttctcaaaaatcccgaccccccccccccctttttaacgtatgacagacagacaagcaagggcattccgacactcagatttttgataaaacccaaataaatctagaatctggcatgtttcataaaacccaaataaacctagaatctggcatgtttcataaaacccaaataaacctagaatctggcatgtgtttttcggcaccgtgggttctaaactattatttttttagcaaaaaatttcctgttatattgaaatttagtataattcctcaaattaaaaattaaaccacgcattctttagaaaaaggaacaatgaaacgagtgcaattaattgaaacacttaaaaatgttcaaaatttgttcgtaattactcataatgagttggcaatgattgaaatgttggaaacaaaaaaagtaatggagcaaaagttggacgaattggggcaaataatggcacaattgcaggacaatgaaaagaatggaaatggcacaccgaacgacgaagacgaccaagtggcaataactgaacgaattctgagctgtctgaatgtcgaacccatcgaaaaaggcattgaaaaagaaatgaccaatttcgcgaccaaacatttgttctaattgcctttgatttatttgccaattctgttgacttattctttcttcatcgtcaaactttcttcattatgtacaagtttagtgtttatagtaaaatactgttgcttataaaaaatatataatggattttaataaaaaaaaatatatatataattnggtttcaattcaaaaaatttgattttaatttattagggtcaacaaatccattttgagacatcccacttttctaaaaattagggatgtttaaatctcctagcgtgaaacagaccagcaatggctggagacaaaggatcgcgatcagcatttcacgtatcgaacctgcgcaattttattttgcgcgaatcgcgttttcattgaaatttagaccacgacctacatttactaaggagtatcatttgaacgataataaattaataatcggagcgaaggattttcccgaattttaatttgaaaattcatttctacccaaaaaactgtttctcctttttctctttctttggagtccaattaaatttgtgccattatgaccacttttttggtctatttgcagaaattaaaaaatgccttattaaaaccttcgaatgatattaattttgttttagtttggaagaataagtaagaaaaaaattgtggggcaaaacaaattttggtccatgaaaaataaaattaaaattattctaaaaatcaactgtttaatgaatcattagcgctaacaataaaaaaataggcaaacagaaattgaactatgaataaatatacgaatttaaaaaaacaaatatccttggtcatcatttatacatattagagcccggagcaggaccggatcctgcgcaggattttgcaggatcccagtccgaaatcctgcattttttggaaaatgcaggatttgcaggattaatccggccggatccggtccggcaaaaaattttgaattccaatcctgcaacaggatccgcaaatttgatttttgtgcgggatccggcaggatccgcatacattctttgaaaattttaaaaaacggaatgccaaaatttttgaataaatttataataaaatcaatcaaaataaattcaattttcatctcaaatttcaccagaatttgcaaaaaaaatttcccggcggcgcctatcgacaccactggatagacattaatcctgtagaattgagtcaaaaggtgtgacatttggtcaaaatcagttaattaattgataaaattttcaaaaaaaaattttcagacggcgcctatcggcatagacggacccttttgttcctagtttttgaaaaaattgcgccgaaaaaaagcatttttgaaaagcaaaaaatagtcaaatttattgacaattaacagatttgatttccgatctctttttaccgtctgacccattcgaaaaatcttagtaaccttttaatgcatcccgccagcccctaaaatttctttttcaaaatgtcaggtattttttcttttttggaaatttaattgaaattttttcaaaatttctaagaatccgcaattctgcgcgggatcctgcaaatttaaaatgcaggattaatccggtcgggtccggtcctgcaaaaatttttgaattccaatcctgcaacaggatccgcaaatttgaaatttctgggctctaatacatatgtattaaagattgtaagacaaaatggattaaaagttttattatttggtcattttttgctaatttatcaaattttaaaagtttaaaatcactttttttataatttttgaaattaaataccaaaaataggatctttcggatagacaagcgcctccgggcaaatttcttttggaattatttttagagtgcaattttaaatcacaaaatatgcttgaatgtggcgaaaattgaaaaatctcaccaataaaaatgccattttgagcccttcttcctagcaaaaaaatatggaaacgatggcccttacgtatcatttatattttaatagctgatttcaattcgtccaagtcaataataacattttcattcttcaatgtgcggaacagctgaataaaacttttgttaaaatttggtacacctaactaaaaacagcagaaagggcataaacattattattattcagtattttaattttaattaaatttatttcatttgcagcaaatcgagcaattgcaacaaattgggcggacaccctttttaattggttttggcacttgaagtgattttgatcgtaaaacttgccgtataatccttgatcgccatgcacatcacatatttattggagcaaacgtgcagcacggctttgcacagcacagccccgtcactttcaatgctctcaacatggcatttttgttcatttcgtatttcttggattagcctcacatcgtcaaggctcataatcttttcgaatggatcttcgaccacgcccgtctcataagtgaccacgggggtgccgtactttccatgttttgccaacgcgtattcaatgcgtaattcgtgcactttgagagaacactcattgaactgtcctagaaaagtaaacggatcaaagcaaaattataagtgcattttgaattgaaccatgtaaaattacggcattggcaaaaaattcattatcatttttgtacaattaaagcagagatgcccttccttatttggaggggtcggaactttgaaacttaaaatccttccttctatgaatcgtccttatttcagcctaacattcattttttttctttaattttttgcattcggtaaggattcttttaaaatttaattattttgacaaaaaagaaaaattattaaaaaaaatcatccggtttttttgagcaaagcctttgatttttggacaaaaaaagaaaaaaaaatactaaaatttataaaataggaagtggcacggtgatgccgataggcgcggcaggaaggcattgataattttggactgatttttaacagtttttgtacaaaattttctgttacacaggtcgcccaactgaaaattttcaaaatcagcatttggccgacaaacaatcagcattttggaaaattttactccaaatgaaaaaaatcaataaaaaacgttcattttttgtggcgcgtttttttacaaaaactttttgggcagggggcaggcagtgccaataggctaaaaatggccaattttaagagatttttcccaaaatcagcataatcagcaaacgttctcaaaaagcatcaaaaaccattaaattagaaactaaaaaaacaatcatcattgaccccttgaaaagcatcaaaatgatgattagggttataagttgtatgcactaaaaaatgccaaatatgcactaaaaatcccccaaatatgccctaaaaacccgaaaatccctgaatatgtattaaaatatgtttttaaaaactgccaaaaatgtcttttaaccctcaaaaaatgccaaaaattgtatataaattaaaaattgactttaaaccacaaaacaagggctaaggagcattttttagcgattgtaaaaatattgaatttccaaatttataaatttttattatatgctaaaacaaaattacctttttatataaatttttttccaaaagtttttacaaaaatttaaaaaaatttcaatttttaagggtctattttttaaaaaaattctaaaaaagtcgatccttagggaggtgtatttttcgcttttttcgcatttttcttatgaaaatttgcaaaaaatagccaaaatatgctctaaaaatgcaaaaatggccaaatatgcatttattctcaaaaacccccaaaatatgcttttatatgcactaaaaaccttcaccaaatcaaaaaattttaacgcagaaatgctatttttgagccccttcttcatagcatatgcgcagaaaaaaaatgcaaaatcatacaaattataaccctaatgatgataaatcagcagagttgggagccctgcctgctgttataaaattataaagtgtttactataaaatattaccgtataattgaattgttttgtttttgaatgcgtgtgaaccgtttaatttcttgtcgatttccacaaaattttttggaaaaaatttctcgggtggacaatttccgtcgaacaaattgcagacaaattcgtacacaaaatcaacacaattgtgcccatctttctcataaccataagaccatccgtcgtacactggtgatcttgcgaaaaaatttcgttgactcatctcccaaaataattcatccgctttttttgtgctgacaaaaaaaggcgtttcaaatgactgggcctttacggcattgtcctcattagactcattattgtctttaaaatgattgctgaaaattgtgatatttttacatatatatatttttaacttacaaaagtcggcgacgcggcccaatggaagtgtagtcatattctgaaattttgtattggataaacgaaaaaaaattctattattcaaatttattaaattctgaggtacttttatagagagtttagggccacatgaatattatttttttgttaaaagacaaaaaatgtacatgggggtttttggggttgctatcacgaatatgacatccatttcgaccaattccgaaccccggactcgaacaatggtcgaaaatccatttttcaccaagacccactcacatgcagatttgggcattttgctgaatttggttgtgttgaattttaaatgatatcagaaattcgggcgaactttac

SEQ ID NO: 4341 - DNA, 1761 bp, Heterodera glycines
agggatgcgatttttaggcacaaaaaatcgcgaaatagccattaaataggcacaaaatcctctaataggcatttttgtaaaaaaaaaacattgtaattcttaagggtgtattttcttaaattttttcgtgtcgattttttagggtgtatttttcattttttttgcatttttccaaaaatggcggaataagcaaaaaaataggcaactaggcattaagcacaaaaagtcgaaaataggcaaagttaggcattataaaagtcatcgtagaccccccaaataaagcggaaaatgcgtttttcgtgcttatctgtgcgtatcaatcaagtgcgcaaaaattttaggcatttgcctaaaaatcgcctccctaacattatcaataactggtttaatactcctcccccaataaattttggtgactttgcttgttgcaagctgcgcgaattgagatttgttttgtgccgctttctgcaattagcatgtaatttgcagcgattgtcccgtggtaaacgctttgccatttaatttggtctttggccgacaatttgccgtcggacgaacagcaataaatgttctgtgccaagctatcctttactggaatagtcaacatatcggtgaattgatgactgattttggcaatttgccgttcgactgatggcgacaatggtcgtggcccacaataggccaaactttcattttgaaagtgcacagcgcctaaaaaggacaattaaaaacccaataaatttgtaatgtttttgtattttgatttaatttttattaaaattaaaatttaaatgcttacgaatgcatccctccggcacggaatcatttgcagcgaattccggcactgagaagtaacgctgctgatagaaaaggccatcggtggcaggagttggacgaaagttttggtcggcagaaatgcaacaaaattgaacagatgggaaccattggaacccttttgggcattcggaagtgctttttggatttaggccaatagggggcaaaaaaactaaaaatttcacaaaaattaaaagaaattaaaattaaaatttaccatagcaatcgaattgtgatgagaaaacgccgttttgaagtgcgaaagcggcaaatagtgaaagggataaaaaatggaaaatattttccatttaaatttttatcagctttaaattgaaaatttattaaaataatttttacttttcttcaatttcattatttataaaataaaataatattattaattttttatatgaattatttattacacgccccacacaatttttccatgttttaagaaggatttcaattcaataattcaagaaaatcaatgtaacagattactagacaggtgtgtcaatagtcggctttttaactaggataaagggtgggtgctaagtcacttcaaaaaaagtgcaaaaatcaaaaatcagatttttcctatgattttatcattttttaaattataaatatgttaaaatttgattaaattgatgcttaaatacacattcatttagcttgagttgaagcggatacatttacatataaatattttcatattttatataatttaagctcatttataattgtttccatttgtaattgaactttcaaatatttaaaaaactcaaagtaatctttctaatgattttatttatattatggttcttttatttgaaatccttccaacaaaacttctagaagaatgtgtatttaagcatcaatttatttaaattttaacatgcttgtattgtaatttaaaaaattgag

SEQ ID NO: 4342 - DNA, 1086 bp, Heterodera glycines
ttaacagacgcgcccactacgaaacagtttactcagatggagagaatagatttgttcgttacatccaaatgccacgttcaacgtctgatgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggggtaggaaggatgtagtctaaaaagaatttttaacagaccccccccctacaaaa

SEQ ID NO: 4343 - DNA, 2150 bp, Heterodera glycines
cagatggagagaatagatttgttcgttacatccaaatgctacgttcacgatctggtgtaggaaggatgtagtctataaagatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagggaatagatttgttcgttacatccaaatgccacgttcaacgtctggtgtaggaaggatgtagtctaaaaagaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaaagatgtagtcaaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacattcaacgtctggtgtaggaatgatgtagtctaaaatgaatttttaacagacgcgcccactacgaaacagtttactcagatggagagaatagatttgttcgttacatccaaatgccacgttcaacgtctggtgtaggaaggatgtagtctaaaaagaaaatgtattttaattctagtttgttgcctatggattttacacgttcgctaccaaaaatactgcagcgcatgtttctcccattctgacaatgcaaatgtaatgaatgtccctttcatgggtcggccagtcggtattatattggtgcaaccggtgaaattcgtgtacgcatgaattgaacacttttataaaaagaaaattaattcttcattgaaattttgagtatataaaggaagaataactttcattcactcactttatttcattctgttttcgtctccaaagcatcctactgcctaatattaaataacttctttagaatgaacttctttatcaaatttgttttatgcgttcttatcatagtatttgttttgcttttatttctttccaataaagtttcgaacaacgctggaacctgggtgctcttcttgtatgttctattggttttaacggtagttagaaaatactgtttttgtaatcacatttttccatacaggttatgccattcgttgttggaattagtatgagcttcttcgctacctgcgtttcagttatcgcggttaattgtttggctaatgttaaaacacatatactaccttccttgattaaaggtgaccgccattaaaaacccgactcttgttgaagcgatcttgcgccgtgttgggattagcagtgccagttttcgccgcattgctcaaatcgtttttcgccaatttcgcattgctcgccgttttccgaaccacgaaattgaaaaccagcaaattgttgatgcgcagccacagcaaaatgagcaacaaaataatcctcaacagcagaacacggctggcgccggcacgcaaaacgtcgcttcgaccgccttaactcctggccagcgttctgagcatgctgtaagtcaatcattcaacagcactttcttaactccaatcacatcaattcaacctttaagcaagctccgccgcaagacaacaccaaaaagtcgaaaaagaaagaaaggaaaaagaataaacaaattaattgcgttgaatgaggcgatgtgttcgttgtgttttctttacctgttttgtatttcgcattgtcaatagtccacgaaaatgttgttgccttctgtttaaaatggacgaagcggtgc

SEQ ID NO: 4344 - DNA, 3766 bp, Heterodera glycines
tcatccaagtgggcacggattagagaatgaatagacaaatgatttgacaattgaaaggcacccatcggaaaaatggtcgaattgaaagtggaaacgatgcaaatggaacaaagggacaacgccagcgcacgggtggcaccagcggacgcggcacttgccgagttggcccccttttgctacgattacgccgccatttatgacggaccgaaggtgaagggatggccaaccccagcagaaggaatggcccgaccgattgcttcttcccatggcttctccaccgtttgttctcttctttcaaggccacttcgccctttctgatgcggcccaattgtgccctttcctctgattcgacgggcgatcagtcgaagccctcttttgtttcctcccaccgtcgcgtcgatgtgtttttcgtttcggacttgagcacagaaactgccgggggctttcaagtccatttttaattaattttttaactttttatcaattaaaaggtctctttccgtgccgtcgatgctccgtgcggaggcgtaaaattggcgtcggaagaatggcaggcggtggaatacagcagcgaaaagacactgacacgcacaaaccaacgccacaaacggtcggttttgaaatgcaattgaaatgccaaaaaaaggtgccgttggtttgtctattcggatgagcgtcagcctgtggaagtgttcttcgaacagttctcttttccttctacgagcggaaattgcgtggacgaattcgtcgagttacgcgacgttggcgcattggccgagtgcgaacatccgtcctgtgccagggaggagagccaacggaagggcaacaccgtgcggagttgcggcaaatatgtcagcgcggaaggggggattaggatttagcatagcattttgagaggagcggaatggatttgggtgtatggaagatggcactttgaaatccggggttcgaaaccagccaaaacgggtgtcatatttctgaccattgtcagaaagaccaacaaaactcataaactgaactgaatccatgttcatatgttaacaccatttggtttttctttgtttaggctcccagttggcacatctcttccacttccatcctccaaatcacttcttccgtcattttgcaaagtcaattctctgccaatttccgtctgcgcttccgcgcgctctccgcctgcaaccgaaccatcgaaattgatggcaacggtaatgaggcatcaatttaagcatccgctaattgctttagcccccgacggcgttagcatcgcttcgggccgtctcacctcgccgcacttcccccactcgccctactcccacaacaattcgtgctccactcatctgttagctgctccctcacatcgcattttcatagtgttcaaaacgtttcaattggagcgcggccgttacatcgcccgtttgttggcgaggccgcggtggactttcgaccggagttggctcgaccgcaagagacgctctgttcagttgcttagcggcagcagcgggcgacagaactgcgtgtacgactcgctgacggtgggcgtggggacggacagctccaccgctgtccgaccattcattcattcgcctctcatccattgattggtcagatcttcgccaacaattcgtcgcttcccgtcggattgtccttttgtggcgattggctgcctccttccgttctgtccgatcgcaatgagctgctcttagagcttacaactgatgcttctgttgccgggagtggatatgaactcagctattactccgtctcttcgggtcggactgattgatcacttttggactgatcactttccatcacccattctcctcatttagtgtcctcgtcttcttcgagtcaaattttcgaattggccccatcccgcgaacgttccggcgcgttgacaagcattggctaccccggctcttacccggcttccgcactgatgaggttggcacgcatttcctcctccccccccccaattgcattttgctttagggcgacaatcatcccgcccattggacttcgctgtgttgccgtggtgctccgcgctgactttggcggcgactgtcgcgagagagatggcagtgagtgccaatagcgaacactccgagttcaactctcattgccctagggttccccgctcgttccgctttttcccctctcgattcggtctctcgtgcgtattcggtgcccgacttcgacagtttggactgggacccttggccttgttcggtgagttggcatttacttttgtttcagagtttaatatttgccccaaaggtggacactcctttaaaattgtcgatccccgtcggaaaccaactgatcgttgaatttcgcagtgattcggaccccgagaatgacgggagcggattcagaatgacgtgggactgtgaggacatccaatcagtccaactctaacaatagactgctgattatagtttaacactccgcattgtatttactcaaatgaatttttaatgctagaaaatgaaatatttgaattattaattaataaaggaaattagtaaagctttgaaggaattgttctctgttgattatatgtgttgtgagcacaattaatcggaagtcaaagtcttgtgcaaatcggcgaagggaagcaatttcggcatgagtaacaccgccaacgaaacagacgagaatggcacgccggattctgttgtcgggtggtcgcgcgtccgggtttgtgcagtgcacacacttttcaccgaacaatcgcttcaactgcgcctcgtcccatcccttacaaattaggtatcgctttttgtgggttttcccatggattgcccttttttccctcacatttgtcactgtgccgtgcacaatgttcgaaatcagcggaatgtacgcctctgagaacgcataagccaaattccgtctccagtttactcagatggagagagtagatttgttcgttacatccaaatgccacgttgaacgtctggtgtaggaaggatgtagtctaaaaagaatttttaacagacgcgcccactacaaaacagtttactcagatggagagaatagatttgttcgttacatccaaatgccacgttcaacgtctggtgtaggaaggatgtagtctaaaaagaatttttaacagacgcgcccactacgaaacagtttactcacgtggagagtagatttgttcgttacatccaaatgccacgttcaacgtctggtgtaggaatgatgtagtctaaaaagaatttttaacagacgcgcccactacgaaacagtttactcacgtggagagtagatttgttcgttacatccaaatgcaacgttcaacgtctggtgtaggaaggatgtagtctaaaatgaatttttaacagacgcgcccactacgaaacagtttactcagatggagagaatagatttgttcgttacatccaaatgccacgttcaacgtctggtgtaggaaggatgtagtctaaaaagaatttttaacagacgcgcccactacgaaacagtttactcacgtggagagtagatttgttcgttacatccaaatgccacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgccccctacgaaacagtttactcagatggagagaatagatttgttcgttacatccaaatg

SEQ ID NO: 4345 - DNA, 1981 bp, Heterodera glycines
  misc_feature (1971)..(1971): n is a, c, g, or t
ccatcgtttggtgttggaagtttccttttcgctcattttcgctgtgcggtggacacagtggaagtgcgctgattccatttgccagtggggggaatgattgggtcggtttgaactcgtcaaccaatggagggcaatctgacgaaacaaagggaaatattggccaaataaaaacactttcacttgcgtttttgccgagaaatggcaaagcctttgagcgggcgatggcactttccttttctgtcagcaaaaagtgctggcgcagtttataaagaacagccaatttttcaaatccatatctacataattaaattaaaaagggataaaattcaaattaaaatcgaaagaaaaccgatggaggaaagtctcctgaaactgccgatagaatctggactttaacccctgagagcgcaaagaccaaagacaggcgatttgcaggacaacccaatggttgcacttcgaagcgatcagttttagcagagtttcgctaaccatttggtcctaaagttaaatccaaatacaaatcccctctttttactatgctttttctcgtcatcacctcaaattcgccccgtacaatcgcttgttcaatgccaaaccgttcgtttgctcctcccatccctttcaaaatatgttcacatgcaaaaatgtgctaaacaattacaaaaaaggtcaatccctggcaatggacagagaaacgactcaccaattcaagctgtttttgctgctccttcaaatttcgaagttcggaagacacaaagtttttcatttcgtccacccttttaatggcttaaaattgcattttcaaccatttaaaaagcgcatttaaacgactcgccggacgccctgtcaaagctcgcctgaagcatttttgccttcgagctgagaaaagagaaaactgcggtcatgtgggcatttcttattgcggagaatatcgggtcggaattgttcagtgcgtaaacaccgctcgcgtcgatttgtttcggattggcactttcggtccctgctttttccaacgcctctttgaaagagattttgccacatttgtaagtgaacacatcgtcaaggaccgactcgtaagtcaatccggtgagcaaaacggacggaatgtcgcagcgacggtcaaacagaaaactaaagcataagagacaatagtcattacagaaactgcagaacgtacacatggctaattggctgatcggctgaagcgaaagcctcgcccaattcggcagaaaattgcctaagttgtttttcgatagaacaaaaacactgtccgatcccaaaaaaggtttgaatttgcccgtaaagcacttgcaacttccataaagacttggccattggcgaataataacggtcgaacatttcgggtgaatattgcggaagctccatggagaacagatcagactctctaaaattataaaaaggcaaggaattaaagcataaacaaacacggacatggttacgaagtccaagtcaaattccaagaatttaacgttgtcaaagagtccatttctctcaagttcccgatcgaagaaatgtttccgattcccacaaatgatgatcacataattgtaattcgggcttgatcgtatcagttcacaaattttgtctgaataatccaattttaaaagactgggataaaaaagtgaaaataatgaatggatggattacatgcgagtttaattgtgggtcgtataaagaaaatccggtggcaattttggtcatcgctccaagcaatgggaaattcgggcagtaattgatgaactctcacacaaccatggctttgcaagactgacatggaacacaatttgtcgagagggcggagaaggcattgctcaacaaccaattctttctttccgagcactgagaggatcagatgaagaagtttttgccgattcaatttagaaaccagagaaaattcatcaaaatcattcattaacaactaacataaaatgatattaagaccagtagaangtagacctgc

SEQ ID NO: 4346 - DNA, 1680 bp, Heterodera glycines
tggtcatgagagtgatcaaattcaaagactctttcagaccttctccgactgccacaaaatgtgccgaacaatggcactttgggtttgctggaccccctcattctcaacatggacttgcaccgtccgccctttttccccttcgaccccgactctcatcccctcgggtaattgtgcccactcaataatatgccaaaatcttttatttttttttccagcgaatgtgccgccgaccaatcgaatccacgccaatttacacaatgcgaaggtgggaaaacagaaacgaccgaatgcgagcagaaaattgtgagaaataagcggacattgtgtcaagaaatgacaattccttttaagagggatgcccaacggaaaatcgacgaatgccgaaaaaaccaaatgcacccactaaatgccattttctacacaaaattggcaaatttgtgcgtcattaacctttgtccagcccttcttttaatgccaaatagagacgaaaaaggcaaaaacgaaaaaaataaaaatggaaaagcgaagcttttaagaggggccgaccgttctgtacgagtcgcttgccgctgccgacttttacgaattctccggcggcgattcctcctcccaatgtcccttttttgacaaaagtattggcaaaaagtgccaaaatcagacgaaaaatacatcgaatggcaccgttttgaaaagcatagctgcttcaaggaataataatggtaaaacaatgccaaattgcaacacttggttcgtttcccttcagtttactcctctccctctgactttgtccccctcctttttccgatgttcgacttttttgccgatggtccgtccgcacttttctttttgtttaatttcacaattcaggcccattcacttaccttcagaatttaactgaaaattacgtgcgattgtttggaagggttgtctcattaacgggcacaataattgacgaagactttgacggaattggcgaccaacggcaaaagcagcggaacaaaaagtgcccaaaaacatactgcggcgcaaatgccttttaattcagcaaatccgtcggcaattcgtcgaaaatgccaacgcattttttccgaattctcttccgttgtgaggacgatctttggcatttgaacggaatcaattgcaaatggaccaacgccactcgcgtgctcgccttcgttctgcccaatgttcagagagatttgaattgtttggtcagttgcggtggcttttccctttcgatttgctcttttaaattgccaaagcgcgccgacgaatatcttttggtgaacaccgcgagggtccgcgacatcgaattgcttacggacgtacaattctttgcggaacgaatgtggtacccaacggaggatcagttgcagtggcggacgaacatcagcacggaactgtggcattgagagacggagacaaaagggtgggaggcgaagacgaaatgccaaacggatggatgggggagaatgtcattgagagcggggggggggggggggttgaagcaaaaatagggaggggggattttttatgattggacatatcaaaatcagcaccacaacgaaacgggcaattctttctttcataattaattcgctcacatcgcttttctctcatcaatcaattccatcgctagtcgaattttattttaattaacatatcatatcattattctat

SEQ ID NO: 4347 - DNA, 3109 bp, Heterodera glycines
tctgcacagattgaaaagcattctctcaccgttcatattgttttaattgactatttttttggctcattgcatttcttaaatcaaaatgttcgactgatttgtgagtcaaacggtgcttctaactccggcacccccccccccaaattcgcttgccatctccgtcaattggtcgtgcccaattctcttcccaaatgggtgtctccatttgctgagcagtggcctcgtcctttgacatgccgtgctatgttcagggctcgcataagtgctcggccgttcatttgctggtgcaataaatttggtcaaacaaatttcgttgttcagcgaattgcacgcgaactccataaaatcttccgggaatcgttcctcttttcccatttgcaaaggtttgtactgctcgaagttggggatggccgactgaaggtcgatcaacttccatttgttctcccctctgacgaagatccaattgcccggcttcaaatgcaaatgtgcagcatctaaacagcggtgagggaggggaggggagtgaatgtgccgaatacgcgagggtaagccgagaatcgcttttccgcaattattaattaattagtgtgtacgtctgtgaaatgttgacaatgtgcttgccaacttggccagcagttgttctgcgtcctgctttatctgctgttcccccatttgtttttcccttgccaattcgtcccattgcttcaaataattgtccaaagtgttgtccccaaattccatcacgtaaatcatcgagaaatctcttctcaactccacgtgcaatgggagcagcttttcgtgttccaccaccatccgacttttgtcctccaccgtttcccccttgaataatttgaccactgagtgctcatcgacgggtttattcgcctccaaatcattgaaccacttcaacatatttaattcgtgcttaatcatcgacggtggctttgccaaattaaccgcgcgtgcgcttgtccccgtggagacaactttcaccgcgaaagtcctttctgagtcaagttccgcctgcccaatcccttgcttgaacttgtccgctttgtaaatctgtccagtttggttggttcatcaacgaatgtttccgtccgttcgtccatcaattaactaataattcgccaattaactaataccttgctgtccggctctcctgcaattttctttccttcgaaaaagtatgacggttctccgttcgttctccgatagcaaatttcgccttcccttccctttggcacatcgtttggcacttttggacagactaacggagaatgattttggatgaaaagagaagggaggggaaaaaaggaaagaaggaaaaagtaatggaaagaaaagggaaaaggcatatcaaaagagaaaaatgggataaataaaaaaatgaattttatgaaaaggcgggggaaagagaacagacagcagcagaggagaagagaacgaagaaatagcagggcggggagagagagacatggcagagatgcgtggaaaagtgccactaataaaatgccatccaattttggcaatttcacgtgccaaatgcgctccccaaccactcaaaatttgctttatttctttcattcatataacatttttgacggagagtaacacaaagtgcaaaatgtccttcatcattctctgcccttggctcggcttcacaatgccaaaaacgtggctttgcccgtgcgacgggggcagcggcaataactgcacagaaattgggagagtgaattattgagtcaatggtgcccttctcccaaatgccaaactcactttgcgtctctccctggctctccgtccaatcccggttctcccgaagtgcctaaattaatgcccattcattagtaaataattcccacccctcagtccaaaacctggcggtccccgcagtcctccgtctcccgtgttgccgccgttccccggcactccgatcagtcccggctttccgtcgattccgggccgtcctggcggacccgccggtccgattggtcccttttggccttaaacaacaattagtaactaaattgtttaacagtccgagattgagaagatgcttccccgagcgaaagattaatggattcaacggtatgacaattaatcgtaataaattggaaagaagcaaaggaaagatggggggtagttcatttggcagaacacaggtctaaaaagccagagacaccggttcaaacccggcccgtccatattttttccctcaaaaacttcccagagctcattcatatatcttcaagctcttttcacctggtgctccgttgtctcccttctgtccaattactcccggaagtcctggcatgcccggctctccgatcgttcccggcttccccgactcgcccggcattccctggggtccgaggaagcccgtgctgcccgacagccccgggttgccgggctctccgtcctgccccggtaggccgtcctctccgcgatctcccggaggcccagggtaacccgggggaccagatgggcacattctgaacagttcagaatgagcaagcacccgtgtttagtataaatggcaatgttcacctgcacatcacttcgccctgatttatcatcaccggcggatgagtaccgggctgtcccggcagtccgggattgcctcggtttcccggctcgcccggcaccccgggctcccccgcccttcccggcggacccggggggcaccgattttcttggcggcacgcgcaatgcccggccggaccaagctcttttacttgacgacgttgacgctaaatgaccaatatttatataaatgcaaaagcctaagctcacttggattttttatgtgtgatatctgccacttttatcctcggtatggatcttattcctgccatcgatctcatgtgacggggcggacacagagtgtatgcgctgagagccgaaagatggtgaactattcctgagcacgatgaagccacaggaatctctggcggaagtccgaagtgattctgacgtgcgaatcgatcgtctgacttgggtataggggcgaaagactaatcgaaccatctagtaggtgcttcccctccgaagtttcctctccgcctttttttttttttttttttttttttttttttttgagaatgat

SEQ ID NO: 4348 - DNA, 406 bp, Heterodera glycines
  misc_feature (378)..(378): n is a, c, g, or t
agcatttttcggtaaattggcaaatttcggcgtccaatgtggagagagagatgaggaaagaaaatgagagacggaggagggggaggggagacagactttgacaatgatatcagtcgcgatgattacatgcacaaccctttagtaagagattaacaaacaaacaaaacattgcttaaataattaattaatttctttttgatttgtcattttcccctctttctctgcctcccttatctctcgtcgtctttctttctctttccgtcattgcctttttccttgtcaaactgcccgtctgagatggaatttgattttgtgaagcatttgtattcatcctttttgttgtcgttgttcgactcgtcctcttttgttgttccgccngtcgacgacgaaggcactgaaaaaagca

SEQ ID NO: 4349 - DNA, 1671 bp, Heterodera glycines
ccctccctatatccctctatctcgctttccctccctttccccccccccctctcccacttacccccgtcttctctttgctgttgtggcatcggtttaacgatggactgaggctttttacttctgctgctcccagtctcattcgacggtccaattgtgtccaaataggcaacgatgccggcccgtacattttcctccactgtcattaccgtatgtgttcgctgtctgtcaattaatggcaccggcactttctgaggggcgttggaggaggaaggcattgcctgagcaagcatttaatgggtgatttgttctgtccatggcttaattttacctccaaaagtgtcgtttgatctgtccgtttcggcttttccttcttttcgttttcgatggctttttctttttccgtttcttcgcttttcccttcggctttttccttctgtcgttcgtccgttttgcgctgtttttgctcattttttgactttttattgactctgctttctgtttgctctgtttccaaatttttatttgaaaatgttttttggaccaaaacatttgccgatttgtgcataattttcgcatttaaatgcgccgattggctttttacatcggcggacgatggatcctggattgacattcttaagtaactttcaaagcttaaattaatactgtgattgtcttacagagaattgtttgacttttctgcgtctgttctctgttccaagtccaataccgtctccgcacttctttttctgacccttctttgggctttgtccacgttccgcgcccttcctccatcgtcctcttccctgctattcattccgccccttcttcctcttccgtcttcctcttccctgctattcatccccctccttcctcctcttccgtcctccccttccttttccctctcattaattccgctcctgcctcctccatcgtcctcttccctgctattcatcccgccctttcttcctcttccgtcctccgtcttcctcttccctgctattcatccccctccttcctcctcttccgtcctccccttccttttccctctcattaattccgctcctgcctcctccatcgtcctcttccctgctattcatcccgccctttcttcctcttccgtcctcctcttcctcttccatgctattcatcccgcccctttttcttcttccgtcctcctcttcctcttccctgctattcatccccctccttcttcctccatcgtcttcttccttctcatttattcttccatcgtcttcatccctctgattcatcccgctccttctttctcctccatcttcctctttccaatttgtctcctttttttcctcatcccttccgtcttggccatttattatcatatttgtagtcccggctatttcctcttccatttgagtgcttaatgagggtcgacttgtcactgtcgcgtgtccatgcaatgcttttctctccaatgaccgcgtccggtccatctcggtcattcccagccgagaattcggcccgactccgacactgctcgaccgtttgtgcactcgaccaaagctggacaatcgcgggaggggcgcccgtggcattttgagttcgacgaaaagaccgactgaaaatggaagtgccaataccatccaaccttttttgtttgggacaaacattcacgaatccccgcctgttcagcat

SEQ ID NO: 4350 - DNA, 2616 bp, Heterodera glycines
caggggtgtgatcgaaaatttttcgaaatcaggacatctggcccaaaaaatcagattttggggtcgaaaatcaggacattttgcaaaattgcttcaaatcagttatttttacaatttttgatcaaaagtgtatcaaatatttttttttttcatctcccattaacgattttaacaattttgtggagaaaattagcaaatcataaattttagcgcattcgagatcaaaaaatcagatttttaacaattttttgcggcacatttttccaaaaaacttttgggaaatgggcgagggggagggtccggcggtgccgttaggcgtcgccggaaaaatttcgtaatttcgttctgatttgttaacagattttcatcaaaaaggccgatttttgcaattaaattaaaagtcaagcgacgacttttttgctttaaaaccacttttttttgcggcgcgttttccaaaaattttgggggatggacaggggcgtccggtggcgcagtaaaatttttgcgtttttaatcgatttgttaacagatttttgtcaaaaagggaccccattttgccactcatcttatgggccccagggtcgtttgggccccaagtacagaaaaatgaaaaatcacagtaaaaacagctttttaaatttcagcataaaaatgtaaaataaacattttaaaaataattcaacaataattttaacaataaaaaatgtaaaaattaacagaaattcacgggttcattcgatagttgcgagaaattccccggagaaactccaaaataatgtgaaattgattttttgaactcgcatctccaaaattttgtcatcccatcagaactcattttagcgaaggtgtaaaggtggccttcgtaagacaattttactttttgttttttggttgcaatttggttagccatttctgaaaaatgtccaaatcagaatgtacatcaaattggttaactattaaaaaataataggatttggaataagtaaaattgtaaaaaatgagcgaatgttaattaaacctaacttataccaagtggcgagggttccctcaggcgtagtttttagaatcttaatttttaaaaaagcacatttttcaatttttgggttggggcccaaacgaccccggggcccaaaaacgggggcccaaacgaccccggggcccaaaaacgggggcccaaacgctctggtcccaaattgggccgctgtgtttagggaatataatccttacccgaatgcccttcattttaaaggtccgattttccctgtcggcaccctccgaacccaaacactcttagtttttaaattaaatcattaaatttaattttcatggatttaaaatatttttttgaattgtccaaaagtgaattgagttttcttttcgctcaaaagggacatgtcgccatcagcacaaagggaagtgttcgcgtcgcgcgtctttccctgcgattcattggcgccgctcacaccgaatggcacgacaaatgcaccggcgcccctttcgaaagtgtcgacagagtcctcgacgagtacagagacttgaccaggtaaagcgaatgagaggcgacttttccgagttttgttctcttccttgacagcgaactttcgtccctttgcgatggctccaccgaactttcccccggcgaacattccgtcgcttttcacttcaaagtcaacggggggggggggagagggaaacgcacttcgcaccgttccttttaagctgccgatggattccgtgtcgaccattgccaaagacggacacggcgtggtcaaatacttttgcgttgcgtcgttggatttgcccgacgacgggggagacaacgaaatcgttgcgggtgcagcacagaacaaccagcagggttgccgcccgaaacccgacttttttccgacccgcggcaaccctggcacagaccgacccccctctaacaaagcccccccccccctcagagaaggaattcgctgtcactgcctatctgaacttagacgcgcctcattttcggtgagaggccattgccaagtcaaatattggtgaattgagctgtacgtttcctccagggcgggtgatcaaagattagtgaattcaaatttataggaaactaatttcatatttacgatttttagagagaaaaacggtactttccataagcgggaggagggggggggggaagagaatcgctctctcgtcgcttctctaactgtctgttctcttattcctctttatctcctctttatctttccgtgcccagttttgctttgttttgcctttctttagagagcccgcccattcctccgaacaaattaccaaaggcggagttttttgcggaagaatacggcgggtgaaggcggagctgtgcgtcgaggaattgggcttaatgacgggtgagagggaaggcaaagaggggggagggaggggaggaaaagagaaaggatagagagggaagcgaaagagagagaaagggaaagagagggggagagtgaaggaaagaggggagggaaggatagaaagggaattgaagggaagattcttccaaataccaaaggaggagagacatgcgaagtgacactgacagtggcaacaacggcgaaaagggggcgccggaaaagccacgccggggag

SEQ ID NO: 4351 - DNA, 3038 bp, Heterodera glycines
atcaaatcccgaaaaaaggatcaaacaaatattcatcgcttctaattgcaaaatctttattcaactgctccttttccacttcaatttgtcggccttgccttgagaagagcagtggcattacgcgcatccggaaacaattcatggtagctgaccacgggaacataattcgcagtgattacttttcctgaaaaaggtttttaaaaaacatgtctaaaactcgggattaccagcaaaccaacgaccgtgcagagcaattactgatttatgggcgattgccaccgtcggacatttaacgtaaacgttgccctgaggggaagctttgtcgatgtatacgtgcacacatcctaagcttttttcaatataaacagtggtgttggaatgagtcacaaccgacccccgtgattagtgcactcctcaataacatcatctcgaatgtccaagtcccagccaggctctgtttctttgcctgggtcgaacatattcgtcagcataaaacattgtgttgcgaaaatgggaattttgtcggcgttttgctggtgcgcctgctgagccgcaatagcctcctgagtgaccttggggagctcgacatccgacttccctaaaagcgaacgacggtcttcttaagaaattaccagccgacctttagccaaattcgcaattaactgcagacgactcgacgaattcatattccggtcttcggattcaagagacgtttcttttttcggggtcgcctctttctcctttgaattggtctcattttcctcgacagttgtcaaccgaatatttcttccggccaattcaaatcttaataagaaacaactgaaccaattcaacttctctagcacacccattgagttgctccatcgctctgcgtccctcctcagcatggcggaactgggggatggacgatatttgcatgtgataaaagagaatggaaacaacaaaccgtcacaaagcccgtcccatcagaagaatcttttcggacatagcagcgttcaaccttaaaccgacaataattggagttcatttatgacttaaattacacgtccaaaaggttcgaatatagcggcaagcatatcatcagtaatattaggatgaagattgttgacacaaagctgcagaggcccactggaaaggccaagaccaagtcctaaaaggaggattaattaaaactacgagtttttgctattgagttaattgcaatttgttttgttcgtctcctttcctaaccaattgtattcgcagctgccaccgcatttgctgctctgtttctctcagcacaagtcatttgaataaccaagggagcgccgtgaagtttttgtccacttaaacccatcgccttaatttaaaagtaattaaaaggtaattatggcgcgaaacaataaattaatatgatatcgttgaatgaaggatcgccctgacgaatctatactgatctcatgactattagctgcacatggagatgacagtaagacccgtcagagaaactcttccattaagtaggcggaatgcacgcgaattccttgtgtggattagcccatttaagcaagaaaaaggttaccaggggaactgcctctcgctcccaaaactccacataagcaattcccttggaacgtcgcgtctttgtgtcggtaatcactcgaacatctctaacgtgtccaacacttgaaaaaaattcctccaagtcacgaggacgcgtttgacgagcaagcttaatcagaagaatttctcaataatcagaaaacgaagagccaacctggagaataaaaactgttcgctcatctctttcttcggaagtcatatccattcgagcatcacgcggcggtgatctccgaggcgtaaatggcatacttaaagaatcaaggctggaattagcataaatgtgtacttttagttgaagcgacccccctctaaactcacacatcccggcgctcgggcccgggtaaacgacgcggggcaggcgaacgacgtttctcaagaggtgatcgggaacgggagcgccgacgtgagattggagaacgacgccgatcgcgagacctagaacgagagcggcgacgatcacgagaactaaaattacagattaattccatgtaggaaagcacaatttgccttaaaaattaaatcaatgtgtctgtgtgcctggaaagcaaattaataaatttatgggagggtaatgaaggcatggcgcgaacgaatttatgaacgaaagaaaagaaaggttgtggaatatgagaggaatgagtttctgctttaacgcacgttccacgccgttcttcgtcttcatcaacaaacaaaggagaatatgatcagacgtcaagatctggagatatttaggcaattgagttcgctcactcaaattttgtgcttatccggcttcctaaccccgaatagtaaatccaatcgtaaacttgatcacctagaccgacgttttcttttgctgttctctgacggagaacgccgccttcgctctcgcgacgaatccctaaaagtaaataattaaagtgtcaaatggcgtcagaaacctcttcttcttctcgcgactgcgacttcgtctgcgctttctctccctgcttccgcttctgctacgtttacgtttgccttcactgtcactcattctaagaaaaaaacagcaattaaaatttaaaaatgtgatgtttacttgattccaacttccttcgcctttttcttgataacatcatccatctttgtcccatttttctctgcctaatttatgtattgtttatgagtgtcactataaaagccaacctcgtcaacatttttgaatgcttcttcaagaagatcatctacctcatcttcagccatttgtaattactagcgtatgactgtgtgtgttcaaatgaattctcagtatgtaataaaaatgaaattgtattttagtacttatttaataaaacccagtttggtcatgtactcatcacaatctaattgtacactaatggccagaatgtttgggtaactatgttgggtactaggaaagtcaagacgctataatcttttcgacacttgtaaagtatagt

SEQ ID NO: 4352 - DNA, 1210 bp, Heterodera glycines
gttcattataaaatttctaaaaaaccactgctttatttctcaaaaattttttttcttgaaattttcgtactaagaaaattcataagaattttttatgaaaatttctaggtttgaaaattttttttaaaaaaaattttcgggggggaaacgacggggggaaatgaagtgcacacgtttctttaagttagttttccgttgttaattaaggcaaactcaaatgggactgtgctgagaagcgaaatcgttggttccattcgaatgcgtgtgatccttacaggaatgccagaacttcgactgggactaaacgacaaagtgttgtttcaatcagtcggacgtaagcaaagattgccttaattaaaagaatttgagatcattaaattaaaagctttctttttttcttgctttggctttcttaagcttttccataatccggcagattcacccgggggggggggatttgttaacatataaagttttgtagttcggtaaaaatttatgtgtcgagtttaaaacagcatataagaagataggaacttgtagctttgagtaattaaatcctaaacttttattcaagcacttttgaaacaattataactaatttaaaatttgttttcttaataaagtcgtttatgaattgaaaaaaccgtcggtttggtgtcgtgtttttttgggaagtgagggttcgatggtgccgctaggcgccgccgtgaacaatttttggcatttgtttttgggttcattttctcctttgtgggcaaaggaggaaattggctgctttttaataccgctttttttgctgcgcgctttttccaaaaaattttggggaacatggattttttgaaaattttagtgcagattgttaacggattttatcaaaaaactgccaaatttttgcgcttttttttaccaggcgacgactttttttgttttttaaaaaacgtttttttgggcgcgcttttttgaaaaactttttggtggacaggggtccggcagcgccgataggcgccgaaattttctaattttaattctatttgttagcagattttgtctaaaaaatgaccaaattttgagattttggctaattttttaagaaaaaaataggtttttttggggggccgacggtgccgataggcgccgccggggtaaattttaagggtttttaatgaatttggttaagaaaatagccgaatttttcaggaatttccctctt

SEQ ID NO: 4353 - DNA, 4544 bp, Heterodera glycines
caggtcatttccaccaaaaaatagtaaataaaggcgaaaaggaattgcatcggacggggaatggaaccgggcctgcccccgtgtcagccgagcattctacccctggaccaccgttgcttgagcaacacaaataccaataagctgaaaaataatgtttctaagcggaagaaagtaagggatcgatgcccccccccccttatattttgtatgtttttaaacctaattgcactagggctctttttgttttgtattaattttgtggaacaatggaaccattaatttggaataaatggaattttcgttgtgaaaaaatcagttttaggacagactaattgtaaaattttttactaggaaacagaggaaaggctgttgaattggaggatgtgaagttccatcagtgcgtccgtctgtcccgtttcgaaagcgaacgcacaatcagctttattccgcctgacggtgaatttgagctgatgagttaccgtctctccgctacaataaaaccgttgatttgggtcgaggtccaattggagaagtacgcacattctcgtgtggaatatatcgtgaaggtgctgataatgtcattaagattgggtcggcgcaattttttgaaaaattctatttccttcatattgtctatttttagttttaaattatataatatagagaaaagactgaaaaacttttcctaattaagggtttggcaaaaatcatacatttatctaggatttgaagtcgttcggcaaatctgataccatattaatttattggtttaaaataccccacaaaagtcattcgctaaaaaatgcatgaaaagagtggatgttaaaaaaagtgggctaaaaataaattatataaaacacattcaatactagtcgaaatggccttaatggttttatattgtcttccattaaattttaggcgaagtcccaatttaaacgacaatctatcgcgaatcacgtggagataattgtgccggtacaaaacgacgcggattctcccaaattcaaaagcaccgtcggatcggcccgttacgcaccggagatcagtgcatttgtttggaccatacggagttttcctggtaccaatgaatgaaactcttccttttaaaattaactgcaaggaggtcgcgaatatctcatgagggcccacttcaatttgccttccatagagggcgaagacaacgaagggaaagcgccgatgagtgtcaaattcgaaatcccttacttcacaacatcggggctacaggttgtcaattcgaatgggtcttttggtgaacagaaatgacaatgttaggtacgctacttgaagatcatagaaaagagcggttaccaagcgttgccttgggttaggtacgttactcaaaacggcgactaccaaataagaatgtgatcaagaatgtgtgataaaggatttgtatgttgccttactttatttatgtaaaacatttaatatcttctgttgaaattcggttcctttgtttaagataaaatgtttagaaagaggagcaaagatatttaaactcagtaaacacatttcatcatttgttgagttaggctaggaaaattcagtttaatgtatattaaattttccatttttatactctcgagaacttaagaatttgaagaataaaaaaggatgattatattcttcgacataaataattattttacaattagattggtgaataagtccgtgagtttcttttactaattttatttcatacgaaaagagaacaaaatagaccttgaacctccgccctttttccctttattatctttcaaaaaccacttaaccaaacatatttacttttaaaactgggagcccaaaattgagtggtgcaaatgttggaacacaaaaaggaaataatctataatgcacaacaaaattaaaaataactcttttttgtctttttcattgggacacaaattcggaaggattagcgaagcttccccttcgcataatcatatatttgaggttaaatcgaatatttgtcttttttattgtacttgcatattttacagtcatatacaggcattgtgatataaaatttactaaccggagatcaaaattatcagtgaaaggtggaaagaaatgatcggtgttaatccagtggtttgcgaaaaaactgatatgggagtaaagggggcgcattcccaaacggatcatcgctgatctgttgctccatcgatgtcaaatccaaacccaaaatgtttggccgattaatttcactttggaagtccgattgttgttcgacgacacaactccgtcgcatttcatcgaagcattcaccaaaagcgttgtcgtccatgtgatggtcgatggtggacatacacggctgaatgaacggattggacgattcgaacaaagtatttccagccaatgtttgaagcgtaaggttcaaattgttggcgtcggccgaagaattactctcacgttggccataagtcagagtataaggcctaattaagccaaaattataagaaaagagacacgcgaaagaaacttcacctaaatgcgctttgagttagcttcggcggatttgaaacatcgcttttttgtgtgttatcgtaaatcgtgtgattttcatgtgctgccttaacaaattaaacaagcaaagtattggcatcaaaaaggcagaatggtctcacagcattggccactgtttgttgcttgagctgttgctgtccggacaaaggcatttcccccctttcatcggccgtttctttgcgctgcgacattggagtggaatttaccaggaccgcttggggtttgggcctaagccgtgggttaactgatgttgttgtggcccgtcgatgcgtttcggtacaatgtgaagaggctgtgttcacaatcattccttctgatgctgctaaaagggccgaagagctgctacaaacggccgaacagtcgtccgttcggtgcccggggagttctgacggttttatccctgcgacgaatgttcgctgcattccgtctcggctgtgcctttcttcgatgacttcacccggccctctcccaaccgaaggggccgtgtgccttcgccgttgtgcctcaaagtcgttaaaagccttttcatacaaacgcgcgtaatcggagccaagcttattgcgcattttcagaatctgaacagcttcactcagttcgatccgcaaacttttctgaacaacaaaatttacaaaatcgaaaaagaggaaataacttcgatgttatacactggacatttgcgatcggcagcgaaaaatgccaaatacgaagcttggtaaacatttggcctgtgtttggcattcagagtgaggagaagatctatgaagacgaagataacattcaagagaaatgactaacaataaacccactaattatggcctttatttggtcagagattggcggagattcggggaaagtgaacagtccattttgaatagccaacgcagattcaccaaacggaagtgagaagtaacaaagtttgtacagcaaaatgcccaacgcccaaatgtcggactttgtatctaaaaacatagtctttttgatatgaattttgttcaaaaaatcacaataactaatgctaaccaattggaatgcccgaatacaaatcaatcatttccggggctcgataactgagagtggtgtaacgttgaatctcttcctccataaaggctgaaaagaaaagtaactgaaaagttggagagacaatgaatgattgattgaatgaccatgggtgtaatgttccttagaaagaacttttgttgtggagctgccaaaatcgcagagaatgtacgtggacttttcatgagcattccgttggtcaatcagaatattttctatctaaatgcaataaaaaatatcatcgattctattgggttaatacattaaaagggagggggtctatagaatttttacgaggggcaggggaggggggattggcagccaaaaacgcgaaggtagtccaatctcgacgaccttttgtttgccgaaaaataaaagaagtccgcaatagggaaaaagaaattttggtaagtattctatcatcttctatataggtaccctaataatccaatgggttgaccgtacctttaagtcgcgatgaattacgggcgttttcgagtggtgaagacgtgcaacagcttcacaaacatcgcaaaaaatatccaagatttcacgagcagaaagccattcattcagcaaaagccgagcattcatcaattgcagaacattggctaatcaaagaaaaagcgtttgacccatggaatttgtgtgactttaccttggtaataagcctaaaattgaaaacaatttgaatttgtttactttcccgacttcgtaatcccttttttgattaaaacgtaccgtcaaaagcatgtaatcgtaaatgcccactttgttaacagaaagctgatgatcaatatatgaaacaatatttttgtggccgttgagatttttctaaactgagtaaaacactatttaatattgataattgaagtaaaaaaccgaccacaatttgaatttcggtccgacatgcttcgacctgtctcgggtcatcgcgcact

SEQ ID NO: 4354 - DNA, 3915 bp, Heterodera glycines
gaaaaaatggactttttgaatgcaaattttgcgcatttctttcgacatgtcataagcggttgttacggggacaaatgcaaaccaattgggtgctatcgaatgagctaggcgcgctctacaattccaaatgtatcaataaagggtctaccgccactccctgccgagatctggccagtcaaagcagagtggggtctataacactgatttttgttaaccgtcggcttttgcctttatctcgagcctgctctactagtgcatcctttcccaatgtggcactgctccagaactcttgtactgcttcacgacggattgttgagataatttttctcacccatttcttttatttccaagcatagacattattaagtgaagttaatagctttctggaaaaaatagttgaacaatataagcctgtttcgtgaatatttacaacaaaattttatagacaatttctaaaaaggaaggaaaacaaattttttggtctcatgttttatgtcatgttgttgaatggcttagactgcttcagatgcggttgggcaaagttttgggcttttcgagaaaagttttctcagaaaaatcaggaacaaataaaaattttatggaaatagttgaacaatataagcctgtttcgtgaatatttacaacaaaattttatagacaatttctaaaaaggaaggaaaacaaattttttggtctcatgttttatgtcatgttgttgaatggcttagactgcttcagatgcggttgggcaaagttttgggcttttcgagaaaagttttctcagaaaaatcaggaacaaataaaaattttatggaaaaagttgagaaatataagcctttttcgtgaatagttacaacaaaattttatagacaatttctaaaaaggaaggaaaacaaattttttggtctcatgttttatgtcatgttgttgaatggcttagactgcttcagatgcggttgaaaaagtttttggcttttcgcgaaacgttttcccagaaaattctggggacaaataaaaattaagcttctattaggagcgatttaatgttcttatcaacttctggtttgctttaccacgctggccaatgaaaaaatggacttttttgaatgcaaatttttgcgcattttctttcgacatgtcataagcgggttgttacggggacaaatgcaaaccaatttggtgctattcgaatgagctaggcgcgctctacaattccaaatgtatcaataaagggtctaccgccactccctgccgagatctggccagtcaaagcagagtggggtctataacactgatttttgttaaccgtcggcttttgcctttatctcgagcctgctctactagtgcatcctttcccaatgtggcactgctccagaactcttgtactgcttcacgacggattgttgagataatttttctcacccatttcttttatttccaagcatagacattattaagtgaagttaatagctttctggaaaaaatagttgaacaatataagcctgtttcgtgaatatttacaacaaaattttatagacaatttctaaaaaggaaggaaaacaaattttttggtctcatgttttatgtcatgttgttgaatggcttagactgcttcagatgcggttgggcaaagttttgggcttttcgagaaaagttttctcagaaaaatcaggaacaaataaaaattttatggaaaaagttgagaaatataagcctttttcgtgaatagttacaacaaaattttatagacaatttctaaaaaggaaggaaaacaaattttttggtctcatgttttatgtcatgttgttgaatggcttagactgcttcagatgcggttgaaaaagtttttggcttttcgcgaaaagttttcccagaaaattctggggacaaataaaaattaagcttctattaggagcgatttaatgttcttatcaacttctggtttgctttaccacgctggccaatgaaaaaatggacttttttgaatgcaaatttttgcgcattttctttcgacatgtcataagcgggttgttacggggacaaatgcaaaccaatttggtgctattcgaatgagctaggcgcgctctacaattccaaatgtatcaataaagggtctaccgccactccctgccgagatctggccagtcaaagcagagtggggtctataacactgatttttgttaaccgtcggcttttgcctttatctcgagcctgctctactagtgcatcctttcccaatgtggcactgctccagaactcttgtactgcttcacgacggattgttgagataatttttctcacccatttcttttatttccaagcatagacattattaagtgaagttaatagctttctggaaaaaatagttgaacaatataagcctgtttcgtgaatatttacaacaaaattttatagacaatttctaaaaaggaaggaaaacaaattttttggtctcatgttttatgtcatgttgttgaatggcttagactgcttcagatgcggttgggcaaagttttgggcttttcgagaaaagttttctcagaaaaatcaggaacaaataaaaattttatggaaaaagttgagaaatataagcctttttcgtgaatagttacaacaaaattttatagacaatttctaaaaaggaaggaaaacaaattttttggtctcatgttttatgtcatgttgttgaatggcttagactgcttcagatgcggttgaaaaagtttttggcttttcgcgaaaagttttcccagaaaattctggggacaaataaaaattaagcttctattaggagcgatttaatgttcttatcaacttctggtttgctttaccacgctggccaatgaaaaaatggacttttttgaatgcaaatttttgcgcattttctttcgacatgtcataagcgggttgttacggggacaaatgcaaaccaatttggtgctattcgaatgagctaggcgcgctctacaattccaaatgtatcaataaagggtctaccgccactccctgccgagatctggccagtcaaagcagagtggggtctataacactgatttttgttaaccgtcggcttttgcctttatctcgagcctgctctactagtgcatcctttcccaatgtggcactgctccagaactcttgtactgcttcacgacggattgttgagataatttttctcacccatttcttttatttccaagcatagacattattaagtgaagttaatagctttctggaaaaaatagttgaacaatataagcctgtttcgtgaatatttacaacaaaattttatagacaatttctaaaaaggaaggaaaacaaattttttggtctcatgttttatgtcatgttgttgaatggcttagactgcttcagatgcggttgaaaaagtttttggcttttcgcgaaaagttttcccagaaaattctggggacaaataaaaattaagcttctattaggagcgatttaatgttcttatcaacttctggtttgctttaccacgctggccaatgaaaaaatggacttttttgaatgcaaatttttgcgcattttctttcgacatgtcataagcgggttgttacggggacaaatgcaaaccaatttggtgctattcgaatgagctaggcgcgctctacaattccaaatgtatcaataaagggtctaccgccactccctgccgagatctggccagtcaaagcagagtggggtctataacactgatttttgttaaccgtcggcttttgcctttatctcgagcctgctctactagtgcatcctttcccaatgtggcactgctccagaactcttgtactgcttcacgacgtattgttgagataatttttctcacccatttcttttatttccaagcatagacattattaagtgaagttaatagctttctggaaaaaatagttg

SEQ ID NO: 4355 - DNA, 1302 bp, Heterodera glycines
  misc_feature (1226)..(1226): n is a, c, g, or t
  misc_feature (1277)..(1277): n is a, c, g, or t
ggggagcagcgaaatgcacaattcgtggtccctttaaaatggaagattttcttggatgaaatggcaggaggaaaaacggacgaaatgagcgaattgatcacttccggctctttgttcacgtccaccaccaccgactcaatgttactgccaagcgaagccaatcgctggccgtcctttgacgaatcgctggccacggtcaattggacattcgatcgcgaggcgtaatatttggccaaggggtcggacaccttaatgaggtcaaattgggagaaaaaagggaaacgatggtcgagagtattgagtttgttgatgcaaagaaaagagaccattccggcgccaagaagcagcacacgctttgaactaacagccacaacacgcgatttgtgcgcagaccgtctaaacacagtggaagtttgtgatttaattggtttagtgattagtctgtcccctttccttctctctcctcactctctctccttttctcactctttctctctctctccccctcctctctctctcttctctccgcccactctctctctcctctctccctctttctctcttatctttctcacactccttttttcccttctcacctctgctccaatctaagctcgtcaatgtatttgtagccgggtgttaattgcccatctgaagtgattatcgcccgtttgatttcgtcgcgacattgcagcgaagcgaacggctgatcagtgttacaatttagcttaaaggaatgggggaggtgtttaagaaaatgcatttttggcaccaaatccatcatataagggagcagcaacgagccaaactgttcagtggcctcgacggggagttgggcgggcatattatcaacggaacagatgagacagccggaagaagcatcgaagctaagtcaaatggcaattagaagagagaagccgcttttgactcacttctcatggcatttgtttgtgtccgcgtcgtaaatgacaaagggtttgtcgatggtggtgcattcggtcataaattcgatggaaccgccggggtcggcggaaatgtcacaaatggccatcggaaaaggggaagggacaatcgactacttaaagaggggagagcagagcagcaacagaaagtgcccaccaatcggtggggcaacgacggacagccggggacctaagggggagagaaaagcaggaaatgaacaaagccaggcaattaggcacctccaaacttttgttcacagttgnggtcaacaggtattttgcatcgggaatggtgagcaatctgtgaggaattanacgatgaaatgccattggcggaggg

SEQ ID NO: 4356 - DNA, 1164 bp, Heterodera glycines
caaaacaaaacacagggacaaaagcagtgccaaaatttccaatcacctcccacgcgttgattgtctcccgtcggatgccaattgttggcacgcctcgacttgtgtaggaaaatgaagaagccgtggaatgattggaagggagcaagaaggacgaaatggaggacactgaggaggaggaagaagtggaaggacggacacggagaagggaagaaagtcgcgcacaagtcattgctttatttacccccgggggaggaagaggaaaaacttaaaatgaaaataaataggaaataaattatgacaattattttagggaacggacacaaacactgattaaagaaagggaataacttcaaaaaggggacggaatgaatgggttggctgattatttattattggaatgatatttaacggccgaatcagtcactgccaataaaagaccccttctccacccccccccattcactcatcacaaatttgagaagttccgcccactgatattgggagagaagctgatgtaaccatcgaaaagtgtcaaaggggacaattcaacacaacacgacgaaatttcttttgcaatattttccaaattcccaaatgtcccacaatcgttctcaagagaattggtgtttattcgctttataaataagtgatttcgaatgaaattgaaggccggccgatcagcagaaaagggcgagggaagtgacgacggaagggcggggggagggggaggagagaacgtgacaaaaacgactgaataataatgttcatttgattgggttaggctgatgcaataatcgtcggatcgaacgctatgagaaaagagaagaaaaagcagcaaaaccgaaaccaaagggagcaaatgacgagccgatcattagaaagggccgggcttcaaacgacgagccaacaaacaaatgactctgtgatttttaaaagtacaaaaactaaaggaaggataaaagggatttagtctctctcttccgccaaatcagccttaagccctgctgatgaagtcaaattccgacacgtgggcctgagaaaacacgtgaaaacgaggaattattcaaaaatacgaggggggggggggaggagggaaaaataacaacacgtgggaccaaatcgagcaatgaaagggaaagaaatgtgcaactacggagggggggg

SEQ ID NO: 4357 - DNA, 5387 bp, Heterodera glycines
gcaatcaatccaaagggaatgatcgatggtcagcccaactgtgtcagtcccttaatattttgtaattttgcaaaaaccaattaatagaaaattagtttggagaaaaaattgagttaaattctcaaacattttttacgtgtccgcgtgaggagaaatggaggcattcttcggatagtaattgacaatcgcagcatccggcacgagggggaacgaaccaagcactgaactcaacaatcgctcaatgtgcagaaacgacaaccaaaacgcaccatcgatcaccaatttggaaatttgtttaatttccatcggcagtgctttttcttccatcgaataatctttgctagtccaatcgtaatcgaggccaagtgtcgtccatcgcaatttctcagctccacatgtcttgaagacggaactgccggaataagtgccattggacgacaaattggtgatgttaggcggttcggggtactcaaaaagactccttcccagccaacgaagctgttgctcctcagaaaataatccgaagagaatgtataatcctggtcgactcggcaaagtggagaccatccattcatctaagggcctaaaaagctctgccatgccatagcactaaaccgaatcaattgtcttgcataacttagcccatccaatttttctcgttgctcataaattttgctccgttggtaatgaaaattttgatcagtggtctcgaatatccaaggtgtgtacgtagtcaatggctgcagaaaacaaaaacgactgttgttgtgagggtcaataacattggatcgccaatcgtagcttttgtttttgtaaagtttaaattgatttctgatcccaatttcggggtcagactttgaaaaagggtcaattacagtagaatacatcaaattcacaaattgaatctggcttaaaagttaaatatatatgtaaatggttgaagaaataaattaaaattatatatttttttacatttctatttacgaaaatttaaaagttaaaggctatttatttattttccaccggctatcgatcgaattacctacctaatttcttataattcaaaaaatatgtatgtacctaatctagtttttaagctttaatatgggcactgaacaagaaattaattatcgcgagcctaccttttcccaacgcattgccaacagcaaagttttcgttattggtgcaggtggaattggttgtgaacttctaaaaaatttggcactgacaggattcaaaaaaattagtgtggtagtttttttttttggatggaacggcattcgaaaatatcaaccttcagattgacttggacactattgacattagcaatttgaatcgtcagtttctgtttcggaagaagcatgtcggaaaatccaaggcggaagttgctagtgaagcagtcaaacagatagcccctgacgtcgatataacgtttttccatgactcaattatgaacgagcgctttgacgttgatttctttcggcaattttctctcgttatgaacgctttggacaacaaaggtgtgaggaccgagttttttatgtaacaaaacaaaattcgtttttagccgctagaagtcacgcgaatagactctgtttggttgccggggttcctttgattgaaagcggttccgcgggttatctcggccaagttgcagtcatattgaaaggccgtactgaatgttatgactgcacaccgaagccgaaccaaaagacatatgcaagttgtaccatccgaaacacacccacggaaatgatccattgcgttgtttgggccaagagtttgttcaagtaagcgactcgaaaggcttattattaggatcacgtttaaacgcatagttcattttgttacgttctttcccttttacaattagtcaactttttggcgagagtgaccctgatgacgatgtttctcctgagacggtcacttccgatggaatgggcgaccaaaaaaactcacaaacaatggataatgatgggacgaccaccaatggaagtgttatttttgctgacaatgggaatagtagtgctaatgatgcgattacaaaaaatggaaaaatgagcacacggcaatttgcggaagcgacggattacggaccaaaacaaatttttgagaaggtttgtttaacaaagtaaaacattcttgttaagtttcagacttttagttgttctttgatgacattaattatttgctttcgatggccgatctttggaaggagcggaagaaaccaacgccaattcactttatgcaagttattgacgaaggttttcaattttttaaggtggatctctgattttaaaatggatttgtttaactaaaggacttggtgggagtcggccgaatgaggacgagaacgagcattggggcgtatcgaaatgggctgaactgtttgaggactctctttttgcgcttgcggaaagataccgaggagctgtcaaggaaaagcgaatgctcatctgggacaaggacgacgagccggcaatgcaatttgttgcggcctgtgccaatctacgggcttacatttttggaatcggcacaaaaccattgtttgacctgaaaggttttaattggtcgcgaaatgccttcaaaattagtttttagctatggctggcaacattatcccggctattgccacaaccaatgcctgtgttgctggaatgattgtcgtcgaggctctgaaaatcgtttctggtcagctgagcaaatgtcgaacggtaactttcgcttgtccaattaattcccttttcatttgtttagatttttatcaaacgcttaccaaatccgcaagggaaaattttggtggaccaggaacccagtgctccgttcccgaaatgttatgtctgttccggcaaaggagaggtgacacatacgacaccattactccaaaatattgcccattcttggttctttttcaggtgattgtacacgtcaatttaaatgaaatgttgctcagaacattccgtcaaaatgttttggtcggtgctttgaacatgttgaagcctgacgtgatggatctctgccaaaaccaccgaattttgctctccagtgaagaaggcgaaaccgactccattttggaccgttctcttggcttattgggagttttgaacggcacgcaattggagtgcgatgactatgcccagcaattgaacttcaagctgatccttttcaacgacaacacactgacgggcgaacagttcaaaaaagtcgaagatcaggcgacgaaaggggcgaaaagcatttctgacgacaaacagaaaagagaaaacgaaatagacgaggaggaaggagtgccagtgaaaaaggcgaagattctctgcgaaacctgaatgggctttacatttcttgaaatgtccatcgttattattattattattgttttattattattgtcatttaattgcttgcaattttgttatttttgatcaatattgcattgtcactgaaaatagttccttcgtttatttcatgcatttgtttgtttctgtcaatatttatttttgcattaattgccccattaagaaacgttgttttatttagaattttagaaaatggatttgttagaaatcattgcccagaaaagaaaacagattgaggatattgcaatcgaacatggggtaacattattagcattttgatctcccaattaataatggttctcagagtggtgcgaaaatgatcagacattctgatctgtttaagaaagagaaggacgcttatttggagcgacaaaaacagctgggaaaggaacagcacctttctgtcaagggtttaaacaccgaggaacttttggacgcaaagttttcattgaccggctcggattcgatgccgcgtcccgaagttgtgcgtcttgagggcccgagggcagcccattcggctttttggtgaatccgatgcgatggctttaaagcgattgaggcgtttggaaattgaaaagacggaacaaaatgaggggtggaagaacgactttcaagcggcactcagtcaggtggagaatgaggaactgatggagcaagtgatcagggggaagcgtggaaaagacgaaatgggcagacacgacgtgcaaattgaacagagtgaggatgacgccagctgggaccaaattgtggtaagaagcagtttcattggggttcgtacaaaattcatatgacggttcttccaaaatttaaaacagattttttgagaggattcttaaaagcgtgttaagacatttgcggtccggacatttgcgcctcggacatttgcgtcccatttcttaagggccattttcggacatttgcggcccgacaaatgcggtcggacatttgcgcctcggacatttgcgtcccatttcttaagggccattttcggacatttgcggcctgctgaaaatcggacatttgcggccaacggaacgccaaatattacttttttaattccaaagaaacatttgcggcccgactttttcgaccccaaggccagaatagggctcatttatcgaaaatcctttttcctcttaaattttcgccgaaatttattcaatccagtaattatttttaaaaaattgggctgtcaaaaccccactagagctcgaaagttgcgctagtcagtctaccaactactgtagagatctgagattccctaataatgttctccatcattttgggacttgtttcgctgatattctgctcctcctcttcattgcttccagttgggtgggggttaggaaattttttttctctagaagacttgaatcggcttattagaaagagcattaaattcggttaaattggatggaaaataatttcctgaagtttttattttgttgaagtcgaaaaagttgagccgaaaatgtcgtttttggctgtggccgcaaatgtccgaccgcatttgtcgggccgcaaatgtacgattttcagcaggccgcaaaaagtttttcgccgcaaatgtcctacaaccaaaggaacagtgtagtcagagaaattgagaaaattagcgatgaaagaaattaaaatgcagagtgtgagacgaaaggagagagagaagagagagttcgggaaaggtcgcatctcatagtttcgggaaataccaacgaggaaattgataatgttttctgggtcatgcacgggcaggaaggccaatgaggtgatcattttagactgctcttcgaaagcaggatcagtgttataaacctaaataagtcagaaaacaatttatgatccaaaaaattcaaactgaaaagaataattaaaatccgaaagaaaaataagagcaaaacaattttttggtaaaataatagagcatgaattatctaatatgcaaccacgcgaaaatggccacgcgaaaacgaccctgaccccaaggagagagaacaacgaaaggagagatgagaaaaaactttcaagattatt

SEQ ID NO: 4358 - DNA, 3997 bp, Heterodera glycines
ttttttttggggagcggtaccgggaacatgagttttttcaaaactggggacgggggccctcgaatggctgggaattctcgggccggtcccgttcccgtggcactctaattatttttgatgtaaagttgtgtaggtctttatttgaacacttcgtccttaaaatttcttcagtccatttgcagaatttaagccggacagcgcaggaaaggtcctatgatttggctttagtcgagctagtcccagtcaaagtgaacgggatcggaactaaaagtcgtatttgccgggactctcgtcccggtgtttccagttcaggcttatggtgaaaatcttccatttatcattaagtcccaatttttccttaaatttcctcaactttttaaagttttgtatcaaaaaattcacaaatttttaaaacaacaaaaaattctcattttcaaaaaaccctttttaacccctccaaaagggtggggggaagtttgggcaccaaaagtttgggcaccgggaagcaatgcaatttttaaaaaattaaaaaatatttttgttaattaaattttatgcatttgttgattatatgttaaatatataaaagaaaaaaataattaaaaagcaaatggaaaaataaattaattaaaaagtaaatgactaaattattagtatgtatttacttttcactgatttattatataaataatttgagataaatgttaattaaaataatttgaattagccaacatttatcagctttttgaaatcgttatctttagtctgcacatctgctgtttacataaacattaatatataggatgaaagtgaataaaaatattttcatgaataacttaagatgggaattgtccattataaattttttctgttttctgtgtttaatttacccaaagattttcggttttttacaatttaaattttttacatcgtcgagcggaagcagctttacgtgccttatacaatggcacttcccgaggatcagaatttgtgtcaagcgattcatctgaggggcagcagaaggagcccctcagcacataaattttttgtaaattgtttcaaaacgccatggctaggaaagtaaatcgcttttaacgcacaatggctttgaataggctcccggacagtggacattccgacagtggacaatcggacaatccgacagaggtggacaatcggacagtgggtaatccgacggtaaaatgcacaaaaagattaagaaaatgccatcgccgaagtgaaccgattgggcaaaggtatagattattggtcccgaaaattattttttaaataaagtttaagaaaattatttttaggggtaatctgaggcgccgagcacgaatccggccttattttggctcagtctcgaatcccgaacccggactcgaacaaaagttcgagaattcaatttttcgtacttcgcagttttagttcaaaacccggctaggtatatacgtggaatcaaacaggatcttattaatacgtcaataaaagattatttaaaccattttgcaccaaaaatgtaaagtttgaaaaatttagatttttgaactattattcgaatctgggtcaggggttcgaatttggtcgaaattgatgtcagaatcggatctccgaccctgaacacccctaaacaactttgtttctagaaaaaaaaattaaaatttttcaaaaaaagggtgcggggtaccatcgacagtattacgaaatgttcgaatccgggttcggggttcgagactgagacaaaataaggccggattcgtgctcggcgcctaagattacccctaaaaataatttcctcaaatttttattaaaaaaaaattttcgggaccaaggggggggggggtcagttcggcgccgccaactttgaaatgccttaagcgccatgaaaacaatttgccaaattgggtgtggaggaaatttggtcaattcttccggtggcaaaaaatgaaggcgaaatcggttcatatccacaaaatttatgatgattatcctgtcatttcaaataattctcttgtttctttctccgctaaccaatcggcgccgtcacttatcatcaacgaccttttcgttgcttttgctcgttttttttggcggagacaattgcctaaataacgggttcagatttttgaaaaacccgaattggggatggcacgcccggccctgccaagatttaaatgcgtgttcagttgttggtctctttaagacccggaccctaatgggcttataccctctgttctggttctcatttttgattcgatgaaaactaaaaagagcaaatgccctgtgctcagtgcttacccaatgcaattgtcaccaatcaaatgaagcttgactccgttcaaattgtctgccgaattttcgtcttcccattgaaccgccgccgccgtctccccaacaattgggcatcgcttcaacagccaattaacatatccaaaatcgccttcgtgcttctgcaggcttagcttttcgttggtccgctcgttcaccaatgcaaaaagtgccattgacaatgccgggaaatgacaaaattccacattgtaattagcagcaacggtggcactgataaatgcctaaacaatgttcggtcaattgtacggtctgatcagaattatttgattggacctctttgatattgttgatccattttgtaatttctggatctgcatgaacaagatctttgtaaaacaatcgcctcggctgcccatcagtgcgcggagtgtgcaaccatttagccaatgattggccggcagttctatatagcccatccaaatcacctaatccatccgggagcacaccattggcttcaattgatctcaggtttagatcggtaagaattgttggcgaaatgagacggcgcaaattgaacagatgatttgcagtgggaaagtacaaatggtgaatattaggggcaaaagtgggcaaaatttgacgggccaatacatccaaaatcggaatgacgttgtctattttgtatgaacacacatccaaatacaaattggtgcctcgggcgaaaatgtgcttattggagcggagaaatgtgatcacggaatggcaaatgtacctgaaaacgaatgactgactatcaacatttaataatgaaagaaagcattagagtactcaattttgaaaaaataaaagcgaattttgttgggcagcggacggtcgggcaagggaaaaaactcaaatttgtcattaattggtacagatattataggtttttcagcatttttgtcttctcgaattgcgattgttctccaaattgtccattcgcttttgccatcgaaatgtttgtccactaaaacatcaaaacggggcgaaagcaatgccatttttaggccgagtttggcatggtcaaaaagaggaaaaatgtccatccaaacgtcgttgcacacccagctgaaattgtggaaaatattttagggttaatgaaaactttgataccgtcggttcattatgtgacaattaacacaattttccgtattccaagtgaaaaagaagatatgtaggtagggaaagcggaaaatatatgtacccttattccgcttttctttgaactctggggagagttttgtcgaacgcaagattagaggcgcagaggactttttcgccaatttgaggcgattatcggcaataaaaactgatttgcctgaggcaaaggaaaggcacaaattgtgggacaattaggggagggctgagggcaaagagggaaagttatctttttgaatttggatggacagtcaaatcggcaaaagttgatgacaaaaaatgggaaggagacagaacggacatctgctactggcaaaaaaagacaagttcaaaaaggatttgtattttaaaagaaaatttcaatatctttcttcatctctattttttaaatggtatttcttcctttttggtatttttttaatttttcggagggagggggaatggaatggcacttaacgcagagttagtcggtaccggcacggtaatttttttttatttaaatggagat

SEQ ID NO: 4359 - DNA, 4804 bp, Heterodera glycines
ttttattacattgttgatcgagcaaaactaaattctaccaaaagtaacacgtacagttaattaaataaattataatttggctgctattttctgcggcttttcttttgatgagaaaatcatgaaaaccatggttttatctcgacaattgatcattttagcgccaccactattcttcattactgatgcatatttttgactttttatactaaataattgcttaattattttgatatttcatcattattttcgtcctttttataattctctagaaattttttaacgaaaaagcagtaaaaaacgaaaaaacgaaaaaaagagaaaaacttcaaaaactgatgcttaataatccaaaaatttgaattttgataggtttcttctaattatgtccaattattttcgtgagcgactctttggccattgcttttttgctgatttgtgagttggccaattcctgatcaatatccaagtcattaatttgccaattccctcacttttgactaatattcacatttttaatgcaaaaattcatgaataatgccaattaaaaattggtgatttaaaggaaaaatttatttcctttctcatcgcattgaacattcaattatgaattacaatttttttttcaatttacaattgtttttgggggtttttttgttctttttccctacttttttcaacctggcggaacaatcgggcaaatttatttttagaaaattagtttaaattgaatacccaccaatccatatttttaatgctgaatttaaccagcctgcatctcaactgaccacgctataaaaagcgcttaaaagcccgtttgaatgatttttttattgcttatcgatttagaccgatgtttttaggcattttttaatttgtggactatgatcaatgttttcccaattttcttcaaaatatttttagctttgttgtttttttaattttaattttaattttttgctatttttaagagattttctttaaatttaatgaatttaaaaaattgaaaaatttatatgcatatttttcaccttttaagtgcatattttactattttagtgcgtattttgcgattttatatgcatataatttttggaaaaggcgggatttgctggattaatcccgatggatccggacccgaaaattttttaaaattccaatccagcagagggatccacaaatttggtttttttctgcgaaatcccgccgaatccgcattgcattttttgaaaatctcaaagacggaatgccaaatattttccaaataattttatgcatgaaaaacaacattttgtccaggaaggctcccggacatttcgacaatgaccgtttcgccaatacctttcgacaatgccgtctcgacaataaaattaaatatatatttttaaataaaattcaaatttctctaaatgatatgagatagtgctggtatgggatcaatataaaatagttttttttcgtttttgttcaaaattgcattatgagaatggctttagttttcgaacctaaaaatcactaatttaatttttttttcgccacttacaaataagataattaggccattatttttaattatctaattatttttggatttttcgccactaaaaatacccaccctaatacataaaactgctattctttgcaaaatataataattatttgcaaatccaatatccctttgcgatcaatattattattttattattactattcataataatggaaaagatttttagatttcgagaaaattctagaaaatcaaatgaaataaaatttgttttatttaacatttattgaaaattcgtagcatttaattaatttattcttaaaaattattttctcgctgaatgaattgtttatttttaatattattttttgctttttgtccactctttcgcattgccttcttttcccaactatcatcatcagctgaggtttgttggtgttcttttggactgtgttcaaatcttaatttgaaaatgcctcattttaagccccgttctttaagctaattaaatgcgcacataatgagttaagaattcaaccgaaaatctgtgacagtaaaaggagcccggaatttaaaaaaatcgggatcgggctttgggattggtggattcgggccgggactgaaatccagattttgccggaatttcaatctcgaaccgggatacaagcccgattttgttgggatcacgatcctggtcattttctcaaaaaaaagcctgggttgagacccggaaaaataccgcgggatctcgatccctcccggctctaatattaacgggcaaaatttaaagaaaaatgatattgtaagccaattttttcatcccaaagcccaacaatccacttttttggggctgtacttggccacaatcgcatttaaattcaaccaattgaaaaattccaaaacgcatgaccaatgaatgaattttggcattggtcagtaatctaagccaatgaaccttttagtttttttagtgtttatatttcaaaattttgtgcagattgacaacgacgcgcttgtagcttttgtgaaagggccctccaattttgtgcagttttgcgccgccaaaggtgtggccaacaatgaaagcaaagggcttttggcccgagtttatggcacacaccttggcatgctgtaccacatgagactgaattggcactgtgccagaacgaacaattcgatacacagaatgctgtacaagagaaaatgcgaatactttcgcaaaagtgtggatattttgtacgaatatttgtcgagggttcacaacggaggaaacgcggaagtgacgaggccaattttcaaggccgaatccacttctattcagctgacatttgttgatgtcgtggagtgtttggccacaatttccaatttttatttttgtgatcaaaaaatgacaaataattacgaaataatgaaagaaatggccaagttcagtcagttcaaattggaaaatgaggagcagcaattggattttaagagcggaaaaagtgccaaacaaaaaaacaaaaggctgaaaacagatggaaaggcaaatggaatagaatttgagcaaaaaatggaaaaaatgttcaggaagataataatagagaatgctaaattggcaaatggaagctcatcatcggcattttcatcgtcgacatttccatcatctgcgtttccgttaccgatttccatgtgcaccgtacctatttatgatgccgctttgcgcgtgccaatatatgacatgagcgatgctgtaagtttctcgaaaaaacaaatattcgggttagggctgccattcgacaaaattactcggaaatgcttccggaaaaatgcgtcagcaatattaatttccataccaattcaggattagttttcaaattataaaactactgtatctctttttaaattcactgactcattttccggtcaagtttggaaaaataaagaattacagaagtagccaaaccagattgaatttttgaaattggtgcaggaaaatgccaaaagatttaaatggttgttatttcgtgccatttttgataaaaatctcaacacttgcagattgaagaagaattatttcttaaatttgtgaacggaagtgccgatttttccgcacattttgctgctgtgccattagatgaaattaaaaagtacgaaactcatcttggtctactgtatgcgatgaaaacaaattggcgttgtgccaatgccaaaaataaaattgacaacagctgcaccaaagatcgccgatacattgacattttgtatgaatatttgttcatgattcgctatggaattaagtctgtgaagccgatgttcgagactcttgtagggcaacggtaatattatgtttaaaaaagcaggaagtaaaagggaaacccgaaaaacggtaattaaccctctttagtcattcgtcctaaattatttttaaaattttttcgaaaataatttaaaccgctaaacatttaccccaattttaggaggtttttgcatttcagtccccttaaatataaattaattggtaatcagttggattaaaaattgcatttgggattttaggccgagtgagtcaaagtttaatgaatgttgtgcatttattgggcaccatttctaaatattacgccacgggatatgaaaatgcagaaggcaaagcattgcctaatgagccatttaagctaaaattaacaaatgaaaacgaattgctgaattatggcgcaaaatcagcggcaggtaataatgacaaagaaaaggcttgaggacattatgaaatttataaaaccaaaaacattatcaaaacgatttattgggaatttattgcgattaatgaggtttctattaaatttgctgaatttaaatatgtgtgtatgtatggtctattaagaaattataaggacacttcacctacttcccataaatttgtaacggaaatttgtaattagtgccgccctgatatgcagacaggctttaggccctataaaccacaaaaaaacaggcacaaaaacaaaagtgccattttctctgtaattctcggtaatttaaccagtttggcttttttggatgtcgctatttgcagatttattctaaaacagccatttttaagctttttttaaaaaataattacaagtggggcacctttgtcatttgtccattagcagggatcatttttaatgtaaatacatattttttcctggcttttccatgcttctaaatagtgggaaaaacactttcttttttgtttttccgaacaaaaatcgggacttttatttacatatttcggggtttttctacatattacatatgtacatatttttatacatattt

SEQ ID NO: 4360 - DNA, 4843 bp, Heterodera glycines
  misc_feature (4390)..(4390): n is a, c, g, or t
tttcgaatgataccaaatttgttcaaatttgaccgtttcctcctatcaagggcacccttttcattcatttttcgagttttcatccggttcaaaaaccggttttttggcatttccgcaactggagacctactttctcgtgcataactcgtcgagacgaatcgattggtatatcattggtgccattttttaatgggaccttgactatagtatatccaagtctattttaggggtttccgagtcggtgaacttattttccggatttttatgaaatttaatttatttttttctgcacattttgtgggtcagcgaaatttcttcattaggacgtcattttttgtcactagaaatcactattttggcgtttcatcacttaaaatatgtagtttaaattcactattttggcaattttgtcactattttttcactttttcgacattttttgaaaaatttgggctcccggacatttcgaaaatgaccgtttcgccaatgaccgtttcgacaataccttttcgacaatgccgtttcgacaataaaattaaatatatttttttaaataaaattcaaatttctgcaaaattatatggacggtgcggatttgggatcaatataaaaaagtttttttttcgtttttttcaaaatagcattatgagaatggctttagtttgtcaattttcggcgcaaattgcttgtttttttaaattaaaaattgaaacattgttttacacctaaatagttgataatgaattagaagcttttaggtaatagtaaagtttatcccccccccctttttcaaaaaaaaattaaaatttttaaaaatgcttaaaaacaggttttagggggttttcggggtcgctaatcacgaatccgacatccatttcgaccaattccgaaccccggacccgaattcgaacaaaaaatcaaaatttcatttttcaccaaaatgcatatttattgcacaaaatcgatccaaatgcatatgcgcataaaatatgccttaaaaactgcaaaaatggcttttaaccctaaaaaaatgccaaaaattgtgtaaaaattctgaattgactttaaaagcttcaaagaggagggaaaagaaggaatgacttttatagtacgatgcagcggggaaggggaaaaaattacaattgcccaaatgccaaatgttttttctcctttataaggggtgcttttctcatcggactgattattttttctttgaattaacaatctttgcattactaaattgcttaatttgtctcttcgttgctcaatcctctgttccaaaattccattttgtttttcatttttgaccagcatattgctacccatgcactccgtcgattgtcaaattcatcaacgacatttaccatccgaacgttggagaaagcggcgacatttgtttggacgtctgaagcagatgtgggctccggcgttgaccatttcgaaaggtgagagtggacaaaacgccgacaaaatatcgacaaaacaaaacgaccgccataaccagactttttggaaaagtgtcgatattttgtcgtgtgaaatgggatttttcgaattcggtagtgccgttttaatctttatccccccccccatttcagtgctgctctccatctcttcgcttctctgtgacccgaatccggactgtgcgctgcgacaggacattgcgattatgtaccgcgacaaccgtgaggagtacaaccgaaatgcccgtgaatggacgaagaagtacgcgatgacatgacacgacaaacgaccgatggatgggagaggatgcagaagacaaccgccgaagaggaaggaggaggaggaggatacattcaacttaccctattcccatttatatgatcccaactgtattgtatcattgtatctcattgtatgtacattattatgtcgcccggttagtatttaagcgacgataagtgtctgttgttggttgatcactattatcaatgtgttgtatctctatattatcatttcaaacgatttgtgattaattgttgcgcctgtgtgtaaataaatgtgaagattccaaaaagttgttttgaaaaaagttttttttgcggcgcgttttttcaaaaaattttggtggacgtccggcggccgccgggaaaaattttgtaatttaaatgcgatttgttaacagatttttgttcaaaaaataccaagttttgccacaaatcttatattttcatgataaaatagtgacattctgccataaaatatcaaaattaagagtttattcaagtcttttaccttggtgtgggactaaaatgaaatttagggctcccggacatttcgacaatgaccgtttcgccaatgaccgtttcgacaataccttttcgacaatgccgtttcgacaataaaattaaatatatttttttaaataaaattcaaatttctgcaaaattatatggacggtgcggatttgggatcaatataaaaaagtttttttttcgtttttttcaaaatagcattatgagaatggctttagtttgtcaattttcggcgcaaattgcttgtttttttaaattaaaaattgaaacattgttttacacctaaatagttgataatgaattagaagcttttaggtaatagtaaagtttatccccccccctttttcaaaaaaaaattaaaatttttaaaaatgcttaaaaacaggttttagggggttttcggggtcgctaatcacgaatccgacatccatttcgaccaattccgaaccccggacccgaattcgaacaaaaaatcaaaatttcatttttcaccaaaatgcatatttattgcacaaaatcgatccaaatgcatatgcgcataaaatatgccttaaaaactgcaaaaatggcttttaaccctaaaaaaatgccaaaaattgtgtaaaaattctgaattgactttaaaagcttcaaaacaatgataaagaagctttttttagacaattgcaaaaaatattgaatttcaaaatttatatatgcaattttgaatttttttaaatttttattttatgctcaaacaaatttactttttttgtattttttgcatctaaatttttttttcaaaagttcttacaaaaagctaaaaaaatttcgatttttaagggtgtattttttaattattccaaaaaagccgatctttaggggcgtatttttcattttttattgcatttttcttatgaaaatttgacaaaaatgaccgaaatatgctctaaaaacgcaaaaatggcaaaatatgcatttattctcgaaaccacccaaaatatgcttttatatgcactaaaaaccttcaccaaatcaaaaaattttaacgtagaaattctatttttgagcccctttcttcatagcatatgcgcagaaaaaatatgcagccctactcatcaagtacctaattttttctaaaattttattattttaaattttcttttccgatgaatttagggttaagaatgcgttatcacgattccgagctcagattcttaatcagcgcatttttctatcctagaaaaaatgcttcttaaatttttaaatttattttacgcagaaaccacaaaactgcaccattgcccagaatcctgtatgtatacaaactcaaacaaaaagaaaattcaaatttgtggcccaaatttatattttgttgattttcaatttcttagacagttttagacccaaaagtcgaaactccaaaattttccaatttacttattgttgaaaaaagaaaattcattatttttgaaattcaattttgtgattgtgcaaatggcaatttgatggcattaattcgagaaaaagcagtagaaaacagaatttttatgctttcaattagtacaaataggtattacaatgcgagtgtgttttgactttcactgtcgagatcacatagcacttttcaagcaaattttgcaaaattgctatagataagcttaatggctattgtaattagcattaattaatcatcgggtcaaaatgcctatataaagggaaaggttcgaagaaagttctcttatttttgtgcccgtcagcagggatggcacggaatttcgatttccgaaatttttgataaaaagtcggaaattttcggaaattttttttgaattttttttcaaaaaattaacaatttttttacaaattttgttaataaattgcactgaaattttcaaaaatttcccggcggcgcctatcggcaccgccggacctcccccgccatgttttcaaaaattttgaaaaaacgcgcagcaaaaaaaggtaaaactttgatgaaaatcattgaataattttttaaagcaaatatgtatttaaatagatcaaaaaatttttgagtcaccttttacttggttaagaatttaaaatttagcctattaaaatatttagaaaattttttattattttttgttttntgaaaaatttccgacttccgatttccgacgtttttgggcctcggaattccgatttccgaaaatttttgggcctcggaattccgatttccgaaaatttttgggcctcggaatgccatccctggtgtgaagcatgttcagagttgtaagccccatctgagtttaaaaagtataaaataaatttgtttttatttcattaacttttaaatgtttaatttaaattaatttttttaccacaaaactaaaccaaatggcactgaaatgccaattgcaccgtctttcataatttttagctcacagagtggccattaaacgttcaatgactaaaacatgggcaaggtaattgcgaaaaaatatgggagccattgtggcacgagtttgccaaactccaccatctgtcgaaacgaattgacccgtcaaaaagtcttcaagcaaaacttcaaagcgaacttaacc

SEQ ID NO: 4361 - DNA, 1355 bp, Heterodera glycines
gataacggcccgtaagcaaagccaataataacgatgaattaattttcatttggtttttcagattacgccttttgctggattgacatgctgcacagaaacccctcaacaatgtcactgcttcgtttttcccaacttttttggagcgcattggtctcgcttgctcttctgttctatggcatcatggaaatgctgcgctctatcgaagaatataaagtgagcgagcgcaacacgtggcccacatcaattcaacccgacaaaatcgtgaccaaaattgcttttcagttgaaatccgattgattttttggatcaaattgagatttaagttttgtagtgttgaggttctgtgttcacgagttgtcaaaatatgttttgtctgcgtcgcttaatttgtttcttttcaagatcggcatctattcgtatgccttcgcttctatcttctgctgggattgctctgttgtgtactcatccaaattgctgctccattggacggacttttggacttgcgtcaacttccaagcggatcacacaaatgtgccgttgatcactttggtgagtttgttttgttgtcacatttaccatttgattcctacatttttcaaaattttaaacacttttaaaggtgctcagcattgtcttgttgtgttcgtccgtcttcgagattattcttcacaaattcgtgctgaatgatgtcgacacggaatgtgccaatatgatctttcatcagcaccagaagaagaacggaagtgccatcgaatgaacttaagcagagacgagtagaacgatgccaataaacataatcaatacgatgaaacgacgatgtgatggatgcatgatatacttacatataagataaattagttaacctatttcgtcataaactgttgtattcaattgtatatttcatatgtcaattgcatatctgttctacccgtatgcttaaaaatcggattgggtgacctgctgctttgaatcgtaccgacttttgtctgtgtcaacatacaaaaccaaagattttttaaaaatattttaataggcaaaattttaaaattcttaaccaagtaaaaggtgattcaaaaatgttttggtttacatatttgaatacctatttgcttgaaaaattattaaatgatttcatcaaatcttttttatgtcattttacaccattattttaggtcaagattacatacaaattagtacatatattgtcagataaattttctctgcacattttgtagatcattcaataattgtgtatctcatcaaaaagaagtttttttagaggttttcgaagtcgatgatcagtgataaggaatataatccgcatttctactcatttggattttttaggtcagcag

SEQ ID NO: 4362 - DNA, 1113 bp, Heterodera glycines
tttattataaaagctaaagggaaaaataaaaaaatccatttaaatggaaatttttttttcttaataataaaaaacagaaattttttgcattcctgatcacatttcatcgtctttggttatggaaaggctccaacaaacaaccatgataattgaaaaaaataaaaatttctatccctaaataagtatataaataaaagacacgtgcaacatttaattcagcgctggaaaagtatacaaatttttgttatctcccgcttttttgtcacggtgaacattttggacaacatatggtaatttgtgtttcgattccatagcaaacagttttttctcctaattaatttataattttggccaaacatcgcgtttatgcacatcaaattttttttattataaaagaccaaaggaaaaatttaaaaaatcatttaaatgaaaattgttttctcctaataattaaaaaaacagaaatttttggcattcctgatcacatttcatcgtctttggtttatggaaaaggctccaacaaacaaccatgataaattgaaaaaaattaaaaatttctatccctatataagtatataaataaaagacacgtgcaacatttaattcagcgttggaaaagtatacaaatttttgttatctcccgcttttttgtcacggtgaacattttggacaacatatggtaatttgtgtttcgatttccatagcaaacagttttttctcctaattaatttataattttggccaaacatcgcgtctatgcacatcaaattttttttattataaaagaccaatgggaaaaactaaaaaaatcatttaaatgaaaattgttttctgctaataattaaaaaaacagaaatttttggcattcctgatcacatttcatcgtctttggtttatggaaaaggctccaacaaacaaccatgataaattgaaaataattaaaaatttctatccctatataagtatataaataaaagacacgtgcaacatttaattcagcgttggaaaagtatacaaatttttgttatctcccgcttttttgtcacggtgaacattttggacaacatatggtaatttgtgtttcgatttccatagcaaacagttttttctcct

SEQ ID NO: 4363 - DNA, 1738 bp, Heterodera glycines
  misc_feature (1687)..(1687): n is a, c, g, or t
ttatttaattagacattctcatcatgggcattttcacctccccttttgtggcccaacttcggcacaaaagcgggtcgcccattgccgaatgttacgaagtgcgcattttgttgtcatcgcttatggcacggattaacttgttggagcgaagtttatacgaatacaacgacaatttgccagctccaacacgaaaagcgtgcttagagaaaatagtgagagcgaaaaacgaattttacgcaaagatcgccgaaggaaatttgtcgcatttgagaaaaacgttttgcgtaatgtaccagtttgccaaatttttggagaaaagtgttgccgtggggcgtttgggggaggcaattgagcgatgggaggcgacggaatgccaaaatgaaaatgtcgtcaaagagacaattttggcacatcgggcgcagaagaaacgcactatttttgatattataatatcagctgtaaaaaaggaggaagtgatgagacaactcagagaaatcaggggatgctacacaaggataagcagatatttggaggaccagagaatgttcaagaagctgctgaaggaggcggacttttatgagcagagaggtaaatttattatttagaagcaattcaaagcgattaagggactaattgccataaaacaatgccaaaaatgtgtaattattaaagccctgaattttaggttttacctattttttacggataatacttgatgagagaagcacgaaaatcatattttctccgaacaatttttgaattagattgactttttagcatccaaaaacacttaaaacggggatcagcacttttttagcattttcggtctttatcacctattttggcctttttccagaaatttcataccaaaaatgcaataaaaacgtaaaatgcacccctaagaatcggtcccagaaatttcagaaaaatacgccccgaagaaccgatcaagaaattttcaattacaaccctaagtatcgaaaaaattttttttttaaatatctccaaaatttattatttattttttcttgacaagttgcaattgttcagacgaaatttttgcaccttttttgcacctattttagtacctatttcagtatttttggcacataaaaatcccagctctagtcattatctaaattcgcaaaacttagaaattttgggccgtttttatttctcaacatttgtcttctgtgtgggtgcattagattaagatagcttttaacattttgattactctgatagggttttgctatataataataaaaaaaaagataagagcacttttagtaattcaaaaactattagatttgtcagtgtctttcaattaaaatagctattcttctaatagtttcaataaatgcgtggagattgaaattttcaacactcaaactctttgataagaaatttaagtttctttctttgcttatctttcagtcgaacatttcttaaggcaaaaaaccgtggaattattttaattttattatttttagtttttgaaaaagatcgcttaatgcaagcccattacattgaagtgttattgtgtgtcgatttggccataaatggcgagggatggctaaaggccgatttaatgggttttgttcgttggatggactcgaaaaaatttgcaaaagatgcccaaaatgagctgatgggccaccgaattgggaaagtgtgggacaacganattcggccaatttttggcaaaacttacgacagtttttacgatttggatgac

SEQ ID NO: 4364 - DNA, 1811 bp, Heterodera glycines
  misc_feature (66)..(66): n is a, c, g, or t
  misc_feature (80)..(80): n is a, c, g, or t
gccaattttgcaaaaacttacgacagttttttacgatttggatgactcgccggagaatcacgcgtntaaaattaaaaatntaagaaaaatattatccattttcaagaattatttggacaaaataatcaatgccaaaaaggcgaagagtgaccgcgtggtttttgcggaattggcaaaaattattggaagcggcggcgactctctgccggcgaatggcaaggaaacgataaacgacatcaacggaatgccaatggcactttcggaaacgcaagagaaatcgtggcattgttttgaaaattggatccaaaatttgcatttcgatgtgctaaagcaaatgctcaataagcagactatattcttcgacaacattaaaagatgtatacaattctctgagttttacagaatcatggacttttatttaatttttcctgttcttaggctgtttattctaattagttataattagggtaggtcgggaccgggaccaaaacacggacaactgagtatcgaagtcccggttttgaccagttttgaccggaccgggaaattcccggttttttcccggttttcccagccaaaaagtcccggtttttcaaccgaaagcccggtcgaggttttgcccaaaattcccagtcccgacctaccctagataattaatgccataattaattgagcacccaaatttcagtttttgaatccaagccaaaagaacatacggataaattgatgcttttcctacacaacaaacaaaacgtggagaacattttacgccttttgggcattgattttgaagccaatggcagcagcgacggagatccgacggaacgaacaccgggggcggaagacgacgattggccaagtacggacagtccaatgggaagcaccgcttcgcccgtggtaagtccatcgacagaaagaaaaaaggccaagcggaagaaggcaaaacgaagcaaaaaccaacgcaaaacgtcaattgttgagcatgaaattgacgaagaaatgtttttgtcaagtgaaacgcccaaaaatgggacggaaagccaaaagaagcaaagtgaggaggaggaaaagccatcagaacaagaagaagacgaagcagtaattgaagcagcggaaattgaagaattaatcggggaggaatcatcaaaagatgaagcagcaaatgggggaaaagcacaagaaaaagatgaagcgaaaattgaggaagaacctacagcagaaagggcaccagacaaggaagaagatgaagaagaagaagcagtaaatgaggaaaacggaccaaaagaagacgaggaggaagaaacagtggaaaccggagaattaattagggaggaaccatcaaaagaggaagcagtaaaaggggcaaaagcacctgccaagcatgaagcgaaaaatggggaagaacctacaggaagtgcaccagacgaggaagaagaagaagaagaagcagtacatgaggaaaaagcaataaaagaggaaaaagaatctgaagaagaagaagcagcagtaattgaggaaaaaggagcaaaagaagaagaagcggtaaaagaagcattggaaggggaaaaattaacgggggataagaaggcaccaaaagataaagtggatattggaaaaaaagcatttgaaggtaaagcagtaattgtgaaggaaccaatggaaaaggaaccgctgaaaaatgaagcagaaaaagcggaaaatgaaaaaatgccggaacattcattagcaattccatcagttcagaaagcggaaagagagatggatgtgagggtagaaactattaataggaatgaagaacacattgattatca

SEQ ID NO: 4365 - DNA, 6002 bp, Heterodera glycines
taaacaattcaaaagttatttggccaaaataaaaaagttgaaaaagagcagaaaccaatggcaaaagaaagtgtcactgtgccgggagaggatgcttctgtgcgtgccattgtccatctgctcgaccttggcatttacgcgaacgagatttggcaccgattgaacgctattagacttgttgagcaaatatggccagaacttggcattttgcagtcggaagtcgctaaaattgagggccaatgggccaaaattaagggcatcaaattgtcattgaaaagccaatggacggaattggagaaatatttgcatcaaatgctaaagcaacttttggtgctaatggacaaaaagaaattccctggcattaattatgatggtgttgctaatgataatgagggagaattgttgcgcgaaatccgtctgctgaaggatgaaatgcatttgcgtaatttggcattttcactcgccgaaagcaaaagcgcacaaacaatttggcacagtttgtgcccagctcaatccgcatcgtttttgtcgttgctctttagccgtacgttttaaaatgaatttctttaaataaatattttaaaaattatttatttcgaaaaaacactcatttttaatgagagaattattttcagttttttaaatttgaattttattttttaagatttgttcagaaagcatttgcatcaaagagtgaattttgcgatgaaagaaaataatcagcagaaaattggtaaattcataaaactatttatgaaaataatctaacaattcagatgttaaactttattatgaattccgaaacaataaaaatttgaaaagattcgttccatttaaaatgtccgccaattttgcgacgaaaaaattgaaccaaatttcggagttatggcaacacatggcttttggggaggacagatttaacgaattggacatttacaatttggtatttttaattttaaataaattgcaaaatgaattatttatttagaaaaatgaaattgcaaagggaaataattatctgatttttgatgtaaatcaaaaagccatggttgaaaatataatcagagaaatggatgaacttctcaaaaattgggtaaatatttaataaatttgttgattttttaaaacttgatttttagtcatcaaaaataaattgccatttctccgacgaatggctgtttagacccaaagaagaagcgaaactcagtgccatttgcataatgccatttgaatttgacatttcgtcctttttgggcacttatttttcgagtaattcgtcagtttgccatgaccaatcgctgttctgtcgactgtccaaagtaaataatttattttttcaaataaattttaaattctattttttcaatttccagaaggaaaatctattggcactccaaagaattcaaaaagattatttcaactccgtgccacaaattcatttcacttacaaaactctgcctgtaaccattatggccattttggtaccaaaccttggccaagaagtgccaaatgggtcattggatgtccaaaaaatcaaaacaatcgcacaaaaatttggcgatgaaatcgaaaaattgatcagagctgatcatctttttgacgaaggccaatttcgaatcagccaaagagtgaacgaccaaacaatggagcagttggccaattcaattgttcacgcaggtaaaagggcggacaatcaaaatgaagagataattaggtaattaactgagtgttaagtgccaaaagaagcggccaaaattatgcaccaatgggtaatgttcgatcagttaaaagacctgctgttgaaggaccgacaaaaagcaatgaacctgagggaatctgtgaaaactcatttggccatgataaaggcatttgcaagtgcgaaaaatgccaaataaagtttaaaacccaatttttgaaattttagactttacaactcatgcaaaaattcattggtttttattggacaaattggacacaacacaaaaagaagcagccagcactgtgcttaaccgcaacattaataatcataataatttgttcattaattttgcgtttcttttggcttatttggaacaatgggccaaatgtaagaccattttatttggcaatgaaaatttaatgccaaatttcagctaatcacattaatggcgagcatatcggctttttgaactttaacattttggttgtaatggtaacgaaaattgtgctcgcccactcaaatgccgcactgccgatattaatcgaaaaattcttcatcacatattcaacatggcataattatatttaaatagaatctctcaaaaataaaatgcgattaattaatactagttaattaactaattaattgcaggccctggccactgccggttcaattgacagaaatttgtgtccacagaaagggcgaatttctgagttggatgccgggcagagaatggttcacaaaaaggcaacattcgcccaaaaagatgctcaaggcgatccatgccgaattggcaatggccatcattacgccgacattccctgaacgaaatttggcacaaaacgcaaatatttccgctttaaaatgcatccaaaatcaaatgaataaaggcaattaaatttgaaataattgcacaaataaaatgataattttagcattgaaaactctgcgaaatgaatctgacaaaaatgcgctaattgggccattaatcaacaaaacattcagccaaatggtaaaataaaaattaatttcataaattgtcccattaagtatgagcatttcattgttgtcatttgcgctgctcccaattatcaattggacacttttgctaattttgttggcattcgaattgggcacgaattgccagaaataattgaaaatccgttggaaagatggattaagttttgccatctgtttgcccgtccaatttcacttggcgaatgtaataataataatgcaccatctccaaaatcaacgacgtaaattatgcttttaatttaatatatataaattttaaaaatgatttatttttcagttattgtaaaaagatttggctggtcggaattgaagtgaatgagaagcaaaaagaattgagcaaatttcaggacaaaatgcgagaaaagcttaaaaagaaattggccgaaaaaatcatcagcaatttcgagggaagctttgttgaaattgaaacggactatgtcaatgagcgggaacagctccaaaaattgtggtgaacaatttggaaagaaaatattatttatttaatttttaattttaggggcatcgatttaaatttaatatgagtaaaacaaaagcacctaaatcatttgcaaatgatcgcagaaaatcggtgaaaataatcaatcaattaaccgactcattattcaataattgttcatttcttcaattgtattaaattactacaaataattttcacatattatgcataaaaagctgctcccttttctcattttccatttaagtaatttatttaattaatacaattagcgcaatttgaatttacaattcacttttgataattccaagggtaatgtaagagggaaaatcgcttttaataatgaaatattgtttttattttttgcaggcattttgtcaatattggtataacggagtcactcagttgggccagcacggtttttttacactataactttttactttatcattcaaatccaataatgttggtatttttgctaattttctaatcgcgaagcaatagctagaaaagcttctaaacatgttaagtttcgaatgataccaaaaatgttggattttgatgacaaagaaaaaagttatagccaaaaacatgctgggcccaaatgtgccggcccaactgaggtaaaccgttgtataagaagatctaaaaaagaggagtaatcgttgtcgcaaatgcgcaagtttagactaaattcagcggtcaaattttagcgtgtatcgcaacttgtctaggaatcgaaaacttttgggtgtttgaagaaaatgaaatatgaaattgaaaaaatttatcaaaatcggagaaagttcggaatcgaataataatttgttcattttttgatctttttccaaaaccaataaaattttaagcatttttgcaattatggcttattaaagttgtctcatcagagacagagttggcaagacccagttgacccttatcgtccgtctcctgggactttctgagaaaaacaaacttttttcgcgcatcgcggattcaatttgccccggtcgtgtcccacccatggtacggacaagggatttatttgctcctcgttttctcgcattcttaccttttttgggcttctcgtcgagcattaaactcgaaatgcgagaattttataaacgctgttcagaaatggggttagagtgaaaaattattttggaaattgtggaaaaagtaacaaacttttactataattttttccttttcaaactcattatttgcattttaattatgaacggatccgatcggatttttttttaatttggattgagcagcgtattgattcagatgtttatgaatttgaaaggttgagcaaaattttaaaaacacaatttttcgaagaaaactccttgaaaatttcaaatttctcacagtggcgcctattggtacccccgccgaaatcaaaatgttttcttttcttttttaaaaaattgccaatttttctaaaaaatttaaagcgatttttgtaaattttccaatatttattgtttaatagggccgctttaacagaggggccctttatagaatccaaacatatgtacaagcaccaaacgaagttaaaaacatttttgcatgtttattcctaacacagtccatcaaaacaaaatatggaattagaggaatttttagctaatgatcaatcccatttcatctgtctgtctgtctctctctgatcgtttattttcttgctttgcctttgccacggtttgttgtgccacggcttgatgaagcgccaccggtgtttttgctcgtccctccgccgccattcttttttgtcgtagtgagcttgccgaatagttcattttttgcacctaacatttttttgttttttattttggattttttttgtctgccagaacataatttcgtaaatgaaagaaagcataaattactaatgaaaatgaacataaatacaaaaattgacggggaaattgagtgaaaaatttggagtttttgaaaaaattttttggttttttatttttgatttttttttgtctgccagaacataatttcgtaaatgaaagaaaacataaattactaatgaaaatgaacataaatacaaaaattgacggggaaattgagtttaaaatttggagtttttgaaaaaatttttttgttttttatttttgatttttttttgtctgccagaacataatttcgtaaatgaaagaaaacataaattactaatgaaaatgaacataaatacaaaaattgacggggaaattgagtttaaaatttggagtttttgaaaaaatttttttgttttttatttttgatttttttttgtctgccagaacataatttcgtaaatgaaagaaaacataaattactaatgaaaatgaacataaatacaaaaattgacggggaaattgagtttaaaatttggagtttttgaaaaattttttttgttttttatttttgattttttttttgtctgccagaacataatttcgtaaatgaaagaaaacataaattactaatgaaaatgaacataaatacaaaaattgacggggaaattgagtttaaaatttggagtttttgaaaaaatttttttgttttttatttttgatttttttttgtctgccagaacataatttcgtaaatgaaagaaaacataaattactaatgaaaatgaacataaatacaaaaattgacggggaaattgagtttaaaatttggagtttttgaaaaaatttttttgttttttatatttgattttttttttgtctgccagaacttaatttcgtaaatgaaagaaaacataaattagtaatgaaaatgaac

SEQ ID NO: 4366 - DNA, 1069 bp, Heterodera glycines
taatgatcaatctcatttcatctgtctgtctgtctctctctgatcgtttattttcttgctttgcctttgccacggtttgttgtgccacggcttgatgaagcgccaccggtgtttttgctcgtccctccgccgccattcttttttgtcgtagtgagcttgccgaatagttcattttttgcacctgaattgaaaagtgaagccttttttgtatgtcataattcagctggggctgtggcgagcccgcgatttgcgaccgggtgggaaaaagtgacagaaattaccggcattattaaccgtaattgcttttattgctaaatttgaaggatagaataaattactagttttcgggcaataataattgttaagctttattcgttatctaaattttaaatggggggtacggtatctgtcgctaccgtatgcccggccccccgtccctctcctgtcactgacttgtgtgttttgcaagagcagcttggtgtcttccgtatggcccattggacgacgaagacgaagacccactcgaaagacagccgcctcggaaaacgcattgcaccaaaacaaaaattatcagaaaagcagtgaaaacattcgcagcaaaattcattattattttttttttttgggggttcttcgatttgaaatttaattgaaaagataataatataattctcttagattcgtatgctttatatacgggattttactaaaatgttttgtttacatttttaaaagtgacgaaaagtctagacgatcatatgcaaaaatatacaaacacacaaataaattaataaattaaaatgcatcatattttgaaagatcatttggattagttatcgctttgagaagcttcttcttcctctccatctcaatgacttgctctttgactaaggtaagatccaaaatatgtctggtcggaaatgtccaaattcatttccgggccccactttcaattttataaaaaaatagaacataaacaaagtctacgcgaagctacccattcaaaattctttcactgctatattcctctttcttgtatttttcgttttttgggaaaaggacgaagaga

SEQ ID NO: 4367 - DNA, 1786 bp, Heterodera glycines
agaattttatggagcacatttttctaaaagtatttcgaggggataaagcgctacgtttgggccaatttgcagaaatgtcaatagaaagatttaaatattaaattcttcgaaaaaataaaaaagcatcagcagggcgaaaaacaaattaactgtgacgactgtccagataatgtgtggtagattaaggtgataaaatcaagtgacgatcacaggaactatacaggcaaaatatgtgaaaataaataactaaataattgaggtcaaagtcaaaattaaaaccacgcgaggggggggaccgtgtgtccaaacccatttgcgcctcggacatttgcgcctatgtctaaaatctgattctaacatacattcattcaagccctgatagcttaaacacctttacaattaaaaaacaaaatcttctaattcattagaaaaaataattcggcaattttgtaagcaaacaaactaaaagaggaggagaagaattagcacatacacaaacatatcgccaagacgaaatatggtcaaaaaaattttaaactttgatattttaaaaaattctccaaaaaaatttttccaataatttttttcttgaaaatttttctttttgaatttctgcggcgatattttggctcggcgagtttcgggcggcgatatgttgggtgcaccccacaaacacatgcacatggaatacaaaacaaaaattatttatgaaataaaaaatcagaggaatcccccataaaataattagccgtcgtttcgtccgtatctgtcgttggtctcatcaatttgaacgctttctgtgttcatcatcatttgtatcttcctccttctcatattcacttatgccttccgctggcactgccatcgaagcccgaggcgccctgcatttgcttcatcctatagggaaagcggaatcaaattctattcgatgaacaccgacttttggatgagtcgccgtttgttcacatcgccggccatctcctcaaagtcgatggatttgagcacattctcacgcaattgcttcaccaacctgcaaaaagatatgatttgatttcggtgatactttttaattattaatgaatttttgaaatttttttaataggaaataataagtgttgttttttttaatttcggggcgcggaacgtagtgagcgtatccgtaaaaacgtttggtattacaagtccccactttttggattttttaaaaaagcagctaatttgagggaagagaggtacactcaggtacaattaatacctcaagaaaattaatgcagctctgttcatctttttcttgtaataaggtgttaatttttttgcgccaatcctctttgataatgaaggggggttgtgagttacggcgaagaataaggttaataaataattggccactgcgcccatttccgtccccataaggttgaaggcgaatctattggtaaaaatcaattagttacttgaaattctctcacccccctccccattttaactaacaaaggagagaaatgcttgcgcagcaaatctttgggttggtaggttagtagcatcgcagaggttcatccatttgaccaattcttcaactccgtccttcactttctctctcttcactccactaaaattcatcccctccggctcaagggcgccatattctcctcggaactttccaacccaaacatcattctcaaactctcctcctttatacgctaatttatgcaactctccgagtatctttaaatggcagcaaatgtaaattttacttgaaataaaaaatttacatcggcactccatggcc

SEQ ID NO: 4368 - DNA, 915 bp, Heterodera glycines
tttcggccttatataattgctctgtattttccgaaaatttggctctattacattacgcatccaatttacattacgcctttaaattatttattcacacactaattgcgtattggattttgtaagttttgaaaaatgtatggactcgaaattttgtgctaaacattaggatacgtaaattgttaaaagagtcaaattgcgaaaaatttaataattttggtgataaaggaatattcactgccgaattggaacactgacgaaaaaaatggaaaacagtgaaataaataaaaatagtacactgacgaaaacgttcactgacgaaaatcactgacgaaatcattcactgtcgaaaatgtttactgacgaaaaagtatagcgccaaaaattaggatgcgtaaattgttaaaagagccaaattgcgaaaatttagtaattttggtgataaagggctgtagaaacatgggatatgggtataatcagcagggatgcgacttttagtgacgaaaaatcccaaaatagttaactaaaatagtgagtaaaaatgccaaaatagttaactaaaatagtgagtaaaaatgccaaaatagtgaagaaatagtgacaaaaagtctgaaatagtgacgaatagtgacctaattttcagtccgatgactttgcgtggcatttgaatttgcggaattggcaatgctatttgaccgaacttgacaatttccatttccttggtgccattctttccaattttacttccaattcaaataaatttcagcgcccatttgcgcgttttgaagtgttcatcgacgtaatagttaaaacggtggctgatcagagcaattccaagtccaagttgagaaaggggcagcaaatcgaacaccgaaagccaacagtcggcggagatgaaactgaaaaaagggaaacaaa

SEQ ID NO: 4369 - DNA, 5910 bp, Heterodera glycines
atttttattttacattgcttttgccattttttcctccgcttcttttcggcggtctgacatttgttgaggcaaatttaataagacagatttcgttggattttaaattagcttagcaaaatgaataaatcagttgatgatttgaaattttgtaatgctgtaatttgtcggtcagggtcgttttcgcgtggcgatttttgaaattccgaaaaaatttagaattaaatcctctaaaaaactaaatatctgaccaatttggaaaagaattttcagggatagcggaaaacatgaaaaagaggggtggtttcgaaattttgcaggctaatagaggattcttagggctatcgaatgatactaagaatgtttaatttggatgcttcgccctaaagttgcaaaaaaaaaagttatggtcgtgtcttttttttatggtcgtaagaactgcaatagataaatgcttaaaatttcttacaactaatcttggtttcaaagaaattgttgaattttaccctaataaataataaaaacacaagtaaatttatcattgcaacaaaaagaacattttatgatcacgtcataaccttaaaattcatttttcaactcttcaattcaataagaccgatcacttgcatcaattcattcattcacttctgctgctgatcacttgggccgggagttgcgtcgagaagcctaaaaattgaacacaataaaattgaattttttgaaaaatcattcgcttacccatctccgatttcgtcctcaccataaattgcactgtcaattatgttccgctgatcacaaatgtgccagccaatcgcttccttttcccattttgtccatttgcttttgtctcgcgcaattggacaacggacaaacatcagaagacagtcgtcgtcacttgacgacaatgaaattggcgtggtaagaagcattggcaaatgcctaaatatggaaaaatttgttaagaaatacaaaatgaatgcaccgctttgaacgcttcaattttcgacgccaatttggatcatctttacacaaccagcatttgaacagcttcggcacattgtccggacgtggagtgaaaagccattttgccaccgcttgtccatccgatgccatggcattgtcatcggccggaaattcgatcaagaaattgtcggcatagaaaaagagaaagtgaattgatggaaatcgttgagaattgacgggacgaatttacgcaaacggcggaaaaatttggcgtacaattccaaggcacaaatgtttttcccgataattggcaaaatgttgcgcaaaacggactccaaatcgggatcagtgctcttaaaaatgatcaaattaattggacagaatgaggcgaaaagttggcgaagaaaagtgatgacattgcggtatagatttcaatgtccatttgcgagtcttgaagtgttcgtcgatgtaaaagtcaaatcggtggctgatcagcgcaattccgaggccaagttgagaaggtgggagcaaatcgaacaccgaaagccaacaatcggcggagatgaaactgaaaaagggggaaaacaaaattcaaattgaaaattggcatttttaattattttacattgctttttccatttttttcctccgcttcttttcggcggtctgacattcaaactcggaaaaatagataaaataggcgcataattttaaaaaattcataaaaaattaagataaaaaagctatgaaacgtttctctaaagaatcagcaaaaaaagctttacccaatacccattaaaaaattatgtgaagtgaaaaaaaatgctaggtggaatgttactttggtaaagaaaaatcaaaataattcaccaaaaacaaccaaattttcagtgataatatcattcgacaatcctagtttatggtatcattaaattgaatatattttattttaaattttttttttgcccaccttgaacaggccttggtttttcgcgtaagtcctctttgataatgaaggggggttgtgagttacggcgaagaataaggttaatcaataattggccactgcgcccatttccgtccccataagggtgcaggcggatctattggtataaatgagttagttacttgaaattctctcacccccctccccattttaactaaagaaagttagaaatgcttgtgcagcaaatccttgggttggcatgttagtggcatcgcagaggttcatccatttgaccaattcttccactccgtccttcactttatcccttttcactccactaaaattcatcccctccggctcaagtgcgccatattctccacggaacttgccaacccaaacatcgttctcaaattcacttcctttatacgctaatttatgcaactctcggagtatctttaaatggcagcaaatgtaaattttttcttgaaataaaaaatttacatcggcatcccaaggcccacggaattccaacttgtcaaaaacttcaaatttggccctgtcggtgatgtagggcgaatgatctctctgctgtgatgcataaatccgccgcatagtttcagcagcggcctctctttctttagcctctttccattttgggttggtttcggccattataaaattgctctgtattttcagaaaatttggctctattacattacgcctccaatttactttacgcctttagattatttattcacgcactaattgcgtatttgattttgtaagttttgaaaaatgtatggactcgaaattttgtgctaacattaggatacgtaaattgtaaaagagccaaactgtgaaaatttagtaattttggtgataaagggggaagggaaattctgcgctgttgcggctcatcaagggttctgctggtagtgagatgaataaacacaaatttgttttttttatttatttatagaagtacaacagtcacggtcgaaagtattggagcaaaaaaaaaaacaaacaaaacaaattcttttaagcgattttctcaaaaattaatggcgacaaaaaaatcttatttacgttaaaagatacgtcaacaaatgcactaataaaatacccaaattagtgataaaaaaaaaacctctaaataatttcaatttttcttcctttttagcctttcttttttactttccactgactgtgccttttgtccagctttcgtcttcaattttcttcatccaaaatagcggtggaaccaccaaaaccagtgacaacatcttcgaggacaacggcatcaaagtcctcgactcgttgtgggccgccgtcgcgcacgctccaaaatgtgtggcgttcgctgccggctttggattggcaaaaaatgccgttatttcgctatggatttaggcgcttgaatttccattatgtgtagctttttgacatgcatttttgcacaattttgggcataatttccaattttcttggtataccattgacggattcaccacgaaatccatcacatgccatatttttttgaaaaaacaaagttttttctgaacagcttgccatgggcaacatcgaaggccttgttgaaaaggtcacggaaatggggctggaggataccattaagtcaaaagaaggtcaaattcgtgctcagcgcatcaaataacccctaaaaagtgttttttgaatttttattcctttttttgtgggaccaataatcttcatgattgccaatattttattttttcataaaaaattgacacaaaatcgcaaaaacttttcatttttaaagtctgttaatgctaattttttgtcggcaaaatgctgattttgaaaattttaggttgggagccctggtttaaaagaattttttggtggccccaagcgtaaaagtgccgaatttaccaacatttaaaattaattacctgtgcaaaaaactgaacatttggtactcattttctttttagaagcaattcaattttctttttttaaatacctcaaaatttcgtctgcaataatccgaaggcttttttcgtcgatggcaaacggttcggacaaattcagcaaattgccgcagttggccagcccgtcgctgtaccaaatttgcctcagcgttgacgtggacacgtgtaaattcaagggcaacgagatcatccatcttgaggttagttggcactaaaattttggggcaatccttcggaattagtgtcccccggcggtaaaaaaaaattgagacccgaattttgaaaaaagcctggacctgggttccatgttggcctggacctggatttcctggacacgaattcgggttcagaaaaacccaagtttaccgataatggccttgacctgctcgtatttacataaacattgattccatctatgattttgcatcaagcaaatgattttttcaaaaaaaaaaaaaaaattaattttgtaaaatttattggcgttaaaacgtacgttctgaatagtgtagaaatgattagcacattttcttaccttaaaaaattaaagaaaatttttatctctttttttgggcaccaattccgaaggatttacctaccccaccaattttggggcaaatttcactttcctcccccctcaccaacctaatttttccctctctccattttcagattacaaagccaacaaatttcctgacactccacgcgggtgcattggaggtggaaaaggcgtcgctgaagttggaggatgggacgggtgagtgaggtggcggagcaggtctttcaccccagaccctcgaaaaaaaattttttttgaatttttcgggggggggggggacacgaggtttgatgtaaaactttgatttctctcacgtaaattttgaaaaaaaaacattttcaacttttgcctcaattcggggtcagatttaaaaagtgtatggaaattcccaagcgcccccgaaaattttttttttcatattttgcaattttttttttgcacagttttgtcggatttgaagcgcgagttggacaccaaatggacgctgctcacccttcagtggccgaaagaggtcaaaccgcaaaaggccgagttggaatttgcgtacagtggccaattggcgacgaacatgcaaggcttctacaagtgggcgacggggaaaaacaatttaaagaaacagaggggaaaataaataaatattccatttttattctgtttttgaatgtttcctttttaggctggaaaagtttttcatgatttttggaaaattttttgaaaaaaatcgttgaaaaatttttctaaattttttttattggattttactggacattggtttgaatttggatcattttttcctcaaactttatgtaaaaatgctgcgcaattttttaatgtaattttctgatgcaaaacaatcattttaattgttttgtaattttttttccttcccatttcacaggtcgacgtacaaagacagtgcgggcaacgaaaagattttggcgtccactcaatttgaggttgttgtccaagcgttaaaaatgccaataataaaaaaaaattgtaaactaaatttgcgtaatggaaaatattgtttaaaaaattggcacaatttggcagcatcaatttttcatccggaaaaagatggccccactttttcatatggttttacattttttgagctaatttgaatggaaattttttgcattttcgcgtcatggagaggaatttttaagaaatttaagcaaaatcaaaaaaaaaaaaattttttttttggttttttccaattggcctaacaatggacaccattttcagagcacttacgcccggtcggccttcccctgctgggacgagcccacgtacaaggctcaattcgacatcaaattggaggtggacaagcacatgaccgccctgtccaacatgaacgtggtggcggaggaggaggggacggacggtggcggcgccaaaaaattgctcacttttgcgcgcactccgcgcatgtccacctatttgctggcatttgcggtcggccactt

SEQ ID NO: 4370 - DNA, 4382 bp, Heterodera glycines
aaggtatgtgatttatttattgtgaacgctttaccagattgcaattgttacattgtaggtcaacgacacaatcccctcactcttcaaaggtcgcatgaagtcctatatcaaatgcaaaaatgtcgacttcggatcatctcgagaggaatgtttttatgatctccagttaaatgtcaagggaaagtcaaatggtttgtgttactgtctttgttatcgtcaataaattttaattattagtccttgaatcgttccgggattacattcaacttgaaattctcgatggagagaataaatatgacgcaggcggtatgttatttattttttactggataatctggcaatatgattacagattttggtctccagccagccgaaaagggactcaaattcctttctttcccacctgttcttcaccttcaactcatgcgttttcagtatgacccaatgatggattccaatgtgaaaataaatgatcggtaatgctattatcttttgttattttattttttgcttatggttttcaggtttgaattttctgaaattatggacttgaacgaatttgccgaatctgagggggatgatgaagctcagaagaacgactacacatatttgctttatgctgtgcttgtccattctggtgatttccacggcggacattacgtggcattcataaacacgaatttgaagggctctccgagggtttgtgttttatttttattatctcgaattttaatatttccctttagtggtgtaaattcgatgatgatgtcgtttcgcgtgtcacttcacgcgatgcggtgactgcaaattttggtggggagaatccagaaggagttggtcggagttttacgaatgcgtacatgttggtctacataaagaaaagtgcgactggtaactctttgaattgttttttcttaactgatcgttgtgattaaggcgaagtgctcggttctgtgtctgaagaggacattcccgaccatcttaaagttcgctttgaaagtgagaaaaaaagagaaatggaacgacgaatagagcgagaggaagcgaataattattgtgaaataactgtgagttttttaaaaatttattgactgtttttcttttttcttctcagcttattttggacgaagacatgaacgcacaccacgaattcgaattgtttgatgggcgaatgaccgagatccaggcacgaaaattgaaggtgcagaaatcgatgacttatatggagctttacaaatttgttgcaacaaatatggtaagtatagcactttcatattttaaatgagtttcaatttattccagggactgaaggaaagagaattccgtctttgggactttcaagaatcggacaacaaccaacgggaaatgatgcacagatttcgtgtggagaatacgcgacctcgttttttcatcgacccatttgagacatgcgacgaatatgatggtggcactgtccgctacgaccgaatggtttacttggaactgtgcagaggacatgttggagatgagctgggtttcccaaactacgacaaaaaccgtaatttttttttggcaaaaacagctcacattgatgatttagatgacgttttggccttcgttaaattcttcaccgctgagcgcaaagttcccgaattcaaaggaactttgatccttaccatgtcaagcgactttcctactattgcagctgccataaacaaagtgcttgggcagccccctgacactaaattaaatctttatgtggtaatgaaacatttcgatgctttaatttggtttattttctccaaaaggaaataaaaccggacaaaatcatacagctgcagtcggctacggtgaagaattcccagcaatacatgcagcaagatggagtgataataatagcagaattggaccaagtcagcgaggaagctagtgtcatgcaattcttcaaaacgctatacaacagaattgaggtaatctttaaaaaattactataaaacaaatgaagctatacataggtcgaggcgcatcttcaagaatttgggtctggcaaccatactgaacagcatgcaatttctccgttgagaggacagattggattggtaagataaatgcatgccgaagtttcaaaaagaacgtgtttttaggattggaagctgacgcgggtctgctcatggctgggttcagagctgaactatgatcccgcaaagatcatgctttataagagtgagtttgatttgtttctcgcgttttaagtttgcatttgttttatcagatgtgttacatggtgacaagcccggcatgtggataccggttagagtttttacattcaattaaaacctattcccaaaattaagcaccaacaattgttggaactgcaggttagccagatgctcaacctgaacacaggcagttacgacccacgttttcaacgcatcttcaaatttttctatgccaaattgccacttccaatggtcgactttgataatcatgcacatgtattgctgcacttgatgaatgaaaaattccagctaacggtggctttttttgcatcgttttttatatatagttgtttttaggaaatgagtatttttgtggataaaaacgcaagcgtgcaaacactcctggatgaggcgagaaaagagttcaggttctcgtcgatggggaccaaaactcttaggtaattttgtaaacaaaacaaagacatacaaaaatatttttcagacttgtgcaagcctcggccgacgggacttttagagtctatcaggtcctcaagaacgacattctttacaaggatatccaactccgaccatctttaatggtagtgcttatttagctatttttaaaaaatccggcgaattaagctgcgtgtggaagaaatcccgaaggatcagcttgaagttggcaccggcgaatatttgctgccagtggcccatttcgacagagagccgaatcggacattcggagtgccattcttcatcaaaatttgcaacggggagaaagtgagcagcataagggagagaatccgcgagatgttggacgtgcccaagaaagaatttgagaaggttttaagggtcggactactttaccaactttcccttccctttcagtacaaattttgcattgtgaggcagggccgagtgatgcgcgaattcgacaaccaggacgacgcagcagcagtcaatttgtcggaattatcccttgcccatataacttgtgtgtaggctgattatattcgagtacaaacgcactattgttttgtcatttcagatccgcagtcggcaccatttctggggattcaacacaattgccccaataaattggtggacttgccgaaaaaatcggtgatggcttttttgtgctgatgactttcgagaagatttccggaaaaatggccaataaacgtccgaaaaaccttcgactgaagccattggttctagtgcagaatacgcgtcccatggacttttacgcgtcccatggacttttacgcgtcccatggacttttacgcgtcccatggacttttacgcgtcccatggttttttacgcgtcccataattttttacgcgtcccatctaatttttacgcgtcccaaggtttttcacgcgtcccattgaatttttacgcgtcccataatttaaaaaaaaatttgattaaatttttatatgttatcacattaatgcaaatattttaggtacgatcacatcacacattatttgttagacagggtagttatggcgcatttcttccaaaatatgctgaaatatttttttgttttcgtgataacgacgaaatgcgtactgaaacaaataagtaggtaaaagttcgggtgtagtcccatgtaaatgtttaaggctttgctttaaagccctccaggtagcctcaattccctgtgtatgtatttgagggttggcgggatctacgaagtaaatttgatgatttatccattcgtggttgtattgctgctgcatgttattaatccctccgtatgccgcccacccatcagatactatcgtgcttcccacctcaatattttcagcgataatgggcagaagagtgtctgcagaccgatcgggcacagggaaaaaccggaccttattagaccctctttgaatcatgccaaagacccattcgtatggacgatttagcattcgaccaccgatggtattttgccctatacaccttcagactcgtttatcagtcaacggattttgatgaattattttgttttcaactccgttgataatgtactttgtttttataatttttttatttaacatttcaaactgaaacaaagaaaaaatgaataaaaatcgatgggacgcgtaaaagtccatgggacgcgtaaaaaattatgggacgcgtaaaaattcaatgggacgcataagagatgatgggacgcgtaaaa

SEQ ID NO: 4371 - DNA, 2170 bp, Heterodera glycines
ccttgcccatataacttgtgtgtaggctgattatattcgagtacaaacgcactattgttttgtcatttcagatccgcagtcggcaccatttctggggattcaacacccgaacagagttcgtgcgtcgaggggtgttttagactcgaagaaagcgattgtcatacacaactgaaggattcgatcttttgcttcttccccaccctctaaacccaatcgcttaagattgattattttattgagtatcataaaaagggcattgaatttactgatggtctatggttgtttgttcgtctgctagtgaagatggtttctgttcgtatataaatatgctgcatgttaaatgctttttaaagtttggggtttaacgcttaaatcgaatcagaatcttattaatatattcttttgtgaaaaggcggggacaaactactattacctaattttcctcaatttttgtacctgttcaaaaaccagcttaaactcttttcccaagacttgtgatttttcctcacttgggactattttattatgtttattggtcagtagctcattagagattggttggatctagggaacgacaaatcgactttaccaccgattgttaattattcgatgttcagaactccaaaagatttttttgaatttaatttcctaaacaacaaaacaccattcaattattttctggtctaaaaatattttatagatctacttacgctagcatgaaaaatatctattttgctaggtaaagaggatgacatggacggtaaaaaagaaaaaaaagcgacaataaatctttttatggataattatgggaaaaaattggcgttctgtcacatttactttttatctttatttctctcacttttacgtactatctcttcattcttaataatgtaaagaacaacattcacttcgctacgtttaactttttttctatacgttaaatctataccaaattttgcatatcgatagagaaagaaattaggaacaaaatgtaagggtctttaagagcaaaaaaagggttaactaaaaagttatggagtgattaaaatttttgcatttctttttctctccttttagagtactattttcatgtctctaacacatgaaaaaacacaaattcgcaaatgctaacaattttcattataagggtacaaaatcacttaggaaatttaaaaccaatagaaaaacgattagttttcgcattttggttcaaatcagcagtttaggacttgagttataacgtgatgaacatttgaaactcgcacaacttttttctgagatgtcaaattgcttagcattcacttagaaaaagattctccttttcaaaatctttttttagataccaaatttgttcatttttgttgggaatgaagcgtgttatggctgatcaaaataaaaaatacaaaaaaggcatttaccagtgtaagtgcatatactttgtttttgcgtgtgttggcgttttgttttacgccaattattttttggcaatttttttcgttttttaccgtccatgaagagtacatacattgggagaatgataaagaaaaccattttaatatgcaaactccatcgcaacaaacttcctttaattattagtagggctgtgaattttaggttttaactaaattttttgctcgattgatttgaagaaaggagctcaaaaaacgcatttctgcattaaaaattttcgattctgatgtcatcatcggtcactagaaatcactattttggcgacttcgtcactaaaatagttaaaaatcactattttggcgttttgtcactattttttcactatttcgacattttttggaaaattccttaacaaaaatgcaataaaaccaaaaaatacacccctaagaatcgaccttaaaaaattttcaaaaaatacacccctaagaatcgagctaaaatttttcaaaatatactcctatgaaatgaaaaaaaattttctcaaaaatttactttcttggcaaaaatttttaattttaaaaaattttttaggtaactattttgggttttttggtcttaaaaatcccagtcctactcatttgcaactgcaatcagtgaataaaaattatttttgctcaatttttggctgaaaattatgtcactattcgtcactatttcggactttttgtcactatttcttcactatttcgggatttttcgt

SEQ ID NO: 4372 - DNA, 2442 bp, Heterodera glycines
gagtttccaaagttggaggatgtgcatccattttactcggatctgatgaacattctctatgatcgcgaccattacaaaattgcgatgggacaaatgaacacggcacgccatttggtcgatggaatagcgcgggaatatgtccgactgatgaaatacgccgattctttgtatcgttgcaaaatgcttaaacgggccgcgttgggtcgcatggtaaaattgctgcgtcgacagaaatcaagttttgagtatcttgaacaagtccgtcaacatttgagccgactgccaagcattgacccgaacacgaggtcaggtgttaactaatgtcgcaaaagtcgtcacaaaaattgtaaaagaaggtttacatggctgacccccttcgcaaagattagttgagtatctcccctcccccatttttcacaaagattaccatcgaatgcaataaaaaaaacttctatttgtctccagttaaacaaaattatattaacttggttcgaatttaccgcggttttgcgaagatggaataaacccaaatatttctaccttttgttcagaactctcatactatgtgggtttccgaatgtcggcaagtcttcgttcatcaataaggtcactcgtgccgatgtcgaagttcagccatatgcttttacgacgaagtctctctatgttggccatttggactatcgttaccttcgttggcaagtgagcttttgttcacttttgaatgaatttactgttgcctttcaggtaattgacacccccggcattttggaccatcccttggagcaacggaataccatcgaaatgcaggccatcacggcattggcccatctgaaggcatccattttgtacatgatggacatcagcgagcagtgtggacggacactcgaagaacaaatccatctcttcgagagcattcagcctttgttcagcaacaaacccgtctttgtcggactcaacaaaatcgacttaatcactcgcaaagatttgatagccgagaaagaagcgattttacgagagaaattggaaactgcgggggttcccgtggtcgaattaagcacattgactcagcaaggcatcaccgaactgagagataaggtaaacggacgaacaatgaaaatggaggaagagagtctgaatattttcaaaccgaagcagaccctttcttatccagacaaagtttttggggaaggctaccgccacccgacggtctttttactccgttcctccaaaaattttcttttggttcgatttttaaaagtccgtgccccccttcccttcctcctgaacacgggctgaatcggattctatttttaggcctgtgatgctttattggctcagcgtgtcgaaaagaaattgcaagtgaaaggcattgcccagggagggtcggtgatcagtcgtctttttgtcgcttacccaactccacgtgacgacaaagttcgagctccgcacattcccgaaactgtactgaagagacatgccgaaatggaagtggaagacggggaaaagccgaaacgaaaattggaaagggaattggagttggagcaagggagggagtacaagttggacttgaacaagcactacctgctgaagaatgagggagagaagtacgacaccatcccggagatttgggaaggacacaacatcggtttttaatctcatttttaacaaaaaccctttcaatgtttaagccgacttcattgacccgaaaattgtcgaggtaaattccaaaacattcattttcaattttaaatttagaaattgctgaaactgagagacgaggagaagaaacgtgaagaagctgggttttatgacagtgacatggacgaagacgacgaagagaccaggaaattattgcgggaagcggagaaaataacacaaaaagagcaaatgcgaagaatggaattccgcgaaaagaaaagcacaaatcagccgaaaatgtcgaggaaaatcggacggaaacgggagcgaagcatggcgaggctggaggaggagttgggcgacttgggggtggacatcgccagcaagaaaatgcgccatttgagcgaggagcagaacagggaacagcggggcaagaaaattcgcgtgggtcggtcaccgtcagtcaaagcaccgcccaaaacgccgcgagacgtacagggcattcccgacaaaaaggtacgaacgaaaagacggatgttttcagggagaagagggggggggggtcataccgggatgtgagtttcgggttctgaaattttgtataactattttcgtatttttatttttaatttttagaaaattttgcgcgcaattatattaataagccgggccaaattcttaattttctccggtagcgcctgtcgacaccgccgggatttcattccttaaaaaaatttcgtttgtctcaaaacaaagagaaattaaagtttcgcacaaaagacaatatatcataatcaaaattaa

SEQ ID NO: 4373 - DNA, 1505 bp, Heterodera glycines
  misc_feature (38)..(38): n is a, c, g, or t
aggggagaacttagagtcgacaaacgacgaaaattcanccggcgagggggaaaaggaagtgacgaaaaagcgaaagaacaaattgggcaaagagaagcgagcaaagcgaaggaaaggactcgccgaaagcgaaggggcgaaaggcgacggaacggaggccgagggaagcgatcggtcgccgctgctcacttcggtggatgcctctcgattccgttttctgaacgagcggttgtgcagccaaacatcggcttcttccgcaaagctctttgaggaggaccccgactcgttcaggctgtaccatcgcgggtaccggcaccaagtgaggaccagcggaactgggatgggatgggtatacgttaaattataatcgacaatcagaaagtgccatctctgactttcttgccctaatcacaatcattgccagattacccgccccaagtcaggtactatgtccaagagtgacaaagtgttgttaagccatccatggcgttgctaattaatgaattattccctccacaattgtgtctttcccattttgcaatgattctctctcaattttaaggtgtccaaatggccggtgaatcctctcgagaaaatcgtgctggacctcggctcccttccgcccggaagtgtcgtcgccgacttgggctgtggcgacgcggaaattgctaagcgattgggcgaacggctccgagttcattcctttgacctggtggcttcaaatgagcgggttttggcagcggacatggccgatttgccgttggaggcggagtctgtggacgtttgcgtttactgtctgtcgttgatgggcaccaatttggcccaattcttccgagaagctcatcgagtgctcaaaactcagtgagaaatcacaatggagggaatgtttcaatacgcagactcagataaggcgtagaatttcgcacgggggagggtccgagacgatttcacaaattttcggagaaaccctaaaactagcacccccccccccccctatcctgtccatatataccgccggccccaaatccttgattttttaaattgtgaatgctcaaaaaggaacgcaaaagtttcttgttggagcaaaaaatttaagacgacatataaaaaagtcccgacgaattccccctcctccgctttatttgtttcgtcgccataaacgcacaaaaggggtgcgccgggcccctccccctgggggtgggggagaggaggtggtcgtagagtgatagcaaatggcaaggcaattataacgacttctactttaagcgggaagatcaaaattgccgagataacgagccgtcttcggagtgtctcactgtttgtgttggcgttggaaaaaatgggattccaattgaaacggaaggtacgttctatttgtagctttttatgcgcttatttcgtgcttttgtttcagaaattaatcggtgatggcttttttgtgctgatgactttcgagaagatttccgaaaaaatgaccaacaaacgccaggaaaaccttcgactga

SEQ ID NO: 4374 - DNA, 1105 bp, Heterodera glycines
  misc_feature (58)..(58): n is a, c, g, or t
  misc_feature (1050)..(1050): n is a, c, g, or t
ttttcattcaatgaaatatttattctaattgccatatgtataatgcaaaagaaatttncggagaaacccacaaaaaaaaatcattaagtcttaatattaatttttaaatatttttaatctaattgaaattaaattaaataaaagattttatttattattgaaatataaattttataaattcctttaaaatacatcttgatgttagactattatttttttctcatatgaatgtatttcttttaaatttattagttttttttaatatttctaatttttttaggaaattatattcattttttaaattcataaaaatttaattttattaattaagtttattttttttgctaattaatgcacttcgtaatttgttagatttactcaatttttaaaatgattgtttttgtcttaaaataggttttagtttaagacatcggctattttatttataatagctgtgatcagcacgttaagagttctttttttaactcgaattatttgtatttttaatttatttttttaaattttttagctcgtagtctttctcgggagcttgattttaggcaaacctcgccataatgctccctcctctatttttctcatatgaatgtatttcttttaaatttattagttttttttaatatttctaattttttaggaaattatattcattttttaaattcataaaaatttaattttattaattaagtttctttttttttgctaattatgcacttcgtaattactcaatttttaaaatgattgtttttgtcttaaaataggttttagtttaagacatcggctattttatttataatagctgtgatcagcacgttaagagttctttttttaactcgaattatttgtatttttaatttatttctttttattttttatttttagctcgtagtctttttctataaatgtttatattttaaaattttttattttaatggatacttattgtttatatttattatttaaacttctctactaaagcttgtaatttagtaatgaaatcacttccgaaaaaacataaatgaattcatttcnactcatgctattgaattaaattattatttttttaaattttgataaaaattcaaaa

SEQ ID NO: 4375 - DNA, 9753 bp, Heterodera glycines
  misc_feature (7)..(7): n is a, c, g, or t
taatacnttttgaatgattatttatatttattttcaagtgtttgtttgaaatttatcttcgattaggtaagcattttttaaattaatttaacattagaatattggtatttttcctctaatacacttaagcattaaaatttaatattcaattattgattattcttcataaaatagaatattttattttctccacttttttattttacgctcgaaatatttatttgtatttgccttttttgtccatttttttcatttgatcaacacgataattgtgctactcatcatctcgtgagctattcattcgggggtttattcccttaacaatccataaattaattcatattgtaattatttcgattaaatatttataaaagaattacatgaatgtattaaataggtttatttatctatttttaaaatatttctacattattttcgaaataagtgcttttatttgccttcctcggtttaaatttagaagatattttttgtaatttattcgttctttatattcattatttttaatattaaatcatacgtaataaactttgatacattttttttataaatctcttgagcttgttggattgaaactctactgcaaaaaattcagtcttatggattgcttggctcttgagttggcgaaaaaattggaaataaaaccagcacggtatgccgtgcgaaagacaatgatgaaagcactgttcataagcccgggacgctatgaatttaatgcaaacttgttcatggaccaagttccacgccgcgtaacaatgaaatggaattttcattaatccaaaaaatcatacttatatattaacaatgaaaatgattgtaaaaaaggtaaaaattaaaattcatcataaccttttgttaatggttaattattttttataaattataattacatgttcattcttcttttattatttttaaataggaataagaaagaaaaatataatttgcttaattgccttttaataaaaaaggtttaaaaaatctccataacaaatttattagtttgctaattcaaattaagcaaaaagtttaaaaagaataaaactaactttataaaataaactcgaagatattgataataattacagcattatatcataattaaaaactaattaaattttaacaaataaatgtgaaaaaaatgaaaaatcaaaaaacaattgtcgaaaatgaactatttatagttattttcgatttacaaattttttctatgttttctctcccccgggggatgttaagcaaaggactctctcctttgcttagtctctcttctgttggctgttcagtcattggtcttcagcgaccgccgcgaccgaacggcgctaatgtattcaattttcccttttccctccttttttcagcagaagcaacagtcagccgatgaaatcgccgtctttgccccctccctctctgttccgccaatctgcatttctccactgcacatccatcgcttcatctctgctcccccactgcttggccttccgccgtcccatctgccgtctcatccgcccccactctctctccatcgcacatcattcacaccacctccgcctggccccacggcttggaccatgccattgaagaacgatggacggaagacatttcacatcgtttaaactgttgcgaccattcgatccgccccctcccccaccgatggacgattttcttttccccgttttcattctattaatttttgcttcgctcatctcaactgacaataaaatttgctccgtcaaattgtcaaacaaggggaaaaagtcggctttttctaatcctgaataaacatcagattcggggttccctttctaaattaaatcccgggagggaatcgtcttttagaaaagggcctaaaaactgtaagcagggaattcccaacactgggaccaagaacggtaccgtaagacacttggtacggtaaaagtaatttggatcacttgtgatttccattcaccgatcgctgtttagcgcattgtcccctcacatcaagcattggtgcttgaaatcccggttaatcatttgatcggtcctttgcccgatcagtcttgctccatcgttaggctttttgtccactgtgttattcatttccaaaataattgttttctccccccttttgttgctctccattcttcactccgttgatcgccgcttggacctttctctgctgaccaattgatcaccacttggaccgttctccgttgaccaactgatcaccactcggacctctcttcgcctctgtccgagcatcaccaggtccggtgttcaccaatcgctgtcgccaactgatcgctgcacacaccagtcgaggaccaattgacgccgttggatcaggtcaagcacagctaactgtccaattagccggttatttaaccgctatccctcgcgtgtcaattagtcgattgtttaatcggctaacaatctgttctcaaattactatctcccaacggcctattcattcacagttccgcaggcaaccgccgcttaagtctcattccaagcggtttgcgttagtggcgacctggaccccacagggacgaccgcagctatcagttactaaccctaaagaccaaaacctattgtacggtccgacacgtccaatcatagaattttaattctttctttttgtttgctcatatttattttttataacaaccttttcggtcaagttttgaacctatttttttttgtgaaccagttttgacttcacacatttattctgattaattttgatcagtcttgatcaaatatttgtctattcatattaaattttgattgcgcatttaatatttatttttgttgagttgctgtcagttttgaacttactaattttattttttttttggggagagcgttgcttagtcagttttgactaaacaatttcaatttttgaagttcaattagtgcatttacaatttgttattcaacattttattgtttaattcatattattaaccaagggctgccgaattaccaagttgatacattttttttttacgaatcaaatcgtgactatttagtcaaattaaataaatctgaattaaacttaaaaagggatcataatgtcggacatttatgtcgaacgcatagaaacagctaaatatgcaattgagttatatctggacaagccattgcccattcttccgcaaggggtgttaacctctcaacagagacataatttaatttgtgatcaaagggaatggaaagaagttgcggacgaaattcagacgcaagtggacgaaataaaggcagcaagggcattgtacaatcaagaggcttctacgcttcacggcgatgaaaaaactgagtttcaacgccagtatcgtgcatcagtcaacgcaaacgatctgcaaaatttgttgcgaagagcaaatcataaattggccgatacccgcacgctgaaagggaacattgatcgtcttcttcaagatgggcccggaggaacggcacgccgaaacattgccttgccaaaattaagcctaaaggagttcgatggcagtgattgggatgacttttggccattattcgaatcgacaatacatgctgatgctgatttggattacgtacaaaaaatgagttatttggattccctgttgaggggtgaagccaaaaaggtcattcaaggacttttgcccttctccagggataattatgatctctcggtgtccttattaaaggacaagtacgggaagaatgaaaatttgatcagagatttacacaatcagttggcccggctttcaaattcgaagtctcttggcgacgacatgaaacttcaattggaattggaacgagtttgccgacaactcgagcattacaaccaggacttgagttctcctcaaatttatatgagtctggaacagaaattgtccaaaaaggtgttgaccagatatgtagacttaaaaaacgtcaagctgagtgcaatgcctcatggttcggattggtcaaccgacctatttagggatacatttaaagcggctattgagcagcttaaacaaatcaatgacatagttcaaagggctaatcccgaacaaactcaacatacatacaagagagagaaacataagagtgaagtaaaagaatcgaccttaaatctggccgtcatatacaaagatcaagagaaaacagacgatcgccaaccatcggttgctgttaagccaaagccatggcgtggaacttcaacttcatcggaaggatcaagctcacgctcatcctccaaatccagccgatacggaagagccccaggaagaaaagccggttcaccatggcccaatgaaagtcgaagaagagaataaaattcaaattcatcaagcccaagcccgagtcgaagcagaagtccgtcgcgatttccatgccagttttgtgctgaaaaacacttcgctttagattgtgacaaatttagttcaattgtgaacaggcgaaaacaaatagaagcaaaagcaatgtgctacatttgcctattcaataatcacatggcaagaaattgtccaagaaaacttagaaaatgttttctttgtcaacgtaccggacatcacccagcattatgtgaaaaacggaaactaatggccagaggacaagtcgcaaccaccacgtctaagaagcaagaaaacacatcaaccaatgtgtttgccatacaaagctgcatgaaaaatccaattcagcccttaagaccgattgatttaattttacccaacattggcaaagaaaaattggaaataaacactagatctgttgagaacttagacagtgatcatatttttgagaactccaacactgccaatctagtacaaacctaccaaaaggcaatgaatatggctgaaaaattttggcaaaattggaaagattcctactcattgggtctaagggaacgtcatcaagggaacaaacacacgccaggaaaagcaccaaaacttggggacgaagtgatcatttctgaaccacaaactccaagaaattgttggaaattggggaaaatagaagaaattttatcacaacgaaccgcaagagtcagaatttcggaaaaatcaattattgaacgtgctattaagcacttatatcccttagagttagccgaaaaggccaataattctgactctggcattaaacaacaggaacacagttttgtgaaacaaattcattataattgggcaaagggacctcctcaaaataaggcgcttgttaaggcaaattccccaaatcactacagatgggcaaaacaaccaccgaaaataataaatggtataactaatgtgacatgtatttcagaaatgaacaaagacttcgatgccgtgtctcttgattgtgaagaaatggaaagagatctcgaggacgaaaacaaggaggaagaatcgaaggatgagagaaagggcatttcacaaattcctgttgaggaaaggcgcccctgggatggcgttggagaaaaaagggttattattaacgctcccatcgcattcgtcggggatgacgaagtggaaccaattggacggacgttccaagacaacgggctccgtgccctagttctcgtgcactcactcagggacgttgtctggtggcatcggttaccagaggtcgtcaccattaatgatgtttgtcagatggtcgtcgtgcggacgacggaatgggccgagcacatcagaccatttttgagccttttgggaagatgggccaaaccggcggtctggattggtagtacaatacatgttgaaggcgtagcctggctggaaccggcacagacagtagaacttgacatcaacagacttgtgtttatgggtgctccgcgaatcactcaaaggggaggaagtgcgctgtataagaagcgatgccaacaaccattttctgatgatcgtagttcgggcgcaacaaagtcaaaaaggttccgtcctgttgaggaccaaccatcgcacagcgaatggactcaggaaattcgaccaattcgtcctgttgaggacccaccgtcgcacagcagatgggcgtaggcaattcgaccaatccgtcctgttgaggacttgcagcaacatcagtccagctcaaatccacgtctccaccgccaacagcagtttccggtcaaggccgtttacgatttttggaaattggaaagtatcccgccaattccgccgttcatcaatgacagagcaccattttgccgccgtgtccgggttgaagaaagaggcgaattgctaggattttttaatcagcaattttacttttcgaatttcaacgaagcgtatgaattcgtcatccacggaagaacctaccgatgtgtggagcagtattactgtgcccaaaaagcgttgtatctgaaacgtttcgacgcggcggatgcgattatgctggggacaaacagatatggcaaaagaataagcgcatttgagatgaagaaattcgcaaacatgaacggggaggacgaagtgactgtccaagaatggactgagctcaaaattggcatcatagaagaagcacttaaagccaagttttcggtgcctgatcttaaagatgtgctgttgagcactggatcggccataatttgcgaattatcactcgaccagttttggggggtgggttgtagaccgggactcatttatgacaaatggccaacagcggacatacaacagtggaacggttcgaacacactaggacgattgttgatgcaactcagagatgatttgaaggaggcaacaccaaaaggtacaacacgggctgttcagccaaattatggatggccaaaaaatagggaagaaaattttcaaaatattcctgttgaggaagacgtattcgacttaaaaagtttcaaaaatctcgaaataacaagcacagacgaagctaaaaggggggataaaccaaaagattcgacaaatgccaactcaatcagtgaactattgatgagccacgcagacgaagtggccgagacggaggaaaagacaaatgagaaatttgcattgtcagaaaggatgaaccagtggctcaaatatgcgggcataaattgtcaagtcctagtttttggttcctaattatgtcaattggctcaacacggttcggacttggaccttttcatctacaagttcgaccaaacatcagttcgtcttgctgacgaattgggaaagattcgacaaattttaaggcaaaaatatccgcgaacagagatggaattgagagcgagaggaaacaccccggtattaaaaattaagttggaattccacgttgatttgacaattggacgatcagagaaattgaatggtgtctacaattctgtgtggctggccacgttggtccgaattaatgacctgttcagttccgtctgcttattgattaaagaatggggaacggatatcaaccaaccggaatttggttcattcaatagcctgtccttggttattatggttcaaagttacttcgctgaacaaaagttgttgccaagcctgtttaggctttatcctgatatttacaaagaagacaagatcgtcaaattctacgacgcagaattccatcaaaaattagcagaagatgcgaaggcaaagtgtccgcagtcaacttcatcgttaattgaggtgttaaccaactttttcctttggttggatgatattgacttcgccagagtgaaattgtcagcaaaaagcggtaaaattgataggacagaaggcaatggattgcagtccgttataatcgaagagccttttgatgcaaaatcaaactgcagcagaagcttaacagataaggagttccaaaatttcaagggtctgttaagacgcacaaatacgcatctcagagcaaaagactggtatacagtaaaacgcctgtttaggctaaacccggtaaatgatgtagcgtggtcaatgaccgacgaatcagaagacgattcgttcgataaaattgctgttgagcaaataaatgaatcaatgaaaagatttgcgggaattaagccagacaacgtacgaacaacacataatgtgcgcagaagccaaactgaggaccgagatttcgagagaaacttcggattcccaaaaggtcagtcaagaggcttgagaacatttacaaatagcaaattcacatttgggctattgagcctttttatgttgttgggcgtaaatttatgtcaaaaaccaatgatttgtcacagaaacgtgccatcaagatttgtcaaaattggtctaaacaatagtgcctgttcagggatatctcaaatatttgaaagaggtacaaaaaatttagaacttacattgtatcgtcctgaccaaaaggaatacaccttttgggggcatcaatgtttactccttaaacattcggtccaattttggacgaatttactgaatgatccattcgacatcaaaagtcaagaaatgatgccgatttctgccgaagaatgccaagaaatctccaaaaccaaaaaatgcagattcggaattctagtaggtgactcagacggtaccatgataacagaaaataaactcatttatgagcattcttggtggtcttggggtaaaaagtctgttgagacggttaattgcatagtcaacaatataacaatcattggatatcccggatcccaaagaattgattcgattgtcggagacctccaacattgtcaatatgacgacggcagatgcagtttacacgattctattgtagtttgggatgttgatcggtatcacacatctgcaccatgggcggctcgacacggacattgcgtttttaaaagtttttcaaagaaaaatggaaccatttatcgaataggttggatcagtgacccaccggacttagccctaacatttggggaaaatccgacatttattacttcttgtttaagaagattggtagttagccaacaaggattcgcaatcgaagaaagagaatttgtaaacttcaaccgacaattggacagaactcgccgaaatgttaattttgatgaaccgttggacggcgaagttcgcacatcacaattagatgctcaactcacagcacgttcgatgttcgcagataaagaaatgagaaaagtattgcaggcatattttaaacttatttgtgactccatttttggctcagcatcgagcactgatctgacacatctcaatccgaatttttgattcgtcagctttcggacaaccagcaaatcgaagcagaatggatttcaaaaaacattttggaaatttggccatgttcctcagtatatgagtacggattcgcacaatccaaggataaatgttacaagaaaatctcagtaaaggtgacattagttaggaaagacaagccaattctggcttacttgggcccaaaagccctcataataagtgcagaagctagaaaagttgatcgtcagacagatcgctacaaacatatcgttcttgaaggtcgactttatgagattgatcaagttttaggtattaagactcctgttaaggaaataagtgagatagaaatcagtaccaaaatttggaaatcaggctgtactcgctcacacttctgcttgcacaattcttgtcgctcttcttgcatcagtcaatgtagatacttgactagagaatcgacaatacagaaaatcgactgaggtgagactacaatggcgactgaggagcgaagttgtttcacgaatttgtcgttggattcagcttccgtgcggggagggtcgagtgagtcaagtgaaaatgatcactcgaaatttccagttttggaaacaaatgttttaaaattaataggacacaaaattttggcttgggaaaatttagtcaacgcggtcattctgctagttttagc

SEQ ID NO: 4376 - DNA, 744 bp, Heterodera glycines
ttttcttgacatgagtcgagactcttgaacagcaccgctctctacaaaaatcaagcattagcaattttgtagttttccaaacagcttatcttttggcattagttcattaaatttatgcgtctaagcaatcctcagtttcctagatcataactttttttcttgtcgatgtcctcatttttggtatcaattgaaggcttaaagtctacagaaattttttagaatgtagacatttaaaattaagaaagttatggcctaggaaattggattcgtgataaaattttaaaaaaacggtccatccaaaaactcaccaaaattgcaattttctcgctgaatttgcgcggcgttgcctgcgacattctgctgatgtactgctcgcgcgtgtgttgcgtaatgtgcaaatattgaacaacagaaaaaagggggaaatgtgccgcttttgcctatgcctttcaaaaaaaaaagtcaccgctgaaccgacaaaaggtggcgaatgaaaatcaaagcgaaataaattaaaagtgcagacaaaaagcgtgcacacaattcaattaggtatatgtggacggaggggcaaaaggacgaggaagttgggaaaattaactttgaaaaaaaaattctcggaaggggggggggaattctgtgggaacacggtcgaatgagtgtggaaggaggcggggagagcagcagcatcagcacacaattggcatgtgttgtgtgtgacaaacccgcgcgtgaaaatttgtg

SEQ ID NO: 4377 - DNA, 2344 bp, Heterodera glycines
tttgctcatctcggcactccagagaaggttgttgagaagttggtgaaacatgtgacactgctaaatgcacttcatgatcgaggcgtcgacaacaaccaagagaatacaagcgattacccaaatttttgatcaaatttcattttttcaaacattttcaccatttcacattttccatatctgaatatttaagtgaacacattttttcggtttcaaatagcatttttaaataaagattttagtcatttgaataaagtttattaatgttaattggtctccaaaaaaggcagtgatcagcgtttcttttgaattaacgcgcaaaaatttacgccaaatacgctaatccaactttcttgatatcattcgagagcccttcggatgctctattagcctgcaaaatttcaaaaaattttattaagtttaaaaaaagtttgagccaaaaaagtttgaaaatctggttttttgagtttttctggccataacttttttgaagcttaacaaaatttttcgcaatttttcagattaatagaggacacttagggctatcgaacgatactaaaaatgttggatcttgttggcaaagaaaaaagttatagccaaaaacttgcgctcgtactaaaacggcccgtactaaaccgaccccgaccccaaattctcatctctcccccctttcagtaaaaccgttgacttttcgtttctccgtctgtcacccgctctctctctctctctctcgtctttctttccatgtctcagccctctctctttctctcatttgtccgttgtctttatccaccctccattttttccattttccgccacaaatttttctgtgtttaaaaattttgtggttctaattgagcagcagcagttcacacaacaatcacaggagaagcgataacggagggctgcctctctttgctcatctctcctccagccgttgtccccgtttttctgcctgtttctctctctctcaaaaactttggttttatggctccatttcctcctcgacttattgtgtgtatgtatacatacacatacccacacatcgtataaccaccccccccccatttttcacaccggaaaacataaaaaaaaactttcatttttatgccccgtttctctaaccgacaatcaccgtgtctgtctgtctgtccgtctcccatcagcggcacagcgaccaaatgcgaatggtagcagctttggccgcgccatattttagatacaaatccatttttaaaaatggacattttgttgaaaataattggggtaaaaaaatgagaaaggggcatttctcggcatttgacagcgttagaaaccaattttttttttttgtggtgtacaacagaggggaataacgaagaatcgaacaatggggcaaaatggatgggtttatctcttgagataatatcggtggatatccgtattacatggatatatgttaaaaaaaggcttgatgtcttttagatttaaaaatttaagtaaaataattttacatataaatgcttaataggtatgtgtatttatgaaaaaacaaaaaaggaaaataaaaaaggtaaatttttgcctgccggacgtgtgcaatggcatggcatggctatgtgtgttaaaatgtgaaatctgctgatgatgttattgatcgagaatgaatgaatgttaatcatcagacgagacaaacaataaaatccattgccatccctaattattactagggatgcaacttttagtgatttaactattttttttgctcgattgttttgaagaaaggagctcaaaaaacgcatttctgcgttgaaatttttcgatttggatctcactatcgatcactagaaatcactattttcacgcttcgtcactaaaatagtgaaaattcactattttggcgttttgtctcttaataaaaatgcaataaaatcaaaaaatacacccctaagaatcgagctaaaatttttcaaaatatactcctatgaaatgaaaaaaaattttctcaaaaaattactttcttggcaaaaatttttttaggtaactattttgggttttttgctcttaaaaatcccagccctactcatttgcaactgcaatcagtaagttgcatccctaattattacatattagttttcttttaatacaaattgattaattgccaaatttttcttcctgtttcttaaatatgcattctgtttttcgtttcaatgtcaatttttgtatatattttttatgtatataaatttgttataaatttatgcatacaacggccttaaatcagggctctgatctgtcctgatttatcagaaatgtcctgatttgaagggtccaaatctgataaaattaaaatgtcctatttgccaga

SEQ ID NO: 4378 - DNA, 3832 bp, Heterodera glycines
  misc_feature (3674)..(3674): n is a, c, g, or t
tttcgaaataaacttgttttatgggttttctgggtcatagaattcgattctgatatctatttcagcccgtttcgaacccctgaccctgactcgaacaaaaattcgaaaattcaattcgaaaaaattcaaaatatgtatgcagccaaatgcattaaataaaaaggagtctcgattcagaaggcaaaacatagtaattcgtgcatttgaaatggttttgttgcatattttgaattttttcgaaaattgaattttcgaatttttgttcgagtccgggtcaggggttcgaaacgggctgaaatagatatcagaatcgaattctatgacccagaaaacccataaaacaagtttatttcgaaaaaaaaattttgaaaattttctttttcaaaaaagaggggggggggtacaaagtacactatttattattaccgacccgggtcttaaattgttcaactcccttaaaagggagtcttataattggagaaatatgtaaataaattaaaaatgattcacgctcgtgtatcacggcgattttctgcgcgtccgcgtcgcttttaaaccgcgttgcgccacacttttttggtccgcatcacccgcaaaactttaaagttaaaaaagtgaaattgaaatatgccaacatggtcttagtaatacacagttttagcaacaaaaaaaagtgcataacaattatctttgtaaatgagctatcgaataataccaagaatgtttaatttggatgcttcaagaacacttctgggtgcattaatgttgccaaaattttttttggtcttgtaaactgcaatagagccaattttttgctgctttccagttatcggcgagataaacaaataccattccacaattattcaatttgttttcagcaaaaagggaaattgtttttttgctttgtttaccaattgttctgatgacaacgcttgatgcgaagatgagcagttcgagctccgttttgcaagacttgctcagagatcacagttccgaaattggcaattggagtgaaattgtcaacaaccatcaggttattttttcatttaattgttttttgaatataccttttggatatgccaagtaacgacattcctcaacttaccacaaacacaaatttggatcaaatattgtaaataagcaattatactggaaaattggaaattgcttggaccaaattatgctttatgtttatcgaagctgaaaattaggttttcgagtccgccaatttcatacaatatacacagattttgctaaaaattctggatgactgaattttcggttaaacttcgaactttgctccatccctttctaatcaacgaattcattgacaaatgtcatcaatttttctactgtttttcgatgtaattttgttggccatccaaaattttccgctttttaggatgagagttcgaaacctgagccatttaccaacattgaccacaacggaccattctacatttttgtgcccaatttaacgcttgactatgccgtggacagtgtgaacatggaagtctacaaaatgtttggtggacataaaaatgtatgcaatttagatagtgaaaacggtacttttaccgtttagtgaagatgttttatcgcatccatttttatccgcaaaatttctcaaaattgatttttcgcggattcgattccttttatattatttgaaattgcaaaaaatggcccattttcagcgcgtttcagatactctaaattgaaccgattcagcaaaaagattatccatttcaaaaacaaaaaatagaacaattttactattttaaacgccatttttgccgatttctccatttattgcatcattacaattattactagtagtcaagcaagaaaaacaaaatgatatcattagtctgtctctccaaatttgtcccccaatttttcagcttttcgctgtctacgcctatcggttggcgaagaaagtgtcgcaatcattcatgctgatggcacgggacttcgaaagctgtgttcaagtgttgaagatggaggagaaggtaaattcaatggaaaaaagcgaatggtcgaacgaatggaaggcactcacacaaatagagcccgaacagtacaatcgatacttatactttttacgcactttttcgaaaaccagaattcgctttacagcttttcccacggccctagtctctgggtcttgaatgaattttggaaaatgatgcaaaagacctagagttctgttaaaaaccaagaattttgtctggaattctgtccgggtctcaggaccgtcacaggatttcggctttgggaaatacggggtgatgacgaccttttttcccatttttatgcggcgcgctttttcaataattttttggggaatagtgggtttttgcatggacacacccattaagattgtcaatagcagcagcaaagaggttgtccgtcttgagtacgtgttgccgtccgtcgccccgccaaaaacgtttcattacaccactgaacagttggacaaccagttgcagtgctacaaaaatattcacccagcggaaggtgggattttttagtttatacgttttgcggaatttccatcgggttactgtattagaaccagcttgtgtattgtattctgtatggaaaaattggtgtgtaatgtatagcccaagtccggtgctacttaaaaagtgttgtccactccaaactaaaaactaaaggggggggggggctctcttggtttgcagaatgtttgtgataataaatcgtgaaagctttttcccatggattttcggggttgttgatcacaaatatgacatcaattttgactaattcctagcccgaacttgaacaaaagtcatgaaaattcaagtttctcgattatccgcttaatttacgtcggggattcagaatttgttgaatatggtaatacaactaattttatttccagaaaagccaaagaagagcccattcggcgatgcaaagccgatcaacaccaccaagaagttgttgagtgtggaggagaagctgcgcgaggagtccatcgccgccgctgctgctgccgccgctgccgttgcagcggccgctgcctctgccgccgctgcgtccgcctccggcacttcgtctgccacaactatgtcatttgttgcaaccgcaacgcctgccgctgctgcttccggcacttcggttccggtcgctgcttccgactccggtacttcgtccacaacaaatgcttcgttggttcccgccgcaacgcctgccgctgctgctcctgctgcttccggcacttcggttgcggcacaaccggcccgcggcggtggcgcaatttctgcttcccgaagttccactgcaagcgcgcctgctgttgccgccgcagcacgttctgcaatgtcgtccgtctctcgaagttcatcgtccgcaactgcgtctgttgctgccgccgcaacctccgcaacttccttctccagcggcacgccgtctgttggtgctgccactgttgctgctcctgctgttgccccggtgtatacagcgcacagcaacaaccacaacaataacatcaacagcagcaccaacaccattggccatggccatggagcggtggcgtcggcggctgcggcgaagaagccaaagggcaacaacaagaagaagaagaagtctttctcaaaaaatgtaattataaaaataatttgatggggcaagaaaatgacgattanactctcggctttcagaatttaagtgccacgggtgagaaaaaatagcaattctagcagatttgtcgacaaaccatttccctttttatcaaatttttttaattggggaagatttttttatccctccctccctgtcggcatgccaattttttgtcctgaat

SEQ ID NO: 4379 - DNA, 2323 bp, Heterodera glycines
tcttcatttgatctgtctgctgttgttttgtcctcttccgccgtttgttgcacgtggaaaaatttctccaaagactgcggcactttttcctgcaacaaaaaaaacattttacagttcattaatattatatttaattaatttacaaattgctcaccaatgatggcatatgtgaacaattcccgactaaacttcaaccaatgctctgtcctggttgcctgaaattggcatattcaaccaaaattttggtaaaaattaaggaaagtttgttttttagaatataatgataattgtttcacgcagattcattcatcaactccctattcgaaatttcgtgtcttacaattaggttttggtgttgacacaaaaaaaaaattgtttgtaggcgcgcggattcgaacccatgaggacccacagagccctcgagcatagatagacaccaccataccacccagcgagggcggttcgaatccgcgtgcctgtaaatgcctttttcctgctcaaaatgatccgaatacgaatttgagattatttttttggtgtttttttgtacattataattagctaatattaataattgttttccaccttgcgttgtccattcttcctgactccgcccccctcaatcactcggatccatcccctgtcgtcattcgccactttgaagtcctcaaaagtcaaacattcgtcgcccttttgcttcgtccgattctttgttggttgccgttgtggtgaaaattgaatacgctttctgtgaaagtgccaaaattgtggtgaaaatggcacaaaaaaaagaaatcagaaaaaaacaaaacaaaaaataatgccgcaaaagcgtaaaaaatgaattttcttcaaaatgccaaaagcataacgcacccgggaacgatgaccaaacgcagcagcaaatcagcagcaatcctttccaatcgcaaatcccttcaggaaaaagggaagtgattaagaaattacaaaaaaaaacaaaaagaaaaaaaaagaattgcgcagtcaacgataaacaaacagaaaatcaacaggtacaagaaattccagaggtagcaattttcgacatagaaacttgagtctgggaatttaaaaacgtcgaaatgtcggggttacgattttttttgaaaaataagccgggatcccggcggaattctgatcccgtctgggctctaatgaaaaccttagctctcacacattactaactgttacgccaagagttgatgctcggaaaagtaagaaaaaaaaatttttttttccattttatatccaaaaacatggcatttaattccatattctcccaaacttacgggtgagagacggtgactgaaaaagtgccgttggaagtgccgttggcttcttcttcctcggcgtgtgtgtttccgtggtcattttcatcatcatccgacggctcttcaatgatcggaatgggcgatgtttctgtcgtcgtcgtttgagtcccacctattacaaaaaaatgtgccaaaattgatttttaaatatggaaatgccacaacatttttactcaccgttggtattttgaattgccaaacgcttctccatgcgaatgcggggacagccaacaaaaaagaggagaaaaatgccacggacgccccacaaaaattggtgccaatcagtcaacggccacacgaaggagaactgttccaccggttggctgaacaatgtaagacttaaaatggcatttttattgtttttcgtgccggggtatgtaaatttgttggtaaagtcaaaaagtcgagtccgcgcgtgccgaactcggcaccgactgattcagcatcattacggatgtgccccccccagataggtccaggaaaactgggaaaaattctcaattatcttaataggtctgacccaaaattttcaaatttttccctgaaggcgtcaaacggtatcgccgggtctcgtttttcaaaaaaaaaaaaaattgacccataaatagccaagatttgtcgaatagctaaaattgcttcgttttttttttactacggcacttaaatgttagacaatttactatgaataaaaactttttgggtcaggaatttttttttttttttgtatcaggccttccttacaattttgtttttcgaaaggcatcgaaaaatgcttaattaaaattgattttcaaaaagttaacgtggcgctaattgactccccgaccaatccgatccgatcccaactttcaatgctaacaattcacctcgaatctcgaaacccaccattcccaatgtgacgccgccctttcgtacgaaattttggccatttgaagacggtggtcaattgtgagcacgaggcaaacgtgaca

SEQ ID NO: 4380 - DNA, 4304 bp, Heterodera glycines
tacagcctttccaattgcagatagaggcttggaattttttttgttttttagaaaacacttcaacttagccccctcacagcagacattttttgatttgggttttagaaaaaaagttacgggcccccaaatgcacgaaaaaatgagaaatccgtccctgggactcagtcgtccgcgctgaatttttttctatagttttcccagatgcgcctcaaaaagttgtaagacccttccaccactttcagggcgctcccggccttcggccgggagaaaatggttttagcaacgaaactccttgtcaatataacatatatagtaactagcgggtgcgtgaaccgtcggctatttagctggggaaaagcgcttcgcgctttgggagcttcgctacctagactgtgaagcgattcaaattgatcgaattggttggagagattttttgaatttttaaaaaattattagaggtttttagtccacattgaggctcaagacgggcgcttcgcgcccgttttttaaatttgttgaactcatacgggcgcttcgcgcccgttttttagcttgttaggcgcttcgcgcccgtttttcaatttttgttggccttggacgggcgcttcgcgcccgttttttaaatctgttgaacttatacgggcgcttagcgcccgttttttagcttgttaggcgcttcgcgcccgtttttcaatttttgttggccttggacgggcgcttcgcgcccgtttttcaaattttgttggccttggacgggcgcttcgcgcccgtttttaaactttgttgggctttgacggccgcttcgcggccgttattaaattttagaacagatacaaaagtgattagaagaggtacaacattggtcagaagaggtacaacagtgattaaaagaggtacaaaagtgattaaaagaggtacaacagtgattaaaagatgtacaaaagtgattaaaagacgtacaaaagtgaattaaaagaggtacaatagtgatcagaagaggttcaacagtgattaaaagatgtacaaaagtgattaaaagacgtacaaaagtgaattaaaagaggtacaatagtgatcagaagaggttcaacagtgattaaaattgtatgaattataaatttattaaattaaaaataaatcctccatttattaattgaaaataacgttgaaaattaataattgaatatttaataaatttaagatgaaatttacaaattcaaaaaataaataattaaattctttaatgtaaaaaatttttttttaaataatctacaacaaatcttaagattagttaaaaacattgaaaatgacgtaaaaaggcatataaaataatttacaccggccggattcgaacctgccgccccccccccccccccagaagatgactcagaatccccaatcacacagggattctgaggtcttgacgatgtcaaaagtaaaatctgatcacgtattcgtgatcagcggcccaaataacccttatttggtagagcaaaaaattgcggatttttgttgtatattatttttacaaaatgacttttcagaaggtagttaggaatttttttctgaaaattcggatttttccagaatttctggaataactttttttctttagaatatagaaatcccaaataaatcccataaaattctcccgattttttgcctatttttaaagctttaattcacttaaattgaccggtcctccattgagttatgaattttcaaattttaacccaaatttccaaggaccaaaaaattgccaaaaaataaagaatttttaaaaaattattatgggtttttagtccacatcgaggctcaagacgagcgcttcgcgcccgttttttagcttattaggccgtttcgcggcctcagtcgggcgcttcgcgcccgtttctaaattttgttgaacttggacgggcgcttcgcgcccgtatttaaatgttgttgagctcatacgaggtacaaaaattgttggaagatgtgttggaagaggtacaacagtgattagaagaggtgcaacagtgattagaagaggtgcaacagtgattagaagaggtgcaacagtgattagaagaggtacgacagtgattagaagaggtacaacagtgatagaagaggtgcaacagtgataaaagaggtacaaatctgattagaagaggtacaaaagtcattagaagaggtacaaaagtgattagaagaggtacaacggtgattaaaaaggtacaaatgtgattagaagaagtacaaaagtgattaaaagaggtacaacggtgattaaaagaggtacaaaagtgattagaagaggtacaacggtgattaaaaaggtacaaatgtgattagaagaagtaaaaagtgattaaaagaggtacaacggtgattaaaaaggtacaaatgtgattagaagaggtacaacattggtcagaagaggtacaacagtgattaaaagaggtacaaaagtgattaaaagaggtacaacagtgattaaaagatgtacaaaagtgattaaaagacgtacaaaagtgaattaaaagaggtacaatagtgatcagaagaggttcaacagtgattaaaagatgtacaaaagtgattaaaagacgtacaaaagtgattaaaagaggtacaacggtgattaaaagaggtacaaaagtgattagaagaggtacaataaatgttagaagaggtgcaacagtgattagaagaggtacaacagtgatagaagaggtgcaacagtgataaaagaggtacaaaactgattagaagaggtacaaaaattgaatgcaatttattataaactttaaaaaataaaattaattattccttttattaattacaaagagaattttgaaatgtacaagaattggatatttaaattaatatgaaattaatttttagggccgggacttttagtgacgaaaaatcccgaaatagttaactaaaatagtgacgaaaaagtgccaaaatagtgacaaaatagtgaaaaaagtccaaaatagtgacgaatagtgacataattttcagccaaaaattgagcaaaaataatttttattcactatttgcagttgcaaatgagtaggactgggatttttaagaccaaaaaacccaaaataggtacctaaaaaaatttttaaaattaaaaatttttgccaagaaagtaaatttttgagaaaatttttttcatttcataggagcatattttgaaaaataacaaatctttaaatataaattaaacgcactgaaaaataacccaaaaatgcatagaaaaataatgttcaccgtccggattcgaactttgcacccccccccccaaaaatgatgtctcagaatcaccaatcacacagggattctgaggtcttgactatgtcaaaagtaaaaactgattacgtattcgtgatcagcgtcataaaatacccctaaagacatgtttttggaatattttcggtgaaaaaatttttccacccaaaaatcctggtcacccccctatggtcccgaaaccaaaaatcacttttatttttataacaattcgcaaaaaagagataaaaatgtaaaataaaatttatattatagagaaaaaaattgcgaatttttgtagtattttacttttacagaatgacttttcagaagggagttctgaatttttttctgaaaaatctaaaatttccagaatttctggaataactttttttctttagaagatagaaatcccaaataaatcccataaaattctcccgattttttgctatttttaaagctttaattcacttaaattgagcagtccttcattgagttatgaattttcaaattttaacccaaatttccaaggaccaaaaaaattaaaaatattttcgaatttttaaaaaattccaaaaaatctgaaacttaaaataaacatcatatttgtgctcaggaccctaatttaccccagaaaaatatttttcaccctctttttcaacccaaaaaaaatttttgaaaatttctagggggcctagctcgaaaatttttgaaaatttcctttcatatagtacaccattcgatagcatttaaaatgctctacaaaaatgtctaaggcaatttttggctaaaaccgatccctgacgagttataggcccgggactcaaatgtcccgctcaggccaaaattttttctatttccggaaaaaaccgaaatttttccgaaaaaataccagtcgatagagcttgaaaactatgttttggaaagtggtctccgttttctgggaaaattcgtaaaaatcataaaattaaaaacccgaaaaccgttttttaagccttactccaaaaattttgaaa

SEQ ID NO: 4381 - DNA, 1590 bp, Heterodera glycines
  misc_feature (1490)..(1490): n is a, c, g, or t
  misc_feature (1559)..(1560): n is a, c, g, or t
cgcagctgcggcggcggtcgttttgcgcagaaatgcctcgccagtccatgcccaacgctttgctgtccgccgcactctttgtgccttccgctatttcctgttttcgcctgtctgcgtccagcagcgggaaacgacggagtgtcacctaaaatgggacacattttgagtcagaaaaattcgaaaacgaaaatacttggtaaaaaatcgtataatctagagactagattttgaaaccactaattgggtcattaggggcagaataatgacctttaatgtgaccactgagccgacagtgaccgtctctttgtcgtcctccccctgcacttcgatgcgcgtgtcaaactccagccttggcatcatgccgagcacgtaaataatctgacgaatgggatggaaatgcaatttgtttaattttgtaaaatgttgaattttctttgtacaccttaattctgggggctccaaatttagtcggttttaacggtgaagccagccagaggactgattgtacggggggatatcactcaatctcccgaaacccgtaaaatccaaatgaaaatagagtttctgcgttcgattttcacaccctaagccaatcgagaatttagtattttaattgaaatttcaaacatttttcattgcataacccacatcttcgtattggtccgatgtgattgtgttcagcaaagccctgcgccggaattcgttgagctgtgccaagtcttggcaagtgataacccggttctgaaagtgccatttttaaaatatcatcacgaagacattatcactaattaattaaccaaattctttgaaaattccattaatttttcccggcgacggaccccagccatattctattttttgaataaccgtgccaaagatgcggtttgaaaggcaaaacaccgtcgatttacttgcctgtaccatgttcgcaaattacgccccccccctcccctctttttaatgtaaaaattggatttcgaatttgacattcaattagttaggcattctgtcccccggcccagccctcgccaaagcgtactttgcgcaggtaggcaatgttctgctcgcgcacgtgcggcaactgcagcagcgcgctgttccgtggccacaacgcctgcaccgtcatagggaagacgcgcaacacgttctcgagcgtgtcaatgctcggctgccgtgggcttatcggcatttggatcatttggatgagtacgcgcagcatttcctcgaccaactgcagcgaacggccgacaatgtatgcctggtctaaagaccgataatgaggaaaggattaattatcatgatgaagaataagacgatcattcaaaaattttgaatttcagtcgatttgtatttttcaaatttttacaaaaattttaggagtcagaaaaaattattctttgtcagctggatttgtggaataattatgcttttagttggtttggaaatacattgaaacaaagcttttccgaacgtatttttaatttttttanattttccaaacctttttttattttcctaagtttggcacccacccaagggcaaaatttctttgaaatganngtaaaaaatcgaaaaccctccaaaaatgcc

SEQ ID NO: 4382 - DNA, 1577 bp, Heterodera glycines
aggtttatctaactgttttactgtcgaagttgccgaattcagtcactggccgaaaacaccacgacgcgaccacgacaaatataaaaacaagcaaacgcaacgtaaaacaatttgaaaactcaacaaacaaaacgccagaaaaaatatttaaattaaatataaggcccgaaatttaagaacaaaaaacggtaaagcaattagctaattaagcatccaaaaactctttaaacatgaaataatcattaaaatattaaaaattttaaattttaaattgactcttaaacccaaattcagtgagttttttttcttccccccccccctcccactctcatgggctcccacggacaatccgtcagcaaaagttattatttttaaagcatcagatttatttaattatgtggaaatgataaattgctaaaaaatgaatattttatataatgggctttttaaataaaacattaatttgaaaataataatattatttaaaaccgattaatttcgtttttaaaataccaaatttaaattcaaagcatttactgctgcttctggataattttaatataattaagactgaaattgtttcaatcaaaggattccgacaatatttaatctgtcacaaaatgggaaaattcaaaataatttagcctaattaatacctttacccacaaataaatattaattcacgctcgctcttttgaatttatccatctgtcatctgcgttttgcttgaagctaatcagaaatcctctatttaaagaagacaaaattaaacttaaattcattttggaaaaattaaatatatttttaatgaagcatttaccgtatttttctcccgtccattaccgtatccttacataatgccaattttgtcttttataacgcttcacttatttcttttttaagtaaaaaatttcaaaatcaattaatcaaataataaatttaacacgaatttaaaaataattatttttgttttttctactgaaaaaatccaatttaaaattcttttgaaattgttaaaaaataaattatttgaactgttaaaaaataaatatttttatgtttttttctcattaccaaaaagccccatttaaacaattttttaaaatattattttatttaaatattaattaagctttcctaaataccaacaaatttgcgtaattcgtagagaaatggagaaacaacagcagcagcagcagcagcagcaaaaaagtgaccaaaaggagaaaattgatgagaagccgaaaaatgatcagccaaaaagtgatcagaaggtgaaaaaagtcgctgttgtgcggccgcgcgtcgttcggaagggaaacggtgagcattttgataattacaaattacagtaactttttcgatattttatatcaaatttattttcaaattggattggccgtaatggcgggattccgactgtgattgagtggcaccaaaattcggcattttctattcaattaagcttttcctttttttgtgtgaattttaccgcaaatgaacagagaacagatttaaaatttgaaaattcaaatgcctttttgttttttgttttgagtgacacttattagtgactt

SEQ ID NO: 4383 - DNA, 1843 bp, Heterodera glycines
cccccccccccccttatagtccaaattgatccctcaaatgcccttttcccaatggtacccctatgatccccttcccctcctccttcccctccggtcattgaaaggctctctctttctgttaaaagatggcaagggcaagcagtacaggcacagagagaggtacacgtgcacccgcaatgcacccaaatcattcaaatatataatccccagctgtaattgatgacgaaaaaaaacaacaaattaattggggtgggcggggaatgaatggtgttccttccccttcccccagaaagctatttaaatgccaatttttcacagcagaaccataaagaacggcaaaaaataaatttttaggtattttagcaataagaaatttatttaaatcaatgcatttttaaaaaacaattaaatcattattctatttttaattattttcagttttcctaatattaacaattaataattattagcacaaatggcgctggaagcaatggacttggacttgtcaactgacggcaacgacagcgagccatcactggccggtgattttgattttaaaaaattaacaaaaaaaagtttgaaatgggacagaagaaaggcacacatcagccaaccattggccatcctgacaatgagtggcgaaataaatagatttgctcataaattatcataaataaatatttttttaagatttaaaacggccagaaaatatggacatttctttaaaaatcctctattagaatggccctgtttcaaagctaaaattggaattttgcttcatttagtatttttttagcaccaattaaggcattttgacagtattttgcgatttttaagcacttaattgacaaccaaataaataattattcttaatcaattctgttgcagcacgtttgtcgtcagttgagaacaaccagaacaaaattctgcgaattctcgcggaacagaaggaaatgattgggaaattgcttaaggtggaaaaatgttgattaattaaaatttattacgcaaaaatgaattaataattaattccgaaatattataattaattgtgaattttcagattgtggcgggccccagcaaatgaaaaatgccgtgccgcacctaatgatcgcttacagagctttaacacgcttaatcttaacttaattttcatcgtatttttcatttttcttaaagcgataaaatattttaaatgcagagatggcaaaattattaaaaattaaaattgaatttttaaatgtaagctaaatcattaaaatgagagtgcagcgggactgggaccgggccgggaattcccggtcatcccaggtcccggtcccggtagggcaaccgtgaaaaacaagcactggtaagaatgggggggtctgagtgaaaaataagagatgaaaattggagttaaaggaaaaaaatttaaaaaaaattaatatattctttaaaagaaacactcccaagtgtgcaaatggcctagtggatagtcggcgctagtttaaaagaggtgcattttgaaaattttctgtcactttttttaaatataatttttttttgtttatttacacataatgatgcatattaaacattaacagcacaatatggcgagtaaaaagtatattcgcgattttccatctcaaaaaatttttgcaaaacaaaagggtcccccctttggtttttgataaaattcaaaatctgtcactttttaactagcgccaaatttgctttaaattttttttcaatttattaaataacgtgaaatgcgtaccatctggtaaaaaagcaaattcttcatcaaaataagcaacaaaaaaaattatatcaaaaaaaaagtgcaaaatattttcaaaat

SEQ ID NO: 4384 - DNA, 1536 bp, Heterodera glycines
cccagtgttagacaaaattgctcataacgccaaatagcgcaattggcgtaaatttttgcgcgctaattcaaaaattacactggtaaatgcattatttgtactgcataatttgatcatcaaataactcgcttcattcccaactaaacagaattaatttggtatctaaaaaaagattttgaaaaggagaatctttttctaagcgaattctaagcaatttgacatttcagaaaaaagttgtgggagtttcaaattttcattacgttataactcaagtcctaaaatgctgattccaaccgaaatgctaaaactaatcatttttccattgattcgaaatgtccaaactgattttgtaccttaagggagtcccaattccgaaacgcagctttattagttgagctggagagatttcggatggattaatgagtgatcactgataaccaacagcacgaaaagggtactaaatgacaaaaaattcacttaaaaactagaaaaagtcggcaaaaattcacttttcatagagcagcaaattgtgcaatatattctgatttggatggtccaaaccctggcaaaaaaatttactagtttcataaatatgatcaatttgtgtttttttttaaattaaaatttccacttttcgcactttgatttttcaaattgactcttaatccgaattctgggtgagttttattgtaaacaataaattgcaaaatttcactggcaaaattcgtttttcaatgtgtagaaaattttaggaaaaatttggtcttttcaaaatcaacttcggatggtgtgggaattttggattatcctaccccaaaaaagcgacaatttgagtccggaacgatgatgaattttgtcccctcctttccctattttaaactgtccattttgacccattaattccaaagtggacaatttccgagttttacttgattctacaaattaggtaatacacaaagaatgaccatcattatcttaataatgcgtttgaacaaatagttgaaacaatgaagggttttttatttagtgaaaaaaaataagtaaaaggaccaataatgctgtttattttacaattacccggggggcacaacagtggttttggtcatgggctgaattatacaaattgctataaaggtaaaaaaacaaaaacaaataaacatggggagtatatatgacgacttgggggaggggatgagaaaaataggatggagaaatagacaattcgtcactaatacatatatttaatattaaacgcaatcacacttaaattccgttcgagtgatggctttccggtccgcttacactgcaggaatttgcaacactgaggaacaaactgaaaaaagcggatgaattagtgagccaaacaaataaatgctcactgaccgttcaatttcggtggcacaataaacaaattcgtgcttccaaaagccgtagcgctggttgcggatcagctcgatgaatgtgatcaacaggccccacgggtgaggacggagagcaaccaaacgttcaaagagaatactgtgagaaaaacaaaaa

SEQ ID NO: 4385 - DNA, 642 bp, Heterodera glycines
aaaatagctgaattacgtcctccgccccgccgattctcccccatcgtccccccgaaattcctaaacaaacatttttcaaaaggtaattaatgatcttttttaataaaaaaaaattatttagttagaaacattttctagcaattttttcaaaattttaaatacccgggccattgtctcggtgaacgggtcgggaagacgcatgtcgcacggataagcgctgagcaccaagttgcgcaactgcacacaattggccgggatcacatcacaaagtatgtagtagtattcgcagagaatttctttaaaaattgaaagccgaatgatgaatggcggtgaaactgggtaaaacctggaaagtcgtgcaaaagcaccaacagcacacgcagagtgcccttgtagatgtaagcaatgggctttggcagttgaacattgcgcaaaaagggggccaaaaacttgagatgacaaagcagcagttgggtgtacatggcacttgtacgcgccaaatcctggctctccgagagcagacggccgatgaaattgcgatggccaatgatgtccagccaatggtaggcaaagccgggcacacggcgaggctgcagcagaaacagcacttgtctaaagagaacaataacaatgtaaatatgg

SEQ ID NO: 4386 - DNA, 5928 bp, Heterodera glycines
agttaagatgtttaattctgtatgatttataattttaaatgaaaaactttttttgtattttctttgttaagctattttcaaaaaaccattggattaattattagctttcagaggcgagacggaaagttttaaaactctttaaccgaaatataattatgaatttcacatgaaaaatgatgaaaatctctaaaaaaaatctcattaaaactgttacatgaaaaatgattaattaattttcttttttacagtattatgcattttctgttaattttattgtcactttggatagttagaatctttcaaaatgccatgagttttgagaatcataagactttggcacttaaaaattgtaattaaatgccaataaaattatcctttctccatccataaaattttttattttattgttaaaattataagtgaaaaggcatttactatttatgaatgcataatattgcaaatctcttaaaaatctgtcaaaaattccaagagtttctcagcctttgacccattgattttcaattctttgcaaaaacattttcgaaagaaaatttttggcgctatattaaagaaaaactcaaaatgttaatatttaatgtgacggaatggaaaattttaattttttggaaaaaattcaattatgctatatttttaaactaaataattttttctaaaattcaaaattgaaaaatttagacactagaatagcgagtttatgaatttttttcggacgtctgaggacatcagcttaaaattggcattgttgtaattctgggttcgtatgattcctcaaaattcttgacatctcaagacatcagttttccgatttccaaatcaaggcaaatctaaaaaatgagacattactgcaatgccgatttgcatgtcccaattttttattttgtcctgatttagaaatattcaatcgtgtatcctgagatgtccggaatttcgaggaatcattgccaattttggcatgtcccaatgttttaaacttgtcctgatttggaaatggcattcttgtgttctaagatgtcctcagttttgatgatcatgagaattttgtccttaaaaatttgtttaaatggcaaatgaaaactaagacattcattcactctctctacccataaatttttttattacaaaatatcatcgaataagcagtttttaaatgaatgtttcatattgcaattgcaatcacttaaaaatctcaaattaaaaattgccacgaaaggcctttgaccctctgattttcaattcttttggtatttggtaagacaaacctccgcttaggcctcccaaaatttttggcgcttcctttacatttttttgtcttcttgtccccgattatgctctgatatttataaaacaataatattccaggaaaatgatgaaatcacttttattttttaccatttttttccttttcctattatttgtggttgccacgccaccagcttcgaaggaaccacgaaatgttgaagagatggaacagataaacaacgaaataaaggaggaaggaatgtaagaaaataaattagaaaaaaagaattttgaaaaatatttgctagagggaggtcagtattttgaaaaaagcctgtacttgctggacataaattcaatgttggaactgaaccacaattttatgcataaaaatccaggaaacccaggtccagcaaaaatcctggcttgcccaaggcctggacatggatttttaaaattggttttaaaaagtaacaaaaggataattaatctgttaattgtttataaacaaatttaaaatcctatataattgacaatattaattatatttttttattctatgtaataatcatttcttgattcttaaaatatacattagtcacttgaataacaaattataaattttgtcctctaaaatccaactggacctggcctaggaaaatacaggcctggacccaggccctctccgaactcttatatttacataaagtttcaataaattaaagtgattccgataccgatgatgacggtccggcatcaacgccgtcatcttctgctgctgccattggtggtgatgaaggtggcccaggaacgggtctgtatcgtttcggcgccgccgtttcggcgccagcccttgtttttggactataactttttttgttgtcgatcaaatctaacaatcttggtatcattcgaaagctgaacatgtttagaagctatttctaagcaattgcttagcgattagtcgcttactaaaaaagttctaactgaaaattgcaaaaaagtcaaaatttttgtgattttttcttaataacttctttacaggtcaaattttttttttggttttttgtaggtctaatagggcttctgaagggctttagaatgataccaagattattagatttggttgtcaaagaaaaaagttatagtccaaaaacaagggctggcgccgaaacggcggcgccgaaacgacctagtccccccaggaacacccaaacgatcgccaaagcaaaattggcagattgccaagaacaaatttaagacttatgtgtacggtatgcgccgtaagcatgactatgtgcgcaatctgtacaagccgagcaaatacaatatgccaaaagtgtggggcggagaagtgaagcggtcggatcagctcgaagtaaaactttgtttttggtatataaacttgtgatttgacattagttgtttccaaacctatcagttttacagaaaatggtaatttttaaaaatttacttcaatttatttaatgaatttgaccaaaattttctaaaacatttttaaatccaatgcgaacaaaaattaacttttcgagttttcatggtgatccattttatgataacaaaaattcacaaaaacaagaaaaaataaatgttgttatttaagccaaatacaccagagaaagttggccaaaaacaatcggaaacgcagtcgaaaaaggagccgaaaaatgcgaaaccgacggaaaaatcgacacagtaagaaaactttacaaaaggaacaaatacgacacagaacggacacacctttaaacaatattttaataaaatttaaataaaaattcaaaaaaaaaaaacaaaaaattctttcgtgtttttaatacggccaaaaagtcgtcgtacaaatgaacattaaaagtgatttaatcaaaattaatttgattaattaacattttttgtattacatttgtccaaacaggttgcaaatgctgatctccaacgaaaagctgttgacggtgatgatgaaatatgtggagatgaagctgaaggacatgtccaagcagtacaaggagttccatgaaagggtaagcacagggacaccattagcatgggaattctcatcaattatcattcattacattttttggcaacgaagaagctggcgctactttaaagtggcgaatagggatcagatttatacggatgataattccaaaagttaaaaaatatatttaggaaataacaaatatttgtgaaatattggaacagccaaaatatttatgaaaatattgagtaagaattgaaacatttgcagtgctaaaaaatgaatgtttataaataagccaataattattcactggttgaagttgcaataagcacttttctatgatatgcctttttagaattgataaaatttaaaaatttaattttagacattaatagggattaatttagactaaatgttttctttcatttaaaggtgaaacaatggaaagatgacgtgcaattcataaaagcggcattcggagaggataaacaaatgtacaaaaagtacatggaaatggcggtcacttggccagagaaaaagtcgaaagggacaccggaaaaagtcccaaaatcgttgaagcagacccatctggacaatttggcacaaatggccaacaaatttgaggagttccgtcaggtggttaagcagtggcctgactcgggctgcttcatgacattcccgctggagaagaacgttttcaacaaggtgagaattgccagattttattgagttttaatttaaaaacatctatgaagagcagacaattgtaaagaaattacctttaaaattttttactgacaagtccaaaaatcaatccacaaaaggttttcctgttcgaccacgcgctgacgctgaaggaagatgatctgcagaaggaattggccacgggactttacactcacgcggaattccgcaaagaatcgccggctgatttcttcaacaacccggactggtcacagaagaaattggaggatgccgaaaaggatgacgatgaggatgaggatgatgacaaggaggaggaggaagaagaagaggacgatgatgatgaagaaggtgacgtgagaatggcgaccaacgcattgttggaggtactgcttgggagggacggacttgtggatttggacatgggaggagagtggtgttaatggagcaaaccaaaacaagtttaatggccagaaaaagtcagcagttgggatggagctgagaattaagaaaggatttggcagggcgtatcttttggctttgagtgcgtgtggtttaaggacaaaagcgatacgcaaatttcatattgaacctctttttaaaatagtgcttcattctcctaaaaaagctacgtaccatttaaattaaatccgaaagtttctcttatttcttaggcacttttgaaaggccgtgatggattcgggaaggaggcaacgctgaatctgcgcaatttgccaaaatgggacgggaagccgaatcagagcaaaagcatgtggcaaatggcgaagaaaattgtgcggaatctgatcaaatttgttaaatggcctttacgtattttttgggaatatagcaacaaattgacgagaaaggtgagagagagagtaggttctgttacaaatacaatttattcttaatattttatgaataataaataatacgtcagtattcagtgttaaactacagtaagatccttttcaaattactgtattattctgtaattcccacaggtgcgaaacgcaatgaaaagtaaggaagaaaaagaaaaaatgagaaaaaagctggaggaggtgaaaaaggatggcatgctttacaaaatttaccaaatgttggacaactcaaaaaacaaggcggaaaattttgatgaaaaagcgaagaaaaacatggaaaaggaggggatgaagccggacgagccgaccattgaccactcggcacacgaacagctgacagacaaagacaaacagcagcacccgttcactttcctgcagggtgaatgatttggggggggagggtaattatgctccaaattgggtaaatagtgaactataatgccataatgagcattaatgaggtaattgaagatcatactaattgatagaaagaggatgagagattgtggagcttaattagcacaaaacaaataacattgaatgcttacttgattgtcactattggaatgatgtattgaagggtaattaaaaaatcacaataattgggatttggtggtgcttttaggggtaaatgagtaaaatttaaattttgatcatcaaatatatgtatattagagaccggacaagagggtcggtcggtcggtttcagttaaaaaccgaaaaaaaaaccgaaaccgaaaaaaaccgaaaaactcaaaaatttgtcggtcggtcggtttcggttaaaaacccgaaaaaaaccgaaccgaaaaaaaccgaagaaaaattttcggtataccgtttcggtttcggtttttttgaatttttttatcttttcccaaaaaaacaataaaccatttttatcaatagaaaaagcgaaagatcacctctgagtaaaattgtagagctattgaagctcatcaatggtgtataagttgggaaaataattgaaaaaggcagccaaaaaacgtttgttagcttcctgattcttcttaaaaactagggttgctccccgacccctgggggggggggggg

SEQ ID NO: 4387 - DNA, 4990 bp, Heterodera glycines
  misc_feature (4922)..(4922): n is a, c, g, or t
gcttcaggcatggcgctcagttcagcggtgagatgtgcagagacaatggcgcccatgacgaacatcgtttgcccttccacggatcgacaccattccgccattctgtcgacgaagcagggaagcgagcgatcttcggtcgatgactcacgaggcgcaaccggaccatacccagcctaaaaccaaagcaaatattagttgcggaacgtaacgagaaatgaagcaaaataccaaggacaagagttggttcgactggtcttcttggggagtcgaagcaatgggtgcgtcaatgttggctgccggtagacgcctatttccaaacaaactgatcactcgttccatgttttccctgttttcctcatcgttgtcttggtgcgcgctttcgctgtttttggtcatcattccttcgagcagctccagcaatgtgttcacagtgtcgatacccggcttctcgtgtaactaagcgattttaacattcagatcaacaaaacattgatttaaagaaaactcaccggaattttccaaatgcctctgacaaaatcttttgccaagttcttcttgtaaatgcttttgacgataaacatggcctgctctgtattgtgctgattgttcacctgttcaaaaatattccatcttttttctttacgatttaattacgcgcacctgcaaacactccctcattcaaatcagtggacggttccgaggcacctgcagatggcggcgaattccaatttggatggatcaatgaaaattttgtcgtttgcgtggtatcttctgaacatgtactgatacaaatatgtcggcagcatttcctcatttgaaccacgtaagtgtcggagagaagtcttcagtgcaccccaagttgcctcaatgccttgcgtatgcacttgccggtcttgggggtctacaaagaaaacacggtgattcacccagtggtgatcgtattgctgctgcatgttttgaatccctccgtaagcggcccagccatcagacacaatcaatgttcccggttcaatgttttgagcaattaacggcaagagcgtagcggcatcacgttccgcgaccgggaaaaaacgcactttgtttgtgcctctctccaacatcccaaacacccaatcatattggcgttgcaacattcttcctctgttatatttggcccttaagtgcgtttttgaattcacaaatgaaacgttgacaaaacacgtcaaatccaactgatcaaaaggcaacgaattaaaacagcaacaaaaacaacaacaatactccacacgacgaattaatgatctcacagcaaatctacgacgaatagaggcaaccaatgacgcagaaaattaccaacaaaccacaacatgttctcaaacaacaaattttaccgaaaaaatttcgactcgtctatttctactatacgtcccataccgcccaaacgctcttgttcttgcatgcgaacaacccaggcctgaaatagataatggcgccaaaattaggcgctagatggtagtgatgctcgggtctcggtatcgtctcgggaaattttggtctcgagcatcactaccaggtggacgaatccgagccctcgtcatacttggcataaatctcgcatgaagttgtagaaatcgacaatagttgctctcgaagcaatttcattttctctcattacagtttccagtttgcttgttgggtgttgagcccaccaataggcaagacgaatcagcgaggtcttccagtgatcccggtggcataataggtccatcatttggcaacaaaatggtgagtcttgaccgtggtgcctccaatggaccaagacttgcccgtaacaatttggccgttgagtttccttggtcctcactacacaaaccaaattgcttgcagatcgccgtgggtttaagctcgtccagcgaaagcttctccaccttatagcaaaatcataaaattatatatgctttgcttacaatagcagatagcattttgtctgcaagtaaatagtagcaatcggcactaaaaaatgggacaagtcgacagtaactccttaattcatctctgatccatccaatgccttcgcttttcacttctctgatcacgctgataaatgctgtacatgcaaaacaacgcatgctcggctcaacttgtgaaacttcaaaattttgtttcaaaatgaaaataattctaaaaaccggtcgccttctcaaaatttctcttgcaatattgttgctcaagcggacattcgtcaattggcattgatgaagcacatgacgacatgtaatctgagggcgttttcccacaaaaatagcaacaaccttctattcctgtacggatttttttaattacacatttcttctcagaattaccagtcatataaatgtaagttgtgttgcgaatgtaacggtcggtttccgtttcatagctagattcgttaacgcatcggcctttatcgtagatgttgttattgtcagggcatattccacaacaatgccaagggttcgcccttcggtatccgaatttgtcaataataaagccgtgccattccattgcatgagttaaagcgcaggccaaaagaaaaagagccaatcgaaacattgccatagcactttgaagaacggagagaaaatgacggctgacagctttttgccgacgaacggagagaaaatgacagctggcagctttttgccgacgaacggagagaaaatgacggctggcagctttttgccggcaaatggagagaaaatgacggctggcagctttttgccggcaaatggagagataaatgacggctttttgactacgaaaagagagaaaaataaagctaactttgcctgtttttgaatggagaaaaatgtgttttcttgagctggtagttggatttagtgcaattaaatgtttaaaggtttttaatgaaaaattgattggacgcataaaaattttattggacgcataaaaaatgatgggacgcataaaaaattgattggacgcataagagtcgattggacgcataaaagtcgattggacgcataaaagtcgattggacgcataaactgtacttgagccaaaatattcattaactttgctttgatcgaaaactcagaacaaaaacagtgaaattttatcgattgatttttactcgttcggtcaatgtgttgagtgagtgagtgcatttgtttacgtaatggtgagccagtgacaaaggcttggtcatatactgtaggtagagatttacccaaatttagaaatttttaaactagcttttggaaaacactgttatctagtaacataaaaaatagggacttttacagtgtgttgcaaaaaaagtataaggacagattaaaagtgagcaaattcctaacaaaaaccaacctgaaactgataaaacaagctaagataaataacaaaaaaacaaatgtttttattatttctattgatttcgcgggcagaaaattgcagcttttccttgtcctttattttccttatatttttgcaacacaatgtacctaatgggatatcgttttataattttggattatattaaacaattttgatattgtatcataaattaagaccgcaatcacttaaacggtaaaaattggtgagaaacagagcaaatttcataccatggaaaacgggtacattgacgtgacatctatcgaagaacaacaggaatatgcggaaactgagcatcaaaatacaaggtaatgtcaaacagcgacaaacgaaaaagttttatagtacacatgtgaacagcattcttttttgttgtatttagtgcgttttgatcgtgttgcaaaaggtttttgactttttgttcgattccgggttcggaatccgagatccataacgcgaaagcccctagaaacatatctacgacttttgaaaacaaaaaaaacattcaaaaaaggtgtaccatctaaattagatatttcccataattcacagctctcatctcaatggcggtccgtccgacgttccaaattgacccgcgaagtggcgatcgatcggattttggatgaacgcggcaaaaagggtgcaacggaacatcagtaccttgtcaagtggaagagtgtcaagcagtgctgggtcaacgcggacgaactgaagaaattcccgtcacttacggatgcgtttaaggttctcttttttggcactttgagacgcgaacaattgaagacattggttccctctctgtttaaaattttaaataactcatataaaacgccttccctggtgttttaattgtctttgatcacgaatctgacatacatttcgaccaattccgaaccttggaccaagctctaacaaaaattcggatacaaaattttcacattttacttttgtggataatgttttattttgtgccatccattttcagaagaagaggggcaacatactcaatttcgaggaagaggaatttgacgagatcatcagcaatggcaccagcaagcgcgacaacagtccgtacaccgaccacgactacgcaggcacgcgccaattggcgacggcgaagggagcgaccggcaaacaccaacggcagaagggcggcggagggacggcgaaagagccgaaaaagaaaacggcacttgtcagtgggaccgattcgggggtccgttcatcggcacggccgcaccgtccgaccaaacgttttggtgggcgataattatttggacaaatttgatacattttcacttacagacagacaatgaatgaattttaaggattgagtttatttggtcgttttttcagtagaggaaacaaacgaatcattcattcgtgggacttcgaaagtgcgccgaacatcgccacgcaaacatggcaagaaatcgactgcggagggaggaagcgaaggggaagaatcggaggatgacgggaaggagtacagcgtggaaaaagtgttgaagaagcgtgtgaagggtggaaaaatggaatactttgtgagtggngcgatatgcaaatgggtgaaaaacagatattttctctaaaagtttaacaaaatatgcattacgattga

SEQ ID NO: 4388 - DNA, 3842 bp, Heterodera glycines
  misc_feature (53)..(53): n is a, c, g, or t
  misc_feature (66)..(67): n is a, c, g, or t
  misc_feature (74)..(74): n is a, c, g, or t
  misc_feature (94)..(94): n is a, c, g, or t
  misc_feature (106)..(106): n is a, c, g, or t
  misc_feature (116)..(116): n is a, c, g, or t
  misc_feature (118)..(118): n is a, c, g, or t
  misc_feature (125)..(125): n is a, c, g, or t
  misc_feature (138)..(138): n is a, c, g, or t
  misc_feature (141)..(143): n is a, c, g, or t
  misc_feature (145)..(145): n is a, c, g, or t
  misc_feature (149)..(149): n is a, c, g, or t
  misc_feature (159)..(159): n is a, c, g, or t
  misc_feature (169)..(169): n is a, c, g, or t
  misc_feature (181)..(182): n is a, c, g, or t
  misc_feature (184)..(184): n is a, c, g, or t
  misc_feature (186)..(186): n is a, c, g, or t
  misc_feature (192)..(194): n is a, c, g, or t
  misc_feature (203)..(203): n is a, c, g, or t
  misc_feature (209)..(210): n is a, c, g, or t
  misc_feature (215)..(215): n is a, c, g, or t
  misc_feature (220)..(222): n is a, c, g, or t
  misc_feature (228)..(228): n is a, c, g, or t
  misc_feature (231)..(233): n is a, c, g, or t
  misc_feature (238)..(238): n is a, c, g, or t
  misc_feature (248)..(248): n is a, c, g, or t
  misc_feature (252)..(252): n is a, c, g, or t
  misc_feature (254)..(254): n is a, c, g, or t
  misc_feature (263)..(263): n is a, c, g, or t
  misc_feature (272)..(273): n is a, c, g, or t
  misc_feature (284)..(284): n is a, c, g, or t
  misc_feature (291)..(292): n is a, c, g, or t
  misc_feature (300)..(301): n is a, c, g, or t
  misc_feature (309)..(310): n is a, c, g, or t
  misc_feature (318)..(318): n is a, c, g, or t
  misc_feature (357)..(358): n is a, c, g, or t
  misc_feature (411)..(411): n is a, c, g, or t
  misc_feature (418)..(418): n is a, c, g, or t
  misc_feature (427)..(427): n is a, c, g, or t
  misc_feature (429)..(430): n is a, c, g, or t
  misc_feature (462)..(462): n is a, c, g, or t
  misc_feature (469)..(469): n is a, c, g, or t
  misc_feature (473)..(473): n is a, c, g, or t
  misc_feature (480)..(480): n is a, c, g, or t
  misc_feature (488)..(488): n is a, c, g, or t
  misc_feature (491)..(491): n is a, c, g, or t
  misc_feature (504)..(506): n is a, c, g, or t
  misc_feature (512)..(513): n is a, c, g, or t
ccgaacatcttcacgcaaacatggcaagaaatcgatccttcgaggtaggaagngaaggggaagaannggaggangaccctttggaggacagcgnggaaaaagaggncaagaagcgngngaagggnggaaaaagggaanacnnngngagnggggcgacangaaaaggggngaaaaacagaanncncnaaaagnnnaacaaaaanaggcannacganagacnnnaaggcncgnnnaaggncaaaggggcngggnangacgacggnaggaacacnngggaaccgcgngagagcnngaaacacnnggaagggnncaagcagnacgagaaggcgcaacaaaaggcggcggagaaaaacaagnnggaagccgaagagacggaggaggacgaagaagaggaagacgaggacaacgaanacaaagnggagaaagngnnggacagacgcgagaagggcggcagaggggagnacagagngagncggacgnaaggcaanggnggaaaagcaccannngcaaannagaacaaagggaagggctatgacgacagttggaactcgtgggagccgagcaaaagcgggaagcattttgaggtcgtcaaacagtacgagaaggagtggaaacagcaacaccagcaggagaaacagcagccggtgtctgcaaagcgttcgcttcgtttgtcggtgggtcacaaattgcaaagcgacgaaaactgcacaaaggctgtttggtgtattaagcgcaccgaacaaacaccgacctcaaagggcactactccgtcctcatccgtcagtgtgtcgaccaagcgcattcgcgtggtggtccgaaaggagcaggacgacggaccggcgcacgtggaacagaccgagatggacgctgtctcggtggagaccaaagagttggcgcccaagacgccctccaaaaagaaaaagaaacgctcacgctattgagcaccgaagaagaagaagaaacagcagacagaaagcacgatcaaaaaacatcatttccaccgtttcgcctatcgcttcttgattttttaaatttgttttttatttatttaatttcacttctcagatggttttcgtcttgttccttaaataccaaaaaaatcccttcctccaatcaccgccattttttttgatgctcctttgaacatcaccattatttattctgcgatgcacttacgaattagtgttggaagaatttgacgaattgttcacttctgtcagaatttgataaacacacaaacaaaagggaaattagtgacgtaaactgttagtattattcaattattaagtatttaatctgttgcttaatgatgcgtgaaacagcctttgttaaaaactagcaatgaaattaaaaagaatgacttttgattttgaaaagagaggtgacaacgccgacgatgaggacagctctgccgatgaatgttcttcaagcactggtagcggtacaccaaacagcgaatattcggttgggcatggcgagcggcaattatgccgaatttgcatttgttggttgtgatcccttattttttcaattgttttttttaccacaaattgggtgccattgctataaaggatttaattcgaacccttctcccccatgcatgttttttcaaacaatttgtattcattaaaaggtggatgagataatcgggcacagaattgaaaatgggacggacaaatggagggtccgatggaaagggtgggcgccgaagtacgacacgtgggagccgcgtgagaatttctccaattctatgcatcttctggacaaatttgaagccgaacgacttgccgaacaatgcaaagagaatgtgagttgctctgaacgtaagcattctcattaaatagtggaaattattttatttattcattttgcgtttctccgttaatgcctattattattctctaattgtgcattttaaaatatgggcggtgcttttgaattttgcataaagtttactgtttttaaaggctctctttttaaattgttattcggttaaaatcgccatttttctttccttttttttctttattgattattgccttttttctgtccctccgttactgtttttgttgtatcctttttcatcctttcaggaggctgttgcaacccatccaatgtccaataataataatcagtcggattatgtccaaaagttgcgtccccatcgttcgctgtgccttcctccgacttccgccgctgtgccatcggccggcagaaaaggaccaaagaagaaaggaagtgccaaacgaacgacggcggcaaaaactcccgtttcaattccacttttggaggccaaggcgatgctgcacacgtcgagagtccgagtttttattcttgtgtaataaattggcaattaaatttaataggtatttgggtttatcatgtccattctacgatattttttaaagttttatgggtttcagtagaaaatgggctggttttttggcattttctctttactttgtacagtaaataaaccaaatcgtttacgtttagatgcccaaggacatgtcggagcgtgcgaaggagtgcaaagaaattcggaaattccttttgaattgcgtcaaacggacgaatgcatcggcgaccgccgccgcgcctcgcgtgctgtacatcagcggcgtcccgggcactggcaaaaccgcagcagtgctgaaggtgtgccaatgccgctagtcataattaaacagatcggtatttatgggtcacaattttgggataacccaaagagatttgccacgaatttgtctgcagtcaatggcttctttttcagtaccgtcatttccgtttttgcagttttattggattagacgcatttgggacccgaattctccgcttcacctcatcagaaagcagttttaccccaaacaatggtttttaggtgcaaaaagaattgtgttcggaaaagaagacacccaagttcgactttttgaacatcaacgcgttggaactgtccgacccgcggcaattgttcaccaaagtttatggacaagtacaaaacaattgcacggggacgaggaagaaaatatcggcaaggtttttattgggggaggggacaaacaggaaatttaaaacagaattaagaaatgcacagcaattccttgacgaacattttgcagaagagcgaaagaaacgaacgcccattgtcattttggtggacgaggttcgtctaatggcactttggatttgccggaataaattccaccccagggattgtttaagaaatcgaactgaaatttagcgccataattttatgaattctgaaaaaagaggggaaaagaccaccctaaaactcgaattttgtctccccctcccgaaatgggccggccttccactgaatcacggctatgaattttcttccccctccacaggtggacatgctgtacaccaagcgtgaggatgtgctgtacacggtgttcaactgggccaacatggaccactcgcgctgcagcgttgtggccatttcgaacacgttggacttggcggaacggttcttttcccaacggattgccagccgaatggttaatgggcatggttttttaatgaatggggtcatgaaaattggtcgcaaaaatttcagtgatttccagggcaacaatcgactcagttttcaaccctatgaattcaaagaaattgaggagattatcagaggtcggctcaccgaatgccctgaaggcgcattagaccccaaagccattgaattggcatcaaaaaaagtgggcattttgccatttctcggcacttttcttgataactaaatgctgcttcatttaattttttgtgcttttccccttaagagaagggccatttccggcgatttacgtaaagcgtttgaactgata

SEQ ID NO: 4389 - DNA, 578 bp, Heterodera glycines
taaaaaaaccattggcacattttgcgatggaaaccgaatacaaattatagaaaaaagaagaagaaaaaaaaaattaaaaatggaaaatggaaaattattttttccggaatcaaattttgtattcatacaggcatccgaaaagtttcgaacttcggaaaacttaaaaataatttttttgaaaatttgtaagtttgttacatcttcaccaatccattaaaattcaaatttaatttccgtcaacaaaagggcgccaggggaaaaggcattctcattgcatttcactctttggtttgttttgtttgtccagtgaagtgatgcccactcgtctgtgggactttgtgggcaatggcataaaaggcgccttggaagcggcagccgatggcaccaaccgacgtcggcacaattcgtccacgaatgccaatgtcgtcctcgtcaccggcgaaggtgatggtggctcctcctccgtcccttcgcatccgttgggtcaccgacgaacaccgatggcacaacagcagcagcagcaattgcgacactctgacggtgccaatgccaatgaaaatgttgcgcagttcgttcat

SEQ ID NO: 4390 - DNA, 4014 bp, Heterodera glycines
  misc_feature (3934)..(3934): n is a, c, g, or t
  misc_feature (3970)..(3971): n is a, c, g, or t
  misc_feature (4001)..(4001): n is a, c, g, or t
ttttctcggattttaataatttctaagaacttctacgtttttcaaaaaaaaatttacttttttttctttgatacaaaagttttatatattttttttgctttggcaattttttacatggggaaagaaaactttcccttgttacgaagatagatcggaattacttagttttaaaaccatcaatttgtaatactgattcgaccatttgcagggagtgtcctttcttcactgtgaactatgccaaattttggaaccatcggcagaagcacaagcgcgcgaaccggttcacctgcaagcactgttccttctcctccggctcggtgcaatgctatgcggagcacatggaactgcatggggacacgggcacaaccgctacgatcacttccatcatcaaccaaaacattggcaacaacagcaatgttgcaactgaatttggcatgatgccagaggcattggtggccatgccgaaacatgcaacatcgacggtgacagcaacaaccgcaacatcttcgtcaggaattcgatcatcgccggaagcggcaagcagcggcagcagcagcttggacggtgccgaaacgttgtccgaaaaaaaattgtctatcatgccgacgaaaattgtccatgaaaagagcgatgatgaggaaatggaaatgacgacgacggcgtcgatttcccaagctgttgctgcttcgctcgttgatgaagcggtgcattttcttgtttttgtttctgatagttaaatgcggggttgagcctcgagctccccgatcaccgacatttttgggcctgctcaccgatcttcgtcctcactgacggtccccgattcccgagaatttcttccggggctaattttcgaaagtatttgaaataaaagagccagacaggggatataaaggataaaggcactgcattgcggaaacaatttatcgaatctatgaaatttctaaaattcgatttgatactgtataccgtacccaatcgtcccgcacatttttaataggttttttcttgtaggacaagtctgacaagcagctcgatgttgtattaaaaccttttgcgcagacgaaatccatgcttggtttggatgttggtgagtatggtcttagtgattatttccttgttaaacaaaaatcaattttttcaaaaaaaaaacattgattttttccctttattttagaaaaaactgctaatttgtaaaaaattagaaaaataagctaaaaaatttttagcttttttaaattttctctgggcgggggcgagtatataactttaagcatgttaatttattatttagaaattaatttttcttcaaagtttgggtttcgtttaggttcttcctcctcttctgccgctgctgctgatttttcgtccacttcattcattactacagcaatgttgactttagcctcacaatcagcaaaaactctttgctgcagtgaatgtccatttggtagaaaaaaaaaattttaaaacgaaaaatttataaacaatttttttcaaaaaaaaatcaataattttctcaattagacacccattgtgcaacatatgctagaaaaagtaccgataaattaggggttttacgattaataaatttttctgaaaaattcttcttttgtcatttctacattccgcaataaaaactcaaaataatatacaatattaattattttttaaatttcctcatattccaattaattacattaattattgtacaacagaaacggtgcactcggtgctgctcaaactgcacatggaaatgcatcggaacagtgaatgccgtccgttcacttgtgcactgtgcagcttcggctgcttttccgccgattcattgcacgcgcatttggcactccacgcgtccgcaacaacgctggaaggaggcggcagcggcacttataataatgagagcatacagcagcgaatggacccgccgccggacacgcaaacttctgctgctggcggtccaattactgatggtgggctgaagggggggggggggggggtcggtttataagtcattttttatagatttttttttctaattattttttttattatgattttttaaattttaatttgtggcttgtgacaaaaaagaaatcaattacctattttatagattttctagaaaaattgaaacagtaatattatagttttatgtgggttagaagctctttttcttcttttttacacaattttaaaatgaatttttttaaatgtttatatattttttactagaaaaaaaaactgaaccctaaaaatttagaaaacaaaaaaattttcagaaggggcagggagggtacgatgctggggtggaacttttgtgcatccccatccctccctctacaatatcccaaactacagtatgttaataataatatttctgttgattttgtcttttttcaaaattttgtcaccattttttgaaatgacatttatttttatttcttctggattattcagctccattttctgctgtgctcaataacgctgctgctgcagctgctccatcagtgccaacaacagtctccacggtgtcttcatcgttatacgcttgttctcaatgcaattttaaatgtatgagttaattcatacatatgcaaattaaatgccatggtctcccgtgtcaactactgatcacaggcccataaacagaacaaaaattcggagcagtaatccgaagaattttttttttttttttgcacttcgggccaaaaaaatgatttgtcattcggggtcaaattaaaaaaatatttataataaattggggtccggcgatgcaaaattcaacgcttatttgttaggttctgctgacaccccttgtgttcgttcgtgtatgtgttttatttacattttaggcgctgaattggaaccatttctggcgcatcgcaaggaacatgttcaggtagtggtgataatatgtaattgttatttttttcttgatttaatttagttaattatttttttatttagcaaatacataaattccctttacagctgattcaacagcgtctaatgacaatcatcaaacgtgcagcagtgatggaaaattgttgttttgggaatggagcgacaacgataaaaatggacaaaatgccaaaggcaaacggtgccgggaatggacgaacggttgacaaacagcattactgtacccgttgctcatttcgttgtgagtttttttttgtataattaagcaccgtcgattggctgagattcacttactccttggaaatttggcattgtgataacatttttttaaaaaatcgctaaaaatttttattttttttaattttctaagaaaaatttgtactaaaatttttttttaagttaaaaaaaattttaatttattcccggctgtgtttcggcgactgtgattttgattaattatccaaacaggtgaaaaaaacactatactgtaatttgtcattacagggtcaaaatctaaatttaaggctgtttgttttgtcttataaaaaggacattaagatattttaaatttatttctttctttttttctttttatttattttaaggaaagtttttttaaattcaatttttttcacaatttatatttgattagaaagaattgcataataaatttcgtaaaaactttttaacttgaacaaaaaaaaatgggaagcgtattgaattaatgtcctgagttcaaagtgaattaatgttctgaatttcaaaattgagatccatttataactgctcatttctattggactgttcgttcacaggtgacagtgttcaagcattcacacgtcactgggaacaccatcgcattgacaacagtcggcctggcattttccagtgcagcgcatgtgactacagttcagacacgcgcaatgtggtgctgttccataaacacaaccatcatttgggtcagagtttttgaaaaaaaaaaaaatttgtttatactatttataaaacatanaaaatgtgtataattggacgaaaaactcgtcaaggnngcaattgtgctgcccccgactcgaactaantgttttttaacca

SEQ ID NO: 4391 - DNA, 5186 bp, Heterodera glycines
  misc_feature (3)..(3): n is a, c, g, or t
ttntgggaatggagcgacaacgataaaaatggacaaaatgcctaaggcaaacggtgccgggaatggacgaacggttgacaaacagcattactgtacccgttgctcatttcgttgtgagttttttttttgtataattaagcaccgtcgattggctgagattcacttactccttggaaatttggcattgtgataacatttttttaaaaaatcgctaaaaatttttagaaattttacactatactgtaatttgtcattacagggtcaaaatctaaatttaaggctgtttgttttgtcttataaaaaggacattaagatattttaaatttatttctttctttttttctttttatttattttaaggaaagtttttttaaattcaattttttcacaatttatatttgattagaaagaattgcataataaatttcgtaaaaactttttaacttgaacaaaaaaaaaatgggaagcgtattgaattaatgtcctgagttcaaagtgaattaatgttctgaatttcaaaattgagatccatttataactgctcatttctattggactgttcgttcacaggtgacagtgttcaagcattcacacgtcactgggaacaccatcgcattgacaacagtcggcctggcattttccagtgcagcgcatgtgactacagttcagacacgcgcaatgtggtgctgttccataaacacaaccatcatttggtcagagtttttgaaaaaaaaaaaaatttgtttatactatttataaaacataaaaaatgtgtataattggacgaaaaactcgtcaaggggcaaattgtgctgccccgactcggactaatgttttttaaccaaataaattaatttatttttttgtcaaagtggaacaaatttgttatcattcaattaatcattaaggtttctctattttcttgtaaaatttcggaaaatttatcatgttccaaaaaaaaagttatggatgaaaaaattttgatataatttttgtcatgacttttttgaaatatggtatataaaatttcatgatttgcctataaatagagaaccctaaggactattgatgataccaagaatgtttaatttgtttgagttttttaccgtataattaattgcaggacattcctctgacatcgctgtgcaaaaacattgaacttgttaaagaacaacagaaacgacaatctgttgctgatgatgatgttgaaaaacaatgattgagtggccttattaatcaaatgatgcatgatgatgagcgagggattttgacttttatctgatccagttttttatcgataattcattcattatctcatcaggaaaatgatggcctaatttttcccgatcatccccccgggtatattccattcttttttttgaacacacacttttatttatacactcacttgctatttatattttttcattcttcagaaaaaaaagtttaataaagtgatttgattatttaaaaatttgattatttacttgttttattttgaatattcattattttcttttattttgtccgaaaaatttcttttatggttattgattgataccggagcttgaacatgatcaggacccggtccggatttctttgggcccgatccagaatccgagtatacagtcatggtcggtcaaatatattgcatcaacgccaaaataagcctctactaaccccctgggggaaaattttccgattttaagccacattttggtgggatcagggatgctgctgatccattgattttgtaaatttgtgagcatcttttccatgcctttatttaacatttcaacagaaaaccagagtcaaccctcgcaagtgttctcctccattttagatttgagcatttgtttaaacaaaaaaaaagaggaattaaatattttaatcttatgaaccaccaaccaatccacgtctatggagaccctcccccccccccccctccattagagcccataaccctccaatccgaccgaaattatttattcatcacaaccactcgaccgccctttacataccaaccaatatttatgtatgtatgctgatgttgtggagtgtgcgtgcatttctttcttcattttgtttgtcttctctctattttcattgttcattttttttcaattatttttccgtattttgaaatttaatggtaaatttgatttgacttttaattgttgaaagggcgccggatgaaaaaaggaaaaatataattattatcttgaatatatttttttcaaaaactttattcatataaagttttctaaatatgtataatcaatttttattttgatttgagttcctttaaataaataaattacagtttttaaaccttttttaaattttttttatgcggatatcgaaaagtccagcgacctgagaaaattgacccatactaatatatcaatatcagtaaattggtctcttctacccaaaaatttttcgtcagcggacgtccttgtttttttttattagctcgtttcgtcacctcgaattgcaattagttttaatttgtcataatcactaaaaaacaaaaatgttgttttgtttcaaggacggacgagtaaaattgtaaacattcaaatggattgttgtttacacatttgaaaatataatattatgtctgtacatttcattaaataattctttgagattattaattatttttgcgatttaccccccacctttaatttaaaaaataacccttttttctcggcttttcggggtcgctgatgacgaatctgacagccatttcggccattccgaacaccggacccaaactcgaacaaaaaatcgaaaattcaaaattttcgaattttaatttaatatcaaaacctgcatagaataatcattttgatgttggcaacggtttatgactaaattaggcttttttaataaattttttagatacatattttattttcatttacatttgcttaacattgatggacctgcaacaaaatgggggtgccccttcaccttcaaatgttcgtccaaagttggcatcatcaaaaaagaatgtgatcacaattggcaaggtgaagaagcgggtcactgagctgaagtgttcggaagttcgatggttctacaaaaacaaggaggaagacacaaaatgggcacctttcaaaggcacgaataatttacaacacataattttgaaaaatttgggttttttaatttggctagtttaaaattttttaaattttgggtgcccataaataccattttgactatacaaaaagatgtttttcacttttggggcccggattttaatttttttttcttttaaaagaccgcgcagaattgcacaaatatttgttccattatccattttaaagaatccttagctcaaattaggtcatttatgccaccaaaaaattttaggcgcgtagtttttgcaattatgcgcgctctgttttgttttaaaaaaaattcaaatccaggccaaaaacgaaaattaccatatgtgtgcaagggattcttcagcccaattgagacagggggggggtctcgggatcgattttcattcgaaagtccaaatttcttgaggaacagtgggagggggggggggggggggtatcggtggtgtagtatacacccgcgaggcgttgcaatgtggccatccatggcaatgcgcggacatcatcaacggtgtatccttttacgacctaattaaatgatcaacaaatattaaaatatgcctttattattatttcaattatctaatgataatagatcccccctccctccttaattacatggctaaattccgtgtcctcccgcgctacgttgatcattgaaaggatcaaagttcgaaattccgcattccgaatatcttgcgctggaggcgacaaaatttgttcgcataatgaaattttttgccaatatacagacgaataataacagcagcaatttggcaaacattttttgtaagattttttctacaaaaaattaataaacaaaaaaaaataaaaatgattttcataagaattatgatatagaatttttgtaaaaaagaagctgatatttataggaaaatagtataaaagaattcttttgctccttttaaatgattacaaaaaaaggtgaattgaaaagccaaaatatttcacaaaggaaatgggaaaaacatatttattttaaggttttactttacgaatcattatttttttagttttcatttaacgaatttttatgaaaaattttgccttttcaatataagaaaaattttaagtagaatttttaaaatttgcttttaatgattagttatttttttatatgaaagttttcgatttcacattattatcaataaattaaaaaattattttggttcttaatattatacatattattcaaaacaaataaatattcttcataaataatcaacaaaatgttttctgtactatgaattttccttctaattaattccttttttctatttcctcaaaagtcgaaatcggatgacaacggttcgtcttcctttccatggccaaccgaactttgttggccagggttggcaatcacatggctcggactcggcacattttggtgcgcggaatttccttgaaaataatcttttaagttttcaaataaatatttatttaaaattatttggtttgcctttgcttgggtgtccaaaatgcacatccgtaacttcaatgttcagtgcttggctaattgctttgattgcttggctttcctgctcaaattgacttttcaaactgtgccattctgtgccggtgcccgcatggccagcagcagcagcggccaagtcgaacatggcacgggcaaagcccaaattgtacggacactcgtcctcataagtgatcttcattttcataaaggcttaataaggtaatttgcgcattttaaattaagtattttctcataaaaatttcccgcaaaaattattcttttaattattttccataaaacgggttttttcctataatttgacgattaattactcctcagctgccgatcgatttcgtccacaatttgtgcttctcctccgctggggcatccgccgcgtgaggacaaataactttttaacccatccacagtacttttcgccattgaacatactgtagacgcgtcctcaccggcagcagagaaagtgccaatgtatttggacatcacagaaaccacttgctgactgcccgggcagcacgggaaatctgtgaaat

SEQ ID NO: 4392 - DNA, 3946 bp, Heterodera glycines
acggttaataaatttatacaagaggcgtataaaaagactatatgactacaatttataggcggaatgatcacagaatttgcgggggaactaatttgtaaggttaaatattgaaaccaaaaatgcaaaaggacagaaagaacaatgattaataaaattattcataaattgggctggcaattatgtaaataaatattttttcctggattattcatggtctaaatagtaggaaaacattttcttttttgtgtttgcgaacaaaagtcgggacttttatttacatatttcggggttttatacatatttggtatgattaaatgcaattttataaaattaaaaatatcaaattataatttcatgggccaaatattttggtcgtgatgtcaattattttctgctggttttcatgtgattaaaattgaaaaatatttattaattttgtgaaggaggcgaggaacaaatcaaagcgctattgaaaaaacttatcccttttatcctcttttgtgtatccactggcgcaaattgcttagaaccggcttttccttggttcacgccttatcaaattatccatttttcgacaagaattgtgagcgctaatttactgaatgatcactttgctttttcacttgtgatcgaagcgagccaaatagtctcagtgtgggcgaaccgaaaaatccacaacatgaggaaggtcgaccaagtgttttctctatgaatcacttttaacgcattattgaaccgattaaattaaatgaagtgtgattgatattctaatctattggattttttaaatttattttgggaaatttcatccattttgttttaagggtttccatttttcattttgtacacttatttctgacccataaaatttcattcttttgaatcattcaagacaatgaatgcataatgtattcaaatgagttcgaaaatgttactcttaacgcgcaaatatcagaatcgctggacgtgtttatatttaaatgcctttaattgctacaattcttttattttttccaaccttaaaaatatgaatggctatttaaaaaaaattggtagcctttttttcttcgctctttgcatttgtttaataattaaaacaattaatgtaaaattatttttagtcactctttttttatttaatgcttcttttttgcttcaggaaacgcaactcgcagcttttcgatgtcatggatctaaaaaagacgaaattattttatttattttgttaattatttatttacttggcaaaatttccgacaaaatgggtcacctaaaacccacaaattcgttgcagtcccaaagtcggaaagagcaaaaatacatttattgttgtctttccctcgcttaaggatgagagtttcctaaaagaatttaaaaaattaaaaaatattaaataatgaattaaaattttagtgaaattaaattttcaacaaatttatagccaggttttggcgtatatttatgaatcgtataccagccgaaacgaaaaaaaagttgtgtcaaggttcccccactcagactttttccggatcaatacggggaggagggggggggggcttaaattctgaggttgggaaaaagcaaaaaaaaaaaaagagaaatcattaacttttgggttggacatatcacgggattggattatttaaggtcgccgaaatgtcaggaagtgttagaatttaccgaggctgagaactgactcaatataaataacttttgaattaatttatattatgttctgtaaaatcttgctttaaataaaacactttataaattatttttgtctcctttttaattattaattaacaaattctgtcaaatttcccacctttgtcacttcgtatttatgtccattgatcagaaaactgatcgggccaacattctgatcacacggaattgagtggtcagacaaatttgcgtcgtaatggttataaattttggtgacctcctcccgtgggccaagcaaaagtgaagttccggtgtcgacaattgctgcactttggcccccattaattataacattgctgtccaatttaatttccttaattgggtaattaatttcattgaatttcaattaaaaatttgcttaaagaatcacatcgatttcgaacttccaatgtccgtagttgtttggaataatgtcaatccaattgacaatttcaccacagtgttttttgtccgcatcgcccaatgtgaaaacttttcttgcaaaattaaatttgcaattgtgcgatctttttataaactatttttaaattactaataacacttataatatggaatgattagatatattataaataggcaaattaatttttttggtaataataattcatttaacgttattaatttatattataattaattaattaacattgttcacctccccctggcttccaatgcacattcccttcagtggccaaataaattgaatacaatggcattttgagcgcaccctttctgtgggcttggaccaacaccggaggaacattattgcccgaagcgctgtaacttaggccaaaaatgccactgaaacccgtttgttgagtgtccttctgaacagtttggccaaaataaatgttggccaaggtgaacgcagatgaatcggaggccaagccaagctgagaaatttgaattttattattagaatataattttagggattttgggtaatttgccatggggaaaccaatcactcgccaatcccccctacatatgctcattaatttttcgcacaatatctcacaaacttagaacttgaaacccaaaaatacctaaaaaaaattccagttacaaaatttaattaaatttgaaaatttaaaagtaatttgttattttttccatttaaacacacctttaccacatcttggccaattgttccggctgaaaatccgaaaccgtacacaatcgaaaatggctgattcgtattacggtaagtggttgaaacttcgctgttaaattttgtcgcattttggcatgaaattggcgttgttgggtcttccattttttgtatgttgctgttttcgagctcacaacatttggcatcacattgccgggcacaaaaaattgggctatttttacagccctcaaagcaaccagcggtgccacattccgaatcgaccacccaaaaaagactcgaaccggtgtccaattggacacgaaattcttgtggaggtgtgcctaacaaaaacaaaatttaaaaactacaaatgcaaaaatgccaaagactgaaattatgcgtttttatatatgtttttgttaaatcaatgaatttaccaattgatatttgtataacatattcaatatctttgaagtcaaacaccgttgcattatataggaactaaaattaatggaattttattagaagtttttataaaattaatttgtttattgtcaataaggaaaaagtccacaaaagggaaaatccgcttacattgaggacaaaaacattaattaaaaatgtcctcaagaagcgcataaacagttaaacgagatcaccgccaaaataaaaatataatgtgaaatcaatacaaataaatatttaccaaatcacttttagttttaatgaattaattcgactttaatttttcaaataaataaaaaattactcagaaatacgtctaatctgatacaaattttattaatatctttttgaatgattttacattattttgaaaatggaatatcttttcatttcgttgttcagcagctgatgagaataattttttatttttcttttgcgttttgtgcatttgcatttgataaacggcagtacagtggccataagcaaaaaactcagcaatgaaaacaaaaagaaaatacgtaaaaataaaaaccatttttaatttttcttcgcttttcgcaattttataagaaaaattcaatcataaaataacaattaattattatatattttttatcatttgtaaaggttgacatttgcgttgtt

SEQ ID NO: 4393 - DNA, 1786 bp, Heterodera glycines
cggctcctgaaataattttatataacaaaattggcctaattaagtaccagggattgtcccgattttgatttccggctgtccaaacatggccttctctcccgcgtaaatgatatcgcacatcatagccaactaaataacaaatgtttaaacggccaaattggcgaaaagtctccccctcccccccgggtttctttcacctcacatccacccccgagagcgtgtccgttgaccgccgcaattgtcggctttcgtacagtcgcaacttgggaccaattctccaaaaagccgccaccgaaaacctcggcaaatttcttcggcaccatttccttaatgtcggcgccggctaaaaagttgaagaaaattacaacgacaaaaagcgaaagaaacgcatagaacggacacctgcgaaagccctttcactgccggtgagaacgatggcatggactccgtcgtctttgtccaaataagtgagggaatgggcgagctatgaaagaaacggcacaatgaaagaaaatattcattttttgtttggtaaaaatcaaataatttgaaagagcggtaaatgcaattgatgggaccaccaaatgagtgttacttattgttaacctcgtccatcaattggctgcacaatgcgttcagtgccttcggtcggttcagagtgatcagtgcgacgacgtcgtcggcgcccactctctccactttgatcatttcgtaattgggcataactgacaatggcacatttcaatggcaaaattattttgaagagatttgattttaaagctatcatccataaaatgcacccttaaaacttcgcgtcctttctttttgacaagccaaatttgtcgcttcgcattcattggaaatttcattgatttgaatttttgtgaattcgtccaaaagaaaggaggttttatttgtcattttttgttgtcagaaaagggaaaattattgaccaaggaaaagaaaagtgaaaatgaagagttaaatgaacgatttgttatcatagaatttagggaatgactgataaagttgcgaaaatgaagaatccaagaaaaactgtatttgcatgaaattcccagccctaaaattagaccacagaatattttgaagataaacacaagcaaaaaatttcatttccaaatctaacaaaaaattttgtcgatttttttttcatttaaaaataaatattgaacctgccgttgaaaatttccgagcctgttgtatgagagaataggaggccactgccagcggttgtctaagagataaaaatggcattaatttggtgaacattttgatgagtttaggtgtaaagcaataaaagaaagacgacgcctgaaatcagttcatttaatttgtcaaatcatgcgataatttccctatgaaatgggccgatgaatattttatttctctacccacaaagaaaaaatgctcgcaatcagtcgctgcgttgtggtcccttcccccccccccccctctctccctctctttctccgtttgggcggacggaggaatattatcgataaaaggagacaacaaaatcgaacaagtcacgccaccactgacataatattgtttgtaaaaacaaatggtaggtaaatattgttcatctaggaatgaaccggggtaaaatatggtcaacaaggacttttttgactccgtttttgacccaactcgtttttaggtcgcagagaattcaaggttttttgggtcgctaatcatcaattgaaaattctataaatctgacatcatttaaaagtccggcaatggtgcagttttgtggtttctg

SEQ ID NO: 4394 - DNA, 2096 bp, Heterodera glycines
  misc_feature (2090)..(2090): n is a, c, g, or t
cccgttcccggaaaaatttttttaccgggctctagtttctgcgtaaaataaatttaaaaatttaagaagcattttttctaggatataaaaatgcgctgattaagaatctgagctcggattttgcaaaatcattgatttttgtctatgatttctcatcaagtacctaattttttctaaaattttattttttaattttctttccgatgaatttagggttaagaatgcgttatcacgattccgagctctgattctgcgaaatcaatgttttttgttaatttgggaaaaaaacctacaaaatttcatcaattatatgtagaaatttggtgcaccagaaaatgtcgcaatagaaaagacaatttcaatttttcagaaaaaatttaaaaaaatttaggcttgggtttggtttagtgccacaaacgatttcatgaaattctgctgtgaaacagttaaaaattacgtagtaatgatgaaaaagcatgaaaacccatctaccaagtcataaaaaagcgattttagtaagaaattggatttttagaaaacatcaaaatttgaccaaaacaagccaaaaacacattcaattcatggcaaaatttgtatcattcaaagatctcgactagtcaattctatctacaccatgttgtatacggttaaaagatatgaaaaacatattggaaagcatctaccgagcaatacaaaaataattaacaacatttatttttttacaaattttttttactataatatcttttaacagcatacaacaactcaaatggatctaatccttgtttcttaatttctcaaaataaatgaaatttaaatattgttttattaaccgcttaattagtgagtttgtttaaacattttcaattatttttgtgcccacccgcgacattgtttttgtccaccacagaacattttccatccaatctctgctgagcgttgtcctttttctgctgtttttgctgcttttcccctgccaaaaatttctccaacaattggccaacagaaactgaaatttaattgcattttggtaaacggtcagctgaatgttaatttagaagaaattttgaaatttacggtccgttttttcaattttaccatttctgtcctcctctctcttctcctgctgctgattttccaattgtttgatgcgttccgccaatgaattgaacacatccacagaaactacaatatgaatttttaaggaattatttttgaaatgcttattttaacagtaaggctcggggtacggtactggaaatttataattatttttaaaattttccctaccgtattttttctcaaattgctgcttttcctgctccatattgaagacttttgccttcaattcaatgtgttccgtcatcagtttctgcttttccaactctgctttgagagccctctaaatttaaaaaagtgaaattttctctgttttagccacttcgtcctctgaaatttaatttttattttgctcacattttcagcattcagttcaccgttattccacagcaatttcgtttccttcaattcggacttcgcaagtttttctcggcattccttaaatataacaaataattacagcccaataaataatttgtaatttgtgttcatttcataattgaatggttttggcaaaatgccatcaaattgttcgaggaataggtcggccctttctccttttaattttatatcattggaaaacctttaaaaacgaatggaaattttgaactaaattttccataaatctttctctgtttttggcctcccctcccctcccgccgcggtttgatcatttgtccattcaaaaatggcccaccttcagcagctgctgatcagtgacgaacagttcagctgacaattgatcactcaaatttccgtgccaactgaacacttcgtatttgcccacttcttctgctgctgatgctgctggtgctgataaaagttagattttgaatttattttatttttaataattattttcttttttcgtaatttttttaaaatttttccattactttgatcagtttctgaacgcaaaaatgtatctggcgaagcgatggatgatgacattttttcaaattaaagaaagntgtatt

SEQ ID NO: 4395 - DNA, 4320 bp, Heterodera glycines
ttatttttcaattaaattcagctgtacgatctttacaaagatgctggactggtgccaatcgaaattgtcaccaatggcattattgctatgatctgtttttccggcatcactctcaacatgttgcttgtctatgttaccgtcaaatcaaagtgaaatgcccttagatttttgatgccataacttaacaaaattaattgaaagatgcttaatctgagaaaattaattaatcaattggaggaattatgaaataaatttcattgaaaactttcaattttgtcttgatccaaaatcaataaaaggaaggataaaaactaaatattaaaaaaacaatgctgaatccgactgtaagacttggacagaatgtaaaaacgagaaaaaattaattaatttttattaaaattttttaatttcctctaattaattttgtgctttttgttgtactgttttccgattttaaattgtcaatatagccatttatggcatttttcaataaaaaattttaagggccctccattcgacttgcaacattttgatcgcaatttatgccttttccatctcatttattctgatcggaaattcggtcacatttttcattttccttttcggcatcaatttcatcagtctccaattgtgcttttacatccaaattattccactcctttttacctcattcgctattctattacaattatgcatcggaattgaccgtctgtttggtgttagcttcccaatttggtaaattttccaattaaaaaacgaattgcttaattaaataattgctttttaattaggtatcaaatgggtggccgcttcaaacttttcaaaatttttattgccatctgttgtgcaagaactgtatttatcaacatttattattatcattatggcagctcaaagcattggggaaagtttgtgtgaaattaaatatgccaattataaataaaattaaagtaattttaaaaaagttatttccctaattttgaggtctattaaatgtataaatttgcccccttaaaattaaaaataattttggtatcttaattaaggtcattataatttaagataaattttatgcccctaattaagaccagtgatgtgctcaattggtgatccggcacaccagccagagactaattcaatgtcgaatatattagctttactaacatattgtgctgaattcacatgttatgcattgatttggctgatcaagcatttccgtaatggacaacaccacggacagtcatttgcgggttgatgaaattaattacccctaatgaaattttaattgctttgttaattggctcatttagaatcggaaatgaacaaacgtttaatgatatcgctgagtgttattatgtcaaccagtctcatctgctttattggcgtaataatattaatttatattgtaaaatttttggttaaatatttttgctaataaaaacccttaatttaataattatcagaattcttctttgcgaaaataaaaaaattatttgtatttatctccaaaatacaaatgattgaataatataatcgagttacattcttttatatgaattttggattttttgtttgttggttttatttctggtactttgctcactattacattcaatgttactgtatattacagttcccatttaagacttctgtgttctttaatggcataatgccattgctcagcttaaacatttttacaattgaatacattgtttggcccatttgcaatggtctttttttgatggcatattccagctgtactcctgtgcttttcctgtgcaggtggggtttataattaattaattcccaatttaaaaaataattaaattaattaattttttcatattttagcactgaataccgcaaagcatttcgcaaatatgtttgcagaacagaacatggattaactgttgttgtgccattgcataatatgcctgcttaaaaactttgtttttttttcattttgcataattaattcggactcgatgacgtcatttcatttaatttttataatcaatgatcaacaggatttgataaaatatatttttcgcgaaatatggccagaaaatatggactaaaaaatataattgaaaaaatatagacattttttcccaaattagaggtgatatttcttcctttcagtattccagctgtttttgtcctaatggccaataaagctgaagcaacttattcccgagtccttgaggtgcacaattgtttttgctctattgacaaattcagcattctgctattttttataggttttgaatgcacgtataggagttggaccaacttctgttatgttagacttcgaaatgggttactattaatttttaacgtatatttattaaacatttagccgccaaaaatgcatatacaactatttttggagaaaacctacaaattcgtttttgcttgttccacttaggacaagaaattaatcgtagattgaagaccgggaaacttagccactattacacaacaaataatgaatacaaaatcttggttcggagtttggctgcgctctcttttctggaggaaattcgagttgtgccagctttttacttgcttcgacaacgagcgaatgagctcggcatacaagttgttccaaatgcaggacaaccagtcgcaatattcgattactttggacggtattgttaaaataaattggattgtttattcattgactcttctgtagtcactatgtggctggtcacgatggaagacctccactgtttcctgttcatacctggaatcaccatgatagtgttcttcaggacttggggcgcacaaataacgcccaagaagggttccatttggctttaagaatgcaatttaacagtgtgcatccgccattatcgaagtgaaaatcgcgtttaatcagcttaatattttaattatcagagttatcactgttctgaagaaagaagagcgaatcgcagccgataagctgcggcagtatgagttggacccaactcaagggataagaattcgagaacggaagaaaacataccgtgaaaatgatttggctatcagaaatttggttgaaggctttgatgccattgagaacccaaacgaagatgagattcttgctcatctcagatcgttgcaatacagacttatgcgcaatgattttgagaattgggacgacccaaatggtgattaattctgttttcacatcccgttggcccttgggaaaggcactttaaataaaaattggaaaaaggtctactgtagttaaaaaatgtattgtggtttgtctattgtgttgtggttagtatgggctcaaaattctgcgcctcctcgcggtgagtccggaaacagagttaatttttaaaatattaattaatttttttgcaatggaattaactctggctaaagcagacgtaattttgtctaattttgtggcttagaattaaatttttaaatttttttttgttttattgaaatccccaaatgtcgggtccctaaatgtcgggttgccaaatgtccgtggttttcttaagtgtcttttgctcaaatgtcgttcggtccccaaatgtcgggtccccaaatgtcgggatccccaaaagtcgggtccccaaatgtcgggtccccaaatgtcgggatccccaaaagtcgggtccccaaatgtcgggaaagtcgggtccccaaatgtcgggatccccaaaagtcgggtccccaaatgtcgggtccccaagttacaaatccccaaaagtcgcaccacggattctgagcactggtgattatgcggatgtgcactttttggtggggacggagacgaaaaagaggcgagttttagatagagatcggacatgtgccgggcccgagttttggggtcggcattttgctaagaatctaagaaaaaggaataaaattttcaaataaatttgtttgtcttttggggagggaataagcaaattgtgtatttcagtgcaaacgtgatcaaaaaatcggaaacaagtttttatggctctttttaatttcgagtcaaactttaaaatattgctgtataaatatttaattttccataaaatttcaaaatttatgagaaattttaagaaaccagaacgaactttagccactagcccaaaatcagaaatcagataaactagcacatttgtactttctcagacttagaactctcgtgccagtcggttacaggcaaggcaccggaaaatggttctgaattttattgtaaaaatttccaaaaatcaaatcaacagaacgtgagtgattgggtggacttatcggccggtcatttccgcttttttgtcattctttcttctcccacagtaaaatcaattgccatatcacttt

SEQ ID NO: 4396 - DNA, 2275 bp, Heterodera glycines
atatttaacaatctttgtatcattcgagagctcttcaagtgctctattagcatgcaaatttccagaaaatttcgttaagtttaaaaaaagttcgagccaagagttggaaaatttcgttttttgaattcttctggttctaacttttttgaaccttaacgaaatttttcaaaattttgcaggctaatagaaaacacttagggctttcggatgataccaacaatgttagattttgtgtacaaagaaaaaaattatagtccaaaaactgggctggcgccgaaacgcagtggacccgacatggaacagacggacaaacactcaacttttttattacctatataggataacttataaattacaagccgtaacttttcagcaacaattgtggatatttcttgatcacaaagtcatggttcagcagaatggcgtttttcttctccaactgtacaatataccaaacaatgccattgtgttgggtttttccgatgatttccactggcttctgaccgaataatttctgttccatttttgacagcctaaaacggacaattaaatgcgtttacaaaatttggacacacttaatcttttggcatttagtcgacttcgcatgcaactttttataatcagacgcaattgccatcccttttctgacttgtcactgaaaatactgtagttttaaaaaattagcaatttaagtataatctaatcttttggagctaagataccaatgaatgcaattaaaacaagcaaaaaacactttttcataacagctaaaaatgttgcgtgaaaacaaaaatggcagacagttcattccccgtcttccgagtcttcttcttcctctttgatttcaatgtccgtgtcactgtcctcttcggtgtcgttttcatcggacgacgaacattcgacattcctcacatgcagcttaatgttgaaaatcaaattttgcaaggaatatttacaatttgggactaaatcagaaggtcatacccaaacaccgccctccccctccaacctaagggcgtactcttttaaatagtaatacaaattgaactcaccaattccctcttcctcctcttcgctgtcggcggactgtccccctctcctccgtccccttctgacgactcctcctccttgagttcgttgtcatccgtttcctctccgtcctcctcatcagatgatgacgacgtttgtccccgtcctccccttccgccgtctttcgttttccgtcttccaacttcgtcttcttcctcctccttttttggctttacttcctcctctttgtcttcattttgcccttcacttttcttccgccgcactttcactttgcccaactgttcgtcaaaatcgctgttgttcttcaattgttcgataatttgttttcgctcttttctcggctgtccgaccatttggctgactttttgctccaacagcgtttgacgttccgccactgcgttaaaaagttgagtgacaccactgaaaaaccgggaccggtataactcattgtctgggactgtcccaggaactcggattggatggagtaccgcctccggacgacgaaatttggatgagggaactcgtggagggtaccaaggaaattgaattcaattgttaattacccgttatcacgcggcaacactttcgaatttaatttggataaaacttttcaaatattcccctcttttcctgttaattcacctcgtcgcaattcgctgcaatttgcgctccttttcccgctctgttgcataattcggcttcacataaccaattttctttggatccatccaaaatattaattatataataaatgaaaatgaaacaaaaaaaagtattattgcgaaaggatacgaattttacaaattaatgagacaaaagatggtagtaattttacactaattctaattatgatatgttaataaataatattttaataccaacaaaaacttaggtaattcttcagcaaaaatattacgcaaaagaaatgacaagccaagaaaagacaaagtaaaacagcacaagcggataatagaacagaaaccgtcggttcggtggttcggagccggccaaaaacaaagttgaagctgaaaaatgataaattaaatggtaaattaagggggaaaagataccgtagagagcccaagcgaaaccagaaacagtggcaagtgcacgaagaagcaaattggcggaagatttgtgccagaaaagaagcgacagacttttgatggcaacggacgctaaaacgtacggcaaaaggcaatatccgatgacacacaaagcttgg

SEQ ID NO: 4397 - DNA, 1265 bp, Heterodera glycines
  misc_feature (1248)..(1248): n is a, c, g, or t
agttcgggttagggattagaaattagtcaaaatacatgccagattcgtgattagcgaccttttaaaaccccggataacaaattatcatggttttttatcttaaaaaaattttgcaaaacaaaagggtccccccttttgtttcaaaaacggccacttttaaagtagcgccctgtatttttgtttgtgccctctcacaattgtttcccaaattggctcgtccaacgtgtcgaagtcctcctccaatcccaccacattgctcttccgttttgtttgtgccgaagttccgctgccaatgttcccttttaagtcgggctgcacttttgtgtccgtcacattgtcccttttagaagcggcttctttcgcctggatctccttttccaactaaagaatatattattggtcattgttacaaattcaattagaacctgttcaaggtcaacagaaaaggacaaatttgtagtcattcacaaaacaggcgaataaatgaaaaatggtctaaaagtggggatttgccaatagcatccccaagtgtcacgccagccactgaattcacaaagctttttttagcataaaacaatattgtggcaccacattcattgatatctttttgctggtactagattttaattaatgcttcattcttaagtgccgttctattttttgcttcaatcagttcggttttacgtgggcactatgggtacgtcccgctgtgtagagaaaagcctagtactatctcgtcggttttttttctttgtaatttctatcactttggcgtactatatattcattttaattatgtaaaaaaacatttacttctctctaagaaatcttttttcccgttaacagattttctttaaattttgcatatcgatagagaaaaaaattacgaaccaaatataagtgtttttagaaacataaaaagggttagctaaaaagatacggggtgatgaaaattttgcatttctttttcttgttttggcgtactattttcatgtctctagcaacatgaaaaaatcgaaattcgcaaattctaacagttttggttataagggtacaaaatcactttgaacatttagaatcaatagaaaaaagaataaatttagcatttggttgaaatcagcagtttaggacttgagttataacgtaatgaaaatttgaaactccaataacttttttctgagatgtcaaattgcttagtattcgcttagaaaaagattctcctttaaaaaaactttttttaaataccanaatttgttcagtttagt

SEQ ID NO: 4398 - DNA, 7019 bp, Heterodera glycines
  misc_feature (520)..(520): n is a, c, g, or t
  misc_feature (531)..(531): n is a, c, g, or t
  misc_feature (559)..(559): n is a, c, g, or t
  misc_feature (566)..(567): n is a, c, g, or t
  misc_feature (582)..(582): n is a, c, g, or t
  misc_feature (6967)..(6967): n is a, c, g, or t
aaggagttttcctctacattatggggacctgctcatatcgttttgacctgtccattcagctcaaagaaaacctgaaaatatttgcacaatgatcattaagtctcttcccctgacaattagctcacttctcgctcgcccctcgagttcaattttccctcggccaacatttgaatgttcagcactttgccacgctcaatctccacttggatttcctccacaatatccattccggcgaagaacactttggaattgagcttgtccaccggtccatacttttgtctgaactgttcaaattcgtcgaattctctcggaaacatcgccgacgacatggcctaaaaaaagaatcataatcattcattcgttcctatcttcctattcggttcaatgtacatcaacgtctctcagattccttccgtgcttctcctccagggtccgtttgtgactttcaaaatctaacgaaggcaattccgcgccaggccgtccctcaatcctcggctttcctctcaaaacttttgtcctncaaggttcggngaacccatacggcggctgaccaatttgntcctgtnnaaataaaagaaatgngaattcacaaatccttttctttcatttacctgcatgaattggacaacggacttcgggaaagagagttcctcggcccgttcaaccaatgtctctttcgtgagtttgttctgcaccataaactggggccaagtccccgacaattttcgaagatggagtaactctaaaacgtttcaattgctcttcgattcctagtctcaattcgacgcacttgataatgtctccaagtgccaaattcgcctcggcgtacattttcttcacctcgtcgaacttctcgcccagccccagagaaaatgcctaaattttattttatttttgtaacaaagtcgccctatgcctggaattggagattcgtatattgacccccggggatggcgtggttgtacacatccgagttgccacttttcattgtcaccgtgcattcgaagggttggtaaaattgacgtgccgtctcccaataagcgttgtatcgcgaaatcgagtccatttccaaaccttaatttgagttatcatagatcaaataagcatttgagaaccggtggagtgcggtgtccgctgcaacgaagccacaattgcacccatcgaaggctgagaagtcattccgctcatcgagtcgatagccgcgtctatcgcgtccgcacccgcacgggcacattcgatcatgctggccacacctgcaccagaagtgtcatgtgtgtgcacgtgaatcggaacatccgggtgttggtcacgaagtgcagtgatgagaagtttggccgcttcgggcttcagcacaccggccatgtcctcaaaaatgaaaacgtgtcaattggaaaattgctgcccatccgaactttaatcgacagaatgtgcgcattcgcattcacaagctgtttggccaggttcagatagtattccaaattgtagcgttgtgcgttcgggtcggatacatcgccggtgtacgaaatggcagcctcgacaacccctcccgccttcccaacggcctccatgccaaccaccatattcggcacgtagttgagggaatcgaacactctgaacacgtccatcccgctcttgacagacaattcacaaaatctgcatatatgtcagagggtaaaagccacctagcaatatatgaactcacttgtcgagcacattgtccgggtatgacgagtatccaaccgcattggcaccccgaaaaagcatttggaaaggaatgttgggaatcaacttgcgcagcaactccaaccgctcccaaggacattcgtggagaaattgcatggcgacgtcaaaggtagcacctgaaaagcgaattaaatatttaagtgagttaaatgctattggttcataccgccccacatttccatagagaacaaattcgcaaatttgtgagacacaaacggagcaattttcgccatgtcgtaagtgcggacgcgggtggccaacagactaaaggaaaggaaaagtcagcaaggacttgcacctcattttctcgcacccactcgcgtcgaaaaaatcaaatttaggaacagacctttggtgtgcatctcggaaggtcgtgtccgtgatcatgcaccctttgttcgctcgcaaagccttcgcaaatgcttcgggtccttttttcaccaaaatgtcgcgaatgccaacaggcggttgatcatgcaaacctgaatgagagaaataaaatgaaattggacaaagaaattttatttccgttacccgccggaacgacagggacagtcggttggacatttttcggcttcatttcggtgaccaatggagtaagagaaccgttgaccttcaactgtcccaaataaaacagcagcttctgtgccctgttttgactcggtttgaagctgaacagttcgggatgttcgtcgatgaaatacgtgtccacaacgccagtgcggaatgcgggctgttccagcacattaacgaggaacggaatgttcgtctttacgccccgaatgcgaaactcctgaatcaaagttgtccaaaggatggattatttaaactaatattataaaaagttgttgggtcactttcaatgcacggatcagcttggccgaagcctggtgatggtctcctgcccgtgcgataacctttcgaaaaatgaattaaaacaatctctcggattgtcgccaaccttaacaagcagagaatcgtaatggggagaaatgactgagccggcgaaggccgaggcaccgtccaagcgaatgcccattccctcgccactgcgaaacacttcgatctgtttgtgaacaaagcaaccaatattgcttttttacccagcgatcagtcactcaccctcccactgtcaggctgaaacccccgtgccgggtcctccgtcgtaacacggcactgaattgccgccccattgacatgaatcgagtcctgacgaagattgatgtcctcgagagactttccctcagcaatgcgaatttgagattggacctaaacgaaaagtaaaacataatcgaaaagaaaatatgtaataaatagtaaatataccaaatctacgccggtgatctcttctgaaagcgttcaatgaaatgtaattaaattattttccaattgaaaaacgcacccgtgacggtgtgctccacctgaagacgtgcattcacttccatgaagtaatgattccccttagtgtccagcaaaaactcgacagttccttaaatttttatgattttacagaatcatttcgtgatcagattcattcgctacactgaccaacgttttggtacccaacatggcgtgtcaatttcaaagcatcgtccaacattcgctgacgtattgccggatccaaaacaggtgccggtgccagttcaacgaccttctgatgccgtcgctgcacagaacagtccctctcgtacaaatgcaccaaatttccgtaatggtccccaattatttgcacttcgatatgccgaggtctttccacgaatctgaaacatcaaacatgcttatttgttattgccatagccgaataaaggaagttgtacttctcgacaaacagcgaaccatcaccgaacgcggccaaagcttcggaaaaggcgcggttgaacgcatcttcaatctgtgaaaacgaatgatcttcgaaagacggtcacagtaaataatttaaaatgccaaattattacagtgacccgctccccattccgccgaccaaaaatggcgttggttcctccatttgcttacctcttcctctttttcgattttgcgcattcctcgccctccgccaccgtacgccgcctttacaatgaccgggcatccgtactgttgcacaaactgtttgacttctgcaacagttgtcaccggacctggcgtaccagggacgaccttaaacagggcaataatgatgaaaaagtactaaatattcggtttgaataactcacattaactcccgcttcgatggctgcctgacgagcggcgacctaaaaagggcggtaagtatattttgaaggcgctcctccgaactttgtctcccattctgcgcataacttccggcgttggaccgatgaaaacgatgccgttgtctttacacgcctgtgcgaaatcggcacgctccgacaggaaactaaaaatattcaaagtgtggaccgatgatcataacagtccactgacacacccgtagcccgggtgaatggcctccacatcgtttcgaacggccgtgtcgacaatctgttcgatgttcagataagcagcaacaggcggaagccctgaaaggcaaataggtttttgatttgtaatgaaaggttgaggcaagacacccacccgtcccgactaaatacgcctcgtcagccttgtaaacgtggatcgaacgtttgtcctaaagaactaaatgtcttataacaccaattgttgttcaatggtacggacttgttctgagaaaatggccactgaagttttgttcaattcggtcaatgctcgaaacactcgcgtagcgatttcgcctctgttcgcgaccattaccttaaattaaattgcattttttcggaaataaattggccagcgtaatgcctttttgaattcgcggttcggctgcgaggaattgcatctgattggagtgaggatacgacatttcaaataaaagcgccgagacggactaagcaattggcatcgaaatatagacattttctaaagataaagtggagaaaaacaaatgcaaaatgggaccaaagagtaataattgtgcaagaggacaaaaaaataaataaataaaggcgaactgatgggggtgggggtgaatgggaagggagggaaattcacatgaacggatgaccgaccgtcaaaggctcgcctcattcattggacacaccccgcccaaatgagaacgtcaaaatcagctcattctccccatactttcagtgcccaatcaccgctcttttcccaccgaaagattcagatccaacagttatttgaagccaaagagtaaatcaataaagcaacagtggtcagaacagaatcctttggtcagttgttaccgagtaatcggatagaacagaaattggttctttggcaacaataaatgatctgggcaatgagaagtgggcgggggggggggggggaagagatgacagaaaaaagcgatttaaattaaattatgagttaaacgggaaggcactcttcaaattgaaaggaaacgccgacggatggaccacaaactgttgttgttgttatcagctcaaaagagaaaagataaactgaagagatgatggatgataggtaaatcaattaattacaacggagagaataaatggggaagggtgaaagggaagcggacaaaactgaacaaatgaaagaaatgcatgcaaataaaaaggaaataaaataaggcaacattgaaaaggagaaactgccaatgcaaccggtaaaataaacaaatggattcatccccgagtaaacactttgggtaaattctttaatgaatcgtagtacaaattgtttgacggaaaagcctattctcgaataggatgataaataataaaaaaataaaatttaatcatttcttttttgcacattcccttccgatcactggggtttttgtggtactcgtggtcaaataattcagtgggacaattgttttgttctttcagttgtcgtcagattgcgagtcgggcgaatgcattggcgacggtgagtagagaccgctggtgatttctgagaagaaagactcgtgatcgttggcgtcctcttcggattcctgaagacggattcattcaaaagtccattcaatcatcagttttaaaaacgcacaactgaatgtactacaaagttggccaattcgtcgtcttcttcggaagagaggtcggaaacgaaggctctgtttgacctcagcgtctgctgaattggtgcaatatttgtgcttaaaaggacaggacggacctgtccaacctcataataaaagtcgaatcgttgcaatgtgtcgaggtcttcctccgtgtccgaatccatcgacccgtggtcgggatcaccgagaaagtcgggaagaatcgtcgaaatgcgctcgcgttttttcggattttggtacgagtcacgcaaaggcagcccactccaacactgacaatgagcaaaaattataaataaattcttttttggattttcactttaatgattttctcgacaccgcaagacaaaagcaaattgctgcgtggtccgtacttcacatggttcacaatagagcgatggccctccaaaacggagtgaacattgacagtgccattggcgaaatcgtctgaaaagcattgcaaagatatagaaaatgcctaatttttattcgaaatgccccactaaccccaattgctcggcactttccacacgtaaatattccaatcgtcacttcctgtgaccaaatactgatcgccagcaaaagagcacgattttattgtgcaaatgtttgagtattttgggtctgatagccgcaaatgctcggaattttgcaactaaacaatgaaattcggaatttggcaaatactataaatgtgattttgtacattgaaacaaattgggttggaacggctgatagcacaaaaaagcaattcacctgaaaatgaatcactttccgttaggaataaaatgctttaaccaacccgagggggaccaatcggcacaaatagcgcttttcgtgatttttcccgcctcggcgtaagtgctaaaaagacaaaagtgtatttaaattaaggacaagcgatgtctgattgaaatacctatttcggcatttttgttacctaatatatagcaaaaaaacaaaaaaaaacaaaatatcccaaaaaaggattccctaaaatatatcatttcttggaaaaaattttggtttaaaattgtccttattcgaaagaaaatgttaaattttttggtgcttgtgtgttatttgtgggcagattttcaaaaatttttatgtttttcgctnataacttttttctttggcatccaaatccaagattgttggtatcattcgaaag

SEQ ID NO: 4399 - DNA, 1705 bp, Heterodera glycines
taataatttcatttataaaatgaaatataacaaagttttctgattaagtttttatataacaaagtttctgattaagttttatgtgtttgctatcaaaaattgttaatatttttttattaactagttttccacctatttggggatttttgtacctatttattaactatttcgcgatttttcttacctaaaatcccagccctactaatgagtgttttcaaaattttgaagtcggccctctttggcatttgcaattttctaaagattcccctgaatttgactgctcaaaagccattttcagtccaatcaaaattcacttgttgctcatcctcaggtcgtacaccaacagccccgtctttttgttgcacactgccactatgttatggttttgcgggttccaaacggcacaaaaggctgtcccttcctggcgcagtttggtgcacaatccgtcgccctcattccctcgcaaatcgaacaaatacacattttggtcctccgaggctgcagcaattacattgtcatcggagggcttaatttgctcgtttatttgcatcgcctaattcaaattacatgggtcgctatgtaataaatggttgagctggccctgtacgaacgcagtctttcccgcgttttgatgtcatgcacgtgcattcggtggtcattgccggccgagtaaatgcgctccgtgtggtgggaaaagcgtaacgaaaagatgttcgaatggtgaatggctttcatgacaacacagttttctgcaggcttttcgctggtgcagcagtcggccgtcctccacaaacgaacccgcaaatcatcgcctcctgaaaagtgccgaatccgaccccatccccttgtcatttatccggctctttaccactaacaatccattcttcggtgggcgaaaagtccacggcattcacacagccggtgtgtgcccttaaatcccgctggtacaacaagccctttctattctgttcgaaaatatttctcatgcacaaaggtcgtccatttatttccctttcgtaaatcagtccttccgcagtctgtgcaaaacaattgaattttgataaggccgagttagccatttttactggagaagaatttggcttgattagtttaataggcgccaattcatcaattctgatcagtcaattaatgagaaagcagagcactttttagcaatcaaaaagatgaaatcaaacagaaaaagaattttttgtcggtggaatctcgaatttcttaacatcgatagaaatggacagaattggaaattatcgaatactcaaacgacagaatttaatacataaaacagacagaccgaaatgaaatttcgattcacacacacacacgattgttgttaaattctaaaaaatatttaagatcggttaatgagaagcattccatccatcaaaactttctcaggttcaaacagctaaaccatcaagctgccattccaagttctgaaaattggcaaattgcttttttaaaaaatgcggtgtctattatttacctatttttgtttcttcagcgaaatagcgaacgtcaaactcagggtcttcgcacattttcacaatcagtggtttaatctccgtgttcatgaccctgaaacaaggaaatagggacccatcactaaggagaaattaatttttggtttttttgaagttttcgaacccatactttgttattttaaaattaagtattaaattaatta

SEQ ID NO: 4400 - DNA, 3521 bp, Heterodera glycines
acacaaaaaataatatggccatctttcacaatttaatagtttatatagttttctctctccgtcaggacgccgatttctacaccctctaatacccggattttgagatttcttaagacaaaaacgaaatcttttagttttgcatttttgagaatttggatttccaataataatttaaggaattccaaaaatcaagagtgttcatcggacgaattctatttttttttttggcaaattttatttgaaggaaccgattaaattccatatttttgagctatttcaattaagaataatgctttgttgttttgatcaaatttaagctgccagtaatttttaaatggataatatattggcgaataaaaaagtgctaacatttttgcgtattgcaaatgaactttgtggtgttgggaaagaggccgcttttgttgtttcgatggcttgcgctggtggacacattttacgtgatttggcgcttattccggtgagtggtgacggtaattatatgactggtaattttgagaagaaattaaaattttttgtaaaaatagactagaaaatcttggtggaatattgtcaatgcaatacaattcgatgcaaaaaattgaatggacgcataaactgtacttgagccgttacagacccgagtccttggaacaacacttttgttcgctgtcagtcactctttaaattacaggagaatctgctgaagttgcttcgtgagcctggagatgatctcgagttcgcttatcggctctatcagctcacattcaacaaaaagggaaagaaattattaaacaaactttgtcacaacagccctgtcaaaattggcaatatcatgcaaattgctgaaatggcatccgaattggcaaccaattacagttccaactgctcctacattgaacatcgtcgtattgatgaggattgccgagcatttcgacccgttgatttggtttgaactttaacaataatgatgtgtgtttagctagttgtaaaagctttcagcgtaacgtcaacaaatttggttttttggtaatttcggcactttcatatgctttttgccaggccttcgatgaaaatatttgcaatttttacgacatttacggagatgggaaaggctttttctacaaccctttgctcggttgtacagttacggtacggtcatcttttatttaactatctgtttttttgtctatttttagctttgtgacaatagtttcgctcgacaaactgataaatggccaaaaataaaccaaagtcgcattgtttcgtatagattctcgaagaccaccgaagacaaaaacggaatgttggaggcattttttgtctgtcgtcttccgatttcgctcattcatcaatacccaatcactgaagtttgttttagaaatgctcactttgtaaagtgaaattgagaaatgctatattgatgtagtttagctcacttacctattgttagaaaactcaataagttttggggggcatacaaatatgctgatcacgaattaatattagtcccggttctataactgttttgaagttgtcagaccctaacaataagaatggtagcgattacttctctcaccgagaggtattaaatgaagaaaatctgagttaaccttattcttcaattttaccaatgctgatgactattaaacataacagctcaatcaattcaaaatcaacattggcccaatggttgctgagaaattgctgtcctctgactttgttaacaatctttgcgagggggaccttgccagcttccaggggtacaacccggccaccggccttttgtccatcgcctgttccgcacgttccgcactcaaattgcgtcaactcaccgacgggacggtgaatagtctgtttgaactgctgaacacaatggacaaattgcgatggttcgacgaagaatcgggtgctttggtaggaaatctttcccttactttttccgtgattaatcactgactattttcagatttcctttggtcctggctttcaaatttctcaactgaatgcaaatccatctgagagggagaaggacacaatcgtcgtttcgtacatcgactccttcgaacactttgagcctatggttcaccaattgactgagttttctttgcagttctgcgagagtcgagtatttagctaacatttgtttctatttacaattggtttctttgtcatcttttgcagaactgtaagcctttgctcttcaccgattgtaagtctcgtcgctgcttcgtcactttgctcgctccgtccatcatcaacgacctcaagtcgtccattgactcacttttgcaattttttccgggtgtttcggttgaggtgtgttttgcactgtttgtatcattcgttggcttttgactttttttagaccaggcctggcaatatttctgaatattttgctggttataatgccattaggtcaagtggaagcgttttcgacaactcttcttatccgaccgattgctgtgcgatttgttttggcaccatcgatggccaatttattcgcctttccctttgtggtcatgtttactgtgacgattgtttcatcggactgctcaaaaacgccatccaatttcccgtcagttgtcaatccggatgtttgtatcagattctgttcgaggacattgcggttagtcatttgctctgacgtacaatacggatgccatttaactgttttctcaatttgtccatgattaattgtaaacacaatctttcagttgattttttcgcggaactttcgcggcgttgacgaaattcagcaatttttgacgccggtgttccgtctttctttgcactctttccttctcgcgcaccgtgaccaattcgtgcgctgtcagtcggagggctgccattgtttgatgccattgtcgaagggaacggcgaatggagccgttggcagtccgatgatttgcttcggttgcaaaatgaaacgctgcacattgtgcggggaggcagtccaccaggaaatcacttgccaagaggtaattggagcagcaacggcggattcatctacctaaaaatgtaatgccatttagcgacaagaacaaaagttcagcatcgaacatccggacctctctgcatggaaaaagtgaggcggttgaaacaattcataccgatttcgtttgttatataataggcttgcagccaaatttgctaattatttctgacaaattataaaatttctttcatttcccgttttgtgttcaagtgaacttccttctcatcgccgtctttgtccgaatgtccattgtaaaatgctgattgaaaagggtcccgggtgcaaccacatgtactgcaagcagtgcggcgtccacttttgttggctttgcattaattttcaagttcgttggttcctaccatccatgaaaaggatatttgtgacataattttgtttttcgatttgttaatcgttaatcccccccccccttaggctggaacaactgaagaagtctacaaacatttgcggggaagttcaccgttccattggcgagccagggttctttgacgaagtacttttacccttt

SEQ ID NO: 4401 - DNA, 3233 bp, Heterodera glycines
ttggtcactcgttgagcagtttggctacgagagggccgttgcggtgatgaacgtcgaagtggcaccggacggccatatggtgacggacccattctacgcacaggcaatgatggtgatcgacgcgttcagtgtgtacggactaagggaggacgacgaagagacgggcgacgacgcggagcgagaagacgacaatccgttgcacaaatatcgtgacaattggacggcgatgttcaaccgattcaaaaaggtgctaatcatacctgtccatggggggggggggggtaagagaagagaagcaggaaggggataggcgtcactagggaaaattttgaaattttgagtacaatattttaaattttcgatgttgagccagttttttaaaagaaataaggattttaggagcccgccgagaaaaaattttttgagtttatgaaatttctaatgaacattagcccaaattttcagaaatttccctctttttcccctatgtctaggattttgatgggcacgtacgacgcgacaattgaattcgaattgaaatacgaagaaatggagggagtgaaagtgattcgcaatttcattatttatttattgccgttgatttcctttttcatcacaaatttttgctccattttcaatttctgttatgaacaaataccagaataaaacttgggaatccttaaactttgcataagttttgtcctgcacattcactggcttcttcagtaaacagctgttcttcattcgtttcccatcgctttgtccgtctgcggacactccgccgccccccaaatgttttccggccgatttccaatcgatcagaatttccaattctcaatttccatccgccgatcgtttgcaattcgattgcacattttcctagtcaagatttctccaaagttttggttttaataaattcttcctcccccattattattaccgcaataattttttgtttatgccgtggaaagtggcacaaatggccaatcaatggcacttttgctggtccgtctgccgtctctctcattgccccactctttctcccctcattagtgtcccttctatttaataatgcccacctttttgcccatttcctttgggcttccgctcgcttctttcatttccgttttggcttttattagcaattaattcttaatttttacaatcgattagtgttaaagtaattagtgagtaagaacaaaagctttaagcctgaaataagaagaatttccataagaattttccccacatgaccatattttaaggcctttaagttaattttaaaaaatatatgaaaaaagcggcgattggcgccgccggggattaatttcctcttctgtttccttttggattttgactatcaaaatcacaaattttcttacttaagattgtcaataatgtttaataatttggctaattaattaatttaaaaacgaacggaattaatggccgacaaagaagaaagtgccggaggggaacaggacgacgtgtcctttctgagaacggtgaggacaaattctgaatttaattttaaatggacagtcgccaaattaaaactgatcagtgaattgtgatttgtgtttgaagtattaataaataagctgtggggccgtttggccggggggggggcttttcccctttcccccgagggtccgcccgcgccaaagcaacaaaagcacttccgctcactgaagaggctcttcgcccacccaaaacaaacagaagaggaagttgagttaagaatgtgtcttttgggggcatttgtgcagcaattttcggatcattcggtcgttcggtcggcggcgttttgacattttgccaatgagtcgattttttcttctgaccgatagcagtaagtgtggtgaggaaattgatgagacaattgatgatcagcaccatcagcagtttctctcaaaggtctctctctccattggaattaaaactttttccctttggaaatgcctttctttttcctccatgccattgttttacatttacctcccccctctccctctcgcccagggtgacatcgtctgtttgacctgcttggtatccaacagtcaacgggatggggcgggtgccgagtcggaaagggtttgcctttcctctgagggtttcggcaaccgaatgtgcgcgttggaaaatgtgtcggatagagacttccctccggacattgcctcgtgcatgctctacatcgacaacgctctgtcaatgcgagctttgcaggagatgatgaatgcggagagcggcgaaatcaaagggactggtggcaccggagggcacaaaacacttttgtacgggcacgcggtacaactgaagcatgtccaaagtgaaagtaattgcggcaagacatggctgctgggatttggggtcaatgtcgatgttaattgccaaattgttcattagtaattaccggtgctaatgatttccctgcgcttttactcttgactcttttctttgcccctttttatgattgccctttcccaagtgttcttggcctgcttgtcctcgtgttcctccaatgataaattggctttcgacgtcggtgttcaggagaccaacgcgggagagtcctcctggtggacggtatttaaagccttttttgtgctgccacttattcagccacaaaatcagattcatccggccagcaaacagcgatcggaaggagagaaagtgcgcgcgggggacgacgtcattctcgttagtgtggcaacggagcgatatttggtcagttggcacggcacaataaagcaaaaggcggaccaccgaagggtctccaaatcgctgttcccaccccaccccaaatcatcgtttgtgaatgccgatggcatccatatttaagcacatgacttccatgggtggcgagcagtggggggcgctgccaaccgccgtttaccattctcattttatggtaattgcttcttttcatcaaactctgtggaacgtcacttcggtcagctcgggaagtgttcgtattcgaaacatgggtaagggaaaagggcacagaataaggacaatcgggcgaagaagggcacggggggggggggaagcggcacattttgacgacgaaccgaaaggacggcatatttttaagcaaaaggatgtcactccttttgggggaatgaagtaaaggatttggtggttgtttaggctctttgttcggcaacgacgtcgtccgactgttccacggcaacgacgagtgtttgaccattccggagaatggagcgaatatc

SEQ ID NO: 4402 - DNA, 2386 bp, Heterodera glycines
agaagccggacgagaaggaggaggagggcatgggcatcgccaccattcgctacggcgaaacaaacgttggtaactcaacaaaatgaggggggaaaggagggaatacggcactctccggggcttgtccaattcgaacggcactcactcgaaagggcacatttttggtttgactgattgttttcataggcttttatccgacacgcggacaaagaattgtggctgacctatcaaacgttggaggtgacaaagaaagggctcggcaaagtggaggagaagaaggccattgcccacagtgaaggtcagcaacagaaagaatgaggacaatgggaaatgacggggaatagcatttgatcatttggactttttgatcattgcgagatggcatttgatcattaggaaatggcatttgatcattgggacttttttggcatttgatcaaatgcggaaatggcatttgatcattatgattttctttggcattaccccttggcatattctcccaggacacatggacgactgctacactttcttcatggcgttggaggaggagagtatgtccgcccgagtaattcgaaagtgttcgtcggttttgaaccgatttttgaagtaagtcaaaggaaaagcgaatgaacaaacaaaacactgacttttaaacagagggatcgaaggattgcaaacggaaggcgaagaatcggtggattggatgagagtcgatcttcaagaagtgctgaaggtgggcgaatttagcaaatttggacggaaattggagaaaaaccgaaaaccattgtaatgacaatgaatgacttggcaaataccgaacctatcatactaccgtattccctgttcaagagatgcatactgtctcactacactgatgcatttccgggaacactgtttggctttaatgagtgagctcttttagctgatgcaagacctaatcacttactttgcccaacccaacgacgaattggacttcgaaagtcgccaaaatcgtttccgtgcgcttcgctcacggcaagatttgttccaggccgagggtgtgctgaatatgattttggataccatcgacaaattctccgttatggaagcgatgccaaactttgtcggattaattggcgaggaaaatcaggcaaaaaacgaaatggaaaagtacgattggtccatttgtttagctaatgtgggaggaaatctccacttatctctatttgctggtggccgcgatgatcaaaggaaaccattcgaactgtgcccaattcgccgcgctgcttcgccttgattggctcttcggccgcctgtccaaccctcagtcggccgagggcattttggacgttttgtactgcgtgttgactgagtcgccagaggcgttgaatatgatcaacgagggacacattcggtgagggggggggagacaaacggacagcagagaatggcactgttaattcatacattgttcttttgcagttcggtgatttcgcttctcgagaaagtgggaagggacccgaaagtgagtgatgtccaatttgatcagtagtttgatcacaattccctcttatctctctctttcactgatcactcattttctgatcacttttatcgttttgctgtcttttcccatttgtccactcatttcttaatgttcttcaggttttggatgtgctatcttcgctttgtgaaggcaacggaatggccgttcgaagcagtcagaacacaataacggattatctgttgccgggaaaggaccttcttctgcagacccaaatgagagattatgtggccaggtgggttttgtgccgttgcccatttcggcccattagacagctttccttactgtcctcccctcacattagcttaattccccattaaaattggctgatcattcattatccttctcccaatttgtctaattggctcatttcattttttgccttcagtatgatgccaaacattctcgttggggtcgtcgatggcagctcgttgttcaagcgttggtacttcgaagcggaagtcgaacatgttgaaagctatgccaaccagcagccttacctgagggtcggctgggccaacaccgtcggcttcaaacccttcccggggcccggcgacgggtggggttgcggcggcgtgggcgacgacttttactcgtacggctttgacgggatgaatatgttttgtggtaatttgcacgatttgttgagctaattaacttccccgcgaccaattaagcgggcaaagcgcggcaagtgggccaccgattgctgcgcaagggcgacgttgtgggctgcgcgttggacctgatttcgaccgaaattcgcttctctctcaacggcgaggtgagtaaattggcaccaattggagaaagcaaaagtagaataatgacagcccatctact

SEQ ID NO: 4403 - DNA, 1617 bp, Heterodera glycines
cgggacgcatttggccaccaaatggtccacaaaagtgtcgatgaaagaaacgcgacaaaaatggcccggcatttgggcatggaatggagaggctggaaaaaaaaattgtggagaaatcagacccaagtgacttaaacaggggagcagctctgtatttccaccccttatcccgacaaatttattgaaataattgaaaatttttttttaattttttacaattagattttttagtaaaagttaaaaaaaacagaattttttaattacaaaaaactacttaaagaatcaaatatattcgttttacaaaaaaacaaaaattttaaaaacttttttttaaaaaaggtttgtttttttaaattaaaaaagttgaaaaaacaaatttcttttgaatttttaacagatctttacaatttcaaaatgttagagaaaactataaaaaaaaatttcagttacttttttaatgggaaactcccaaaaaatttaaaaaattgttgatgtggagagagacctagtgaacccataaacatcgggtcgggtttcgggtcaattaacaaattttaataatatgttcaaaatcgatatgaatttttttatcgaatgaaaaatcaataaaaattttctgcgtcgcgctttttcaatgtaaatttcccgaacaagaggaatgtctggcgatgccgataggcgccgccgggaaaaattttgtaatttataatacgatttgtttacagattttgccaaaaaaaataaccaaatctttggtaaatttgcggttttaggctgtttaaaaaagaaaaaataataatttttaagtcgaaatattttttattaatttaatttcaattgaaagaatttgaagaaaatataaaatattctatcccagtggggaattgaacactagcgaaaaataaagaaaggcagaaggtatagccaataaaccacacaaccataagaacgaacactttaaatgtaaaataataatttaattttttttcaaaaatttctccttctccatcaatttccttatccacctaattttcaccaaaacccctttcttaccagtgcttatttcgacccgaaacccgaccaaaatcatcgggtcgggtttcgggtcgagaaaaatgtcgggtttcgggtaacccgcggcaaccctgatgccaataatgttgaaattggtcatttataagaaaagttataaaatgtcaaaatgcgccgcattaaatggccccaaataggtatgtttttttaggaggccaatcgtttgatgcgagaatgtgtgcaaatcgttgtcgcctgttgcgatgcgcccgtttcgaccgcgttcgacattgagggactttcttggggtaaattaattttataatatatatatttatacgtataatatatataaaataataatatattatctgtatttttgtctgcggaaagttgtcaatttccacgaattatttttgtcgaaaaatgcctcatttatttacgtatacattttattttcaagttttgaatgcgaatcaagctcagcttcctctgattgtttctttggtggatgaactcttgttttattttttaattttggcatttccaattttaaaaataatttatacgactgcataaatttct

SEQ ID NO: 4404 - DNA, 4268 bp, Heterodera glycines
cactcatttcggccctttcaaacccaaataccccaaccctttttggcctgaacttggccattgccccaaattcagagctcatttgatccctaaaaaaagggaggggaagcccggttttctgcaaggctcgcctgtttcctcatggagcattggatgaagtcaatgccgaaattgattgtctttcgaaaattgggcgcaattaacccgattgagttcagccattgggcggctccgattttggcagtgaagaaaaagagcggaaaaacgcgagtctgcatcgatttttcgaccggctaaaacgatgcgatcgaactgcatcgtcatccactgccaaggcctgaggacatctacaacgcagttggcggcgctaagtttttctcacggctcgacttgcgtgatgcctatctgcagttagagttgtcggaagcctcgaaaaatctttgcgtgctcaacacgcaccgaggcctgtttcagtgccagcgtttgccgtttggagtcaaatcggcgcccgcgatttttcaaggattgatggacaaaatcatcgccggaattccaggtgcattcgtctatttggatgatgttgtgatcgccaataaatcactgaccgatcacacctcaacaattttcgcggtttttgacaaaatcagcgaatacggccttcgaattcaattggaaaaatgcagtttccttcaaaaagaaacgcttttcctgggccacattatctctgaaagtggcattcgacctgacccatcaagggcagaagccattgagaaaatgccggcaccgaccgacaaatcaacgctccgatcattcctcggcgcactcacttattacggaaaatcatcaaaccgatgcgagagctcagaggcccgctggatgaattgcttaagaaggaggccaaatgggaatggggagttgagcaacagaaatcttttgagaaagcgaaagaaattatgctttccgatttactgttgactcatttcgatccagaattgccgatcgtagtcgctgccgacgcttcgaaagatgaattggcgcgacgataagccacatctttccggacaagagtgagcgcgtcattgaacacgcctcttgtaccttcaacgcggcacaacaaaactacagccaaatcgaaaaggaggcacttggcttggtcttcgcagttcaaaaatttcaccggatgctgtacggtagaaaatttacgctgctgaccgaccacaagccccttttggccatttttggatcgaagaaaggcattccgatctatgccgccagccgacttcaacgttgggcgttaatactctccaattatgaatttgacataaaatatgtcaacacaaattcgtttggaaacgccgacgtcctgtcgcgactgattgcaaactacccacggcccaacgaagacattctgatcgccaacatttgcgaaaagacagaatgctacgtcaacttcgtttttcaggccaaagttgagcaattgccgatcacggccaaagaaattgctgatcagacgaaaacggacgaagtccttcaacaaatcagtaaattcaccaacaaaggatggccacaaaaatgcgaagacactgatctgatgccattttatccaaaaagagaccaaataaccgaaatcgatggttgtctcacttatggcgaccgtgtaatcattccaacgacacttcgcagacaaattctgaaatcccttcattttgcccatccaggaattgttcggatgaaggccattgccaaaaaccatgtttattggccagggatcaacagcgaaattgagcgcactgtccgccaatgcgacgactgtcaaatggccgcgaaaaacccaacaaaggcacaaattcagccttggaaagcggcagacgaagtttttgagcgcatccatctcgactttgcgggcccatgcgaagacggccaaacgtatctcgttgtcgtcgacgcctattcaaactggccggaagtttgggagatgagttgtgcaacaagcgaaaagaccgtcgctatgctaaaatcgttcgtccatcgaatgggaattccccgagaaattgtgtccgacaacggaacacaattccgatcagcggaattcgccaacttctgcaaggaattcgacattcgtcacacgttcacgccgccatatcacccgatgtcaaatggggcggccgaacgattcgtcgacatcttcaagagggccatgaaaaagtgccgaaaagaaggcaaagattggatccaaaaagcacttttggcctacaggacaacgccaagtgcagtgctcgacggacattcaccagatgaattattccttggacgccggatgcgaaccaaaatatcattggtccatcccgccaatcagaaaattccgaaagtggatttgaaaaattttggaaattttcaacaagattaccgtcaaaatatgaaaaggcaattcaacaagaaaaacggcaccaaaaccatcactttccgaaatggagagccaatgttcatttggaacttgaagggcaataaggcaaattggttgcctgcgaccataattgagagagttggcaactctccgacttatcgaaccgatgttccgacacttcatcgcgcagtctaccgccatgccaaccaaattcgccgccgtttcccagtggacttggagacgccagaaattggccaaagaaatggacacattttggccggggaccaaacgaatcgggcccccgttaaggagattcaaaaagccaaatctccagttggccaatgtcaaaatgcgcagcgaaaatcagcacgcgccaagagggcacctcagcgactggacatggatccatcaaagccgaagtacgacctcgtccggccatgaatctcgcgcaggagggacttttctcaagaagggaggtgttggataaggaacacacatattattgattgtatttccctttctctccctctctattgtctctccctctgcccccttgaccagccccataaatatgtctccttttccctcactccgggcattctcccattcattccaccatttcattattttatttatttattccctgctgtcctccatatttatttgtttaataaattatttatttatttatttgacaacattgattttggtcgaagaccaaacatttttattgttgtagcaaatacacaacaaaaatgaattcaaattttgaaatgcttttattttaaattacaaatttggttaatcattcaggtctcgtggtacggcatatttaattcgttttttaattacattgtttcttattttgatgtgataattatgagtcatttttcaggttttttaaacccattcccgcttaatgtgatagtcggaaattttttgctgttcgacagtagaatttaaaaataatcaagtttaatatttatttttatatattcaaatgacaaaaatttattttatttcactaactttttaatttgaaatttaatttaaatttctccagtttcattcttctcgagaaattcagctcaaaattcgatttgagagctttcgattgacagcatatttgcagggattcacattcaccttcaaaatttgaaaatacaaaataattagcatacctaattaacactttacgaagcaattaaattttaaatcgcattcgcttaggcaatttggttgagcagcataacaaattaatgactaataaaaccaaatgatgaggtgaataaccactgaaaaatattttattaaagtgaggaacatacagaaaataaatgtgccgacttggtgacacaattttgacatttttgtcaattcgccattttagaaaattgccatattttggataattaagattgtgtaattaacactaattaattaatttatatttttttgttgtctcaataattcgcctgtttagtctcatttaatctattgtaatccataagctaattgaccattaaagcttcccgtacagttgaccgatttataatttttaggaatagaaaaatttaaaacatttcgccaaaaatagacaaatactgtaaacaaacagctaatcaaatttgtctttgttctgttgctgttcattcaacagcagtggagtgctctcctcatctctgatgccgttgctcggggctctcttgccggacatctgtgaaaattggcacgacaattgaaaagccaaaaaaaccatggattggaaaataatgccagggagagggacgaatcgcaaaaactcaaattctaaccccccttgggggggaatcagtaattatttgataattggtgtctctcccta

SEQ ID NO: 4405 - DNA, 4237 bp, Heterodera glycines
gaatagcagagcccccaccaggctccttctcgtccccggtcgcgcctccccccttaaatgtcggactttgcctcccctgctgcccgtccattgtaaatgcgtcaatgttctcctcataccgtaggtcttgctgtgccttttgggtacagaaacgaactgtaaaatttaattttaaatgttcgcataatttggcgaaatgtccgaatttctttacgtttattgcgccatgccactttgagtacaatgtaaactgaaagattaacgagaaaatgacaatttcaaatgagcaaatttttcattatttattaaaatttattaaaaatttttaatttaaatatatattaattttattattatttaacgttaaaaaaaattaatttctttacattttgtcagcatatttatgggcgacggcgttgccgaccgtttgttcatttgtctgatcagaatggcacgcccgaacttccattccttgtcagattgggcctgaatgcgctgataggtgtcgctcatcattgcgatcagcaaattgatcaacacctgcgggacaaatcaaattatttcacaattttcaaatttaattattatttttttaattgatgggcacaattgcataagtcatacaattagaagttaattaaaccatattgaaaaattctcaagttttaattgcttttgataaatttttacgcgtccttggattttacggattttcaccgttatgtccttggaactggacatgtctatacttggaattgagtttggccgatccaagcccaggcactaaaattattttttctttatgatcacaatttatgccaaattattaataaaagatagaaattgtctaactgatacaaaaaatatttttttacaaattttatgatttttgcgttatattttattttggtactaaattttaggttttattttcagcaaatgttttcatttccctggtttaaaatggcataaaatattaaaagagaaaaaaaagtttttgtgatttaattaaaaaatattggataatttaaaaataataaataaaattcgcactcacaatcaatgtgaccatcatgtaaatgccgaacaagaacttgagcacaatttttgcaaaatcgggcaccaaatggagcgggggcctgtgttaaaattagaaaaaaaacttcaaaaaaatttcaaatttttcacatgctgtccggctcgacgaggccaaacagcgagaaaaacagcatttccaaggtttggctgggcgatgccaaacgcatcagttcggcactgtcctcgtccaccggttggtaggcgggcttaaaacaaattgaaattcaataccgtattcctaaaatatagcccgcccctaaattagtgcccccccccccccaaaaaataaagaagccgcacttttgagggaggttgaaaaatagagcccacgggggttctatttaaagaaataatctttaaaaaatttttatttcgaaattattttttcctgaaattttcttataaaacttgaaaaatttctaaattaaaaaaattaaattttttttccggatgggaaatggatacggggtggtctctgcaaaaattttggtggcttaagctaattaattaggtatattacttgaaaaatggaggtgacgtggagggtaaagccggcaacaaaaagcaaaagaatgaccagaaaacgggtcaggtcgtacatcaggtctaaacagcattgaattgagtgtatgcaacatttcaaaagtatattttatttttttttttatttcgtaactaaaatgatgacatttcggttttaattgccatgaaattttacaaattttactgcaaaaattgagaaaaaaaccaatagggcgacagtgattcttgagtagttatgccgaattttttgtcaaaaattattgccaatggttgtgggaattggcaaaaaaaataaaaaatgagattaaattgtcattattttatttcaagaaattattattggggaaaaaattggttactgtatttataaaaaataaaataaaacaaaatgaatgacccaccacggatgattattgcccatgggccgaacagatggtgtactgtaagaaagtcgagaaattctacaaaagcaaacagcagggcgaaggcgagcaactggtttttctggaaaatacacaaaattcaattcataaatttaaaaaaatttatttatttttgagaatttcgcatttttttcgtgcttgaaattggcgactttgcagtccttgaagaaatagaaattgtattttaaaaatattaaagtccttaaaaattcagagaatttgtactctaaaaacatttaaaaagccgtaaataaagaaagtttgtacttgagaaatctttttgtttccattaatttcccacttttgccctatttttgcgtttttttggtctttgaaaaatattgaagtccttaaaacaaagataatttggtgcgtgaaaaacactgaggtccttgaatacagataatcaagtacttgaaaattttttgaatttccattaaattgccattttccccatttttcagcttttcttctgttttttttttgctgaccaggtaaagcattgtgcgcgcaaagtgcagcttctcgtcgctgtccaaattggtcaaataaatggcgggccacagaaatgccaaaatatgcacagcaatggcaatggcggccaacaccaaaatcagaattttgaccacgccgaggcccgagccaccgccgacgttggacagctcggagacgaggttgccggacagccaaagcagcagcagccactccaccgagttcggcaccaccgaagtggtctaacgacagggagacggaaattaaacggaaattcataaaaatttgcaaaaaatggagctccaaggggtaaggtggaattcggcaccaccgaaatgaccaaacagagagacggaaaattagtaaaaaaaatttgacaaataacgtagggaggggcggaattcggcaccaatgaaaggcaaaaatagaaaaaataggaaaaaattcagaggatgagaaacgtcaggagttaagaaaaatggaatctaattatagtgaaaatttaaatgaacaaaaataattagcgtaaaaaagaaattaaattaaattaaatatttttatacaaaaatattatatattttttaagcttacttcataaattttgtgcgttatattcagcacgacaatggtcaacagaatggtgaaatacacatgagaaacgatgtggcaaacaaatttgataattggggcacgacctgagaaaagaaaattggggaaaaagtaattaaaaggagaggcaattaattaattaaaattaatccatttttaatgggtttaataaaaaattttaattttaccaatccgtgagtccaacggcagtgaaaagtaaaaccacgccggagggcaaatgagcacgaaaaatgcaaatgccacggttttgccaaaggaccaatccacacgacccgtcctgatcaaaagcgaatgttaattagacaaatccaaatattaattgacccgatttaaaggaaataaatgtaaaatcttttttttttaattttaaaccgaaaacaatttttttttgaaatttaactaataaattttgccagtaaataaataaatacgcatcaatttcctttctcaccatatttccgtgagatagcgctgcaccgatgcgtaggaaacaacttctttctaaatatatatatataatgagtacattgttttcataacaattcgttaaaaattccaaaaattttccactacaggcttacaaaaaagccctagtttttcttaaaaaaaggtccaaaattcggtcatttttgacaaaatctgttaaaaatcatccggcggcgccaaaaaagggatgaaaattgtcaatttcatcataaattttgttaatttccaagaattttcacggcttttgttagaggccggaaaattcaaaaaaattttcccggcggcacttttaggctccactggcggatggaccggaggaccacctgttcattttcgatcagtacgtccagcagcggcggtcctccggtggtccttggccttcagcaacagcgcagcattatatctttcaaaatgaaataaataatttgccgcattttcatttaatttattgcgactttgctgccgaaatgccaagcaattccacccgccaattctccccaaaaatggccccatacctctgcaaaattgggcaaaattcaaaaaaa

SEQ ID NO: 4406 - DNA, 2374 bp, Heterodera glycines
cgggcacagaagtgaatttggacaaagcaggacacgtcgcattcgaagacgaattccaaacggtaaaagccggaggaataaccgccgccggcacggccaactctaaggggagcaaagtgaggacggcaaaattggggggggggggggagggaagcggaaaacggagtggacgcagacgaactttgtgaatttgacggagtcctttcgcacattgaccaacgcgttcagaacaccgatcgaatcggtgacgcctttggccgagaaagggaactgaattcgaaaataaaattcacatcgaagagtgatttttagtcaatgaacatttttggctaatttaatcacgagtctcggttttcggtttgcttttcaaacttttccatttctcttcgactcaaccctttctcggcaaatcaatgcccggcacagttttctgaatcatcgcaccttcactgatttgctgcccaacagctccaagtcctgctggtcaccaaacaagaagctgaagaggggacgcaaatgcaatgggacagtcgaaccctccgcccttcggctcattacacttccggctttgacgaatcgtacagctcaccgcccatcagaaagtgcgagccgaaaaatgagccgccgccgttggcaccgctcggactaccgcgaccgcccgcctcgccgctgcccgacaaatcgggaggagccggcgcatggcgccggcggcgcctgccgaacccggcacggaatcggcccatttccgctgactctctgcacaatggaaaatgtgtaaaatccaatacttttttgtgtttttcatttaatttttggcaatttaactcgactccccctttacgggctcaaattcatttctccctcaaatcttttgaccaacccctgctgattattgtcgttccgttgctccaaattattcgctgtttgctgtccgaacggcaaaaaagcactgagcagaacgaacagtcgtctgttgagaacaataaaacataatcattcagagataaatgatacgaaatcaaatattttattctcccgtgcatttcgtctcaaaaatattgtaaaaacgcaattttcatctccaattttgcttcgaaaacaaatcggcaattgtatcattaacgtctagagattgaaaatttgctgcttatgcttaacaaattgttacacgaatcctttttcatttcaaacagaattttccgctttctttgtgtttatataaatcctcattttttaattctatcatttggtcaattttctgtacctaatccctgccgatggatttgtatctgcattttcgttgtcgttgtttctgttgccattggctgctccccgaaaagcgaccagcagttgtcccattaaaattcgttccgttttaattattaatttgttgtttatgcgataatcgaaatgggaggaacagaaaacgcataaccacgaaaaatgcgaaggaatgagtcgcagcagcgaccgacgaagggcagccggttcttccgatcagcctgatcaatctccacctacactcttttattcaaagatgtgctacttctacatatgtaatgttgctgttctgttcaattttttgaacatttagaacacaacgtcagaaaacatttaagcataaataattaaattctatttgattttaaagaaagccgaatcccggacaaaggcttccctaatttggatggaaacccataagtttctcgttgtttttcattatacctacaaaatatgtgcatcctttaacatgacaaattcaccaaggtagaaaattccaataattcaaatttaaattcgtttaaccaaatttagttcctttgtaattcgattaataatgttcttacatttaaaggggaaagcatcacatattattaaacataaaaaatgattgaaattactgtcaatgatcgtctgggcaaaaaagtgcgaattaaatgcaatccgacggacacaattggcgacctgaagaagctggtgtcagcccaaattggaacaaggtaaaaagtcatcgccaattggaaaaacttctgaattctctccccttttcaggtgggacaaactcatcctgaagaaatggtacaccacttacaaggtgagcaattgcgtaacacaccgttataaatatttaggccttattttcccatccttttgcttttcaggaccacatcactttgcaggactacgaaatccacgacggattcaattttgagctatattatcaatgacttgctgcgcgcgtgttcattacttttgtgatttacattacattttccctaataaattgcgctgtgttttagagaattttgagttgttagtttcgaccctaatggttcgaggctaatggcatatttatgcatccttcactaatcaa

SEQ ID NO: 4407 - DNA, 3197 bp, Heterodera glycines
ctaattcgaacaagaagtcgtaaaagtaaaatttttttctttttcatttttagtctaaaaatggtttaaatgatttttacttgaagcactgatgactttcagttcgtttccgtgtatttaaacaattttgaccaaaataatatgaaaacaaaaattttacttttacgacttcttgttcgaattagggtccgggatttgggattggccgaaattgatgccggattcgcgatcagcgaccccgaaaacctatagattggcttcttttattctgaaatgtaaaaaaaatatttgtatatggggcctaaactgcacaagagccatgcaaatttattgtcaattttattatttaaaaacatctcaatatttacaaagaagtgacttttgaagtataatggaaaaataatattaaatgtaggaacagtcacttaaattgaaaatcaatcctttctcactatcgcataaatttcatttgtctaggatgaatatccggcaaatgagaaacagtttttgtccgtctcgcagacaacgactttgtgcaaaagttcgggggaactcattgtggcggagagttcgttgtacaaaaacaccgaaagattttccgttgtgctcacaattccattgtcccttaaagtatttgtaatttgttaaaaaaatgccaaatatgactgattataacctaaagtagggcaagtccttgtccaagtgtttgtggtcgacctgctccaacacttcgttcatctctcgtttcaaatcggcaaggttgtacacctgcaaatgcaaacagaattcgtttttgcaatggattataaaatgaaaacccaaaaaagggtaaaaataattttcatttctaaatcagaaagaattgtctgctcccgattcaaaaagaaatttgggtatccgcgagaaacacaaatgtatatccaattcgaatttgctgacatcccaatttatgtttcgtccaatattcgactgaccattccggtgtgctggtccaccggccctttcagcaccactttccacgtgtaattgtgcccgtgtccgttcccgttgttgcacttgccgaacacctcgcggttcaaataatccggcaaattgtcattgtgcagtcggtgcgcggccgaaaatgtctcaacacggcacattttgacgatgggctgctgttgttggcgttgttgcgcactggccgcaaccgacgactgttgcataagcactgacaacgacgaagtcggtaaaatatcgttgttgttgttattgctgctgctgccggttgggatcaaattggacgatgccgtgatggcatcgctttttgacggcgctgttgtaacgcggctggaagagcattgcctctttttggctgaccacggcggaattgatggaatagcgatattgttgttgttgaacttgtcatcgtttgtcatatcatttatggcagagacgttatcatcacgcaaagtgttcataaacatggacaacatggctaaacacaaaaaggcattgttgcaaaaaacagcgaaaaatgaaaaagcaataaataactacaacaattaccatggctgaggcccaggctttctttgagcgctccgctgtcagtgtcaacggaaggcataaaattggccatttgtttttcgttggaatgttcggaaatgtcaaattttggcgatgaatggtcgacgaaattggagcaaaattcagctgcagctaaaaaagtcaatgaatatggatgaaatatggggtaaatcttcaaaaataccaaagtcattgcgaatcatttgtccgtattcatcatcgtctggtgctgcttttaccatggccaagtccaactgaaaaagcaaatgttactcagtcgtccaaataagggattgaagcagaattttcctaacatttagttctttagggttttttggaacgaggtcacaacagaaagccaattaaatgatataataccatcgatttggccatggtccgtcgttgctggcgtcgttgtggccgttgctgtgctccctgcttcgccgctgcccccgcgactgcctccttcgctccgttttccgtcggtgttgtcattctccgctttcgtcccctctgttccgggttcggcgtcgtcgcctgcgcctccatccgctggtggtacagttcgctgtgtttcgactttaaatggcaacgcaaaatgctggtcgatttcgctgaacaaaatggtggcattaaaattgcaaaataatcttctgattaaacaagaaatccaggctgaaatctaattaagccctcgactacggcttcactacggaccagggagtccttttttatttgaaatttttctcagggggggatgggactgataagctccgccaaagcattggctcacctggaccccggtccctcaaccactcgcagtttttgcatttggctcggtttccgtctagcttctcaaaccaataccaccacgacactttgtcatcttgagacggagatttcctaacagttttcatcctcaaaaggcaaataaagaaaataaaaaagaaaatttaaacaaataaagtcagccattaggacagataaatgaatatatgtcaaaatttataacatagatttgtttttcaacatttacaaaatacattttaaaattggacacatacaatttaacaatataaatagaaagctttttgcacgcggtcgaattcttcttcagtcggaatttgcgccaccgaccaaaacgcgcccatttcgcaaggtgtcgaaaatgctcatcaactgatcgcacacaaatgccttcagatcggccgggtgtaattgttgcgcagcgaaatgcgactccaattgggcgaagtccgacacggacaaatcaccgccattctcgggcttccgttcaattgtgatttctgcttaacatacaaatgaatttaggaaatgaattacccatttatggctgagtgaatttaaaagcaaaacgaattaaaatcggtaacaattaatgcaaaagaccattgggtaatgcctgatttgtccaaaatgacctgccgtcccttccgttgtttgtcctttttccccggcattttccgccccttttgagcccgccgatgccttttgccggaagaatgggaataaaaagtcggcacacagtttcagtgcaacattgtcgcacacattgcctggctcgcaaaaggattttccgacccaaaatggaaatttaggaatttatttag

SEQ ID NO: 4408 - DNA, 2708 bp, Heterodera glycines
  misc_feature (23)..(23): n is a, c, g, or t
gtcctgcataatgtccaaatganaatcgggccgagtggcactcatccgctgcccatccatgccgaccaacggaggcttaaatttggaaatggctacaaatcactagagcaaaatttaggaggatggcactcacattaatcaaaaaggcaggaattgcggtgcttaaactcagccgtttgaaaatcttaaagtaaaaaaacttaatcattttttgacattgttaacctttgcggtcaattcggcagtttttcgctggtttgagccaattaacaccttaattgctaatataatatctttttacatcatttttctcacaatgtccgctgcattttgtcgtacatccaacgcaaaataaatgggacacaaatggcacccaattggaggcggcggtgaatcggtggaagtgacggaaggcgcagtttcggcacgggtcacaacgccggccatttgatacatttccatggagaagtcactgaaaagaattagggagggacaaatgacggaacatggagaatgattgcacctgtcgaattcgtattccgaagaatgttttatctcaacattttccatattcaatgaccgcagaatttccctcagccatttctcgaactgtagcgcacgactcttaaaaagttgacacttaacgaattgaaataaataaaatttgaatttgccttcatttccgtccacggacacttcgcgtggtcaagaaaagcgtccaaatcggagagcaaaattgtgatgtgatggccaaaagtggacagccatttgagagtgaacagtgcgctcaaatggccaagtgtcagccgaccctttggagacaaacgccacaaaactcgaaggggacgaaagtcggtggacgacttgttggaggagaacagaaattcgggtgaagaaacacgaacggacgaagcgacaaacttaaggagaaaataaagggaaaaagttaactcgaaatggtaaaaaatcaaaaacacctccagggattggccaaagggtgtcgacacgcatttgactccgtccagtgccaaactgtccaaacacaaatcgtccatcgaagtgccctcgtccttgtactgctccaactgcgctatgattttggaggacggatacgcttttgcaacaatttcctcaaaatgcgagttgtcacgacaattgcgttggactaaagaagaaaaaaaaggatttttttttattattatgttaaaggaaagcataaaataaacgcttaaactgaccggacgataaaattgtgttcaaaaaattcttcaaatattcctttagggcactttcggaaagatcgccacggacaaaggcatttcgtatggcatcaaaagagtcaaaaaaggtgccattgatcacaatttgagcctgtgcaaatgtgttagaaattagaaatacataatagaaacaaaaagaacgaaactatacaagcggaaccaatcttggcacaaaatgcatatttggcactttattctagtacctcagactgaattggcacaacaacatgcttgaagaatgccagaactccattttcgtcgccaacgccggattctttagcatcggtggacaaagttgacggcattttgggacacgcggcagaatcaattttggcactcaccgactcgggcgaatccaacaaatcaattttggtgttctcttcagaactgaaaatgatagaaaaacgatgaaaagcatttttaaaaatggtcatgaaattcaaattgctgagttaaattaaaaaatgcctgctcattttggagccggtgaggccgggcaccatcgggattcatcaaatggaaacgcttggcaaatttcatcttcagcagctgttcctcgcacaaaatgaatattttgcgctgatccacgcccccaaattgaccgaccactttgaggtgctgttcgtccaacgcttgcagcagagggtaaaggattccgctcaacagagggtcgtcaacctggataagaaatgattcattgtaggataaaatagcggcaaagatgtcactgtaaattagagaacaagccatgggctgggtacggtttttgcaggatccggaactgataatttttcgaaaaatccggtttttgagaccgggcccggaaaccggttgcttctgaaagtgtcagctcgaccggcccgacagatttggaaatctttgtctctacaataaattcatttgccaaattgaagatttaatccaactccatttcccacctgcttgacaacttccgcgccagcccgtgttgcatctcgaagactgactaaaccacaaaaccgcagcagatcctttgtgtaagtcctaattttgaaagggtgtttctcgcagtaaatatggtcatcaaaatggcagataaataagactcactcggtcaattgatacgaacgtccgcgcacaaaatgcaatttgccaatgggcacattcagtgcgtttagcagcgctttgatcacacattcgtagtaaagcacgcggttttgaagcaattcaatggagcttttcatgttgtcgaggaacgcgtgaaggtccgcaaaaagaatggtcacctgacagagatacaaacatttaaatctaaaaacgataagctaacgttcgtttttacccgaatatcggctcgcaaaaagtccgctattttttggattggaaccaaatatccgaccatggggaagtgcggtggtggcggtgcccctaatagacgtggatgttttt

SEQ ID NO: 4409 - DNA, 1309 bp, Heterodera glycines
tggcggtgcaccaatagacgtggatgtttttgcgcgctccaatttgtttcgtgagcttttcatcaccaatcacttcttgcagatttcgaacaataagctctttccgtttttgttgggcatcattcaactccattccgacagattcaaagaaaaaaggccttaatttaaaaaaacaaatgctaaaataggtaaacgaaaaaaattggaaaaattcaaaaaatatctatgttcgtaactttgtgacaataccacattttcgaattaacaaatttacggtaattacaaaaaaaacaacaatgattaaaaagcagtcgtctcatcaacaatctactgtcaatcgttctcttcatcgcttccattgttttcttcactttcacttgaagaactgtccaaacggggcgttgttgaatttgtgcactaaaatgcataaccaacaaatggaatatacatataacaaattatgaagaatttttaaaaagaaaatttcctaaattagaatcctatgaaaacgaacagatttagcggaaagtgttcgcagtctttgcaaatgctcctcgagttttgcttccgcctccgcccctttgtgtgcgccccttccgacagtcaaatcggccaactcaaccaacaatttggcggtgggctccaaagtgccatcgtccgaaatcaggctgaattccgtgtccaaaatgtcctccatccaatcggacagcgcaaacggacaaatgtccttgtgcttcagcaaatgtgcactgagcacttcgacaaaccatgcatcctaaaaatggaagaatgaccggaatttgttgggagattaactatacaatttaaaggcttttagagtcgataatcccgaatctaactcaattcggaccccgaaaaaagtggaaagtattttttgtttaagaatgttcgacctcgttatttaaattcgggttaggggtccaggttcagaaaagatgtgtcagatattttttgaacttatgaatacccccacatttggtttttgattttccataggcgctattttaaagagtgaacttttgaattctatcaaaaaataaaaccaacaggggggagggacccttttggtttgcaaaattttttaatatttagtcatgaaaatttattccctgtggttcttggggtccatgacctcgaattggatgtcagattcgtgatcagcgacctttaaaaccccggataacaaatcctcatggatttttatttcacaaaaattttgcaaaacaaaagggtccccccctgttgtttttgatataattcaaaagtttactcctttttaaaaagcgcc

SEQ ID NO: 4410 - DNA, 553 bp, Heterodera glycines
  misc_feature (12)..(12): n is a, c, g, or t
attagagtaaancggataaaaatatctataaaggttgtcctcaatccaaattgcaaaacagcgatttccacacgggcttcagctatgctatgcttcgtttgctaggttggcatttctctaatcctgtgtttaatctcactgataataagggttgcacaaattacggatgtgccgctaaaagtagccttagtaacagcataagcatgttattggaacacccctcctaccattatttcatatttctgtcataaggctaaaagctagatattgtagcgaccagacttttcatttgatctgttgttttacgaaagaattttgtggttatgtagtggtgctaatgtatttctttaattttgtattttgtctatttcatcataaacaaaattggaaatattttcgaaacaaaaacatggtacagaaaagaagcttgactttctgtacacgtagatgggctgaattttggaatcgaatacgctacaatgcatcagtatttcgatttgttacgatgacatactagaaaatgtataaatcaactattttcagaagattgcga

SEQ ID NO: 4411 - DNA, 6337 bp, Heterodera glycines
tttaaatttttgttaaaaattgccattttattattaaataaataaagcttaaaagttttttaataaaaaaaactatccttgtttcatagaattttaccagaaattttttaaatttttacaatatttccataagaaattttgaaaatgtaaccctattttcttgaaaatttgaacatttttggtagaaattctgtaaatatattggctaaaatcagaaaatttggtctttttttaaataaaatctgttaacaattcagaggtaattttcaaaagttttcccggcggcgcctgtcggcaccgccggaccgcccttgctcccgaaaagtttttggaaaaagcgcaccgcaaaaagtgttttaatagcaataaaaaattgtcaaataataatttagcatttattaagaaaaaaatttctgtaaaataataattttgaaggaaataaaaattaaaaatttcttcaatacctgatttcaccgggtacccgatgcccgacccggtttaaaaactaatacccgacccggtacccggcttttcaatgcccggtaatacccggacccggtttttacccaaatacctggacccgtgcagccctacttttaaatgattattttttttggtactgaagtgttcattttcactggaactcagttgtccacactaagattgcgctgtttcgacttaattccttgatttttagacttagctcgtcaagagatgataccaagtttgtccgaattcgacccttttaatttgtcagcacctaatttaagtgtttttgtgcgttttgagccgataccgcattcggaaattttaccccccggccttaagctggaacctggactatgaactcacggtcccaaaacatcgccccgccggtccattttccaagtcccggtggtgctggtgcgtttcttaaatccgccaatgggtttggaaaaaaaaatgggtaatatttataaattcatagcttggctcaaattccaccaaattaatcttaagtgatattattcaatagctttaactgttctctttcagaatataatttttcaaaaatttttccttaagtataaaaaaagttataaagcattgaacatgctatattttttgcaagtatcatgcatatataattacaatcatttaaaatttaagtgtttaaaatgcaaatgtcgcaaaattattttatatattcgatagccctacgaattctctatttaccttttaaattttagaaaaattcattgagtttcaaaaatgttctagccaaaaaattctcatttaagattttttaaaattttatgccataatttttttttaatttttacttaaataaaaaaaattatggcataaaattttaaaaaatcttacgcgccagcacggtcccggtccaggcaaatcaaaacttacgtaatctaattttaactcaaatttttttaagttccggattccggtcgaaaacccagattcaggtccaggaaagtccgattacggttttgcaaaaaaatcctggtaccgtaatgctctagttgtgttcaatcggacgacacccaactcgtcaaatccaacattgttggtatccttcgataaccctaagtgtcctctattagcctgcaaaatttcgaaaaatctcgtaaaggttcaaaactctcgaatgatatcaagatcgttggatttggttgacaaagaaaaaagttatagccaaaaacttgggtccgtacgaaaacgaccccgacccgttgttttaatatttttattttcgaaatataaataacgattcgccaaaaaaaaataatttatatgtttaaaaaaattggtattcaaattccatatacaatttttatttcattaaattaaatgattacaaatttttcatttttcaacttcatctttttatcagaaaattgaaaaaagattattgcttaaaatcatatataaaagcttataaactgcattaaaagagtaggggttgtttcggcgccagccctagttttttgacaatgatttttttgattgatatcaaccaaatctaaagcatgtgaagggctttcgaatgatactaagaattttagatttagttgacaaagaaaaaattatagtccaaaagctagtgttggtgccgaaccgtgggcgccgaaacgaccatttccctagtaattagatggatttatatttaaatcgcaaaccaatttaggtccaaaatcattttttaatactattcaagatggtgcgcggactaatcaataaatcgcgtgaagaacaagttgagcaacagcaagaagtttctatcgcaaaatcgctaagagtgtattgcattctcaaaatttaggtcattcgtagcctacaagaagagaaccgttcgttaaaaacattgtttcgacgtgtctgtgcgcacagcaataccatcagttctgccttactaatgttcgcagaagatcacccggacactttccttcagcatccgattcttttggtttgaaacttttgtttttcctattttgggttattttcatttgtttccgggacaggaatccgagtacttcccaaatttatcctttgtcggtagaaattttctcatcaacacccaagttttcctaaaaatgtaatcctctacctttcggcggttttgtatgtgtttttgggtctcaagtttcgagtgttttcattctttttcgggacgttttgcattttccacccattttcttaaccccccactcaatcgcttctctgccaggtgcagccgcaacaacaaaatgtccccacgccgagtcagctgcagttgttgccaactcgccatgacaacacgtcgtttagcgactcatggccaatactcggcggagcgagccaaagcctgacaatgcgtgcaagcgagacgtttcgaaaaacaactcacccgccaccgaatcttgggcttcatctgtttggcattcaagaagtatttcttaggatcacaaacaaacaaaaaatacacagttgcgggtttcactttactcaatcaattaactgttctagaaacattcaaatttaacattcttggaatcattcaatcgctcgaagaattcgctaatggctacataattcaaaaaatttcttagcttcaaaaagattgaaccaaaaaattcaaaaaccgactttcgaagtcaaagaatcaaaaactgactttctaaactttttttaaaaaagatcccgctatgggattgaaactcaaaaattttgcggacggcattccgcagggataaatcccgcgcgggatcccccgcacctggctctaaatcccccttccctcttcgtcaacaggaggcgaccatgcccggtggaactgctgcagtcgagaacgacgccgaagtgacacaggcgagaaaaggtgttttttgacgggcacacaaagttataaaacttaacgcattccacattgtgtgaatgctgattcactgttctgttccgagaccttggcttcggaacggagtccaaaatttgccgggaatcgaaaccaaaagccgggaatttgccggttatgagagacccccgaacatttaaacagcactaacgcttttcattaataggaaagccgagcccgaagaaacaccgtccgtttcgcaatgttttcaaagctttgggcgacggcgtgtcgaaactgaagttctctacgcgaaagcgcccagaggtttttgagtcctccataaacacacatccaaaatatacgattgatattaatttttggggagcagctcgttttcccctcccagaaatttataaaaaaactgaattttttaaaagaaaatatctcgaaaaaagatatttgaaaacttcaatagcgatttttaaaggtttatgatgaattgctgttttttctaaaaaaaattttaaaaaaattgctgtaaattttttctagaaatttactttaatttttcggggaggcgaaggtattgcaccctaattttggacactggcttaaaggccgctatttgccaatctctcctcccttccctcttctctcatgtgcagaagcagcagcacgggacgacactgtccgggacggatcagcgccgaccgcaattggcaccgactttcgatgcctcgattgccgagcagtcaacgttccaatgggcaacggaaggtcaatcatcgtctacgagtcaatgggcaacggaaaaacaggacgttggacagtacaaagaattgcccaagtttgggcacggcggtgggggcggccaccgccctttctgaatttcgccacgtgataagacaatgccatgaatttgcgctttacattttaaacttcaattaacttatctcattttctgcgtattttaatttcattttattctttattttcatttgcttgttcgcttatgtttttccttgtgtcttatggataaacttaattcttttccttttttacacaattaccgcattttccaataatttattgcctaggctaaaacaaaaatttaaaaaaaaatttttttttcatcacttaaattcttggtccgcgcatgtcctcatttgacagatttgtttgaatggaaatccaagttttaagtatgcccttatttcgaaaaaaaagaattctgcttaatgtaggactttgacctgtattttctggacaaaaatccaggacaagcaaacatggtttatcccatggttcattctgacaatatgtagctgactaagtttttttggttaaaagagacaaaaaaaataaaaatttgtccaagtcatcttcggaattggtgctttttggcaaagcctgtttaacaatttttttttctaaaatctaactccaaagagtgtcatttagaaaattccgaccatccaagtcccaattgcagtgtaatagaatatttaaaacacatgtttattcataagacggatataccaagcagcgagaaaaagcaaaaagctgatgaataaaaaatacgcaaaaagcacataaacaaaggaaatggaaaacagacaaaagaaaattatccaatgagagagactgtcccaaaaagcacccaattaaacccgaaagcactaatttataccataaaaacaatttatggtgtttgtctttggggacagcctctgaaaattgcataaaatggaaaaaaaacaatttgccaaagaaatttaaatgaaatgaaacgaagaggaagaagacttatgcataaaattccggcatttgccaatgttttcatcacattttcaggcaaccgggctcgtcttcttcggcgtgtacacattgccggcgccggcactcggcgagttgggcggccgagtccaagttcattttgtcggcgacacagtgtgagtgagacgagacaaatgggcagatggccaaattcaaagcaaattttaaacgccaaacttttttctaattgttaagataatcttggttcttttgttttgatgaaccaaacgttggcacactaataaaattaagtggaatttttaataatgcttaatttttgaatttttagttaaatttaagtgaatttagtggtctgaacaattttaaattttaatgatgagaagattatgtaaaatttagataagttctgcatttaaagcatgacggagaatttgggccaagaagtcgtaaaacatttttttaccaggtatggctctttttgctctgcccacaccgatggcacagaacggtgtctttcctgcgctattcggcgtccaaagggtacggtaattgaattggtttttactaattgttcgatcaaatcgggtaatcaaagagatattagcgattctgctccagtaattcgaacgtttgcaaatttttgatggtattttttaggttactaagaaaaattggttgataaatgcccccatttgtcggcttttcccctttttagcgttttcttcctccgattaataagggggaaaggagagagagtgcgggaaagagagaaacatgaaaggaaaaagaatgagagaaagcggaaagataaggcgatagagaaagggagagaaagagagagagagacggacgggggtaataccaggggccttatgctcgtctcgcggtttagtaaaccacggttaacgcgttaaccacagtttcatattttgaaatttaaaaataattaaataaaaaaaatataattaaattattataataattattttctctttatattatcaatattagcatagatttaattaaaaaaccccgaaaactatcaaatcaagaattggttttctaaaaatttttggccataacttttttaaacacagcaaaaaattttaaaattttgcaaaataatagggggctatagaatgatactaagaatgtttaatttggatacttcaagaaaaagtttgctgccttaaaattgcccaatta

SEQ ID NO: 4412 - DNA, 2245 bp, Heterodera glycines
  misc_feature (2057)..(2057): n is a, c, g, or t
  misc_feature (2174)..(2174): n is a, c, g, or t
ctgtaaagctaatgtaatgaacggtagcgctgatctgagcccggattcgtggtcagcgaccccaaaaaccccttaaaacttttcttcattaatttatatgacatatttaggcatctgaaaacgtatgttaaaaatacccggtaaacttaaaaagtacccattcttctactcgaaagaactcactgttttagtgaaaagtgctaggtaaataattaattaatttgtcataaaaaaaattcacccgttcaagacaattttcgggcaattcactgttttgacaagcggcttcaacgtcctcaatgcacgggcgacgacttgaaaaacaaaatgatgatgaattcattccatgacaaatttgtcacaaaataatgccaccataccttcttagacatcgttggcacaacagaacgccaggcggaagacgggcaaaaaacgggtcccattgaacacagacaactgtgacaatattgaaacgattaaatgatggtgaatgctttttgaattttaggaaatgtttttaaactttgtatagcatcattaatagggctgggatttttagttttttaactattttttctgcggatttaactcgacgaaaaatgcacaaaaaacacatttttagctcggaaattcttcgttttaacgccactactattcatcactaggaatcactattttgaagctttgccactaaaaaaaaattattttggaagttggccactaaaatcatttttttccactattttgccatttttttgtcactatttagttaattattttggggttttttgccactaaaaatcccagccctaatcattaatcatcattttttttcactgaaaaatactggataatatgcctgtttttctggatgtttttacatttcgggtttggttgaacaaagtaaattgcggtgtttttctttcgagttagaaaaaaaagaagaaagtcttacggccaccattcctacccctcacccgaattgtttttttaaacattcacgtatttgcaaaaatttttttttaaatcgctgaaaataaacacatttccaccatattttgtaccatggagattcgcgttgcacacaaaacatgggaccaattcatttggtgcaattcgttgctgttgttgttccacgacaccagggacagctgactgtgattgtgagacggtgttgctgttgttgttgtgctgctgctgctgcccatcggtgtccatggggtgttggtgttgctctgccgttgttgttgatgtacttgtacaacttgtggccgatgatgctgttggcgttgctgctgtccgtccagtaataacctggtcaaaaaaaaccaatggaggagggaatttcgggataaaattgatcaaaaaaacgctaaaaattttctaaaaaaaatttcgggcatgggaaagttattgcacccatataaaaagccatcagtcgcggacagaacggaccattgtcggcggcgacgtgtcaaaagcggatgatgctgccgccgccgctcctctgcctgccctcccagccgccgctgctgtcctgctcggcaacgaagcgcgcttgcgctgccggttgccgccactgccacccgttgctttgctgctgctcgccgacgactgcggcgtcagtcgctgggcgccccgccggcgcggcgatgccgcagacggtgctgcatcgcgcgcacaactgcacgtctccttgggcgaccggtccgcgttagtcacccgcagtgcatgcagcagcgtgcactgctggtcgccaacggactgcagatgtgcgaccagctggtcacgcgactcgaacgcacgcattgggcgccaactgaacaatttgggaaatttatggagtttccgtaacaaacgcacatgaaatttcttaactaaaagcaaatttttatccacatttatgtgtatgattttttaatttaaaaatgtttgactggctaatttttcgcaatttctgaaaaatccgagaacttccttaaaattatttttgaaatttaaaaacttagttatccttttttaaattttagacagacggagatgcttggcatcagggngtgtgcgaaaaccaaaaaaataattttcgaaaacgacacgaaatttcgcacacccctgcttggcatagtttttcgcctataaaaaaataattaattaaaatctattcgagaaattgnttaatgaattaaaagtttcatttctaaaaatatatataaattcgatcattttaggaaaaaaatcaatataa

SEQ ID NO: 4413 - DNA, 2493 bp, Heterodera glycines
cgcactttggccgaagggtgtacacctccgtcgatatgaggaaaattttctttgtcattagcctttttttggcatttttctcaatttgtcccatccctgggcccctccattgccattgcctgcagttccgctcgaaaacggtcaattgctggcgattggatccaatcaatgccaaaggctgatgatgatgatgatggtggtcctccgttcccggcagcatcattgccatcacaattattctgttgcgctgtcattgcagcggcgatttcggcccatttctgtcgcgccaactcaactccaacaacggcaacaacagcgcccgttggagcagtatttgcaacacaaccgccacccgccgaagacgacgacgactgtgccgtagttgttgttggcaatgcttgttgatgtttttgttgttgattgcgtgcaaatgccaaaaagtcagccgcccgttggtcaagtgcatttccgtggttgagaaagtgctccagcttggcattcagttgctgaactgctgtacaactcgtgcaccatttgagcccgtcagcaacggttttctgaggaggggggggggattgacaggatccgcctccgccggtcttttgctttaaaatcaactaactcacagccaactcgtgcagttcgacccgcttctgttcatcctcgccctccgcttcctctccctcctcttccggtgccattccctcatcaattgttgatgactgttcttccacaatcccttccgcatttttgtcgtcctccgtcttcgtgtccttttttgagtccctttctacctcctccgtcactttgtgatgtttttgttcatctaccgattgtttctgttcctccttcccatcctccccatttgttgcaatgccatttcccgctgtgttatggcatcgttcaatttgtcgccaaattgtttgcgcattaaccagccattgacagcgtgccaattcctgtgccatttttttggaaaatggcatttttaacattgcttaaactcaccgatttcagtcggtccaacccttcggcctccagcttcacattgaactcctcccgtgcctccgtgaccaacgcgtacagctcattgactgtttgttgtgcagcggcggcggcaaatgaccgctcgagtgccgcgtttgcgcgcgacttccaccgctcaacgcgatggcaaaggtcctgtgtaagaagaattggcatgaaaattgggctagaaaatccgcatcttgtcaaccaaatataaagtaccagggcttctgagaaggaccaggacccaaaactgaaccatgatttatgaaaaaaaatgctagggtttctagacttccagggactaaactgaaccaggccaggatttttggaaaaaaatgctagtgattcgagacgtacaaggacccaaaactgaaccatgatttttgttcaatggcaccgacctgaatgccatcttccaattctctgtcctcaagcagtgtgtcggctaactgttgacgaagacgaagcacctggaaaaaaatacaaatttagacataaatacacataaaatgaaaaccgaacaatcaaaaaaaaaatgttatatgtacaggagagagagatgacaaatttgcttacaaaattaacacttcaaaaataatttaatgccatttcccgcttacattttaatcatcatttgtcacgggttcgaatccgctcgagagatggtgagttttatttcgattttttaaaaacttattccatctaactttttttttcttgttattttatttaatgataaatttttgctggtcatttttaaaaagtatttttggctctagcatgagtttgaaaattttgtatgaattttttttatgaatttttgaacatttgcaattcgaaattgttcgcttcttggtaagattaagaaacctcggcatattcccagcgcgtgtccgccttttgacagcgtgtttgatctctgtaaacaaaaaaaagcatttaaggctgatcaattatcagcaagcaagcagtgtattaatggaacaaaatcagtttatggacagacctcagtcgaattttgcggttcaacattttgcgcacggcgttcgatgtgcgctcaaactgcacaatcgcctggttgatccgctgaatttgctcacagtgcgggaagcgagcagtgcgccactggtcggccaatgcgcgcatttggagcacatctgttgcaaaaaaattaaatgcaaaattttttttttaaatttttttgaaaattttctaacaagggaacattccgaactgtgactgctcagatcgctttaagaccacttttatcttgtagagcatattcgatttactattgccaattttcgggtttttttggccctgaccccaaaaatgatctgaaaaaagtgatcaaatgaaaatcccaggaaaaatttgttaatttgattatttttttcctcttgcattttaatgaccatatgtcatgggttcggatccgctggacagatgatgaattttttt

SEQ ID NO: 4414 - DNA, 3365 bp, Heterodera glycines
  misc_feature (2339)..(2339): n is a, c, g, or t
gaaaattggcaatagtaaatcgaatatgctctacacgataaaagtggttttaaagcgacctgagcagtcacagttcggaatgttcccttgtaagtatgcaatttaaaaaaactggggggggggacaagttgcggattggatgttgtctgtaaaatctcggtatattgtttgacagctttttcggctcccgaaaaaatgcgagattcacaatccagcatttcaaaaaccatttcaaaaagtatcatcaaattttttataaatctccagaaattgggaaaacgttaggcatatgtaatgtacatataacagtttacactcaaccaatgaccgaccgtacaccatgctttataaattacagtatcactgatgcacccttttccgatcacaaaaatttttttttttttttgctaacccattttgtgctacatttattgcgctaaccaattttcttcctctgtctgctttccgttcctcccccgtcgttgttgttgttgtcgccaacatttccaagccgttcatcgccgtttgtttcttctgcgtccattttcatcaatttgccatcagttgtgccgtcaatgttgttgctgctgctgctgttgttgtcgtcagcttccgtgctgggcgtcttagtcgtgtcgttcaacagttgcgtgaccgtcgtgcgccactcaaagaaagcggttgtgcgctccgtgagacggtggacaagcggcaccaaatcgtccaatgtgtagcggaacctttaaaaaacagcagagagatggaggtccatttaaaatgttttttgcactcgccttggaaaatttttctaaaatttttatgaatggccgggggggcaaattttgaaaatgttggcaccaaaaaagcacccacttcaagcagtactgttccatgctgcactcggtgcacaactgctgcacatgcttcgcgcacaccatgcgcccgtcatggcgacagcacaggccggagcagaacagcgtggtacggcacacggcacaggaccgctcgtcgtccggaatgtcctcgaagcggcaaaaagcggtggcacacacaccggcgatggacagacggtgccgaaagtcggtctcccgcgccacaatccaactcagctcgtccagcgtggccatgcacatcgctggaggggttggagaagagggtgaagagaatgataatggatttattttaccactttttgggaattttctggaaaaaaaagagagagcaccaccaaccaatgctcagtttgtgcgcaacagtgaccatcttcatcaccagctcctcatgggagaacacacaagtacgacccacatttgcgtagttctccaaacagagacgacccatttttagctaaattaaaaaaaaaaatttttttcgaaaatcccaaaaacggaacccaatcgggcggtgcaaaattgacagcctccgcacagttgaggccctcgttgaaaccggcatggtacgaacgtggaaatgtgatgacaaattcgcccgcattttgatgcactttaagcggggggggggggatcaaaaattaaataattaattttaattcaaacggggtcctagagagtggattttttgggagaaatgaaatcgtaaaatccggcaaaaaaaaattgaatttattcattttctggcattatgttctccttacccgtgtacacatggaggccacggtcgatcagaaattgcggatttctgtcaaaaaataataatggcataaacggcttcaaaaatgatcaatttttatttaaaaaaacaaatacatgtgagtgatcatttgatgaagcaaatccttgttctccataaacaattcaggtgccgattctgttgaaaaaatgaaaatttatgatcaaaattccatggaaaattccggcacacctttaacaactttgtcgaacagttcggcctcttcgcccggcactccgtaccaaattttgcgctccccccaatggttgtagttgatggaatacagcataaaatgtggaaggcggataattagattccaccaaacagacatagaatttttggcaataaaaattgttggcaaaggtatgaaaaaaaaattccagaaaatcccgagcattttcaattgcttaaattcggcgtagaaatgtggatttactatgcccatgcccaaaaacacagtcttacaattagaatcagtgggcgtacacggattcggaatcccgaaaattctataatttttggggacagttagaaattcgctgtatctaaaatttttggagcattttgaactgtttcaattcggcgtagacaaattattttgcccaaaaacaataaggaatcagacgagggcataaccggattctggatcncaaaaaatgccacaattttttggccacaaagccaccaaacagcagacacagaccagtggtcctcgacgtgccaacaaaaggtggagaacagcatgccaatgtacacccatgggatgatcatgccggagatgtcggtggtcatgtggcacagcacactctcgcgcaccttcggcaaattgtgcaaattccacggatggttggcgtactgttggcgctcccgcgcgtccgccgcaacaccgcgcaccgacgcgtcctcacggcgcggaaaaccgctgccgactttgcttgaaatgctgcgcaacaaattgggggaggaatgagaggagcacatttgtaaaatacatacggcattacaccaatgtttggcatggcaacaatttcccgtcaggaaattcttggtttttcccgtccccggaaaatcgcatttgtcgagcaataatgcaaatacatacacataaaccatttagaaaaatttgtaaaaaaagaggatttcaaagaaaaatccaaaaaagttttggatggaaaagccgggggagagggtttgaatatagggattagggtcagaaatttgtcaagaattttagtagttttttttaatcgaattgtcaaaatttcccaaaattcactctctccttgaaaaaatgccaattcatccaaataaattgttggttagagttttaaggcacaaattccctagagtcctgaattgttgggagaaattccgaaaattaaatttttttttttcttttttttcataagttggggaattccaagacaaaaaaaaactcacaggtccgccccgtacttcacttggacacccttgtcaatgtcgatcacattgcgccaaaattccctttccacgcggtccggtgggacctcctgaatgggaaacggtacagaaatttaagaaaaaataaaaaaaacagtcaacttacgcgtggctcctggttgaaatactgttgcttataactgaaacaaaaaagaaaacacagtgaaaattgacaaaatgttattccaaataaacaa

SEQ ID NO: 4415 - DNA, 1846 bp, Heterodera glycines
acgagtgaggagcaaaagtcgatcaaatcaatcatacatttgcatttacctcccacccaaagagtcgaagcggccggaattacagtgatgaacgaagcgggccttgacccgggcattgaccacatgttggccatggtattgctgtgattgatcaaatggcaccacacgaaaccaccgtttaggagtgcatcgacaaaatccacagttacggtggcaaagtgcgttcattcgtcagttttgcgggcggactgcccgccccggaggcgtccgacaacgctttgcgctacaaattttcatggagtccgcgcggtgtgctgctggccataatgaacccggcgcgctatctgttcgattcgcgcgtcgtggacattggcggagggggcgaagtattagacgacctgtacaaaatcgactttatgccgggtttttctctggtcggatacgctaatcgagactcgactaaatacgcggacatttacggagtcagcggagagtgccaaactttgctgcgcggcacactccgatacgaagtcagccaaagcggacaaaagaaagccggaagaaattttataattaaagggttttgtggaggcagtcaaagcattgaaagcgatcggatatttgtccatggagcggaaggactttctgaacccaatgcagggcccagacatggcctggaagcaaatcaccgcttctctgctcaatcagcaagtaatggtccagcagttggcggacattgcaactcaatgggaccaataatatatgtaaaaatgggcaattgagcagtcattccttttcagccggacattttccccgattcgctgatgaattttgtagcggaattgttgggaaaggagaaaaaacgagaactgaaggcattggacgaactcggactggtgagatcgaccacagcaacaaacatcctttgatttattcggccaatttcagttctccgagggaattccggaaagacaaatcacaccgttggacactttggtcggtcagggaaaccacctacgctcattattttaatggtggtttaatgcctcgtttggcaggtgccacacttggctaaagcattggcctatgaacatggcgaaagggatttggtggtgctgaaccacgatatcgaagcacaacttccagcggggacattcgtgagaacgggcgaaaaatgcatcgaaattggacgattccccccccccccccgcaggaacggcatcggatcagtttggtcgcttatggcgaccaaccgaccgaaggcttttcggcaatggcacgcaccgtcggatacacaacggcggttgtgtcgcatatgattttggacggtcagcaaaaagggaaaattaaaagagacgaaaaaacggaagcatttaaggggaaattcagcagcgagggatgcttagacccgtgtcaaaggccgtgtacaggtcataaataaggggctgacggacaaagatttagagaaccaagccataaccagggggcaaattggcaaaccaccgccccccccctttcaaacaaatttaacacatttcggtggtcccaatttatatcacacttaacaaattgtaattgaattcaccttaccttcgcccctcctccagggagtgggaaaacggggaataaaatgggcaaacaccaaaaaataatgcaataattaggcccgcattgcaacgactgaaagaatttgggatcaaggcgacaacaaaagtgagcgtaaagcaataaggaaaccgaatgtgataatgaaagtgactaacataattaatgactgaatagtcaataataaccgattcatttgattggatttcaatattttgtatggatgaaatggaatttcgac

SEQ ID NO: 4416 - DNA, 823 bp, Heterodera glycines
tttggccaattccgacagaatatctccgatcattttgttctgaaatagacaatgatttgttgcatagtaattcaagcagagcatctagccaataagaacaattacaattttaaaggccaaccatcggtggatggcattttcgcaaaaaataaaagaaaaagagaacaacgtacgacaaaaaataaatgcattaaaattacctggtaatgctcaaattgttgagcaatttgctcctccagcacaatctgtcgcgctaatttcagctgttgctcactttttccaccaaaattttcacggaaaatagcgagtttttcgggcgctgttttggacaatttgtcgacgagtgcgcatgtgatccaagtgcacttcctctcggccaaatctgtcaaattggacttcccggtgattgcggggtccccgaaacagtccaaaaagtcgtcttgtgccttaatgaccatttcccatttacttttgcctgaatgaccaattagttgcctgaaaaaggtctcctattcgataagcaattcgccttagttctgtttgatttgtcggtgttcgatcggccaaatgaaatccgacgacgagaggcagaaaaaaagagtaatggctggtcttgtgctcaacgatggaggcgtagcgggaccaactgaacgtgtccaactctaagagaaaggcggaattagtaatccgattgaaacatccaattaattacacactcaccggtggtgtcagtgtccaacatttgtccaattacggttttttgtttcgccttaaaagaatgaatgattcgaaaaaaggatcgccgttttttctagtaacaaaa

SEQ ID NO: 4417 - DNA, 4449 bp, Heterodera glycines
ccctcctcgattttccgccgtccattatgtcatcttcgatgatgtaaaaggtttgcagctaaacgcgtaaggtgaaggatgaaaattatacaaacaaattgagaattttttttcaatctgatttttttttattttaaggtttgccattgaaagtgccaaaatacgatgcattttattcgcattttttagaaataaaaattcaaaagctgagctagtcattttttgcctaaaatctttaacaaaatccgctaaaattcacatattttaccggcggagacgatcccttttttgaaaaaacagtacagccaaaaattaaacaccttgaaaaaagatgtggggtcaaaaagccaagtcaaattctgttttacgtgtgataatctaacaatttcctccttagttactgccaaatttgcacaattatgataaaaatgcttaaaataaagttctaatttccacaaaaaatggaggagtaaaaagttgccatttttttttgaacttttgctatggcatttccctgactgtttcttactgttagtaatttaacaaccaaccatttcaattgtcagtgacactctaacggcgctgtcaaattgttcgtcggaaggtgacgaattcaaagcctgcaaaaacatttcgtccattaaaatttgttaacttcatccacattagtaatacaacaaatattaagtacagaaaagccgatgaaaaccaaccaaatatgttctgagtgccaaactgctccgcgcaaattttccctctcccatcgtatagtcaaaaagccggtggatgcgatttcggcacatcgtcgcctcggcaccgcacaaatccttcgtcatcgaagtgaccaattccttccgaattgatgcgagaagcgaacggagcaaatgttgcggatttgcgatggcactcatcaaacgctgagaatttgcaaaagtattcatctcaaagagagcaaaagaaattgggtggttaaaagggaaaatgattaaaaaaataacggccaaagaccgctggaggaagaaaagttctcctcttctgaaacgatgactaattcagctcttcctcattagcactctttaataatttactatatatatgtacgacttctcttttgaaaaataccaatacaataaaataaataaattagaaaggactacaaaagtggcaattaaaggcaaagaaaataaatacaaaaacgtcccgaactgcatgtccaaatcactttttaagaccaagcatggccgatttattttaaattaaatgtatgaacactcaagttcgggatgttctcttgtaagtggttaatacaatgtctccctaatgacaagttgcatcggtggcaaaagtcatttaaaattcgaaatgactggtcaaatgctttacacttcagtcgtcccattcgttgtcctcgggggatggacttccttcggacgatgagtcagaatcgcccagacaatgctccattcgctttcgcaaaattgcggccacgtcatttgaagtggcaaccgctcgtttctcctccaattcctcctgctgacggactttcctcagtttgacgccctcttggatttgcatcaacagaagggagcgattgtccttaaaatcaaatgtaattttcatggattttttaattttattatttttccgttcttcttttacttgagcgccgctcgtgtttgaagatttgcgttgtaaatctttcggctgttcattctcattttgtccaccgaaagttttcgtcccttcgtttgcaattttgagagaaaaattgggagggggtggcggaggcggtggaggaggcgccggggcattgcaaacagacggagggatctgaaaagcaattgctaaacatttacttttcatttaacaatcgttccctctgttacttgttgaatggaatggagttggttaggacgttgttcaataacagcaacattaatagattgctgttcatttgttatgtgccgtgtcgtccctaactccgaagtttccgttgatccattggtcgatatgaattcgaatttgcttttcagcggttcattagtcggagcggctaaggacgagtttgtagacccgacgggagaagaggatgaaacggagggagcaattcgagggaagttccttgtgttcactgtggaagacagaatattttgaggaggcggtggcaattcatcgtcctcatcatccagaaacatcacgtccatcctcgaagccacagcatgtgctgcgtcatttttgcttgtgttatcggtttgtgtcgtgttcattgcgtcggcttttccgtcaatggtccgttctttcacgcgaaactgctgattgctattgccagaagaatgattggaggacaaattaaatggtgagtgctcgttaggctttatttgcttgtgatgttgttgggtgacagttccctcatttgttgtaaccattgacattccgggcggagggtgttgattgtgagtaattctgttgccaatcatcaaactttgtggggtctaaaaaaataaagaaattaccaaaggaatagaaaacgaacttggtattctgcgggaaagtgcaaaacatccgcagcaacggaagagacagagaaatgagccggaccaaacccatggcgcagtttgtgctgttgggatttgccattctggtggccaatttgtggctcaaaacgcgaataatccgtagaacgggaagacacgtggtgggcagacaaatcattatgttgcggaaaattgtgttgttgttgctgttgacgtcgtcgttgtcgagacggactggtcgaagaacggccttaaaaatgaatcattcggtgccaaaaacaaaatcacaccaaccggcccttttcttctcagccaatcccccatcgcattccttcaaagttttatttcgccacaattcgaagaagtaactcgggtcagtgtaatagcaaagggcttccttttcatcctccctataagggttcaactgattgagttgtggaggagggtcgcaattttggtattgttcaagcaaagactgcggcaaggtctgacgatcgagcgaatgttggtcgattatgttgcaggacttaaaagctttgcgcatcgatgcctcttccaaaccaactaaataagcaagacaaaatgcataaaagaataaatatcatttgaaacggattattgcaaatttaagaccttggtccacgactctgctcaaattgttagtgtcctgagaatttgagagtttttgtgaaaggcgttcgacgcgtaaaaacaaagtgctggagcgatggtcaattttgagcaccctgaacatttcttttctaataaattcaaaactgtgaacaaactctcgatgaatttcggaaaatatttgttcagcataacgactcaatgaactcatttggcgtattaaatttgccacagcgccatttgcgacacattgaagttcgtcttgctgaactgaagcaggtaagcgatgaaggcacacattaacaggggaaactgagcgagtgattaaaggcatttattctaaaacttattgatgaaaagactaacacaaatgctgtttaatattatcagtagcttcggacacggaaaatgggtactaatgtagtttgggtcccatattttttcaaaaattttcaaaatttttttatgctttaaatgacattaaaagtgatttctgtgtttattgggtacaattcagcgatttgtaaccacaaattaaaaaaaatatccggtcctccaaatcagggatggacgaaatttcgtttcgttttcgtttcgtcctacattttcggcactttttgagtttcgtttttgtctaccaaagttttttcgtttcgttttcgttttttaaattttggattttcgtttcgtgtttcgttttcgtcagagcaaatggacgaaaaaaacgaaaatatttacacccttaagtttttgaagcgatgtcttttttgaatattcaaaatttaaatgaaatttttttgaaaacttgtattattttctcaaaaattcgttttaaaattccaatttttccccgtcagagctgacaaaaccttaatttttctttaaaaaaattggccctaaatcacaaaataggtcattttttacaaaactttaaccaaattgcactgaaattttcaaaatttttcccggcgccgcctatcggcaccgccggatccaccccccccatcagttcccaaaagtttttagaaaaatcgcgccgaaaaaagctgtctgaaaaacaaaaaatcatagggtttccatgaatggaactcctttgcaaatttaaacactgactcaccccctcccccattcagtcccttcccgaattttatatgcatcgggattttaattaatttttgtataagaaaactttaaaaaaagtttttaaaatggtctaaaaattgcaaaattttgagtttttaaatgcgcggccgcggtttttttctgtgcgcgctccagccctggt

SEQ ID NO: 4418 - DNA, 2381 bp, Heterodera glycines
aattgcttacgccacaaaaaatccgaaatgtatgtggaaaaaagtgatcggtgactgccaaatctcgctttatgtgcctgtttgaaaaaattcttaagcgttttcattaatctaaaatcaattctgataaaattttaaaaaatttgcaaatttttgaaaaaatatgggacccaaactccattagtactggaaaatgtaccacatcccataaaataaagttcagacattttgacgatggccctttcggacaatgattttcgacattttatttcgaggattccaacaaatcattttgtcaaattaagaaatttaaaatttttttaattaaaaagaaaaatatctttttaaatttttttttttgaaattattgtcaaaacaaatttttcgatattcctactattatctcgaaattaccgatataccgatacatagatatacaaaatattataaaattattttagaaaaaactatgtggaattttagagagaacaaaaaaaattacaaacttaattatgataattcacaattaaattaattattattattctttttaagtttttgttttttcgtgtatttgatattaagaattaataatagatgttcgatgtgctctaaattagaattgtcagtatacatatttgacacattgaacattttctggaagttttgctttttgtttcgcggctccccccgtcttctcattctctctcttccactcattctttgtcctcttcctcttcttcttcctcttctttcgcaatgcaaaaaacgcattttcttggctctttgccgaaatcccttaattttgggtataaaatgtgcgacagattaggcaattacagagaaaaagtcaaacccctcccattccaaaagacaagcaacaattggcagaaagactcaccaattgcaaagtcgggcgatggttcctcttccggttggaatcctcttgaatgtttacaatattttaagaatacttttttttgacttactcattccaaaactgatcgaaccctctttaaatgatcgggtgattaaacagaaaataataatttaaaaatggaaaagaaaccgacccattggagaacttttttagcagatcccttcaaacaaaagtcagtcattaatttaaactccaattcaaattactcgattttggccttttttacttcgggatggtcatttggaggagtgtcggtgttttgctcagtcgattgccgtcgttttttggggagagaacgcggcgttttagaaacacaaaccgaaaacgggggaaaggtcaaatggcaaaaataacagaagactgaccattgtgccaaattattaacggagagcaattagaaagaattttaagagcaaagctaaaaagagaggacactaattaatgaatggcgaaagggtgctgaagagaaagtgaaaaaggcggaagagaaacgaattggcacgtgaagaggaaagaaacggatgacgaaatcattgagggaagagagaaaaatggggggggggagagagtgaaatattggaaaatgcgcctaaagggcaaagggaacgaaaatgtgtcaaataacagacagagagagagaggacaaaagagtgagagaattgaggagagtggcaaatgaatgagagtgatgaatggcattgggaggataaaagaaacgagtgaagaatgaatgtttggcattgggaacagctttttaagcgtgtcccaatgcttttatccgtccgcccgcccgccccctcaataaaaactgccgacttttcgacacatttgccaaagattaaccgcgggacaatgaatgaataaatggatataaatgtgtatctttttcccttttcaacacaatgctttggactgacaacgattggcgaccattcacagctgatcgtgggctgttttgtgttcatttgcttattcccattgtccttttgcttcgtctattagccgatgaattttggttttcaaatcggagaaattcacagaatatttttcagaacggcgaatggaaaaaaataaatccgaaaatggccgaaggaaaattggacaaaaacagaggaaaaaatgagccaaaggataaatgaaagtgacaaaggagcattcggattgataagataagaatgaatgttaaataaaaatggggaggtaaaacttgtcccagagcaaaagggcgcatcatttcttttctccgtttatggcgaacattgcgtaggatttctcaccccttcattaattaggtattactaatgagattcttccctcttatcttacgtaatttatacaaatgtttgtttgtgtgataagggtgttccgcaagccaaaaaaattggtggatttgtgggaaagaggaagtaaattcttttttcgctcggaaattgcttctttt

SEQ ID NO: 4419 - DNA, 4132 bp, Heterodera glycines
  misc_feature (36)..(36): n is a, c, g, or t
  misc_feature (42)..(42): n is a, c, g, or t
aatgacaaaatgatttccacaatttcccccgtcagngaagtnaagtctttgtggtaaatgaaattcaaaaggtttgttgaattatgtgcaataaatactttgtccttaacgaaatgtccatgcgaatgtttggcgcagatcaaatggaatgccaattcgttgttggcacagtccaatttgtagcaacgaatgcttgccccttttagaccacaaagtcggcattcggtcactttggccctccgcagcgctgcctcgacgtttatgagaccgccctaattttacagatatttttgctatattaaatgtaaatgataaaacaaaataaaattctcacgtcttccgccacatgcacttcagctgaccacaaggcacaattctaaaaaacgaattgtaaacaatgtaatgttccgattgttttttattcgttcaactgaccacgtgcacccatttgttcgcgtccacattcaaaagtcggcccgtcaaccgttggtctccgtccccaatctgttcacagaaggaacattggcgcgagtcttcgctccaattcattcgtttttcattcgtttgcaagtgaaccgctgcaaattgctgaagagaacaaccaaatggaagaaagtcaaggcaaaatgccaccgatttcacctgttttgtgccgtcgtattggcgcctgaacgactggacgagcgtcgtgtcgcaaatgttccagccgaagccgcgccatttgaatccgccgtcgtgcagtgcctgtgccaccctcttcttctccatgctctgctggatcattagcaatgcgggcaattccgacgatttgatcagaaattccctttgcgcgatcgcagctccgccgtcgatggtaactgttgcggcggttagtgtcattgtactgtttgctcccgaagttgttgcagtttgaacgatggaggccgaagcagcggcgccggaggaatgctgttgttgctcgccaaggaactttgcttggggtgtaaacccggcatttattcgcttggcaaaattatcggcactgatttgccggagagtttcgagggtcacctggtggaaaaaagtcattaataggtgagcttaattggtaacaaagttaaatgtgctaacattgtccacatatcgttcagccatttccaatgattcgacgctcaaaggtattcgaaacaaagccaagaatttgtagtagcattgcatcgaacagaaatgtatcttttcgtccttctgaaaagcgcaattttgaacgaccattttaaataccatttatttaacttggactattttatctttagacttactgattccgacagtaagcccagtcggccgtgagtgtcgtcaattggagttttgccaggcggaattacggagttgcagtgtttgcagatggttcctcctccgttcccttgcccattgtttctgttcgttgcggtcagttcagtccttaccgttgtctctccgatttcgctttttatcgtttgttgttgatgatgatagtacagtttatgttgttgctgattggtgctgttgtgctcggccaacgactggtaataaccaccaccgccgccgccgtcgttcctcggcgagtcgggcgtgtacggcggagtgtccaactcggtgatgtggtcaatgtgagggatgccgagaatttgacacaacgaatccacaaattcgtcccgtggcatcactgatgggtcaacggtgagcacaacgtccaccattcggtccaagtcccgaggttccttgaacaaaattgttgaagtttgtcggcattaatgcccaaaacaatggttgtgtacttcgtcaaagcgggaccagtgcggctcaagcggcgtctcttggcttggccccggggcacccaaaagggtcaccgatttcacaatcttcgaccgattgccaatttggtcaatggaaagaaagttgagcaatttttcgtcttcgtcgttgtttccgccggcagatgtcacagaaagacacgcgacgggagggaaatccttcacatcgtccgaattctctccattaacagcggacggagacggatcttcggtgtctcttaaaatcatttcaaattaacagtgtttaaaagggtgacattgcctatcattaatagggttcggaattaagtccaaaatttgaatttcagcaaagaagatgccgataaaaaaggttggaccggttaaaaggcaattgaaatcgggcaaatataaaattctattatataatttttggtttatttttcgtgattttttttgttgttgcctattttatgaattttttagttgactttttgttgattttttttcgtgacttaaattccatccctaatcattaaatagtaggcatctgatacattcatttgcccattttccctttctcttctcctctcactttgccaatgcgtccaaatcgacgttccaacaaatttcgcccattgttggcggcaaaagggtctcctcgtcgacgtattcgcgcaccgtttccaattcgtcgtaataatcgggcatgaacggcaatgtgtattcgccggtcgcattgccatgcaaaggcggctccgacccctcgtggtcagggagagcggactgatccggatacttcatcatctgcttgtcatttgcctggtactgctccatgtagttgttgatcggtggtatcaactcaacctgaactttaggagtagaaaatgaccatgttttaactcatttattcgcgtagaaattcccctccatccgtttttcttaccgtttttttgatgcgctcctgaatcaagtccaattcgttggtagtgtcgggctgactgcgtgttttggtctgcgtttgtcgcctctttttgaccttccctggacctaacaatgcgtataaaatgtaaaaatattaatctatatttaattggcatcacattgttgggcaatggcatttatgccgttgttggtattattttgttgtgacaggattttctgaacaagtaaattatcgtcagcaggtgccccgctgctgctactgctgtccatttttgcagcgacgaaaccaacgagaatatccacctgaaaacaatttaaaaacagttacaaatcgctgttttccccgcccattaccgtttcgtacacatctcgctcaagttgagtgcccaaagcagtgaatggcacaccgccaaggacggaagaacgcacattttccggcaaaggctaaaacagatacaaaaggaatagaaaaggaaaggcctagttggtggaccttcttccgctttctgcctcgtgttcctttcacttgctgttgctgtcccaccccaatgatgggtttttgctcgcccaatgttggcgttgtcactgtttgttgttgtcgttgttgtccgtgatccgatgtctgtgatgccactttctgctgttgttcaacaaggtgcatcgatgacaaaaatcccgatgttgttggctgttgctggtgttgctgagcattgcttgttgttgtgctgggtggtcgcgttcgttccgccacaactttttgttgttgtatttgcgtgggtaactgctgctgctgctgaccaaccaccatcataggtttctgctgccgttgttggctatgctgctgttggccgatcatcgacggatgttgtgtgccggtcatgttgcttgttgtcgtgttgctgccatttgggtcagccaatacggaagttgactgggcagagatcgcctgcgattgtttttgctgctgttcctttagccgttgtcgctgcttgtccaccagtcgctgctgcacttgcaacgcctttttcgcaacttcaaagttgttctgtactgctcgcacttcttcagcgtgtctgttcgcctcctccggtgccataggatgcgtttttttctgcaacagtcgctggcgcgcagcgagcgctctcttgtccttcttcaattgctcaagtcgtgcttcctgcactttgaaatcctgctccaaatccatgctttgttgctgacgcttttgggtatgaacaccacccgctggaagcattggtgggttaaaaggcaatgatgctacagccgaagaagataaattgtgatggtggattgtcatagatgttccagtcacggcattgttgccgcactgcttggacgggtcattgcagcaaagggaggaggttgtctgttgttgt

SEQ ID NO: 4420 - DNA, 5047 bp, Heterodera glycines
  misc_feature (11)..(11): n is a, c, g, or t
ttgctgctccnccttgaaagggtgcatccggctgttgttgtccaatcaaaacagagatgctgttcttggcgttggtggttgttggttttggactgctccctgttgccccatttgttgctgctggttgtgagcaacttctgtcgaaactgttcgtcttcctcgtcgtcgagttgttggacaattggcccggtttttcctcgcccattcaacgaatctgaattgaaaacagaaatgaatgtgcgtgcatcttgttgagtggttgaccaactcttgtctcttctcggggttcaagtctcgccaaattcggctgatcattcgaactctgtccgtccaaatcgggaatttgtccttcaaatacgtgtgatgcacctcaacaggaaaacgaaagaaatattttaaacagaaacatccgaaaaagggaaatacatttgcataaagcaccgccgcttttgtcgccttgtcccccaagggttcgtcttcttcccaacgttcagttgtaagagctgaagcactttgcttctgttgttggtccaccattttcccaccaccgtccccattgtcaattgtctaaatatgagtgagaatgcaacacaaataacatggcattggccaaaaagcacttgttgctgctgtccaatgggtggttgtggtggtgcattgttctgcaagaacacagccgtcgccgttgaggacgccgccaccattggcggtggtccgggctcgaacactcgactgggcgttcggattgatgagcaggacgagggcgagaacacctcggagacaacactgtgcgcaaccaaattggacgaactgccggcattgtaaccatctgaaaagaacacatggaaataatgtgccaaatatgggggagggcaattaatgaccgctaattgggtcgattgtgttgctactgctctcaacggtcatcggctcgtcctcctctccaacaattaggtccgagaagtcgagtccctccatgtccaatccgtccatgatgttctccaccaacggaatgtcgcccaacatgtccatctcctgctcggtgcgcaacagttcggccgaatgttcggacagttcgctggcaaatttggtgccgctgacgaccggcaacacctttttgtagtcgctcaaggttggctcatccacagtttgttccgccagtgttcggctgtcaaccgccgcaacaccgaaaaacgattcctgacaatttaatgtttagaaagttttgaaattcgagaatcgaaaaaaatgcaaaatagagatatcaaacattaagtaagcaaatgcacaacccacctgaatttgtggcgggtacgcatcctccagcagcggccttttcagttttcttggcctgcgaatccgcggctttccatttgggcccaagtcctcctccaacatgttggcacccatcatttgttgctgttgttcgtcttcggttgagttcatcggtgtcatattggcaccgctgcccatcaaaaagggaagtcggcttttcggagtgcgaacgtaaaatccgccaacgcccattttgagcattcgtcggcccggcccaccgccgcgtccaccaccgctgccacagccacggcctcggcccgcaaaaacggaggcgatcaactgctcttgcaattcgtcgctcaattccatgtcatcttttaaataacagagaaatggataattttatcagatttaatatgtgttacatttaccaaaccatttgccaactgtgtaaaagtgtgccgtccaaaaattactcttacagttttttacgattttctcacaaaattgtctcattgtcagttccagtatgaaagtgacactctcccccgtgtccattttggtgtggtttttcagacagaaaagactgtgttaatccgacgatcgatgtcaccatatttcattcgaacacattgaatgaaaaccaaaaaaccgacatagccaattcgaaacaaccttgttcacatgagacggaccgagctatgttcccgaaatgctctccaaaattggcaagtccggcaagctttcgaatgttagaaatgccctgaatttggtcgaccatcgatttgctgaccatcacattgtcaaccacaacggggacatttgaagcgtcatcttggatttgggacaaaattgtaacagtttgcaggcgtggaaaacaaaacttacggaatatttgaggtcgacagaatgaacagcgaaacgcattttcggccgcattttccgcctgttcctccgttgtaaggccctcacagcgggcgtgaagccatctgacggatttctcacatttacaatatagtaaaaattgagagcaattcgaccctctcccccggttatcagtttcccccccgcgtcgtcccccgcccctttttcataattccaataaaaaatcgaatcaaaatttttttcctaaaatctaaaaatttatgaaaaatttcctaattgtaagatttttgaaatttatattgaagatttttcagaaggggggggggggggtgaatgaagtgcatcctataaaatcgggagggaagcgatgcttttcaaattcaattttaaggataattaacttccaatctaacaattaatagattaatcacctgagacagcgtccgcatttcaacatcaaatctccaatttcgtaggatgcttggcacttcacacatttgcgcagggaatagcaaatttcgcagaacccttccaaccgctgcatatcggagccaagtttaatctgagcaccgcagcgagaacaagtcgcgcacctttgagtaataaagaattggaatagtctttttaaaatcagagatttatgagtaaattactaaaatttaaattatgaaaaattggcacttaccatttacaacgccaggaaccgcgcgggatacaatctgcaaagttagagtacgaaagagagtaaaaagccattttcatttacacatacccaaaggcggttccaagcagtaagtgtggtaggaaatgtcgcattcgtcgcaaagcaacaaattcggttcgtcctcgccactgccgcaaccctcgcagacagtgcagtccaaacagcgccatccccgcttcatcacagtcggattcaactgagaaatgaaatttgattttaaccaatttaattggaacaagagggttttaacaaatatacaaaatcaacactctcataacttaaatctacaattatctatcgaataaaaggcccgtagcaagagaggagggggtttaaaaattttatttaattttcttgactaaatgctttaaattccaaaaaaatcccggcggcgcctatcggcacaaccggaccccattacactattttttaaatttggtcagaaaatggcaaaatttagtccttttattgaggaaaaatggccacaaattctttttttgcttttcggcgctaaaatttttacaataacactgaagaaaatttttttgactcgaagggcaaaaaaagtctttggattcccccttccaaattttttttgatacgagcttgaatgaaaaaacgttcaccgatttacaaatggtaaactgaatgaatgatcaccaccgactttgtcgtgcattagcacacaataggtgtggaagctttgggcacaacacgagcaggtgatcattgagccttcagtgccgcgtccgatgctgccacagaccaaacacatggacacctccgtcatgaatttgtcctccagactggtcacaacacatgtccggatgtactccttgtccgtcacattgctcgaccctcctccgtcctcctccttccgtcgctcgtccaccgttgttgccgaactgtgctcgcgttgcgatgccgtcgtaccactcgccgttgctgcagctgctgccgtcaacgcgttggcgtacatgctgaccaacttggagcctcggccgcccccggctccagcgggtcgtcttccgcggttgccgcctttacctatattccctttatacgagaggcttttaaacacaatgctctccgacctttcgacgcatttcctcggctcttttttccgcccggcttttcctccgctttgaaatgggcgtcaaactttgctgtgtaagtgctggcaactgaggagggtggcttcccaaatgaacgtgtccgcatggaggtggacgattggcggtggagcgtcgcggacgtcggttttctgcccttcccgcgaccccctcgggtggactcagtgcgccgtacaattgtgctaaaaaaatagacagccataagtgaatgagcaaatgaaaagcaatttcaatttaaattaactaattaacaataagtgtaaaaaagaaaataaaaaacggaatatttttaattcccaattcttctgctattttcaacaaaaattccaggaatccggccaaaaagatgcaaagaatgcactaacataatttaaaaccatcataataacctacccagggggatggtattcgtcgttgtcactgcactcgccgtcctggggaaacagcggagtgctgctccgactcgttggcgtcccgctgctgggccgtggcgacgaagcgcagcctccggcggagaactgtcgctgctgttccaccagtgccattcggtcacgcacggcgccgcgagaagatggccttgcggcagcgcaaaagtcgaccattcccgcgagcaaagcggcggcgtcgcattgagtgtcgccggccgtttgttggtcgtggccgacgcccgcgctaagcgactgagaacgcatggaatgctcgtcagcaggcgcagccgcagtgagttcagcagcagcgaccgaggacgaggagagcaacgcgtcgttggcgaccagcagaggggagaatgcactcttggaacaacacgcggcacaagtgttgggctcgaagaacgacgcagtcgctgcatccgatgcaacacaatcggcatggacacgcctaaacgaaccggagggtaaaatccgtgaaaaatttgcctaaaatgtttgcttacatgtaacgttgagataagcacacaaaaaaagttttcgggattttcgtgcctataatgcgatttgtacttaaaatggaaatcataataagcgttaaa

SEQ ID NO: 4421 - DNA, 1010 bp, Heterodera glycines
ttgagcgggagttgcaggaacatgccaacccgcgcacttttcttccactccccggcactttcgacggaacaacggatttttacaattatttgaaatccttcaatcttgtggcaactgcacatggctggaacaccgtccgctgcgttcaaattttgcccttgtatttgcgcggttcggccaaggccatttatgatggcttagaccaaaatgtcaagacaaactggaaggatttagtcgacggtctcgcggacaaattgaagaaagtctcttccgggctgatggcacgacaaaaattggcgcagagaagacaattcgccggcgaaacattggacgaatttgcacaggaaattcgaagtttggtggcaaaagcctacccggacaacaccttggagatggacttggccaccttggctttgggtgatcgcgagaatgaagtgaaggaagaaaatgcaaaacggattcagcaattccgatcggaaatcgcgcgcgactttttcagagcgaatatgctcccggagataaaagagagggtcatgtacatggaggaacctcaaaacctgatggaagctcttactcaagcaaaacgagttgagcaaattcaaggaagcttggcgaatgatcagtggcggatggtgcaaagcagcaaaagcgtataaatgaaatcccgtggacagaaggaatgctagttctgttgcgaaaagtcgacaaaaaacataagttggagccgaactacaaagggccatatcgcgtaattagaattgagaagccaaatttgttgctaaaaaagttaaatcctgacggcacagaatttgaggcccatatggacagatgcaagccatatttccagcgcgaggtagaagagagaaatgaacctggcaatgaaataaaaacgagagcgttgggtgacccaaatttggaggaatctgacgacgaaagtgaagacgaaaaaacagctatagctttcttgagaacatcagacactgacgaagagtcaccaatgatgcttttga

SEQ ID NO: 4422 - DNA, 3303 bp, Heterodera glycines
tattgacttctccgaaaattatgagccctcaataatcccaagaaaccgtgtccaagcccattgggaaatatattcgggaggacaaaagccttacatcacggcatggctattcgaagaagagttacaaatttttgtagaggaagggacggatcgaccatacatcggtagtgaaatgaaaagacttttgaggcaaaatggtaaaattacggctgaaaatgacatggccatgttttggaactcgtttgaagagaggggacaaacttgggatgaaatgattatgccgattgttgaagtcactcatcgggattcttgggactttgctttggaaaatgtccaaataaactgtctaaagctaaacaaaaaggaaagattcaaaaaaaatgatgccgaaatattgtctactcataattttcaccaatattctcaccaatattcgccttatcttcacccattttcaaatttcgaatatttcgaccgtccatttcattgcacaacaaataatttggacaaattttccgccattttacagcaaaaacatttacttttataccaaatgtcacgccacgaagcttttattcccgaaaaagctcgcaagtcccgcgaccaatcgtcaccaactccgcccccgattttggtgtcgatttcgtcggacgaatcggctgaagaggcttctgaggcgggaaatcaactgaaacaacaacaacgtccggtccgaccacaggacggccgcctgcacgagttttccatgaaggaggtccgagtcctcagcacgacggatgagaaagcaaaggaatcgattcgggagaaggagatccaggagcttaagcaaaaactcctgcttttggaggccgaaaaggcaagtgatgcgcgcaaggcggcgaaagctaagaaagaggcggaaaagcgagccaaaaaagaggcggaagcgagagtcaagcgagaaatggaagcgaaagcccgtaaagaggcggaagaaaaggccaaaaaagaagcagaagcaaaagcgcagagagaggcggaagaaagagccaagaaagaggcagaagcaaaagcgaagagagaggcggaagaaagagccaaaaaagaggcagaagcaaaagcgcagagagaggcggaagaaagagccaaaagagaagcggaggaaagagcgaaacgagagagcgaagagaaagcgcaaaaagaggcggaagcgaaggccaaaaacaatctgagggctccatccgagataagcctttgtgaggatgagttagagtgggaagaagcggaaaaaaaagtgctaaatatattgaaaaaaagcagcgagatagctaagaaaaaagaagaaaagaaaggggaggagaaagttgccagaggaataataagaaggaaacttacggtgaaagagaaagaggaaaaagccaagaaagacagtagtgaggcagcgaaaagagcggaaaataatgccattgaagaaggaagggaagaaattcggaaaatcgtgagagaagcagaagaagaagcaaaaacaaagaatgagaaaatcggtgaaagagggccattgataggggagaattcaaaaaaattgattttggacacaatggagcaagaatatgtgccaggaaaagtggtgggctacatagaagacccaagggaggaaaaggaagaggaatgggatatggccagggcattgaaaaaccgttcaaaagaagacgaagtgcgaataaaaaagagagagcaaagagaagaggggtggaaagagctaataagcggagaaagaaaagcgaagggaagagaaagaccgaaattggtggaaaaattcgtgaaaaatctgttgggcccagctgaaaacgacgtcagccgaaatcccgggatccccccccccgaaggtagccgcagaggcccgacaccgattccttgttggaaccgctacaaaaaaaggcctcgcttcgtcagtccaattcgaaacatcagtccggtccgaacacgccaaagcacagttggaacgcagacgacaaacgcatggcccagctgcacaggagatgtggtggaacaaatgcaactgatgaagacgaagctggacgaactgatcgccgctctcaagaaaagggaggaagaaaaaaacaatggaaacaacgagcaaattggcgagaaggaagaacaacagaaagaaaatggaaaataggaaataggaaagggagtaaaaaaaaataaataaataaataaataataataataataattaattcttttatctcttatttaaaccattttactcaaaaaatagataaatcccttttcgcttttccaaataacatcatactcatttaaacaattattttgttttccttttttcttatgttccaatttgttcaccaatttgtccttttacttctctaccttatgccatttttccattccaattgcgcactcccctctcgccctcactctctcatctctctctctctttctccccccgccccaccgatcggaaatccactaactgaccaatttctgctgaagccaaaacagagggccaaatcagagccatcaaaagaagagccgaaacgacggtgaacaaggccaaacgcatttgaaaattttacgccgaaataattcactaaaaatggaatagctacaaaactgaggggaaatgaaaagagaagaggggtttgaaatgaacaccaccagaagatattttgcaaatgaccaacacttttgcatgtcgaattatcatctttccacatctaactttttctgctacccgaccacaacaacgatggagcggtcggtcgtcggttggggcagggggctgcatctctttgtctcaaaatcatttcattttctccattttctctctctctttaacgtcatttttcttcattcttctctctgctttttccccttttccacatcgctttgttatttttgccgcgagggcgcggcaatgtcgtcggtggggaatgtgatgaaaagatggtcattgaccggggttcccctttggcttggagttcttcccccttcctttgtgtcagcccctctcatcactttttgtctcctcaattgaccaactgcccctcccctttctgccaccctcaattcccctggcccgttcgttcattcattctattaattatccaattttgttcgcttggcttggtttttactcaacaaataaaggggacatcgaacagcgaatttggggatttggtgttttgggccaatttggccagcccggggctgcgacgaggggccccattttgggtgtccccgagtgccaacagaccccagagtatagggcattgtcaccattattataatgttatt

SEQ ID NO: 4423 - DNA, 3750 bp, Heterodera glycines
cccagtcggcggcgcccagtcgacccccaccgaagaaaggagctcaaaaaacgcatttctgtgttatatttaatcattccatatgcactgtagttctctagaaatctttatgttccttattttctgatagttattatggggggggggggggtgtgaagcctaattttagagggaaattttcgcgcattttgtggggatgaaaaaaaaagttttgggggtgccaaattttaaaaggtttgtttgttttttgggtgatcattggtggggggggggggtatacagcagcgctgtggtgtggtgatggatgagaggtaaagtgagagatagagaaagaaaaagaggcagaggatgagataagagtgccgcggggggggggggggatttgagagtatgcgatgccaaagtggtgtcctttcgttgaatgacgcgcggtgatggagggatggtcactccgagcaattgtttggcgtccgtaaaaacggagtgacctcaatggttggggggtctactcgcttttgacgactagagtgacctaacaagggggggattgattctggtgagtatgagttcaccactttcattattttctcttttttttcatcttacgaacatttggcttccccttcccccattaagtttctttttttagaatgaaaaaattgacgaaattgcaaataatttgagattacggacaaaaagggccgctttccaggtggcccgtggaacggacagttttcggcattggagcaaaatccaacttcaaagaggacgcggtggtgcgacgagccgacaacacattggtcaatgattgggaaaaacataggaggggggagtctgaaaaaggcattttttcgtgtgcttttccaaagacaaataaaagttttttgttgtttttagtaacgtcctctcccgccgcttttccacaatgatgatgaagccaaaaggctgtggtcggcaagcgattgatgaggggttttaaactcaaggggggagggggtcacaaaaatatgatggtattataattttgcgattgttaagagaatttttttgagggagtgaatgatcttaaaattaagtttttttttacagttggccaatgtgtgttcaacatcaacaaaaaaaagggccggagatttcagttactttaattattaattagaaaaattattgaaaaaaatccacgcattaccatatcaaatttatcgcagtgcattgggttcagccacgccgagagggtgtgacatatctcgtggatacaaattctcaccagattatattcattttcattttttgcagcaatgaactgctcgtcaaatttttttgattttgccgcaacttttgtccccgttttttttgcctgtaaacacgccggaacagttctttttgctttccaagcaaaaaaggttaggagaaagctgacgataaacgctccaatgtacgcggacgtagtggaaaattgcgagacgcttaggatgatcggctgctgctgccagttcattccgttgagccttccgccgatgctttgtccgatggtggcactgtccgtgtcgggcattgtcatcctcagtccggtgctaaagcattggttaatcattcgaaatgccaatttcagtcagtccgtacagattgacgcagttccatctgctgttgtggtgaatcgatgccctgtcgcttgcttccatttcaaattctcgaccatgcaaatttcctctttcaatttcattgtgccgttccgcgtattgttcatctgtcgaagaaaggattttttaatggattgtcaaaatcgttctccccacgggttaccccaaaaacgacaatgacaaaaatggtgaaaacgacgatgaatggtaacgatgaaaatttctgggagggggcctcattgcatttctgaataaaagagatttttgtaattataaggaagttaactttttcggtgtttagaaaggctaaaagaagatcagttttatttaagattgaccggtcactagttaaacagcctttaaaatattgttatatatattttttaggtttaacatttgagttttgtaccagttttgtgggagatctgacttttggggttattttgagattagtatttacggccttttccctagaacaaataaatggtgataatgtgaaagaaatatcgtcatatgaggtagataatgtcatgggtatcgcaggtggatgagcaacataattggaagtttttttgggaagtggatgaggtgtgggggcattatttttgtttgagtttgtttgttgttgttccaaaaagcccccaaacctcaaatcattgcacatggaagtcagttttttgtcggatgaacatttgtgatcagagaaacagtcggcggaaacatcgcagtgctttttcctttgatatcatcccgcagaatcaggcgatcattgtagatgatgaccataaaccatggttaaaaataagatttttgaaaaaacggcttttacattgtagagacaattaaaaacagagctgccaaattttcaatgcatatttggccaataaaaagtcatcattttgggtcaatttcagcattttgtgatatttaattccaagtaaaaaatcaaaaaaatgtttttttatttgctgatattttttaaaatgtctttttcttctaatttttgcttgaaggctgtgccaatgtaccacgttgagttggctcattcacacacgagatctctctctccccttcttaggcgaacctttattttaagaaatatgttagacgtaaataattgaataaatgcttgttcattatgcaattcttataatttgggcccagatttgttggattttcatttcacaataagtcgaaaaaagcacgcttaaggatggaaaatttttgaaatttttttgaaaatacggctctaaaacagtaaaattttggaaaaagaaaccataaattgcgcgtatatttttgcaaaaaaataacaattttccaaaccgttgaagttaaataccactttaatacaatctaaataaaatattgagttgttaaaatttaatcatgaacgaccattcaaaaaataaaattaaataaaaagaaaaggttgaataaaaattaatatgaattgtaatgaaaatttcatgaaaataaataaaatcatagtcataagaaaattagcataagtaacgaatttagtaatgacaaatcaatcaacaagactcacttaatacagttcaataatttattaaaataaaatttaattatcaatacactacttttttaaatgtttaggagaaaatattaaggcaccgaaaaaattcccggtatctgaagtgagatgaattttcatatattggcctatattcccaagggtcaatccttttgcactttacaagggaatattgaaaaattaaattgaattctcattatttcggttatggtaaatattgttaattctcatcgatagaaataacatttagtattatcacatatcattttttgtattctaatgaaacgttaataataaatgtttcaaaaataaatcaaattaaataaattctttttttttaatcaatggcttaattaataaaaatattaaaagtttacatattcttttcttattaattttaattaacttattaaatcatatttgagcaaaaaaagattaaaacgcctgcccttaataataatataagatgaaattgtttaataaaatactataatatccacttaaaaaataatattttcaattattagtataattttattaaatatttttttt

SEQ ID NO: 4424 - DNA, 1429 bp, Heterodera glycines
tggcgctggtggcgacggtgtcggcgctggcgctgctgtcgacggtgtcggcgctggcgctggtggcgacggtgtcggcgctggcgctggtggcgacggtgtcggcgctggcgctggtggcgacggtgtcggcgctggcgctgttggcgacggtgtcggcgctggtggcgacggtgtcggcgcacggacagggggcggcaaaaaatctgttaatcttatccaatttggaattaattagtgcttcagtttgtgtaaagaaatgctattatgttaaaaaattctcggtttttttttagatccggatcgattaccctcataccatttttctagggttgatattacttgtgtcgcggttgatctgccctttataaatcctaattgttgttcagaaaataaattgttctttgaaggaaaatcccaaatagtccaaacaataaatttttccataattttgcataaagaacaagttaaggcgattggcctgtagttcatggggttacttttgtccccttgtttatgcaaggggataataatcgattgtttccatatagtgggaagctttcctgtatcaagggagagtctgaaaatttcagtaacaaaaggagtaaacgaaagaaaacaattttttaatagtctaaaggtaataccgtccggtgatgtgttatttctgttaggtaaagttctaagaactttaccaacagaaataatgttaaattcaacgtcgtttattgttggagaagaaaaagaagtatcaaaatcaagagaataattatttacaatataattttcagaaaaaattttcgcaaaaatttccgctttagaaattgagtcagaaataaaagaagtattatattgaatagctggtggatcttctactggcttaaagtattttctaagataagaaaataatctattcttatcaccggatagtattttattttctttacgggtttgaatatttcttatttgagtcttaatatgtaaggagatacttttatataaaggttcatattttcctctattttctttcattagcttatatagacgtgctttttccctaattgaagccaataaatgcggtgggtaaaagtttttggcggacttaatagataaaatagtttcaggaatattaatttcaagatttcttcgaacagaactaaagaaaatagcatatttatcctcaactgtataaaatttttgtagtagttgagggagaaatgaggataaatatgcatcgaatagaaaggtattagatttagtgtatttcctaagaacaatttgtttcttggttgcattttgctttaaaacacaaaaatcaaaaagaattgttagaatgatctgtatctaaaagtccaccttttacttctaccgcattaattaagttccgttttttgttgaaaggattaaactaagaaaggattgttcccta

SEQ ID NO: 4425 - DNA, 3361 bp, Heterodera glycines
gggttgggggtcaattccctaccgccaattccctaccgccaattccctaccgccaattccctaccggccaattccctaccgccaattccctactaaggcatttgggccatctccgtaccaaaaaatttttcgaaaattttcggaaaaatttcaaaaacagaaaggggattttcaacattttgatgtttctcgtgaattataagacaataaatttttgtttaatgttgcagagaagaaaatgaaaatacttctaacaaaaaaagaaccgtacaaagcttcaaaacaatgaccattcatactttttcacaaatcgaagtaaaaattttaaaatagtgttttgtctattttagcagctttatccagtctccggattcttaaattggatcgtgaattttttttcgaatttacaattgatttcaaatcgctttgtaggacttccaggggcccgaaaattaggaagtaaggccggggaaatttcatacaagcaagtactttacgaatccgaagtccctaaagctccgggattttgagcccggtttcggattccccgggagttgcggaaatgggtttagaacctatttttaggagggttcaaaactcgaaaaattgagagatttgacacttctaacttttttaaaacgatcgaatcttgataaatttggtatcatccgaaagctcttgacgagctgtctaaaaagcagtgaataaattttcttgtgtgttttaatctcaatgtttatcaatattcaacacttttggtatggaaatggcccaaatgcctttggcggtagggaatcggccagtagggaattggtggtagagaattggccggtagggaattggctcgatcccattataaagaatcaggcgaataataataatctaaataaaagtgaaaataaatctaataaatctaaatctaagagttaaaaaatggtccgccaacgcttccatataacatttgtttcatgtccaattcatccatatatagacctactcacgcacacagaaaaattaaattttagcacagaaaaatgaatctatgggtaagttcgatataaatgagaagatatgcaaggtaacaaataaataatttttttttgaccgtaaaataggtaggtaatttgaatttggcgctattaaatgtgatttatttattaaaaaataaaaaagttaagaaatttccgctgacccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggcgccgaaatttcaacatacatcttttacgataattatttattttaattttagcttaaaaaacagacatcattcagtattatttataagaacaccaaaaatggtacgtgttttaatttagtatgtaaataagcgcttactcgagttgttaagcgtgaagtgatctctattcatgtgggacaagcgggcgtgcaaattggaaatgcttgttgggaattgtactgcttggaacatggcattcagcccgatggaaaaatgccatccgaccaaaacaaccaagacgattcgttcagcaccttcttctcggaaacaggcaatgggcgtcatgttccgcgtgcggttatggtcgacttggagccaacagtgatcggttgccatttgttgtttttcgttggattatccgctgttttagacgagatccgcactgggacttacaagcatctcttccaccctgaacagctcatcactggaaaagaagacgcggccaacaactacgctagaggacattacacagtcggcaaagaaatcatcgaccccgtcttggatcggattcgtcgcatcgcggataactgcaccggacttcaaggctttctcatcttccattcgttcggtggtggcactggctccgggttcacatcgctgcttatggaacgtctctctgttgactatgggaagaagtctaagctcgagttctccatctaccctgctcctcaagtgtccaccgctgtcgttgagccgtacaattcggtgcttactacgcacacgactctcgaacactctgactgtgcatttatggttgacaatgaggccatctacgatatttgtcgtcgaaatttggacgtggaacgaccttcttacaccaatttgaaccgtttgatttctcaagtgaagcaatagctaatgaatgaatctgaatctatcacattttttaggttgtctcttcgataaccgcttcacttcgatttgatggtgctttgaatgtcgatctcactgaattccaggttcttttgtagtctgctgtttcttggatatcaattattccattttagaccaatcttgttccttatcctcgaattcactttcctcttgcgacttattctccagttatctcagctgagaaggcctaccacgaatcattgtcggtttccgaaatcaccaacatgtgctttgagccgtccaaccaaatggtcaaatgcgatccacgtcacggcaaatacatggccgtgtgccttctctaccgaggtttatcaagcctttatacaagtcggaatgttatgtttttaggtgacgtcgtcccgaaggatgtaaatgcggccattgcttcgatcaaaacgaaccgttcaattcaattcgtggactggtgcccgaccggcttcaaggtcttgaagatgtctcgtaatctattagatattttattccaggttggtatcaattatcaacctccgactgttgttcccggcggtgacgttgccaaagtcccacgtgccgtgtgcatgttgtccaatactaccgcaattgctgaggcttggtctcgtttggaccataaatttgatttgatgtacgccaaaagggcatttgtgcattggtacgttggggagggcatggaggagggcgaattctccgaagcacgtgaggatttggctgccctggagaaggtaatatttgcattagggaatttatcggcgctagtgtaaaagtgggtctttttgaaaattttttcaaaaggggggagggacccttttgttttgcaaaatttttttgtgatagtcacaaaaattattctctggggtttttggggtccccgatcacgaatctttcaattattttgatcaattccgatttcctaatctaaatttgaacaaaaaagcataatttgaaaaattcaaaatttcgatttttattcgagttcggattagggattagaaattagtcaaaatacatgtcagattcg

SEQ ID NO: 4426 - DNA, 2279 bp, Heterodera glycines
  misc_feature (2070)..(2070): n is a, c, g, or t
  misc_feature (2191)..(2191): n is a, c, g, or t
  misc_feature (2268)..(2268): n is a, c, g, or t
ttttttatcacaaaaaaattttgcaaaacaaaagggtccccccttttgaaaaaattttcaaaactggtcacttttacactagcgccaatttatcaatttaataataatcctttgatattttaggactacgaggaagtggccattgacactgtggagggagatggcgctggagacgacgactattgatggaaaacattgttcgattaaattatattttggtttggaaatgttcttattgtattgctttattgagacgtaactgctttgatgctttttatataaatatgcttatcttttaactgtactttttttctgttgtaaaaatggggtgactagctcggtccaaaattgcgaaattaccatgaaaattgccaaaatatcgtcaatctcaaacgctacattaaatgactacctaatagtggggcgttacagcgtttcacggttaaaaccttataaggggacataccggaacgagagaggaaaaaagcgaagctcatttgtgagttgcacttttgtaaaaaaatgggtttttgagccatgggttcaaatccgccggactacaaattatttaaaaattgggtacttgtgcagtttacgccccataaaattttttcttaatgtttttaaaacaattacaggttttagaggtcgctgatcacgaatataaaattagaatcgtgctatttcgaatcccaaatccgaatttgtaacaaaaataataacaaagtaaacaaagatgctaattcactttaatattaagcttataagaatgttgcttattttccgcttaatacgttttatccatattgcagctatattaataatctacattatgacatttgaacaattttaccacacaaacgctttatgtttgttttaaaaatttaaggggcgtaaactgcacaagtaccaaaaattgtttctctggctttggacagccccgatcaagaatttgacacccatttcgccaatttcgaaccaatgacctgaactcagacaaaaatacaaaatttgattcaagaaaggaattagtgattaaaacggatgatcagaaaatgattcacaataccgtatatgctctaattatagcccagtctctattaatcccgcagtctccaattatccccccttttctgaggaggttgaaaaataatcccccatgggctataattagagcatatacggtaagttgccttgctttaccaactgtcgctcctgcaatggcataacttatatgcattttcatacctccagttcgatacgttattaatagcattttttgcgcatatgggagtcattttttcacgctcaatccctgctgcctattcttaacttcaacaacaatttatttcggaatcgcaatcaacaaaaacaatgaaaggaaaaatcctttatcatgcgaagtcagtttctatgaacgaggtctctctttctttccacggaaaagtgcgagcaatgacgtgttggcaactttgactactttgaaacgaactccaggaatgtctccaacggcatgtccccttttaaaaattcatggctcactccagcaaaaattatcagcaaaacgtactgcggcacacttgacaacatcgcctctctcaacaattccaacgaaacgacaacaatttttggacggcgcagcgcaattggacatcacagcactgctaaccagcactgaagtgtctgaacccgtgcgtgcagtcattcgccaactggacgcacttctcaagctcgcggtggacatggttcataagacgtcgacccaggacactcgcgcggtactggaggaggaccggcaagaacattcggtcgttctgatgggcgtgccggaatcggacagttgcctttcctctacacggcgcgcgattgctgaccaacagcaggtgttggacattctggacgtttgtgaaatcgaggcaatgccgaccaaggtttaccggatgggccaaagaaaggaaggaagaccccgacttctcaaagtggaaatgccaacccgaaagatgacacaaacatttctccgcaataaaaaccgtcttaaaaactccaaatttcaagctgtatctgtccgtnccgtctctctcccctgaacaactcaaggagcggcataatttgatcaattgttgcaagacagcccgcgaccaatttccaaatcacaatttcattgtttatgctggacatgtcattccccganacgatgtctatgtttttcgcgatgaccctggtaattatgcctgtttttgccataatcaattcataaagtcttgcggngaccacccata

SEQ ID NO: 4427 - DNA, 2384 bp, Heterodera glycines
ctgcttcaagcacatcaacaaatgtgactaaaagaggaagattaaaaagcgtcattgggccaactcattcagtcctaagccttcccctccccccaccagcgtctaactctactgatcagagtaaaaaagggtccaatcagagtattactcaaaatattattactcctccacccgttccaattccatcaataaatgtgactaaaaaacaggaagaattaaaaggcagcagcggaaaaactcattcagttttaaagcctacgtctccattaccagtgtcgaaccaaactacagtgtcacaagtgcatcaagtagtagctactcctcatgtaaaaaagaatgagaatcaaacagtttcatcgattaatgaggcgaaacaaatggaaattggtccgccaccaaatccactttaacaatgattttaatttatcaatgatttttaagggtttatataaaagcattgttgaacaaattttatattcatcataaaaatttattttgttggaactttgaaaaaagcataatttatttaccaaaataaataaaattgtattgaaaagggattcgaaagtataatataaaaaaaattctcagaaatacattgatatatttcttattgttggaatgcagtcaaataattcaacataaatatgatcccacttaaaaagaataattatatgaaatattcttttgaatttttataagagaattttattgatgcgcaagtaaacttttgttattttgacgcacatatgtatattatttttatattatttatatgaatttccaagatccgccttcatattgatttaatgatttttttacgtttattaatccctcgaataaaaatattatatgtataatttatatatatatatttttacaaaatatgaaaatatttaaaataacaattttattttttatcatcacttttgatgaaattgttttaattacctgtggtaatacgtcaaaacggagccaactaaaaagttaaaacaaaataatttaattgcttaaattaaactaaattgtttttcaaaatcagatttaaaaccgccctcaataaatccggccactggtgtgctagagtaccgtattgatatctatgaacatggacaattacagtcgccatctaatcatggtacagtcaataaaaaatttcaacttaatatttttggggatttcataacaatgacatttttttgcgggtataagaaacgccctggcggaatttaagaaacgacctagcaccatatataaaccatgcctttttataccaatgttttctttgaatagcattttacgagagattcataaaagtctattttatgcgcgcaattttttaataaaagcgagcaataaacataaaaaattatacaatttttggtaattggggcactaaaaactatttctactgtttgctctttttttacattttaagatttccgaataatttctttctaaaaaaaactaaaaaatcaaacaaattttctccggtggcagtttcggcaccgcctatttttgagggtaattcgggaattggcacttgagctacctatttttgaatttaagcttctaagaaccgagttctgaatttggtttcaataaaaaagtcaccacatattcccttcttttacattaatagacagtacgactacgataccgaactaccaaaaccaaaatctaccatatgaaaatgagcaccacattgatataccagaggattatataattacagagccacctgtcgaaggtttgtatttagggctccctaatgggaggttcaagcctaattttgtggttgtttgctctgaggctttttgtgggtttttgaaaaattacacctgaatacggtctcattttcacattttaaaaacaacctttttggcatttcttagcattattagtctttgtatattttttaaatcaaaaactagaactgtcacaaatggcaaatcaaatgaccgttttgtcttcatttacgggtaaaaaatttattacaattaaaacttctataaacaaattttaaataaagttaatttttaaaaatatatatataatatttttaattaagcgaatcaacaaaaaacgattccgcattactcaaaacaaaattcctttaatgtttttgaacatcgaatttctgtaccagaaccggaaacattttgggaacaattcggtatcattttcggtaaaattaaattattaactcatatttccttcatagaatcttctatttatgcctctaaagtgaatatccgtcaggaaaatggaattgaatttttgaaaattttgtcagatttgagtttaagcatgaattcccccaaattcaacagagtatttacctaaattggtaaataatttttaattaatttatttttccattt

SEQ ID NO: 4428 - DNA, 1966 bp, Heterodera glycines
aatattttataattttttctaataaggaaaatttttaaacctaaaattttatatcaacaaaaaaaaaaaattaattttggcgatcaatttttgagaaaatttttcaattcttattttacaccaataaataattaactaaagtaggatcttggaagaaaaacatgttttcttggactgtttctatctttggtagaatttataaacaagaaaatgacggaaacaatgtttgtttaattaaaaaaaaatttccaattaaaaccctaataattagtgaacagttcaaagcgaaaaaaatgatgtggataaatacaaatcgtaaattgcgaagagaacttggacttgaaaatggcaataaaaatggcgaaaaaaaatttcttgaacgacaaaacacatcaaaattaattgaattacaagtaaaatgttatttagaataagttattaaaattaatgagttaaataaatctaaattaattcctgggctttataatagcaaaaataattaaatatttagcacttagttttttattcacagagaataattatacaattaaaataataatgaattgttttaaaatttttaaataaataaaaaaaattaacaatataaatattatacataattagcattttgatattcatttcaatgaaaattattagcaattaaaattagcatattaattgttttaaaattttgaaataaataaaaaatttaacaagataaattatataattagaattttgatattctttttccattgaaataattgcaattaaaataataaattaattgtttttaaatttttaaatatataaataaaatattataaaattgtaattttgtaggaatttcttatcttttattcaatgtcaattgaacaagtgttcactttttggagtaaaacaaaagaaaatctgataaacaaaaaatacgataacaacaaatgcaatttttttctatatgcaaaagtaattaatttattttttattttttaatttcataaacaataaaattttaggtaaaaaagaatttagctgaaattacacgggaacgaatgagtgaatttgttgcgacaagaattgaactggaaaatatgtgaaatttcttgacaaaattaattaaattcacaaatttttagtagataagcaataagaaaatataaaattttactgtatttaaatgtatttaaatattgcctaatttgctagacttcattttttgcttttaatgaagaggtccgatgttgtaatttaaaatttcggttcgattaaaaaaatccgtgatttcaagttaattattgttgtttttgccacatggtttgataagacaaaattcgttttttaacgtgtttagtgttctcagaaccacttagaaacattgctgccgtggtggccttatggaattattttttaaataatcctccgccagcaggaggagtcgaacttctaataaagatgttcaagtcgaaaaataagccccaaaaatgtgtttgtttgtttttttaaattacaatttgtcctttgcaataatatccatgtttcatattatttttccttccatattttatttttcggcaagtgatattatgccagaatttaatttggttttttaagaaaaatttgaatatttctcagtgaactgtttccgctattgtaaattttaatgagtaaaggctaaaaaatatgacaaatatgtatttcattcatgacaaaaatttatgtgtttttaaataaaaataagccaaagaatcaatgggtgattttataaaaaataaataacaaataattaattatttttaatgaaaaaactcaactttattgagcaattattttaaataaattctcaatagaaaattattttcattattaaaatatttccctataatcaaaatgtttttgtggcatataatatttttctataattttatttatttataaaattgaatccagcaaaatcggaccacatttt

SEQ ID NO: 4429 - DNA, 891 bp, Heterodera glycines
tttagcaaattttatttgcaaggcaataattagcagtgcaaaaattctccgctggggaacgcatgtcggggatggaccggtgctatgacgttagtcaaaaaccatcaaatgcaaatatttttcgagataactttgctcaaaagctaccaaattttaaaatcttgatatgttcgatactaagtgttttctattattctgcaaaatttaaaaaagtttcattaagtttaaggaaagttatgacacaaaatgcgaaaaataaaaagattatacaacaaacaaaaagtgaataaaagcaattttcttgaatttttgaatatgttttctgatttcttatggtttagcaaaatatatcataaatgccatggtcattcactttttgtctgttgttgaatctttttatttttttccaatgagtttctaaaactttttgtgcgttaaaactcattaaattttttggactcaattgtaatttctttctaataacatatattatttgcataaaaaatgaatcaattggaaaagaaaacacataaagttgtataatgtagatgatcgatagaaagtgaaataaccacaaaaaataaacgagacatataatttaataaaaaataattttttcgactaaatttggcttcaaagtgccaaaagggaatttgcattaaatgtctcatttttaaatttaaaaaaatgaaatgccgaaaaaagcatatttttattttagcataatgttcgagaatttttaagtttttatgtgcaatgaatcttcgtgcacatttaagattaaaatgaaaaagaaattcataaacttttttcaaaatcaaccaaatttttagtcctttatattagggttgctccccgacccctcgggggggggggggggggggaaaattg

SEQ ID NO: 4430 - DNA, 5176 bp, Heterodera glycines
  misc_feature (5166)..(5167): n is a, c, g, or t
tgtcgtggtccgagtaccatcgggggcacatgtcgggggtcgggtcgggggggagctcaaaatatcaaggtcggggaccccgatcggcggatgcccaaaattttagaaaaaaatcaaatttctttttcaatgctcgtaaataaattctcagaactcaaaaagcttctttttcttcacttaaatcaactgatgttagaattttttggtttggtgtagctttttcgtcaggtctggaatcgtcaaaacccctttctaagtacagttaaaccgattttcaagtatattagtgaaagattttcataaaattcaagtgccaaaaaatgcgaaaaaatggtaaatatttaattaaatatgttgaattttttcacccgaatggattttttccccatattttttttttgctgatcgttttcctcatttcgttgcacatcagggctggacgtaattacggattacggaaattacggcctttttggagttacggattacgggttacggattcttgggatttttccgtaattttgatccgtaactggctttttagattatttttcgagacgatttcttgcattaaataaaaattttttaaattaaaaaaatttttaaattacggattacgtattacgccaaattacggccttttttgacctccgtaatgacggatggccgtaactgaaaaaattgccgtaattacggattacggatttccgtaattgaaaatcagttacgtccagccctgttgcacacgcactttttgtggcgcgcttttttcaacaaaaaaaaagttgggaacagaggggctggcggtgccgacaggcgacgccaggaaaaaattggattatttgtgcgatttagtaacagtttttacaccaaataattccaaagtaaaaataatggaatcaatctcaaaaaaatttaaattattcaatgttttttaaaatgctcattttcaatttttcaaaatatatattctgacaaagattaattttttagcctattttggcgcaaaatcttttacaaattgcactcaaatcttcgaaattttcattggcggcgtctatccgcactgccggacacgcccaatctttttaatatgctttattaaattgcttttaaaaggtttattggatcatttaataaaaattgaaaattattttaaaaaattaaacttttgtaactacggattacgggaaattatggggtttttgtacccccgtaattacggattccttaattgaaaatccagttacgcccagccctgcatggaatcccctcttgtccagcagtccgggctgtagcccgccggcataacactcccagaatgaacttgtaatctgcgaaactgcttaataagataataggaaattctacaaggggattttgaaatttttcggattgggaccttgggaccaatcactaattcagtcttacaaattatttgacatctattaaaaaaaaatctctgtaggtcctctagcttagtcaccgtaactctgttgaatttaaatgtatttaaccctggcctctccaaccccctaatttgcttgatcttatgggatcaattatcacctcacttaatctattaatcttcccctcggcgggcaagcttcttctctatctcagtaattcaaatttggattacattgaagaggaaaatctgctcgagctatttttgaatcgtgaaaaataatgatcatgtgaagttatactgtaaatataatttccaataagaggcattctacgaataataagcaagacatcagttgcaatttttcatgaaaaatttgcggatggctttttcctccagttcacgatcagagaactggtgctccttggccattttccactcggcgatcaattcactcaactgatcagcactttgacgaagaaaggttttcatcgcaatccatgggtaagcaatcgatggcactgcagaaatcattggcacccattcatcaagcatacaaactgcaattgtttgataaatttttaaataaattttggcattttgtatcagcaaatttggtccgttctgctgtccgccattgttctcggcatgcatcatagcttcagttattgcatcgatgaatatatttcgtattttgttcgttgcgccaagtctgtaaattttttaaaaaaagtttaccaaaaggcatattttgggtaattttttaggaaatttattggcattttgctcaaatttcataaacaaaaataataaaaaagaaagaaccttgagtaattgactgcaaaaacattcgaaaaatcaattgaactcaagcaaacctttttgcttgaaaattcaataattttagaatagaagttatagagggccgataaaacataaattaattcgatttaaatttgttttacaattttttaatcgcgttatttaaattaatctaaatcaaaagtgtactaaaaataaaatataaaagaactaacgctcgttgtaagtagtcgcctgccatgctaatcaatttgtccaagtccatcttgtgttgcttgcttatcaagaaacaagcaatgttttgcgactgaatttggcttaaaagtgccaaaaaagctgatggatcaatgccgagaatgggctgttcgaccaatggcacaattgttatttcgacgacccattggaccaagtccatgtattccttgaccatatccatggtaccaaaatgttcggccgtttgtgtcttttataaacagatatttttattgtaagggtcggcaaaatgccaaaaaatgaacaggctctatggatgaagaaatattaactatccataaaaatgggtattaataaaaaagtcatcagtcacctttttaatccaaaaattgaaatgcgaaaactttgaaatgaaaaacttagacggtttccaaaaggttaaataacaaaatattaaaaaaaagaaaaaaaaattaaaatactaaaaatataaatatgtattttcagctaatagataaaactatggcattacaaattgaactcagttagaattaattttgttttatctcattttttgaccactgattaataaaagttaaagtttattaaataccttttcagttacattttgctcagaataactggcatttagaaaagtaacaaaatgttgcataaattgtgatagagctacacaaagccaagtcatcaatgcttcagaatcggatgtttcatttttcgtctaaaaacaaaatttggattttttattataatttcgaaatatttgatttaattttacttaacttaggagcagaaattactgcttcacaaggcaatcccaataaaccagttaattttctatacaatcgcatataaaagtagagcataataccacggttaatttctgatgggaattgactccttcaattaaaaataaatattttaaattaattaatcaaaatattgtttcataaccaattttagtggaaaatatatttatttaattatttgaataaatcattctcacaaatatacataatattagtcaaagacctcaaaaattgttataaaacgaaataaaattgagaaagacggcttataaaaaacaaatttattaaaagaatgttcaattttagttaactttaatgtactttcttatttttcttaaagatttctttcataaaaaaatttactgattttgtccaaacatcagctcaatctctctttgaatatcggcaactttcggcttaaacacttcaagacactcatgagcattaattgcagcaattaaccgctcattcaaacaattaaccacttttgctgcatcaatgttatggccaattcttgtttcgtataacacaacatttggcgtcaattcatttgatttaataaattctaattgtgtgtccactgaatgtggcataatgtcgagacaaaccaaactcaaatcgacaatgcgccgtacgtttatcactgaatatattaacaattacaaagaaaaaaagtttgaatttttgtttaaatatttaaaagaaaaacaatatatataatttattttgtactttttataaaaaccaactcatttgcacagattttactaatatttatccattaaaatggtagtgtaccagagctagtttcgctttcacctttcgcattttccacactttttggtcctttcacctttcacttttaggggtgaaaggttaaagattccgtttaaaaaatttctcgcctatcaacatcgacacaccaaaaattcaaaattttcttaaaatatgctttagtcatttttggacaaaatctgttaataaattgtagactagagcggtaccggtaattttcacttaatcgggtaagggtactgtgtaatagaccattattgtgcgaagagattgcagccgattcaattaaacgatttatgaatgtcagaagttcggcataaaaaccagcatttccatgttcaatgtttggcgtttgcatgccaaaaacggtggtgaactgttttgaagtgccaatgccaatttgctgttcattttgtgcacaaagcaatgagtttaccatatttgattgcaagtgaatttcatgtaacgtattattttgctgttcaaattgccgtcttggcgttggattggtttcatgattttgccatgtttggtataatgatggtccaggcattgaatttagctgataattttgaagttgttgcaatgatgcccctggcattgaatttggttgaaaatttcgttgtccaaatgatggcccaggcattgaatttagctgataattctgaaattcctgtcctaatgatggtccaggcatagaatttagctgattggcattgagcgtgtttggtactgatggcccggctgtttgattggataacaaatttgaaaatttccctcctgtccagtattgtacattattggcaaaattttttgcgtcactttccaataaatatgttggctggcttagctttcttcggttcctttgtttcttcggtttcttctgcacgccaagagtattcatctgactttggatgtttgagttttttggtgccatattgttatgagcaaattgttggtttgtggccaaaaagttctgctgattggacacattgccaatgttcaacccaaggtttggaacctgattctgatcagttgagctgccaaagtttaaaccagtctgctgagttgcacccagtttttgatgcaccaatgatcagnngtttctgtt

SEQ ID NO: 4431 - DNA, 1356 bp, Heterodera glycines
taaatgaacaaacacacgaaatatgacaacacaatccttctgagatttattaaaaaaaaataatattgtggtttgcaatatttcaaaataatatttgctagtcctttattattattgtttcatttttcatttaggtatttgagttttcgaatgattcttacaattatcatcagcagaaaaaatccaaccgttaatttgatttaaaaaagcatttgactatattaagccgactgaaatcggagatgatttatttcagataagaaaagaggacaaaagtggacaagtaaacattcattgctttaatcccccaaaaatattttaaatgatttttcaaatgcgcgaatatttaccgacgaaagcgttacaattggcacagaaatgttcaacatcctaaaacggaaaattagataataacaatttaaatgattgcctggcacgattgagcacagaaagggagcacgcagcagggccaacagccgacgagtgccaaagcgccgcaaatgatccaagtgagaaggcccggacgacggacgacccgagtgcgcaccttggcaaggcatcggaaagtcaaattggccaaatgggacagatcaatcggaaaacgaataggaaatgatcagtgagtgggaaatccgattggtagaagaagccatcgccagcagtaagcctatccaaatatccttctgtttttgagttcgggaaattttctctaatttttttatgaattgaaacaaatcaaaatggtttaatgagataaatgccaatttcctcacattacagtacccttttacaaaatatcattactgaagtccttttttttgcccattttttctgctgaaaccgaccgattggcgacagtttgagcattccaattgcatttcgtgtgggcccaatggaattgcgaagatcattttgacaatctttgtgaacacgataatgatgcaggagtttagcactaattgctttgccaattaccaacctgatgatttggcacattttgcccaccgacggggaacgaatggccgcccatgggaatgttttgagatgtgtaaatactatgaacggtgggaggcgaattcgtagaaaaaggaactgctgaaatggaggacacacttagaaatctgcatagccaatatttaaaaaagacaatccctattgcacttttgctgattacccccagggggaaggaccggcgtctcgaccgatgccgcgggcattgtttgttgcgcttgtgccatttgggggttggaagtacggcatttgctgctgcccaccgctgcttctgtcgttgctattactgcttgcgccccgtggtgtgcgtctgctgcgactccgacgaattgaatttgtctgccc

SEQ ID NO: 4432 - DNA, 2819 bp, Heterodera glycines
  misc_feature (46)..(46): n is a, c, g, or t
  misc_feature (77)..(77): n is a, c, g, or t
  misc_feature (111)..(111): n is a, c, g, or t
aagtcattgcatttctgtaaatgatctcttgagattactttttcanctgtaattaagtcacttgccaatatcagttnaattattaatgcaaaacagtaattaaatgaacanatgagaaaaggccaaaaatggaggaaaaccatcagaaaaaatagtaaaatacgaagtgggaagagtaagcaaaagcagcagatgaaacaaaactgacaacggggcattgcacttttaagaagggttggcaaagggtaacttaagagcagaagccaagctgcaaccagcagttaattagtgtgtaatttgcaaaagatgcgaagaaacccataaatattcggaaattgttttgtttttggattttttgaaaagcgcgaaatttcaattgaataaacgggggacttaatgagccagcggaataaaagtgaaactctatttttccataatttatcaggaaaataactgcctctgtgccggttattgaaaggtttggcccaatgtttgccaaatgggccaaacgaatggcactgaaaagttcggcttttccttccctcactctttgcttaaatattaaattcatttgttcgtcctttcgttttgagttgttaaccctttactttcctctcccctttgatttccccccctctcaaatttttaattgtctccccggtaaccgggcatatttcctttaaagtgagtgcccttccccaatgatacaaaacgtaacgtaatgaatgctaacgaagaaaatacaaatgaattgggagaagcaaatggcgacgaaaatgggaaaaattgggggaaaaagggggacattcattaaaggtaaaagcgacaattatctgcaatttaatggcgcaataaaatggcaaataaagtcttaaaaaccctacccaaaaaattttgccaataaaatggccaaagaaggttatcattgtataaatggtcaatttgtgctcaatgtttgaatatgacttataggcaaaaattgaggctaaattcaacagaagacaaatgatgccaaaagcaaaggaagaccagcaggggccgtagcaaaagaaggtggtaatggttaaatgactgagatacgatacgataatttactcatttaacacatttaattgttctccctaatctatcattaacaaatgtccctggggcgaaacggggcggtcccttcaattgttatcctccccccgtcgttctcctctgatcactttttgggatttggccaatccaactttgcgagagggaccccctcaggcgtccctctgttcccgaggacgttctgggctggggcccccagttgtacccctttattattacccaataaaggactattgttgacggtataccatttgtactggggatgcgactgggaaaagggccccccgctacactacgaatgttaggaacacaaattggaaagatgagaaatggatttggacgattaagtgaaatgaatttgaagaaaaaacattcaattgacaaatttccgtcggcttattcaatttcgcacctgcaaaattgtccttttctctcagttcagtgtactatttcgcactttttgtgttgacaattgcacaattttattcaccgttcactctcccacccccaccccctcttcccatctctcagcaccaaattttcgaccaatttcttggaagtgaaaggaaagagtggggacaattggccgaacttcggcctatgaacattgcttcaacaggcgccgttgtgatgatcattaggggccgattggaaacaattagcgggatcagaaaggggattaaagaatgtgactaacaaatgtttaatgggaaaaatttgccaatcacgagaattgggccaaaaatgaatcggctggccagccttaaagtaatcaacataacaattaatcaggaatgtgttgcgaaaatcgccaaaatcgcgaaaaagcccaattctctaaacagagtaattaattagtaaaagacgggcgaagtaaagtcataaggcaaataatgaaacatttgtgctcaggcgaaaataaaagctcatttgggatcccgttaatcctaggccatttgatttccactctcgagactctcgacttaagaaaatattaaataattttcactgattaaatattaactctgtacaatttagtattaaattttcacaattttagcaaaaagcaatcacatatttctctaaccctagttctacaaaataaaatatcaccaattgatttgcactttactgactgatcagacacagctgaacggagagtcgaaaagtcgttccaaaaaaggcaccattggcccaaaaagcctcattacatcaaagagccgttaataattaattaaattaatccgaaatgaataatttttactacagtcgttaagaaccactaattggactaaattttaagtcggagaagattggcacgacatttccaacgcctggaaacactggaaaagagggagattttcaaattggacgcaaacaaagaattgactggaaaagaagcaaattggtggagattggcacgacatttcggacacgcggacacattgcgaacagaggacgaaatttatcggacaaaaacaaggaattgactgaataagaagagaaggtgactttttgttatcttggaaaacatttttgaaagggctaaggtggtagaagtttcctcattttccattcatttgttgcgagtacggtattaaaattgggtacttttgaaaagtgccattgcttaaaaagaagagtgtctgagatttgtttaaatcatcagatttaatctagtgagggctgacaaaagtggaaaaaggttactaaattcctgg

SEQ ID NO: 4433 - DNA, 4231 bp, Heterodera glycines
taaggttagggtggtcatatccattgaagcaccatcaattacaacaacgcaagcagtaaaaattgagctcacttagaatccgcgtaaaattgagccaaaggttaaagtggaaactccaaagtccttctccaaaggcattcaatttaaaagagtaagaaatgaacaacaaatttacaaaattatgggaattaggaaaggcacaatcctgtctactacaattccatttataagtacaactcaagcaccaaaaattacaaagccaaccacagtaagttcagtaacggtaccaaccaaatcaagtcaaaaaattatgaccacagtggccacgacctcgacaatttcaccaataaaaactgtgactaacaaacaaacagatttattaaccaacctaattggcgcagaattgaacaaaacgcttatcagtaagccaacgtcgcttacaaacagcacggcaaaaaatgatcataatatttctgtcaattctataaatacttttccgaaaaaggaaaaggagggaaatttgacaaatacttttaaaaaggaattaattgaggtgcaaaaaacattgatgaatgtctcaagtgaaataaaaaacagtggcaatgaaaagccagctcctataaatgaggaaatggattttgaggacactgaaaattctggtgacaccgaggaaattcaaaatggggaatatttcttagaaaatgaaataaatgagataaacccaggacctagaaggggtctacgatattgagcaattcaatttttttgaaattgacagaaagaaaaggactacaatggttaccactgacgagcagatgggttaaaaatgtagagaaaagcaaaacacgcagtaaaatggggcaagaaaacaaaaatttgaacacacgtgtaaattatgctctttaccgtttaaatgcggaacggaggcaacaatacgaacaaatatatgtccaggcatgcgaaaacacgaaatttcaattacagctcgcaaaagcaatcttacaaatcaacccaaatgagggggtgagaaaaatatttgacagggatgatttgattgcacgatgggtaggagaaaacctggaaattggcttttgtgttccaattatcccagagaaaattttttgggaccataaagttgacggggaatgttttgaatggttgccaattaacgcagaaaatgtgactttctttgttaaacctgggacaagagagttaagtgtattagggaaaaggattgattgtgaaaaagttgaaagcaatcgaattatggacaatgaaacacagttgattattgtcggggagttaagcaaaaatcttgaaaaaataaaaccaaaatatcgaaatatgcagaatccacttattttaaaagcggggacactttttgagtcggaaaatacacgtttagaaaaggcaatgctggaatatcggtccaaaattaacacattgccatcggcaaatttgagggcaattcaaaggcctaatatttctgaagttataaggctgataaaggaagaagcaaatgaaacattaggggctgtatttggcaaaacaggtgattggattgatatggttaaaaatattccagaaaaggcgagagaagcagttaaccacctaaaagggatttcttatttacttattttaatcccgttgctgttactaatcgctcttgtgacttattttgggattaaataccgagtaattatttgcgctggtttccgagcagggactcttttggtccgaattataaggcgtattcttggcatgaaaagacaaaaaacaagagtagcagcagttccaactgctcccgaacttgactcgatggaccaagaggcctatgtcttagactatcttccaccaagacgagttgcagtaattactaatgacccaagaagacttccatctattcatattcagataaacggcctctcaacgacggccttagttgattcatgcgcgagtgtctcttattgccgagaaaagacagcactaagagcaggactgaaaatttcagaactaaatgatgaaaaagttaatttattgacagcaaatgatacaaaaattcaaattttggggaaaacttgtgccaaaatcagaattaaggatgaaatgtcaggcaaaattcgtgaatgggatgctatacttttagtttcaccggacaaacactgtcccggtccagtcttaattggtttaccattactaatggagttaaaaggcataatttcgtgggcagaaaagaaagttcggttaggagaagtttggaccaacataatatcagttgtgggtgcagaaacatccaaaccgttacgaataacaatggaaaagaccgaaatttttgaaccctggactgaaaatattgtcatggctcgggtaaacgaagttttcccgagtgaacaaaatttcttggtaaaaggagtgcaacaccaataccctggaattatagtgggtcgaactttggttgcaccgggagaaagcaaaaacgtaattttacagctaatgaatgcggggaaagcaccagttaaaatttatgggaattcacatttggctgacttagaaacaattaaaataaatgcgttaccaggtgatgaaatctctcctaaagattatattccgccagaggcgagatggagtaccaaacttcctactctcccaaaaccgggattgaatcgccctccgtctaaaagaatatgtcttgaggggacgaaactgagtaattcgggacaaatttcgctaaaaaatatcgttgataaatattctgaggcattcgtcggtgatgacggtaaaattggactttacaacggccctatgcaaaatgtgatggcaatgcttctgagcatacggaacaaagcattggatgtccacgatgaagcacagaatgcttggaacgaattaatgaaaatgaaaggaaaaggggagaagaaagaggaggaaggcatggattccggacttccagggttttcaactgctgattggcaatccgatcatgaccgttggcgtggacaaaatcgttggcgcggcggaagaggagcaagacgttggggacaaccatggcgagggcgtgaatggaaccaaccaaatcaaggagcgggcccatcgacatcagcggcatcacaagaaggacaatggaatttctcaaagatggcgggatatggatagaaaattggattttgagttggaattggttgcattttagattttttttgggccaaaatacaacaaaaacaaacaaaaaaacaataaaaaaaaaattaaaaaatgcaacaaaaaattttttcttataattactttttttctctctctctctctctcttgtaatattttttgtattttcgggacgaaaatatgtcgggcccgggatgagatacgataatttactcatttaacacatttaattgttctccctaatctatcattaacaaatgtccctggggcgaaacggggcggtcccttcaattgttatcctccccccgtcgttctcctctgatcacttttgggatttggccaatccaaattgcgagagggaccccctcaggcgtccctctgttcccgaggacgttctgggctggggcccccagttgtacccctttattattacccaataaaggactattgttgacggtataccatttgtactggggatgcgactgggaaaagggccccccgctacactacgaaagttaattgcataaacctgcaacataaagtcgaaataaatattcgtataaaatgtccaaataatatcggtttctttggcaattttccaattcagatttcgtctaacccaaaagagaccatttgtccatgttcatcaaagcaattaatattttctttctgtctaaatccacataaatattttgaatattctttagccatcctaaaaatttatgaaaatttgtcgctagtcctataacaaattccgaaagtagagcatctttagtctaaaatttgaatttatttaatttttatttaagtgttaagtctcacccatgaaatttcatcatcgaatttcggttgcaaatttatataatattttggttcaaaataataattgaaaaatttgttgagattatattttttcgtacaaaaagtccaaatattttcgatatttttgacattctgtccgttcatattcttcaaatttatccgcaattttatcacatttccaattctttctcataaaaaatacaaagccaaggtgtgattcgtatttgttctttgaatatttactgatttg

SEQ ID NO: 4434 - DNA, 3857 bp, Heterodera glycines
  misc_feature (8)..(9): n is a, c, g, or t
  misc_feature (22)..(22): n is a, c, g, or t
tgcatgcnnctgcaggtccccnctggacacatttttaaaaactaaaaaattttcaatgaacatattctggaagaatgaaaaccgggaattttttttcaaatttttcccatcaggggaataccgtaatctgcttcttttacaaacgcacatattatcttgtttcttaaacgaaagtattacagtgactaattaggttacgatataacacctctggtaaacgggggagtactgtaatctggtgcttctaccaatcgtatactaaattatttgtttctttaacttaagtacatatcactgactcatttcgggttacggtatgacctctcttttgtaattaactaaggcccgccctccttacagtaaactttttttgtacattttacagttcaaaaaccttggcacactgtccacattgcgcattggtcacacgttggaaaaagacaagacaaacagcaataacaataattttatcaataataacaacaacagtaatcaacgcttgtctaaatggtttcttaaacatgtaattattgtcattaaaaaataattaaatttatttatttattttagaaatggaatgccaagaataatcattttttttaaaattaaggtactggttcgcaattgtgtcactgcgcaaacattttatttccggtgagtttccaaaaaaattattaaaaatattattttatgacttaaaaaagtactagaataatccacaaacataggcattggaagaatggatctgatcaaaatatgtagtattgtaaagcgtgctggatcgtttcataaaatccgccaattttagcgatttttcgacaaaacatggcataactttgcttaaaggcaatcaaattttacattcttggtatcattcgatagccaagctttttctctactagcttgcaaaacttcaaataaaattatcaaatttaacataagttatggcagaaatagtacttattttcatacaactttttctaaaatttaccaattttttttttaaattttgcaggctaacagagaaaacgctgggctttcaaatggtaccaagaatgtaaaatttggttgcctttaacgaaaattatgccatgttttgtcgaaaaaatcgttaaaatggcggattttacgtaaacaaactagccccttgtaaaggtgaataaaaacacattaaaaactgtaaaataattttattgaaaaaaaatttgtttttttttgaattttatacacttttgccgaaaattaccgactttccgagtacctttcctgaacacacacagttgtggccgttggtttggccgtggcattgatgacggcgcattggagaggttgctcgttgcagaggcaattgtcacacgacggcactatgccgacggaagtgatgaggatgaaacggtgtcgatgatgaacggcggtggctcgcgcggaagcggcggcgctgaaatgttctcatctgtgcgtgaaaaaaagcgaaattttgcgccaactaatgaaatacttgatgaatttggctagaaaagtgaaaatttctaggcaacgcaagccagcccgagggtattgaaaagttgtcaccatgggaaaatttgaatttttagcggcattaagaaaacaaatttttcaaaaaaaaaatttttttttacctaactgctcgagaatttcgataccgagtcaaggaaaatattgagttttagggtctatgcctggaaccgagtctcagtgtcaagactagggtatctttctcgaatatcgagaaaattttgacaatggcaggctcatttcagaatgccaaatcggtaaaaagttcaaatagctatttgattttcaatggattttttaggggaaaattctacccactaaattaggaaattcatatggcgctaccttttccaaagggcatcaaatcggagcagtatctgctacagcatgtcgaaagcccattgagtgcggccgccgcttttttgtcaccgcgcaaggccaaattttccaccatggacaccagcaacagcacagcgagcgatggaaggtcgcgcgaccgttcctaccatcgccggttccgctcgccgagctgtgagcgtcggaacagcggcgacaccggcgtttctggcagcaacgcatcgaacaccagcggctgtcctggttggtgtagtggataccggaacaggacaaaacacagccagcgaaacacagtcgagacataacacaaccgggaataaattaaaaaaaaattttttctaagaaatttttcaataaaaaaatctttgagaattttatcttagataatttgaagaaaataatttcaaaaaattttccagctattttttcaaaatttaatgatgaataactaagctttttcaaaaatttttcaaaaaaaaatcgctggaaattttttgaaattttttcatcgaattttctaagaaatttttttcaaagattaaaaaaattttttatgtttattcccggctgtttttttatatctcggctgtgtttcgacggctgtgttttggggtacaccgagtggatactgtaaagggcaaataccgattgtaatatgcataataccattatagtagcctctaattagtaaattaattcggcaatcaattaacactcagataaactccaagtgttggagcatcgggtcggaattgctgtcaatgcgctgacaaagcatttcctcacctcaacagacaaggaccagcaaagccggaatgccaaactgagcacattgctttgctccgaggatggaggacttttgccatcgctggacggcattttgtgagacaaaatgccaatttatttttccaattttaaaacatttaaaaatgcctttatcctgaattcggattagctaatgtgcttgccatgacaaaatatttggccaaggcttaaatattctttcccagaattttacttttactatttttactttaatattacacactgagtaccgtaatttatctaccgtatttcaatataaataaataccgtaatgaaaatctatgcgtaaaaatttttgttaagcgaatatggcctcatacagcggttcttgaggccgatgtacccatgggattacattgaggtcaatgaaattttaaatttcgtttttaaactttacaatttatttttcagaaagtttttgtgtggttccgtaaatttttctgctctggtgaatcgaaaaagttcacacaagaacaacggtaagtggaggtgaaggatacatacaatatattgtcataatgccattaaatgaatgaataatgggtttaaattttcaaaaaatggaatttacaaaaaaatctcaaccaatttttatcacacagatcattgatcatctacacatataatttggtgtccaaaatttctggtatgtacgtcagactgaacaaattttaatactatatattagagttgctcggtaatcggtaattgttaaaaaaccggtaccggtactgaccggtactgcaaaaaccggtaccggtaccggtaccaattttttccaccggtaccggtaccggtaccggtaaaaaccggtaattttccaacgtaaaaatttttggacacaatttttcaaatacaaaatttttattcagttttcgcgcgagtgcctgttttttagcattagaattgttcagaagtatatgtatattgagggtgaccaagttttttttcaaattcaggataaagaacactaaaattcagatatagacctcaaaattcagattattgcaaaacaagggatcagcggacaattttccaattttgcgaaggggtctccggccatgtaaattaatgtaaatcaatgaccttttttgctttcaacaccgcttttttcgcggcacgtttttctcaagactttt

SEQ ID NO: 4435 - DNA, 4210 bp, Heterodera glycines
  misc_feature (3588)..(3588): n is a, c, g, or t
  misc_feature (3595)..(3595): n is a, c, g, or t
  misc_feature (3605)..(3605): n is a, c, g, or t
  misc_feature (3614)..(3614): n is a, c, g, or t
  misc_feature (3621)..(3621): n is a, c, g, or t
  misc_feature (3630)..(3630): n is a, c, g, or t
  misc_feature (3635)..(3635): n is a, c, g, or t
  misc_feature (3639)..(3639): n is a, c, g, or t
  misc_feature (3642)..(3642): n is a, c, g, or t
  misc_feature (3649)..(3649): n is a, c, g, or t
  misc_feature (3672)..(3672): n is a, c, g, or t
  misc_feature (3681)..(3681): n is a, c, g, or t
  misc_feature (3691)..(3691): n is a, c, g, or t
  misc_feature (3695)..(3697): n is a, c, g, or t
  misc_feature (3709)..(3709): n is a, c, g, or t
  misc_feature (3717)..(3718): n is a, c, g, or t
  misc_feature (3727)..(3727): n is a, c, g, or t
  misc_feature (3731)..(3731): n is a, c, g, or t
  misc_feature (3733)..(3733): n is a, c, g, or t
  misc_feature (3735)..(3735): n is a, c, g, or t
  misc_feature (3738)..(3739): n is a, c, g, or t
  misc_feature (3743)..(3743): n is a, c, g, or t
  misc_feature (3761)..(3761): n is a, c, g, or t
  misc_feature (3782)..(3782): n is a, c, g, or t
  misc_feature (3790)..(3790): n is a, c, g, or t
  misc_feature (3792)..(3792): n is a, c, g, or t
  misc_feature (3794)..(3794): n is a, c, g, or t
  misc_feature (3799)..(3799): n is a, c, g, or t
  misc_feature (3810)..(3810): n is a, c, g, or t
  misc_feature (3816)..(3816): n is a, c, g, or t
  misc_feature (3827)..(3827): n is a, c, g, or t
  misc_feature (3838)..(3838): n is a, c, g, or t
  misc_feature (3843)..(3843): n is a, c, g, or t
  misc_feature (3855)..(3855): n is a, c, g, or t
  misc_feature (3859)..(3859): n is a, c, g, or t
  misc_feature (3867)..(3867): n is a, c, g, or t
  misc_feature (3869)..(3869): n is a, c, g, or t
  misc_feature (3874)..(3875): n is a, c, g, or t
  misc_feature (3893)..(3893): n is a, c, g, or t
  misc_feature (3895)..(3896): n is a, c, g, or t
  misc_feature (3917)..(3917): n is a, c, g, or t
  misc_feature (3925)..(3925): n is a, c, g, or t
  misc_feature (3928)..(3928): n is a, c, g, or t
  misc_feature (3937)..(3937): n is a, c, g, or t
  misc_feature (3949)..(3949): n is a, c, g, or t
  misc_feature (3965)..(3965): n is a, c, g, or t
  misc_feature (3967)..(3967): n is a, c, g, or t
  misc_feature (3981)..(3981): n is a, c, g, or t
  misc_feature (3987)..(3987): n is a, c, g, or t
  misc_feature (4005)..(4005): n is a, c, g, or t
  misc_feature (4008)..(4008): n is a, c, g, or t
  misc_feature (4019)..(4019): n is a, c, g, or t
  misc_feature (4028)..(4028): n is a, c, g, or t
  misc_feature (4048)..(4048): n is a, c, g, or t
  misc_feature (4050)..(4050): n is a, c, g, or t
  misc_feature (4077)..(4077): n is a, c, g, or t
  misc_feature (4085)..(4085): n is a, c, g, or t
  misc_feature (4090)..(4091): n is a, c, g, or t
  misc_feature (4095)..(4095): n is a, c, g, or t
  misc_feature (4100)..(4100): n is a, c, g, or t
  misc_feature (4116)..(4117): n is a, c, g, or t
  misc_feature (4124)..(4124): n is a, c, g, or t
  misc_feature (4135)..(4136): n is a, c, g, or t
  misc_feature (4152)..(4152): n is a, c, g, or t
  misc_feature (4160)..(4160): n is a, c, g, or t
  misc_feature (4171)..(4171): n is a, c, g, or t
  misc_feature (4176)..(4176): n is a, c, g, or t
  misc_feature (4188)..(4189): n is a, c, g, or t
  misc_feature (4192)..(4192): n is a, c, g, or t
accggtaccgatactttgatttctgaaaaaaccggtaccggtaccggtaccaaaaaaaccggtaattaccggtcggtaccggtaccggtaccggtaccgagcaactctactatatatatatatatatataccaaaattataatgatttaaaataaattaatttcaataaaaaaatatctaataaaaaaataatttattcaattttttcagcacataatgccgtcggcaaagaaggcaaattccatttgttcatccttttttcgctacggtagttcccaccatcatttttttaaataaaatcatattccgatcacatgattcatttgactgatcattatcgacaaataattaatctggactaattctttaaccgaagttttaatcatttctttttataaaaattgcttggacacataaaaatttgaaataaatattaaataaactaaataagaataacaaaaaaataaaataaaattaataaatttctattaaaatactttttcaaccaaccaaaaaagggatcacattttgtccggactgctcccattgatcgcatggacacaagtgaccagccaactctatgatcaaagtgcatttttgcgtcaaccatcaaagctgtcatatttgtcaaagctgatctcaacgctcaacgaatttcgtgagcaaaaaacaattaattatttatatataattaatcactataattagtgggtcattaattaatattagccttcaaaatgtaatttacaattatttattttttaagaatttctctatgaaaaatccttgttgcaaggcattgaggatatatgaagaacaatttatggttttttgtgtgatgtgtccatatgtaaaatcagatgatgtaaatcaaaaaacgaattaaaacaccataaatatatatttatatatataaatacatttattatgtacaaaatttgttgtatttcataaaacagtatcagattttaatgaattaaatttttctttttctttttttaaattttaagactgcccagtcaatttctttcacatcaagcggatttgaacccagaacccatttttaatgcaccgctaaatgaaaaattcacaatagaagtcgatcctgctctatccaatctatatatagcttatatgcaatttcacggagcaggacaaaacgtcgttggacgaatttttgggccataacttttttctttctccaccaaattaaacattcatgctattattcgaaagcatttgaaaaacgctattaaactagtaaatttccaaaaaaaatgtattcatgcacaaagaaatcagggcaaaaaaagttcgaaatactgggtttttgagttccttctggccataactttttttgaaacttaacgaaaatttttgaaattttacaaattaataataaaaaccacagagctatcgaacaacaccgaagaatgcttaatttgattgacaatgaacaaaaagttatggttcaaaaagtcttccgacgacgtttcggccgacgacgttttggggtgcaccggcaatttcatacatacatacagttgatatgttcccttgtaagcaccggaggtccggccgtcccgatatgatttacaaatcgctgaatattaattttttggctgttaaatttcaaaaaaaaaattgcttagtttaaaaaggttgtgcaccgaaaaggaggctttttcgacacttttgaccttttgtatgagatttattgcacgaaagggagtgtggagttggaaaaaaagttcgaaaaactagggtgaaaagaacgtgatcaaatgcatttcccggatataacctccaaaagtagatttcgtcaaaatgtttttttataaaaaaaaaaatcaaattttaattttacaggcagataaagaaatttatgtagataattaactttttattaaaaataaatatttcaaatttttgccataattttattggactcaaacaaaaataattttcttaatacgaaattagaagttttataaacataaaataaaataaaattaaattgattaaactccttaaaattggttaatgtttatcgaaatgagttagcttcaaaaattttataaatttttaaattaaaaattttgtaaaaataattaatattggttaaattcctataaaggctattgttcattaaattgagaaatttttaaaattattaaaaattgaaacattttttataaatttatatatttaattatcaaaaaacttttaaaaaccaagcagtaattggataaaaatgttcagaatttatgcaaaaaacgtgatgaaaatgacagccaattgtttatgttaaagaatgatataaaattgtaaaagtcaattatatccaacacatttaaataaaactttgaaaaaaatgctttttcaaatttttaaacaaatttgggaaggcaatttgaatttttgctaaaaggaaatgtttgacagttgtagtagataaataggaggaacacatacatatgataatggcctgtcgataattgctaaaaattggtaagaaatttttggatatgtatgaattttaaaaattttgtaaatttttttttcataaatttgccaaatatttaaaatttataatttcacaattatcgtactatttcagcaagaaagcaccacactcacagaatacggtatattatgaattgcaggacacactcacttgaaattaaaaaatttctgtgaaatctgctatttttgattttttttttttcagtattgtgaattaaggttctgttttctttgattgccattaatctacaaaaatgcaaataccgtaccatatgcctaatctttgtcatggcaaaactgtgatttttttcaaaaactaatctttcaagctaaaataggtatttaatttggaaaaataaaaagcatttttttctttttttacattttatgttacatttttcaactttttttttttgttgttgcacgttttgccattagcgcgtttaaatcacttcagctatcccgaattacacaacagctgatcaccatagcaataacagaaatcaccagaaagatgccagcgcccaccgtaccaccaatgaaatgaccaatactatggtgtgcaccatgtccattagcagtaatttgatgcattttgatggcacataaagcgatgctgccaacgcataccaatgcaattattagccacaaaacaaagcaacactttgcgttaaagcagcaacaatcgttgttattgttggtactgctacagccgttacagcaacagcaacaaaaatcgcaatcgccacaatcgcaacaatcgcaacgatcgcaacaatccaaatcgtcccgttttgtcctcctttggcctctgcttttgacggaacatttgttgttattggtgttgttgcttttgttggtaatgacatttttaatgtgtgcttaattattggacacatattttagcataaattatggatttaatgaattatttttagggttactccccgatccgactcgggggatttgccgaatgtccactgttgcactccaaatcggatgagagtgtctttagatgagttagtttctaagaatttgtgtaaaaaaatttctatttcaaanattttcnattctttatnaaaatttcnaaaaatntccttactnatganaatnttntttcccnatattattttcaaatttttccanccatccctnacaaattttntccnnnatttcctacccnatccccanntattctctncccnantntcnntaantaaccctaattatttttntttattttttttctataaaantttacttncnantttcntcaaaaaattntttccnaccaataaatntccaacaaatnctctnaccatttctttncttnttccatcnanaaatnncaattttttaattttttncnncattttttcaaaaatttcaanattaattntancaatttctntatttacaacanttttcttcatattttntnctatttcttcaatncttttnccttcttttaattttctncanaaattttcatntattttttntaaattttctccaatttttncnctttcaatttttacattacacacaatnccaaacanattcnntttnacctnttcaaacattttcttnncattttntttctccattnncaattttaatacattntccaccanctcatttactnatttnaacatttccacnnctnaacattaattagttaaat

SEQ ID NO: 4436 - DNA, 1450 bp, Heterodera glycines
cattgagaaatgccaatttttgaattttttgtggcattttttcaaaaatttcaagattaattgtagcaatttctgtatttgcaacagtttccttcatattttgcgctatttctccaatgcttttgccttcttttaattgtccgcagaaattttcgtgtattttttgtaaattttctccaatttttgcgctttcaatttttacatcgcacacaatgccaaacagattcggtttgaccagttcaaacattttcgtggcattttgtttctccaatggcaattttgatgcattgtccaccagctcatttgctgatttgagcatttccacggctgaatattaattaattaaataattcaaaaagaacttaattggcgacaattggttggaaaaaacttatttaaaaaaatagataataataataataataaaatatttaaaattcaaataattaaataccttgaggttggacctgacaacttttgcttgtcaaaagcaccaaaataaaaacaacaatcaaagaaaataagctcatttcaatttttgaataaaataatgctaaatttcgaaaaatttcttcgaggtccaaaaaaatattttaaatagaatttggagattttttatgtcctttttctcattttttctttcatgttggcaatctttgctcctaaaaatagatatgttgcccataagtcacgaaaatttatgatctcaaaaacctaaaaaaaattactaaaaatagtggccttaattgtgagcctgggaataatacttattattaagagtgataatttgtttaattgaacgcgtttttatatgacttttaaaagttaaataaaatgggctaaacagataagtgacggtagaaataatttttttgaaaaaatattaaattaaatcagatcatttttatgggggtccggcggtgctgataggcgccaccgggaaaatttttgattattttaatgcaatttattaagaaattttgctgaaaatttttacttttgggtttcgggggggggggaggcccccgaatctatgcccccagatttatggggagactgaattctttgggaatagtgttgctatattctgcactttaattctgcgacgaattctcgctgcccataattggtggagcaccccaaacgagacaattggaaagaatgatatgtttgtgttcggggcaactgccccgaactcgatgcgcctagatttatgcggagaccgatgccttagggagtagattccctatagtgtgtacttgaattatgagatggagttttgctccgcataattgctcgagtaccgcattcggactcttgaaaaaatcgattttgttgatttcggtgcggtccgctctaaccgatgcaatcagatatatgagcagaccgagtcctgcgcgaataggttccctatatcacgaactttaattctgcgatggatttttgctcc

SEQ ID NO: 4437 - DNA, 8481 bp, Heterodera glycines
ttagaactgacatcacaccgaaatcttggaggtctcgtcacaggactgttggggaatggttttataaaatatttagtaaattaattaattaattagattttaaaaaagtgaataaaagagtacgccaagagtgagaacagaagcaattatgaaaacaaggaaagaaagtataaaacaaagaatggcaaaaaaaagccaagggcaaaaattgtatttgcaaagcccgaataatgaaacgcttaaacatcagttgccaaattgggctatgatgaataattataagaattattgacaaatggaattaaacgcacaacaaaagcggaatgaaaagcaaatgcaagtccgcatgagaatgggccggaatgaaaaaagaatttacacacagcatccggcggaaactgagccacagtaccaaaaaaagatttgcatgtgtggctcagtggttttttgtaagatagtaaaagtgacaaagggcggagattcgagtccgttgtgctgcatgaatatttttatttatttttgtccaaaaattttaaaaaataaattcattctaagaatttgtcgaaatttctccgtgtcgaaaatattcagtgtcaaatttacccttgtcgtaattaaccgccacctattttttttttgccttttacaccacattttgttcaacgacacaatttgggcatatacagaaagaacgcttgggcaattattgtatatcagaaccatccatttcaaattgagaatttttattccaataaaaatatagacaaaaaatctactgtatattgtttccacttaaaaaaatgccatttttgggtttcatttttaaatattaaaaaattttatccgttttttaaacgacaaaaaccaccaccgtcacttacacaacttccaccacaagcagaagaccttatccggctcgaaaatttataccagcatccgtccaattaaaaaaattttttgtaaaaagcatttttgaaggagttcaaaacaaaattttattgaaaatgaggttttcattttacattgcttttgcctctgcttcttttcggttgtctgacattttgttggagcaaaatatagagtgtgtcgggaccgggaccaaaccacggacaactgagtacaactgagtaccgaagtcccggttttgaccagttttgaacgggaccgggaaattcccgggttttttcccggttttcccagccaaaaagtcccggtttttcaacccaaaaagtcccggtcccgacctaccctacaaaatattaagacagtttcgacagatttataatagctgagcaaattgaaggaataaaaaaaacaaattaataacatttaaaatcagcattcctttatatttttgaaaaaataagtgcgttttgtgctcctaagtgaggtaaaaagttgccggaaaaagtcttaactttaaatggagtcgcgccaaagtaacacctcatgagccgatttttgaggaaaaactatgcatataaaagacagcgaaagttgacacttaacgtcatttttttcaggcaaatcgaactaatggggaatgaaaaattcccgagatttctacccttattttcaaacgcttcgatctcgaactaaaaccttccccgaattagtagatttatttattcattttttagtcaaatatttttttggagcctcataccaggggtggagcgcgaccgcgatccgcgattcgcggcatttttgttattctgtgtattggaaccattttttgtttcataaatgcgagtttcgactttctgatccgggttcggggtccaacctaagtagaaatggatgtcagatttaagttccacaactcttaaaaccaataaaataagcacttctcgaaaaaacgttggctttttttgaaaaaggacgattagcatttgtagacttcaattttaccgtgcgccttttggcttttcacgtggcacctaaactgtcaatgatcatttaaagcctacaatttgatcaaatttcgatttaagcggaattattattttcaatggcatcggccgtcaaaaaaaggaaaaaattttcctccgacaatcgccgactcatttcttctaccggaattggtgaaaatgaacaacagaaatcacttggaaaacgacgaattctttttcgacatgcaaagaaaatgaacaatcgaattttgaggaaaatgtgagaattttttggcttaataatttatgaatttcattttaaagcctctcaaaatatttttcccgcatttcagttggatttgcactgatgttttgatggacattctgccattttttgaccatgcccaacttggcctcaaattggcactgatttcgccacgtttcgatgttttagtggacacgcattttgatggcaaaagcgaatggcccatttggaaattagtcgaaattcacaaagaccgtgggtcggaaccaaaacttcgtgtgtttaccagctatgtcgattttaccaatattatgaattttccgttgcccgaccgtccgctgcccgagaaaacacgctttaagcgtcttgttatcatgtaattaaattaaaatcattgttaactgataaaagcatcccattttcaggtacattgatcattcagtcatcgcatttctccgctcaaataaacaaattttcaatggaacacgattcgcattgagtttgtcagtgcaggcgtccaagaacgctgcccagccgatttgggatgttttggcacgtgaaatttggccaattattgcgccaaacattcgccgtttgtacgttcccgatgctgaccatttggacaatttgcgcagtcgcacttcgccgacaattctcacggatttcaacattaattccatcctttctggtcatctgttgcccgatgtgctcgatgattttgatgggccaaatgcaactgcttctgctggccaatcgttgtccaaatggttgcacactccgaccaccgacgggaagccgaagcgattgcgttgcgatgatttcaacgggcaaggaaacgccgaatgggtccacaatttcaaggaggtgctccttcttttcccctattttgtcattcatttgcatctttttcggcaactaaattttcaacatttaatgcgatttgcttttaatgtgtccgttttcccattgtttagccgtttctccgtgccacttcttctgtctgctacataattcaattctttgccttctcatcaacgccaattgtgccatttgaattgttgaacgaacggaccaatgagaagttgacactgacaatgagcacagaatacatatggcttctgatgcggtgccaaattgggcagacgtttcaatgggatgccaaaaatttgaacttttttgtcggcattcatttgtatggttacaaaaaatgcattgggtgagcatgaaaacagaattttttaaaatacatttaaaactcgaacttaaatttgaataaaaactatgttttaatttttatttttaagagtgttcatcgaattaaaattgcacttaatttaggccattgtcaccaccagtggcggctcaaagcggcggaaaagggcgtcgaattgtgcggaagtgaaatttaattaagaaatgatcggctttttggagattattgaatggacaaatttatctgttgatcatttttgatactcatttttgctcgttaatctgtgaatattattttcagggtaaattactaatttgaaattcattttgaggaccaatggaggcaatcatgtcttttactgggacaccctcgtttgggcgccagcccagttttttctaaattctgcaggctaatagaggacatatagggctatcgaatgataccaagaatgttggatttggttgacaaagaaaaaagttatagtccaaaaactgggttggcgcccaaacgagcggcgcccaaacgaggtggaccccttttactggtcccgaaaaaattattttttaaacttttctgaaaattctaataacatatttcttggtgtatttggcgctgagcacgaatccgacctccttttagcgaattccgaacccaaattcgaacatttttcgaaaaaaatttttgtttccgaaagtcacgaaaacacatttccaagggttttcggggtcgctgatcaaggatctggcatccatttcgaccaattccgaaccccggacccgaattcgaataaaaagtctaaaattctaaaatttaactttttatattttttatacacttgccattggctttttaaaagttgcggacttaagtttccattttattttcataaaatgaccaattggattcaacttcaacagaagaccagctggggtcagatgcactcatcaagaaaattgttaaactacaatttgcgtcaaattttttgctgaatttgagcagaaagcaacagaagaaaattcccatcgatatctcaggacaatacaattttaggacgacagtcaaattcgtgtcagagagacttagaaaagcttattaacttattttttggctttttaaaatttcaaaatttttttgaaaagtggggtgccctctacaaggtgtccaagcctcgaaacgtgctgacgcgtttcgtaaacgtgccaaaatggtgttgcgcgtttcgtaaatccgccaatgggttcgaaggaaatctggaagccttgtcataaatgaaattcagaaaattttaggttatgatattttttcgtttattttttgtttgttaattttattttttgttagtattattcctttttttcggcatttcggcggccatttttatgatttgtcattttattttttgtgcttctagagacccaaaatttgtgaaaaattttaatagtggcgttattttaactcactttttgagtttttgagtgactgaaaatgcaaaaaatgctcagataataacaaataatgcaaaatattgaaataagtaaaaataataaaaatttatttttatatttaaaatatttttaatttgccatttttgacattttaattttacattttatttaaatgacttttagcaaatgagatgatgactcaaaagggaacacagcttgttcatttaattgcaattcattcgtttttcttttaagattaaatgtgacttttccattttgaaatgacaattttttttgtcttttgcaatttatttctgttcacttttttcacattcttttaaatttttcaatttgtgcagtaaaatcgctttctttcatttgcataatatttttgcattgattttaattttatttaatcaattcttttgtatgattccgataatcccaatcaaatttttaattttcttttaataataattgaatcatattaattttattggtctttttgccaatttgagttcttttcatttacattttccatttttcaattttgcatccgttcgtcgaatattccatcagattatggttgaacttttgcattaatgttcatggaaaaataagcaaaatgtcaattaagttgaaaattctcgcaaaatgatccaaaaataatattaaatagaagaaattgtttaaagggaaattagaagagaattttatttatttgttcttaatataaatttgttttttgtttggtaaataatttttatttgtttttattttaatttatgcatcggtcccagccgaaggccaaatttggacccaatgctttttctgtaaattttattttaaaaattttccagggccctttttgcaatgtattaaccaaaatacactaaaatttccatttttggcatttttctttttgtgttcaaataaataataaatttacaacaacaacaatttttattgctaacattttgttgttgctccgctgcttttaatgtccaactcttcaggccaaaaggcaaacattttgaagtgggcccctcaattcatccaatctctgaagctccgacaaagattttatgttgtgtattgtatacaatttcttttcctttccatctctctcttctgtcagtaggaatttattggaaatacttaaatttcttttttccgcaacataacgccaaatagggcatttttggcaaaaaacaaaaatgaacaatcctaatcagagataggaacagaaatcggaaggattttccctgctgggtccccccatcatgttccgggtgcatatactctgttcataaatcaggaagccaccgaattttcccggcggtgtttatcggcaccgccggcggcccattcttttaagtttttgtttaaatcgcttcaaaattacttatttaatcgtaaaaagttgaattttaagctataacaaaacgtatgaaaactttttgttaacgtttgttttctcaagaatatgcaaattttggttgtataatcgtttgcatatttttaatcccaaaattttatttttaatctgcggaatagaataaaatccaaaagcatccctaaaaatgtaaattttttacaaagaaaaaacaagtttttttttttggaatttcctagtagattcaaaattttcacttcaaaattgagctttatattaatataaaattttattttttgcaatatgaatattgcttctttggcttttttaaaaacttatgtgtttaagattgaaatttatatcaaattttccggttcgaaaatacaaaaatacacataacaaaataataataataatttgttatgcccatttgacgcgccatttcaatcatcctaattaaaccaaatgggtgttgctttgtgcgcaaattgcgtaaagcggtcgcgcactgtgctgatccgccgcccaacaattttgttgattaatttttttgtcgccaccgcctacggagatggaggaaaagccgatttaaaaataataaaaataatggaaaagcttcccggaggggcgcacaattttaccgtaagaaaaccataatcggttggcactttcacatttttcatatgtacactttaaattttcattcattttatacgaagaaaatccactcactaaacgcaaatccttgcattttggtgaaactaaatcttttcatttttttctctccttcaaaaaaaaatactgtctctttattttttctcgagatattataaagttcaatgtctaatatcgggagcaatctcaagattttcaaaatacggataaaaatatgatttttgaggtaaacatttaaaaaacgacttatctattttaaattaatttttaaataatttaattgtatatttgcattgccctttataacaaattgtgcgcgcttttcacagcctcgtttttatttgaaagttgacgaaataagaacaaaaaggtgtcgttcgtacccgaaaacaagaacaaatattacaaataaggacttcataaaaggccagattccggcgttcattagagctttttaagtggacaaactttcaaattccggtgctttcacgtccgtctatactgctgccaatccgaccattttttccgatcatttttcctaattgtcccctaattaacacattcattccaatctgatcactcccttatacaaaattctccctcagtgaaaaattcgttcacattgtccacttcctcccccgcccccccccaaatgtccaccacccaatccatccgtccgcgtcatttgcgcgtattttttttcttcatttacatcttctacataatgaacatgacgctgatggttgtgttgcagaactttgtttgcactccaccaccacacaatcacaaaaaatcgcgccgcgccgctgttgcacgcgcctcaattgtccacctcaaaaaatacgtcatcataatggctaaaatatgtaacgggtaaaatgtgaggcaaggagggaacgaacccacgccaccatccagcagtacggggaaagctcaaccactgagccatgttcccgacttcaaacagatcgttgatattgccaacctcggcaatcctgcattaataatccgacacttaatttttagaaattttatgaaaatgttagcccgtccaattttctaattgggcctaatcaaaattaattttaaagagaatgcatcgaaccaggcctcttgcaaaaactttttttttttaattcatcaaattcagaaatttggcatcgagcaaacaaattaaacacttccatgctctctccctttccgaattctgacaatttctctccatacttttccttttaatttattatacatatattattttttttattacaaaaccaatttaggaagggggaggggaattaatcatcgtaataatttgtaatttgtttgttttgtcgtatatataccgcttttccccgccggcggttcgtccctctcccaattttctcataacaatccatggaattgccccccccccattttttggtgattcttcggcgtgcaattagccggacggatgaatgaattgaatgaatgaatggatatgcttttcatctttcttccaacaaatgttacacccacaaaagtgtcttttgttgttttgatgggacgacgaagggtgcggttcgggcgaccgccgacgcttttgcggcgag

SEQ ID NO: 4438 - DNA, 1735 bp, Heterodera glycines
  misc_feature (23)..(23): n is a, c, g, or t
  misc_feature (70)..(70): n is a, c, g, or t
  misc_feature (77)..(77): n is a, c, g, or t
  misc_feature (99)..(99): n is a, c, g, or t
  misc_feature (197)..(197): n is a, c, g, or t
ttattttttcaatttccaatttnttcttaatgcgccttaatctgttgcggtgccatgcccacatatgatntatttcncaaatttgcctgttttcaaatntaattaagtaattaattaattgtgtcctcctatcctctttcaattgatcacatcatccattttgatcgatcaatttgctttgtcccgcgcgcgaatcncaatccaccgacgcgacggtcccattgtctcacacaattgagcaaaaaacccgaccaaaagagtgtccagctgatcgcgctaagtccaccgtgtgatcagcgccagtgaaattttgtggacacaatttgagtaaacattttttggccttcaataaaaaaaattgagagcgaggatttgcagcattttgcatttttgggaatatgttttaacaaaaataccaataaaaaattcattcatctaagattggcatttcaaattttcaaaattcgctcaaaaaaaattaatattttccgaaaaactttttcttttttgaataaattttcaattttactgtttaatttttattataaattcgactaaaattcaacagggtttttcttttccctccctatatattggataatcaattaaatatgtatcaatgtggagaaaagaatggtgcactgatgatggcatcagcagaacaccacgacaagggcggcaaaaagttgttggacaacaatgatgacggtataatattgaatagtaaatttaaatgcattttttatttttaaaattgcatactgtaaattaaattgtactgtatgcaaaaagtgtcaaaagattctttcaaaatttatcatgtgccaaaatgtatttagtaaatctttagctttcactgttggcactttttggcaatatttttcgaaagaaaataatattcttgatcaatatttggtgattgaactgatcgaaatacagccaaaaattgatttttgtttaaagaagcattgatcagcgccgtctttgagtccattcggttgccggaagtgcgttttgcgccctcaccgcccggtgcggtaataattgaggacgcggccaccgcgcgctcaacgcccaacagtttgacgacgacaacgccggcaccgccgaacagcatgcgaacgacgaccacgaaggggccaacgatcgctgagagtgatcaggcactgaagctgcagcagcggcagaagtcgccgaccgcgccgccgcctccgcgccgctcggtgcgcggccggcagcagacgccgcgcgacgtcagcgcagtaattttttggcgcgaaattaaaaatatacacctaaagcagggctcggatctgtcctgatttatcagatttgtcctgatttgaagggtccaaatctgataaaattaaaatgtcctgatttgtcagatttgtcctgatttggagggagtgacccaactttgtcctgatttcttaaataaacttacaattttgaaattttatggcataatgtcactattttatcaataaaatataagatttatgacaaaatttggttatttttttaataaaaatctgttaacaaatcgattaaaaatccaaaaaatttttccccccggcggcccccgtcaccacggcccggccctctccccctcgcccatttcctataagatttttggaaaaatgcgccgcaaaaaattcttaaaaatctgattttttgattcccgatgcgctaaaattgatgatttgctaattctcccccaaaattgttaaaa

SEQ ID NO: 4439 - DNA, 4726 bp, Heterodera glycines
aaaatttacgaaaatctatgattttcaaaatcaatgatttttgcaaatctgatatcagattcgtgatcagaggccctgaaaacccccgggttctcatattcgctatcagcacattttttaccctagaaaaaaataaaacaaaaactttaaatttatttttcgtagggaccgcaattccacacattggcagcatttgttgttgtaaataactcacttcagtgattttcttcagaatttcacgaaatcgcatattcaacgcatccgcctttttcttcagtaaactatgccctttttgagcgcctttcagcctcgttttcatcacagtttgagcccttaatgattatttttggtatggatttattataaagtgtaagcgaaaactcacatccgtgacggaaaaactgcaatccgatctttgccaccaccagacatgtttaaaaaaaattatttaatcttattgtaaatcacttaaaaaatgtacattcattagacaattcgcttctttccgagcgagactaaaaatcatattcaaaattcacttttttgcgccaacaacaaatctaattttaaatctgccaacttcattcaaaatttgacttttttcgtgaattttttgcaatttttttatgactttttcgagattttcgtgatttaagacctaaatttcatttagaataattattttcaaattttggatgctaccgggtagcaccaacacagctccatcgggccttgccaacgcgttaacaaacgagtttggaggtaataaacgcggaggtttcatttgtcatacaagcattagtataaaatcgctgaagagaaaaaaacaagccaaccttcaattgttaagccccataattatttgatttcttggtaatggtccgtaataaattaaacatcagttcgggtggtttcattttttaaattgtccagttccagtgagcttatcccaatgcttatgctcatgacatgacaattggtcttccaaattgtttatagaagacttggccaccgcggtgttcagtgaggacatacaggaagaagcgaactcatattttcaacaggtttcattttccctcaactttatttgattaaattttcctctttttgtgtccatagatttatgctccagatggtcgtgtctctgtcaatgatttcatcgcaaaactcaaaggttttcggcattctggaaacatcaaagagcgcgtgagtgttttgtcaaccaacgaacgataattccttctcccgtctgatagaaattttttaaactatttttttttaatttttaacaaaaaactttttcaaagaaaatttacatctctttctaggaattgctgctgtgtgtggtgaagaacttgtttgatgagtatcgcttttttcgcgaatatccggagagggaacttcgcaccacggccgaagtttatggaggaatcattcgggaagagataattttgtatatatatatataattttttactttttgaattcatcgctttcaggcagccattagttaaaccattcatttaggaatatccaatttgcgactgccattcgacgtgtaattgaatcgctgaatgacgagccgggcagcgtactttggacgtttggcattgtggcactgagtgcatgtcgcgcatgtctctacaaatatcccaaagtgtgccatatgatcatcaacacgaacagctatggccggttcccgcccggtctgaaggactacgtcagtgccggtgcgctgggccaactgccaatgaatcactcagcggcacatgacgtcggcctattttcgtccaaccaacaaccacagccgttctttccgccatcctctgttgaattcagcgtcccaattctgccgatggcgaaaatgtccatgccgggccttggtgccgccgctgcgaacatgcgatttaccacgcccagttgggggacgagcacggtcctccaaacaacaaaaaacacgggttttttctgatatttatatatttagggaaattcaattttgaatgtgaccaacgtggacacgctgatctcggccaccgaacgcgagggcaaccaagtgaaacagccgccacaacaactgttcgagaaagttgcattcacctgcaacaatttgtgcgcgaacaatttactcgacaaagtcagtctgtgtcgtgatttgttgacaacggatggatgatttattcaacattttgtttgttcgttcagactcaagaattgactcaactgatccgcgaaaacggtgacgagttcttggaatggtttgcccaatatttggtgatgaagcgcgtcactgtggagcacaattaccaacaactgtacaacagcttcctggtgttgatcaacaacacctcgttggacaactacgtgaagaaggagacgtaccgcaacatcaacattctgctcaaaagtgataagcaacagtcggtgtccaattttggtgaccgccaactgctgaagaatttgggccattggattggcattattaccattggacgagatcgaccaattctgaacaaggacttggacatgaaatatctgctctttgaggccttctacaagggtcagcatgaactgctgtacattgtgccgtttgtggtcaaatgcatcactgcaagtgccaagagtcaactgttcgggccccactgtggttgggtgtacgccattctgaaggtgctcgccgaaatacacaacgaaccggacctgaagctgaacttgcgttttgaaattgaagttctctgcaaggagctgaacgttaacctgggaagcattgaggttggcagctacctgaaggagcagcgacgtttggtcagtgtgaaacaaaagaaaattccgatgattgagcaaaatctcctttaagcccagattggtgccgccctccaaactcggcacagccgcagcatcttcaacattggcacaatgtcagttgccgccaatccaaccaccgcacattggcgctgggatttcgtcacacagcacggcagattatacgccaactgacatagcgaacatcctcgctgaaatgagcatctcccggaaatattcgccggccagttatacgcccggcggatcgcaacaacaagtttcatcaataacagcccatcagactctgcccaccttcaactacgcggacattgctttgcaatctggtacatatttatccattatttaattattactaattttactttttaaggaattttgcaaatcatcgtcattcctccgcatttgatgcttttccaagttcatccacagcttaaaacaacatgcaaaatcgctattaatcatgcaatcaaagatgtctatggtaattaattcatcgtaatacattgaaatgtactaatttattatttatttattttttgggtggcgtcgctgaccgcgcaattagcgttgcaatcgctgccactgaacaaatttgtcgcaaggacttcagcctggactcgaatgaacaaaatttacgtcgtggagcccaccaaatgatgcgttcaatgactgccgctatcgcgtcaattacgtgccgtgaaccgttgtcacagcaaatgaacagcattctgagaatgtatctgaccgacgcgatgggaaatgttgtgcctggaagcgaccaggccaaaatggtggaagaagcggccaccgctgtgacggacacgaacataaacatcgccacaaatttcgtcgtgaaaaacgcatgcgaaaaagcggttgccgacattgagaaaggacttgagtcggaatatatgtcgcgcaaaactgcttcagacgaccgtccgttccaagttgacgcggacatggccgagatgagtgaaaaaattccggaaatgatcagactaaaggaggggccgatcagtgaggcgatgctgaaggtgtacgacgacttttcatcgtaatgaaattttaatgattcatttcgtccccattttttaatattttattggaaaaattgtaggaaaatctgtggcttcaaaccattcgcacccgaggacagatttatcggattcacaaagcctggtctgatgaacacaccgaatgctgctgcttctcgaacgccgacaaatgtgctcgccccaccgttcatcccttccagtcaaatgtccgatgttcgtcttcctaccaccactctctatggcgtcatcccttcccatcatccgccacccattggtggttattccgccgcgcccattatgtccgcagaacgaatggcacttccgccaggcattttctctaaaggccgcgccttctgcccggcgccaggcaacgaattgggcgttcagacagaggaccaaattctgcagagcaaagtggagaagatcctgcgcgaatggatttccatctgttacactccgatggcgcaaaaagacccgcaacatgcactcgcttatatcgtccaaagggtactttcgagggtttcgaaactttttttggggaaacgtaaattttttgaaatttcgcggggttgggacgaactaactgctcccgttttttcattagttttgctatttttactcttattgtttgaattttaaaatttttaagatgcacgataatggagttctcgccacagatgaaatgatcaccaaattcttccgtctatgtgccgaaatttgttttgacgtgtcttacagactgttgaaaaatgaaagttcgggtcagtcaacggtggtcggtcagcgctgttattacacgcttgatgcattcaccaagcttacttggtgagtataatttttacata

SEQ ID NO: 4440 - DNA, 2012 bp, Heterodera glycines
gaaaaagattctcgcgattctgacaactgctttaaacaacgaccacgagcagcaaaagtttgcttttaatggacttccattccattggatcgtcgtcatcgtaatgaaagagctaccctctaccgacgcagtgttgtactacatacaattgtacatgtaggagtcaatagggtattgatcatatacatggacaaggaggagatgttggatttgaaatcccccctccccccctccctttgtccaattatagtacattgttcttgtacattattgtttgttccctttagacaagttctttttctgctgcagcctcgccgtgtgcccggctttgcataccattggttggacatcattggccatcgcaatttcatcggtcgtctcctctcagagagccgggatttggcccgtaccagtgcgatatacactcaactgcttctgtgtcatctcaagtttttggcaccttttttgcgcaatgttcaactgccaaaacccattgcgtacatctacaaagggactttgcgtgtgctgttggtacttttgcacgactttccaggttttgcatgtgtttgcaattacgccattcattaatctttaatttttaaccagaaattctctgcgaatactattacatactgtgtgatgtgattccggcgaattgtgtgcagttgcgaaacttggtgctcagcgcttatccgtgcgacatgcgtcttcccgacccgttcaccgagacaatggcccgggtataataaaattttgaaaaaattgctagaagtatgtttcaaaaaaaacttctcttgtaaaaatatccttaattatcttttgaaaaatttcggcttaataatttcggggggacgatgggtgagaatcggcggggcgggtacgtaattcagccattttacgcctcaatttgtataattttaaacacttatctttagagtatgtttacatttagattgagtgtctgcccgagatgagcaaccatccgaagatgcaccgtgagatgaccaacgttgtgccgtccgaactgcgcaaacgcattgacgcctacttggagacccggtccgtcgtctatctgtccgacttgccctccatgctgttgtcccacccgccgcctcacatcaacaacaccaaccaatcgcataagtcacagcagcaggacgtgccgtcctcgttcttttcgtcggcatcacatcagtcgccgccaaacagcaacaacggaggcggtggtttctcctcattcaccaccacaaccaccaaatactctatcagtgttgtgaatgcggtggtgatgtacgtcggtgtacgtgccattgactccatccatggcaaagggcagcgcgtctccatggaaacaattgcacacagcccgttcatggacattttccaaaatttggccgtctcactgtgcaacgaaggcattttttctcattattacaattaattaccaaaagcattcttgagatgttttcgctaattatgaatcgcaatcttgaaatgtttggctaattatgactaattgtaaatgtcctttttcaggtcgttatttgctgttcaacgccatcgccaatcagttgcgttacccgaattcacacacgcattacttcagttgtacgctgctttacctgttcttgggtgccaattccaagcacattcaggagcagatcactcggtaaagagtggcttttataagacctaaaagtcagtcctcacagtcccgatttaaatatgatttaaattgtctcacaatttgttgtggtaatctctccccccaccctcttcgtattttccgtccttgtagatagataacttttacacatttaaaacaatatagaagggggttttaccatgcaagacgaattttttgtttttccatagtattctttttgaacgtttggttgctctccgtccgcacccgtggggtttgttgatcacattcatcgaactgatccgcaaccagcgttacggcttttggaagcacgaatttgtttattgtgccacagaaattgaacggt

SEQ ID NO: 4441 - DNA, 1571 bp, Heterodera glycines
atcagaatgttcgcctttgtgtcagtcaattgggctgagcaaccagcaaaggtcgttcattggctcatggctttaaaggaagagaattcggaaaatgcaaacggaaaatggcaaaagcggcggacattgtgccgccgtaaacgcccgaatggaggtcctggttgggcccactgatttcgatggcaaacggcgaaagaccgctgaagagggagacaaaggcattctgtcgaaaggcgaacggggcacagaccgaaggccgtaagtgatgcacggcttctgtttgcccagccaataattgtctgaaatgcacacgaagtcgacgccggagagaaaatctttgcgctgctcgaggcattcgtccaatccgtcggagccgcactcctccatcccctcgaacacgaactgacaaacgcacaattccaactcattcattattgcgtgccatcaacgacagacagacacacctttatgttgatgggcatgtcaatgccaagcccttgcatggtttcgatgacattcagccagccgagcacgggccctttgtcatcggtggaaccgcggccaaacaatttcccgtccttttcgatgagttggaacggttccgtgttcctgaagtctttctttgccccgtggtctttttgaggtgccgcaccagccgtcctcaaacgccgccggctgaacgtccaaatggccgtagaccaaaagagtccgtttgtttttgtcagtgcccagcgtaccaaacaaaatcggaggcagcggaagggtcgttccatcggacaatgtttcagtgccaagtggattttcttacgagagaaacaaccataaaagctgagaaagcaatcgtataaattgcaaatcaccgattttttggcatactattcccaagttggtcatcagctaaaagagtttgtttttgtttatttcttgcaattcggaggagtgcaccttctccgtccaatcgatcatccggaagacttcttggcgatgttccgcgctcggagaaacgctgcgaatcgcaactgattctgccaatcggtcaatccatttcgccttgcatttgtcaatttgcctgttttttctcaaaataagcgttcaaaagcattgcatgagacttacgctgcaatggaatcgtatgccatttttgaaagtgtcagaagatgaaatcaaattcgaatatacctaattgaccaatcaaaatagtattactattttttaatttataatactgtatttaattttagtcgattttattttttaaaaatataatttatttttttaaagaatttgtgatttaatacacagcggacaaataatgaagaaaatgatgcatttcattttaaataatggccaaacaaattgggatgggagagaggaattgcttaccatgcaaagactatgtatgtaacatctcactaaattgttttgtgtgcttttttatctacgtaaaactatttgcacaaattaattaccgataagaaatggtcagttgggggtttctctcattggtaattttatttatttaacacagacattaattaaaggataaaaaagcgaaattaataaaagatttg

SEQ ID NO: 4442 - DNA, 1938 bp, Heterodera glycines
  misc_feature (908)..(908): n is a, c, g, or t
  misc_feature (965)..(965): n is a, c, g, or t
  misc_feature (981)..(981): n is a, c, g, or t
  misc_feature (1879)..(1879): n is a, c, g, or t
  misc_feature (1920)..(1921): n is a, c, g, or t
aaagtcttggcatcgcccatcccctaattgctgctcacaatcagtttgtacatctttattgacctgctccgttttgacagtcgcgtgcggtaagacaggaaaatggctgagcaataagcgaacagtgtttgttccatctgattggtcacaacaaattcgattaactgcaccaaaattgatcacatcagactgaacagaaaaaacaaaaattaaattgcaatcatttattttaaaagataaatcgctgcttttgtggacccataaaaccttcaaaatttcagtaacaactttgaatggaaaaagaataattgacataaaagcacctcataaacggagacaaaacgtttgaaattgtccgaaccgttagtaaaatgtggtggaaaatgctgtttgaaacgttcgtacaattccgcataaaccggctccatttctcctccaatatcgttgtcaccaggcaaataaatgcgctgaaattgagtttatttatttatttaaaattaatcaaaaatgtaaaactagacaattaggtttcgcttaaaatttgagttaatttttcaactttttaggtacaaatcttggtaaaaccttttagaattgtacaaattttcactgacatttgtggagtatctattgagcggaaaaatgttcatgaaacgtttgcgcgtgtcgacaaactgttgttcatcgcctcccagcaaaacgccttcatcaaataaatcgcccaaaaacacttccaaatccggacggactgctcggctcgccaatgcataagcacgtcgcatataccaaaaaaataaaaaataatttatttaaaaataatcgaaaaaattaaattaatttaaaaaaattttcgaaaaagttaacacctatccgcgtcccaacgagacacaataccagtccatctaggnctcatttatgtgcccaatcaattgcggatcagaaataataaggattatgacctgaantttgggtcaaaatggngcggtatttgccacaaaaaggacgctgcccagaaggaaaacagttccacgatcaaacagggaagcagacagatcaacaatggcacaaaactgcgaaaaaagggacgttgacgccgcaaagccatcaaaaaaaattaatgtggaaaaagttgtcacatttcaaacaaaaaatatgcaaacaaataaagctaaaaaaataaaattgacggcgaattattaattggtagctttactttgacaaagttaataagaagagaccggtgcgagtgcgggactaacaataagctttttttagaaattgtgggcttaaactaaacggattgccaaacaaaaaatattcaaaataaaactgtaagcaataaaagtaaaaattaaaaaatcactacagtatgacagggcatcatactactgtattctggtcgagtgttatgaaagggacattaaaaggaaaggtataaaagaagattagtgaatttggaataacaattgatgagtaagcagcgcagcatttttcgccttttcgttgtttccctggcaaccaaaagaaatgttatttaaaaaagaaaaagcagagaaataaagtcaaaaattgtgtgggtcttctgcactgatcgtaggctaacatgtcctttcgagaacttcgaggtaaatttagaggtgaaattaattaaatttaaacgaaaattattattttttaaattaaaaagtaaagtaagttctcaaaaagtaacctaattctttttgcaatagatgctacagaaatcctacgcgccttgggctatccccgccttatatcaattgaaaattttcgaacatctaacttcccgttgatcgctgaaattttgacatggatcgtccaaaagtttaaatttttttttgaaatttcagtggttttttgngcacagattcgattcaacacacgactgccgcgacaccttgnnacatgaactgaacgagt

SEQ ID NO: 4443 - DNA, 3136 bp, Heterodera glycines
catacaaatcagaacaagaattacacttttataaaagccaaacatcacaaataaatgtttttgaaaatcacaaaatgcatcttcccaaaactaaaatacagtatttatcagaagaaaaatacaaatcacaacactaaatacaaacaaaattattgccaacccatggaaaacacttaaaacaaataattttacaatgaataaaatgtttgccaaaattaatcaattaaatacatttcattttgttgccattttattttattttcacagggaatggtatatgggatcgtagatcactaatacagtaatctattgactacctagcaatttaatcaagtccataatccctatggattaatggataaatcatttttacacctgcacaggttgtgctcacactgcttcaaaaggcgcatgttcggttgaacccaaaatatttgtaccaagcggatgggcatgcaattcgcgagctgctgcccgtgttgagaatgctttatgaaagtgtgaaggaacagaaacggagcaacggaaccggggggagcggaggaaaggcagcggaggacgggggagggacattacaggtggctaattgagctgggttcaatagcattcctctttcaccaaattttttttttaattttcaaaaaatcttaacaaattcaaaaaattattgtaaaactttcagcgattttttagaaaaatcttgatcacaatgctcaagctgacaagggaccatcccgaactgccagtgtccaaatcactctaaaacaattttattgtgtagcgcataatcaatttgctattggaaaattttagtacaaacaaaaaatgattgaaaaatctacaagcaaaaacacttatctttattcccttcccggtacagatcaatgtgcttcgctcgcaagtgaatgccaaggtcgcgtttttataattttaaatttcgcttggtttttaaacaatgaaatgaatgacggatgcgcttaagcgtcaagagctccatcaaaccatcaaattggccacagaatttccaaagacggcagcttctctgtatgaactgcttcgggaggaaatatttgcaaaagtgagaaaccaatgcattctcagtgtataaatgtaccaaatgttcaggaagtgcgaactaaagcactgggcagaccgctgaacgcagcgcaggtgcaattgaacactttcaccatctttttcccatttagagcctatttaaacacgttattttccgttaatttaggggaaaaaaagaaagaaattggggaatgtttaaaattagaatttttataatatcagacaaaggtcccggccggacccaaaaccaagttcgctcaattcggataactgtgaaatgaattataaccaaaaaaccgtaccgtggcccgttgaccctcaccgagaaatactgtgcccgcctcctcccctccccagtaaaccgacctcgtagaacagtgggtacattctgttgcataggtggaaacggaacttcgggaacgcattcaaacaaccgaacaacgcattgaaggagtgaaggaacggctccaaaacatcgagtcggacgaacaggagttgggccgaaagattgaacggcgtcggcgcgaaatggatcaactgcagaagcggttggccaaactgcaggcattccgtcctccctatttggacgagtacgaacgttacgaggcacagctgcgcgttcgctacgctgtggtacagttggccaattaccgtaatttggccaaatgtcaaatttcgaaccgatttttagtatgtgatactgttccgcaatttgcatgcgttgcaaagtcgtctagtacaatctgagcacgcggagcgcgagcaggcactggaggctgaacgttcaatgcgcgaaatggttgaaaaaatgcgcatggaaagcgaacaggcggctccattgtaggcgcttaatgaaatttctggccccaataatttggccaatcattcaattggtttgtctagccactttttaagaattgctggcattccgctgcacattgatgagctgaaccaagctgcagacgacgaattggaggaatatggacaaaatggaagacagcgacgaccaggaggtgggtggaaaaattggacacaaattttttatttcagtacaatatttaaaatagttgaaataaagtaattagagcttggatgggaaggagatcccgccgggactttcccgggatcccgatcccggctttgctaggacacggtttcccgttaatgcgtaaagacaatgtccctatggcggttgttcttttttctgtaaagtctcaatttccgcaaacagaagtgcgcgttttcggcaacatgactgggttgggactgtccgatgacgatgaggaggatgaggaagaggacgaggatgggctaggaggtggacgaatcattgaaatggaggatgaggaggaattggatgacgatgatgatgacaatgacgattatatgaacaattttatccgtggcggcggtaacggttcaacagcagcagcagaagggaacaccacaaaacgacaacgggcgttaattgagagcaaaaaagtaattaagttaatgacaaaaaaggtattaattaaatcaatccaatgatcggcagatgcgacaagaaaacgtcgatgaagaggaaacggacgaggacgctgctgatgaagacaattcgggagacaatttttgatcatacaaaaataccaccattctttttacactgtagttggatagatgtttcaatgggacaatttttttttataattaatatttttcatttggtaattgtagtattttttaaccagagtagagcggtgcgattcagaaatgagaattttaagctaatttttaaatagatttattattattaattattattatttttttacacatttatattcaattaattaattacttgtttaattagtcaatttatgcaatattattggatgttattatgtgttaaggtacttatacagtttacgccactatggatgagtctcgcgcggcttttttttgaaatgtgcatgaaatttgacaccatcgctaattgctaatgatgatgataatgatatgcgtggcaaaatgggctaagcattcgcggcatacctaatttttttttttatatggtatg

SEQ ID NO: 4444 - DNA, 3205 bp, Heterodera glycines
  misc_feature (2429)..(2429): n is a, c, g, or t
agcacccatttttgccatttcgaacccctgacccgaactctaacaaaaacaaaattagaaagtttgtatggatgatgatatcctcattggcatcttgcccatgagggtattatatgtacaggaagcctgtcaatttgttgtccctgtacagctcatgtagtgaatggtagcgccgatctgagcccggattcatgatcagcgacctcaaaaaccccttaaaacttattttcattaatttctaaaacacatttataggcatttgaaaatgtatgttaaaagtaccctgtaaactgtataagtaagtacctgtgttaataataaacaattaaaatttaaaaaaaaagataaattaaaatatcattggattatttattaattggatagcatgattttgttataattttggctctttttttttgcctggaaatgtttccctttttgctcatttttacatggcaacagcagaagcggcagtggcatggacacgacaaaatggttgttggtcacgttcgaagtatgttttaccttcaagtccagtgccacaagtctggggcaggaaggaaaagcaaaacaaatttagagcctccgacaaacagaaatttggggaaaaataataaaattttaagcctccgacaagaaaggtgctaaaatggagcagaaaaacttaaagctaccgcgcatttgaagcagtccgcgtggaattggcctccgagtgcttccagccatttttggcccactttaattggttttagacagtccgaacacttcgtggtgaacagcaaattccaatctgtacatagaatcaatttcattgtatattaaaatgaatttacgtccttggtatttttgggttttgcattacattttcctccgcgaaaaaattgttttatttttcttagtttttcctgtaaaaaaatttagaaagaaatctatttttgaaaaaaaaacatttttatgggaaaaaaacttttaagaaagttggaaaacaagaacttgttttacaatataaattttctcggagggagggaggcagcgaacagttccagtaattagtaagggtaattagtgatcctcatcatcccattatatcagggctacccttgaaaatttcccaaaataagtatttcgctggtcaaaaataagttttaagggtcaaaataagtacattttttcaaatgcttccaaactttaaatcacatttttattcaacaaaatcaagcattaacaacatatttctcgccgccaactatttttctgagcaattccggcttagaaatgagaaatttatacattttcgaaaatgaatttaataattttgtttaaaacataagcaatttgtaaataattatagttcattcgggatcaaaaaatcagatttttaacaattttttgcggtgtgctttttccaaaaaattttgaggaatgggcgatgggatggggtccggcagtgccggtaggcgccgccggaaaaaattttgtaatttagcgcgactggtaacaaattttcaccaaaaaggccaatttttgcatggaaaattttaggtcaatttttgaaatctcagcggaaatttgcggcactgcggcgccgataggcgccgacgggaaaaattttttttgggctttttcatgaattttgttaaaaaaatatattcaaaaatccccctttttgctcctttttatgccttgaaattcacgctcataatcagcgtgaaatttatatttgcggtttggtggagccattaacgtaaataattaataatttaaactctaaaaaatgtgatcatagaactttctttcgaaatttagaatatttagcgaatcttgttacgattttgtatttaacattcgcttcaaaacataatttttctttcaaatattgctataaaaatcggaatttcctttgagttccaaaaataagtacaaaataagtaccttgagctgaaataagtacaatacttacaaataagtacaaagggtagccctgcattatatggattataaaaaaaaggaattaatactacaaagaaaataattttaaaaaattccccaaaagtgttcaccctcttcacagtagggtttgccgtcctcgacaaagaatgagagagtgccaaacggtttacgacaatgggtacaagtgaagcattcgttgtgccatttgtcgcccagcgcgttcagacaattctggcaaaaaatcatttttacgctagtacaataatttttttaaaagaaaaattcaaaaatttttaaaggattatttttgctaattttacaatttaaaatctattgaaaattttaattttcaagttttttctttttaaaatttttaacaaaaagttcaattttagatttaaaaaaatttgttgtacgacttgcaattaacccgttgaaattgtacaagcggcgggaggggggggggggtatgggtttcnaaaaaattgccaatacatcccaattccgataccaaaatctttttttgtttttaatttgtaatcccaatgttgtgccacctccatcaacggcaagaagcatttacggcacacaggcgccatcaaacattcatagcaaatgggacaataatttttacggccctgcggctcttcaacaaagccactctccaataagcgtcgaccacatgctgtatacaataataattattatttgaggatgaaaaattgggggattttttgaatactaattagctaataataactaccagaattagcgcacacaaaatgctctggacaccaacaacgacccttcgccaacacaaattcggcaaaagagcgcaccatagcaaaaatggcggagtttgaaagacacttctctagggtttgaggtgttttgagtcagaagtttcgcttttcaaaaaaatcattgggatcgtacgttttcggcaaaagagtgcaccatagcaaaaatggcggagtttgaacgacacttctctagggtttgaggtgttttgagtcagaagtttcgcttttcaaaaagctcgttgggatcgtcctttttcggcaaaatagtgcaccacagcaaaaagggcggaggttgaacgacacttctctagggtttgaggtgttttgagtcagaagtttcgcttttcaaaaagatctttgggatcgtacgttttcggcaaaagagtgcaccacagcaaaaatggcggagtttgaacgacacttctctagggtttgaggtgttttgagtcaaa

SEQ ID NO: 4445 - DNA, 2018 bp, Heterodera glycines
  misc_feature (55)..(55): n is a, c, g, or t
  misc_feature (60)..(60): n is a, c, g, or t
  misc_feature (78)..(78): n is a, c, g, or t
atttcacattcatcactcctccactaatattcggtgtcgtcgtcgtcccattttncaatngcagtaaaatgaatgaantggggctgaacacacaaaaaagccatttgtgcattacacatgtttttccaaatttccaactatttttcccatttttgcatttatcccatttttgtcctttgctcagagaatggcgcccttttccctttcgcccgtcgaccgaatgcgtcaaagtgtgttccgagttcgaagtcgtcttgcggtcaatttgttgtcggaagggttggccacctttctgctgctgctggtcggcaatggcattggggcacaacacattttgggaggggggaagctggacaattacatgcaggtgaattccaaggggaagtgccaaaaatagagtggccaatttggcacggctaactcagcggagacaacgagaattaggcacaacagacaaattgggggtgggagaacaatttagctaatttgagtgtcatttgacaacttactccgccacccgccaacggcaaaagcccaaacaaagagttttcggaaagttctttcatagcggtcgttttatgtaaattagaatttttcgcacccaaccgcaacctttggccaaattctttctgttctatgggaaggagcagattttactgcatatgttacgagccatttcattttcctttctttgtaaattgattttttaaaattatcctaatggagcacccaaaatcccaaatccgatcacttttattgtacgggtcaaaactttgctttgatcggttggaaatttattaaaagcagtttttctggccaaatcaagtccggagaatccaaatcaggcctcagatttgatctctgaattttctctggcattgtactgctccatgtcgttgacaagaagttgaagcagtacagggtcatagaacagcaactgactaaatctgaggcgatattcggattctccgggtttggtttgcccatgaaaacatcaatttcattttattaggtcctttcagaacaatgttgtacaaagagggtgctgaatcttggcacttttgagcacccattttcagacaggacaactttaaaaaaataacccatcggtcttggtggctctttttcagcttgtcagatagtcccaacattgctctacaaacccataatttgttttgcacctttagccttttcttggccaagaaatcagtggttgaatttggccacttttttaagtagaccgatcagtttatttgagtctaactatctttttaaaatctaaaaaatgggagaagattgtggagaataacggagcatattttgattaaaattggttcattagttaatttgttacgatttttttaaataaatttttggtcgctatgaaagaactttccgaacaccccaatattagagccttgaaatttaggattttggggaagggaatgtatgtaccacagccggcaccccggagaaaattctgaagcgttaagtgtgatctaaaaggttaggaaaatcatattagaatttaattttgaaaatactttgataaaatttttaaaaaatacaaaatccttaaaacataaacactgtaaacggattcctataagtttgtttcaattcactcctactaaacagtatctcgtttgcaaaaaatactttgacactgacgcattttccgatatcgcccaacctccccttgtggccatgactttgatagtggtcacataatttcaccttttcattgtgccaatttatgtcaggtgtgcttcggctggggcatgctaatcgctcttttggtgttcgccacttaccacacatccggtactactaaatgatgtggtgcccagttgtgccaatttccccccccccgtccaaaggtggccatttgaaacccggccgtgtccctcgccttcgttagccttggcaaattgccattcgcccattttttgctgtatcccctcgccaaactgtcggcgcctttttttgctcccgccctttgctcccacatctacaga

SEQ ID NO: 4446 - DNA, 4889 bp, Heterodera glycines
tttgttaaaatcggatttttcaaaaatgccaggaccggattggactgatattttcaaaagcaaccggtttccgacccggcctctcaaaaccggtcaatccagaatttttccaaaaatcgtgggaccggttttcgaatccagtaaaaaccgggtcctctccgatctctttttctaggctaattttttgtcttgatcacgaaaatgacatttctttttagccataatgagtttacaatgcgttacgtgacaatttaacatatatgataaatttgaaaacgaaaaaattaacaacaatttaccgatcttcgagaagaactcgaaagtgtatggcattttacgaaaaataaaaatatcaaattttccaaattttattcaaataaaaaatccaaaagaaggacaaaagccgcttacacatttggatatgtttagatctccaacaattttttaagtttggttctgtaactttgtatggaatttattgatgagaaatctattgttttgcttaattcttgtaagttttttgtagtacggttaatgaaagaatgttcagatttagttattttagatttagtgattagtctgggaaaaggtgaatttcttctttgagataagttatatagttttagagggtttaggtgagtttcttgtttaataattttgaatgctgtgtcactcaaaacataaaaattatgggcaagtttgttttttatcttttaaaaatatttagcgatagaattaatttaaaagctttatatagaacgatagcggagacttttctctatttaataaattttatttgggatttttatattgtttcgctgatttttggcagatttttaaaagttggtggttaccactgctaccatgggtaggggcagggttggcgttttaccctggttacatggttaggtaaccagtaaccaccttcttttactctgcgttcacgaaccaccaaccatcatggtcaaatgaccaggttaaatgaccttgaacccgtggttgctcatttgctacgggtaaaccatgatggttgtggttatttaaccataaccactttcttttactacggccccaggcgtcccaaatttttattttctcgacactcgcccacactatttactcgccatcaacaaaacttgccggggggtgcgcaataaaaaagtgaaatgataatgaatatgcaaactcaatgtaaaaataaggtaaataaataaaataaaaaagaataaacaaataagaagagggggggggggggggggagtaaaaatgaaaacaaattttcataaggctgcaaaattgttgcagaaatcgcgtgcttcaaatctcaaatgtctccgttcttgttctttttttttgtacacatctcgtggtctgctttctctaattttaatgggtgttcaaataccataattgccgccattcaatgaaaatccgtaattgctagagctcatcatcatgggcctagacccaggcctggagttttccttcatgtccatgccatttttggcaacctggatttttcctggatccagggaatccatgcccaggtccaaaatagaatgccaggtcctggcttttttcaaaaaatcaagctctagtaattacgtgtccaacagctctgcaaattgccccccccctcccctcccctcaacttgcccctatgtttttacgcaatttttctttccctatataagaagtttctacccatgatccaagcataaaaatgaatatctcgagttatatcgagtgttacggggtggaagtggtgtcattcgatagggttttggcctgcctataagggaaaaatacgggttttccgaaattttcagaattattcgaactatattcgaaaaatgggtcaaaaattgcactttttttgaaattccaatttttgaacggtttttgcacccaaaatatgtcaaatataaaaaccatattttgaatataataaaatcaatttttcttttcttcttatttaattctcacaagaaatttaatcaaattcatttgaatttgtttttttaatttagagaaaattaatcataaaaaagcactttcaaatttagtaatttttagtttttgctattcaattttcaaaaaatttaggtttttgtttattctctaatttaaatttgattttttaactttttcccaaggtttctcataggacaaataaacttaaatataaaatccctcttcaattttagtaattttaatttctgtgttatttaaattttcgaaaaattttctaatggacttcgatcctgaccacgagaaatggaaatgctgctgttgccgcattccgaccggcctcaaaattctcgggttggccgagtgcgtgttggccaccgcggtgttggcacttggcctccatctgatccatgtccatttcgtgacggacaaagtgagtagtacaaaaatactcaaaaatcaaacatttatcggaactccctagaaacccactaaattttgcgaaccgagactcgaaagttaatccattgtcttgagaccaataattcagtggaggtattggccccctttacacacacactactggtgctttatcggcactcgccgtggcggttcatccccgccagggcccgtagaataagaacgtggttatggttaaatgaccatgaagttggtggtaaaacccgcagaataagagctaccacgaactttggtaaaatgaccacgaagttggtggtcatttaaccatgaccatgaccctattttttttaccatgagccttttgacacggaaaattgtgagataaaaataaacaaaaataagtaaactaattataaattaattttattcctctaataggaccacatatccctcattatcacataaatagaagaaattaacaaagttattgtataaaaacccgggattgtcaattgattggactcataaagtgcattagagccattgatttttgcactttttatcccttgacttagcaccaatttacatttttatgaggattcttttttaatttcttataatgtccatttttattgacctccactttcttctttttcgttgttcttacccaatcgaatgccatttttggtgaagaaaatctttcgattagccaaatcaatgccacatccgaccgtatcgccagcaccgtatttacatctcttgtcaattgtgtgggaaccgtttttccacaaaaggctattgctaagccacgcataagtgccgtcgcgggtgcaaatgtactcatccaatgccatttgcctttgggcgatgaatccgaaggcgacacaactgaaaatgaaattatgagggaaaaagtagaagctaacaaatgaacgggtttgatcttactctttcatatttttgattgaaatttcaaagtaaaatctgttggcggtgtcattttgatcatgaaaaatcggatactttgcgcagacggagcgctttccttttatgaacaagaaaaatgcattataattaattatttaaaggatggaattgttttccattttatttttacccgaggaatttagaaagaatttaaatcttttttcaaaaacacatccgtttcactctatccagatttttgatgtattctcgaaaattaaagaaattgttacttttagacagtaaaattatttttcacttttttcttgaattatctaacaataagttgcgtttttgaaatccgttcgggattctgaaaaaagtgttttgagtgcagtttctaaaagccagaatttttacaaaaaaatttcgtacaaaaacaagacttaccatgcattaccattatatctccattgtgacggaccgtcaaacaatcggcaccaattatttcgaggtcactgtgacagaaattggcatcccaataatttgaaatctgtaattttgttttttaatttttcttattgccataaatttcggaaaattgaaaaaaaaacactgttagtgatgaaaattttttgaggtatctaaaattaatggggttgaaaaagtcgggtaggaattctccgataatttgtgaggatagcttgagaaatttaaaacatgtcggggagcagcaataatctcttgtcggggaggaaatttacatatttttttaaacataaaatcttttaaatccatttaaagcaccctctaatccgttttggaatgagactgaatctgatctgggaccaaccctaaattggtaaaattacaatctttcataaaaaatttccttcctcaattcatacttaccactttctgctgtcgcttttccaatccattagtttcaattttctgctgctgatcattttgtaactgagtgaattgctcggaagcttaaaatgatttgaattttaaatgtttaaattattttaattttaacacaagtaccgtattcattatcgtaatgctcgtcttgctgttgtttttgttgtttcagttgctgcttttccaattcactgatccgttccaaaagtgcaaattgattattttgcattttgaagaattgatcgaccgaaactttacaaatttaaatcattttaataattaaaatatttgtaaatcgctttggttgaccatggtttgctgttgttgttgctgtgcccttttctttcactttttgctgcttctgttcttcttccaattcaatcactcgtgccaaaagtgccgcgaattggtcggcagaaactgcagtttaaaattggaattattttaaataattaaacggtgcaatttaaaggcaattatttcttatacgagtattctaacccatcctaccgtatttctcatttttcttcttttgttgctctttttcctgctccgttttggcaactttctcctgcgataataaaatgtgttgtgtcatcactttttgttgcttcatttcttcttcaattgtcatcttctattaaaaa

SEQ ID NO: 4447 - DNA, 1617 bp, Heterodera glycines
aaaaaccgggaaatttccctgtcccggtcaaaactgatcaacccggggatttcggttctcaggttgtccgtgttttgggtcccggtcccgaccaaccttagttttaaataaatttttttaattacaaatattatcactttaacttgcgctcaaaaaaatataaatttccataaaaaatgcacaaaacaattttattttttgctttatatttgtgggggagaaacattaaactttctgagtgaggactagagttgcacgggaccggggcgggaattcccggttctgaccttcatcatttttcgcttaggttcaattccccaaatgaacataaatttttttcatattttctttaccactattttaattgaaattttaattaataaaaaaatattccaaactttttttaattttaaacagcctaaaaacccaaaaattaaccaaagattcggtcattttatttattttaaaaatccagagctttgtgactcagaaaattccaggattccccccccctccgaaatgaaaatttttaaaaattttccaacgaataatggaaaaattcttcgaattcctcctccaaaggaaaattaaaaaattttatgggtacatttttggacataggcaattttcataacaaagtgcaatcaaattttcaaatttttttcaaaaaattttctcttggaaaaattcccggttggtcccggcttttctcgcggtcccggtccctaacgaaaaaagaggtcccggtaccgactaaaacttttttctcattcaggcagaaaaccttataaatttgcgtctccttcattttgcttaattatctgacaaaacgctgacccaaaaaaggatgaaaaaattatgggaagaaaggaagagaaagatgagaggaagagaaggataagaggaagggaaagatgagaggaagggaaagatgagaggaagagaaggataagaggaagggaaactatgagaggaagagaaagatgagaggaagggaaagatgagaggaagagaaggataagaggaagggaaactatgagaggaagagaaggataagaggaagggaaactatgagaggaagagaaggataagaggaagggaaactatgagaggaagagaaagatgagaggaagggaaagatgagaggaagagaaggataagaggaagggaaagatgagaggaagagaaggataagaggaagggaaagatgagaggaagagaaggataagaggaagggaaactatgagaagaagagaaagatgagaggaagggaaagatgagaggaagagaaggataagaggaagggaaagatgagaggaagagaaggataagaggaagggaaactatgagaggaagagaaagatgagaggaagggaaagatgagaggaagagagggataagaggaagggaaagatgagaggaagggaaagatgagaggaagagaaggataagaggaagggaaactatgagaggaagagaaagatgagaggaagagaaggataagaggaagggaaagatgagaggaagggaaagatgagaggaagagaaggataagaggaagggaaactatccgaaaaagagaaagatgagaggaagggaaagatgagaggaagagaa

SEQ ID NO: 4448 - DNA, 619 bp, Heterodera glycines
aggtctcctgaaaaggatttttaatcctgaattccgttccgtgtcaaattccctaatcctgattcggatttttataaagtcggggttttagtaatgagtagagtaaaacaattttaaaaaatgatgggaatgaatggaaagaatggtctttggtaagtgttttgttacacaaaaatcagcaaataaatcaattacttctctttatccctcacctacacatttgaattcattcacatgtacaacaaagaccattcttctcttcattccacagtctgaacaaaatgaaagatgaaccaataaaaagagagtgcagagaaaaaaaaacaaaaatcctttttttctctatttttctcctttttttgcgtacaatctaatatttttctttattaggaacatttgcttcgccatacatatagctagagctgggatttttatgtgctaaaaaccccccaaaaatgccaaaatacagtcatggtcatatgtttaacaacactcaaaattttctaccaaatttgatttaaattgattataaaatctcaatatgactatattgtgtatatatgttttatatttaatgtagcattttttgtgggctttataatgataccattcactatcc

SEQ ID NO: 4449 - DNA, 3880 bp, Heterodera glycines
  misc_feature (100)..(100): n is a, c, g, or t
aaaaaaaaaaaaaattcccccccgaaaaaaataatgaaaaaattaagcatcgctcgggaaaaattcgcaaaattttgtcattgcccacgcaaaaggcaanttgtatggcatttttgattaaatttccaattttttgatttctataaaactatacttcttaaatttttttatataaaaaattcttttattcgaactccagaaaaaaattgaaatttttttatattttttgtaaaaatagaaatttaaaagtttgattctacaaaaagactatttttattttgattctctttatttattcttttttgctgcacaattggtggaataattttttttcaaaatttcattttttttatttttcaaagtcgaggcctcttaatgtatggacacagtagagtaaaaaaattttttattttttaagaaaattggttgaggccatgtgttcagctctgtgatggtggtgctgagtaccaaaattgaggcgtgaaattcccagagcagataattagggattgaattttgcggggaaaaaaattcgcatcgaaattcggtggcattttgggaaaagaaaatagacctctaatggcagcacaatgtagagtaaaaaaaaaaaatttttttttcattttttttgttttttgaggaattggctggcgcaaatggattcagctctatgatgtggtgatgagtgccaaaattgaggaggtgaaattcccagagcagataattagggattaaattttgcggggaaaaaaattcggtggcattttgaaaatctattgtgttatttagaaaattcacttggaaaatagatatattcgagagttttgttaaacaaatttcgccagtaaaataagcattttcaacagtcgagaaaataaaaaaattttcagtctaaaattttgaaaattattcgatcaaatttattttttttctttatattccaaggtcgatgtcattatgtcctccgatcccatgggctatatgctggtcaacgagcggatgttggagatgagcccgcaaatttcttcgccgtgttagtcactaataaaacaattttattttccaatgtttacctataaacatttttttttaaactattgtattttttccacatttgtaagacaagccaatgtgatggagttggagatgtacatcgatgaaaaggcggtggcaacggcaacaaccaatgccgcgagcagcggaaacgggaacatttgtcaccgaccgggtcggcgccgttggtaataacttttctcttaattttgtctttttcgtcattttttgtttgttactcaaaatttattttttatcaataatgcgtttttttgttattttgaagctaagtgtaataatttattaacttcgtaaacggtctcttccagtttttgcattttttagcacaacattgagtcagacaatgcaaaacggcgaatttgattgtactacaatatgttgttggtcgacactcagaaatgattttatgcgttcaatgctaataaacaaatgctttgtttaattgcgtctcccttaaattgcacaatctttttaattttaattgtttagagcgttattttatgcgcttttatttttcattttaatgattttttttttgcttattttataattgtttaagcctgttatttgctgccttttgccttgctttaaagagctaccaaattttattggtaagaattcatttcccaaaaagagtgtgcctatacactttaactttattacagactttgtcctcaaactgttacaaaatggcgcaaccgaacactccaaccgttgaagttggtgggggaaaggggtggggggctgaacatggaataggggtgcactctcggcttgaaataccctaccttgcaccttttggtttgcaatagtctaaaatatgtatcaaacgattcctgtcttgtgcctgtaactttgtatcaaattgtcgccggccacccagacttagctttcacaaatggcattttgccaactaaatctaaatcggattattcgccaattattctaaaatgatgtttttgctggatgaaaatgtaaatacatggttcctgttcgttcttcgatgacaaaattatatgtccttgaaaagtatcgttcgaaaaaacattattttattaaaaccaatttttaaatacctaaaagttttcctaagcctaaataggccgtttttacggtattgtgttttctaagaatttttattccaaaaatcatgaaaaatttttttatttcatattttatgtaaatttttttaatttacagccctattgaccagaattcggaatcgtccgattttgtataattggctacctgtccgcgtccatgacgcataattcattttaaatcaatttttcccttattccggtccgctgatatcatggatatttttgaaaattatagccctaaaaactctcctttgatttttgaaaatgtatcatccctcaccaagcaaagagtgacaaaacatatcgccaaaaatgactatattgttttttaatcgctaacattgaacaatatttgtgaatatgcaatttttcctcaaattatttgtttaatattggactaaatgttatttttttacatgtatccactttaaggtcctctttttgggtttaaatttcaaacactttaactagtgttaataaattgtttttttgttaataaatttgttaattaattttcataccaaaatataaaatttttttataatgtaatatgcaagaatactccgtaaaccttatagatttttgactttgttattgttttaatttttcccatgtaattcacatagcatttataatttaaatttattttatgaatgatttataaaattaaggcaaggctcaaaagtttacaagcattttgtattagcacgctttttgttgtttgttttttggtgtttattttaatagtgctctttttttgttttatttttgaacacgaccacaacaacttttatccatctacacattatcattttctttccctcctgtttaatctttaataatatttaaatcccaccttttagaaagtatgaaattgtctttatctttattagtattctggtctgctcttataatttttgtttttttttcttaaggaaatacccaatcatttaattaatttgttagttaattgccctttgcttatttaaaacaagccattccgatagaataatttgtttacatttcgagttcgtccagaattgaatctttatttctgccgcattatctctgtcattaaatttgacaattcataattctatttttcatctgattctttttattgttaatatcataaaaataaaggtcaagatcgattttcaaagtttcaagtactgttttactctaatttacaagcaaaatctaacaaatattatttcaaataactcttcttaattttttatagtttgatattttcgtcatcttcgtgttttgtctccgttcattttcttctattataaattgagagcgaaattatctttatatttctttattttttatccttaataagtgtgaatatgagttttcaattaatgctctttggaaggctcaattaagtggtgcaaaattatacttgtttcacaaaaattcccaattaatcactgattaatataggattctgtggcctaaattaatacatttttaaaattcgattataaagcacaattttactttgacgattatgcttttttcgattcaataaaccttacaatacatataagaaattaacaaaaatacacatccgaattattatgtttatattcttcttatttgggaaaagatcggagacgaaggggcaatagagagagaggcgtcttcgtaagacaaaataattaaacaatttctaagattttttcaaattaaag

SEQ ID NO: 4450 - DNA, 2248 bp, Heterodera glycines
  misc_feature (18)..(18): n is a, c, g, or t
  misc_feature (113)..(113): n is a, c, g, or t
  misc_feature (153)..(153): n is a, c, g, or t
ggtttcgatcgaaaattnttcaaatcggggtcaaaaattcaaatttcaaaatcaggacatttctctgataatgggggacagattgaagccctgaattaaactaatctttaatntaggagcgcgaaaatgcttacaaatgtgagattctttacncgctccaaaaatggccaattctgttgcgccttcactccaactgtctcccgtttctttcgattcacacgtttaatactgcggccaattattttgtggtcgccgaaacggactcgccggctgattatctcctcaaatttcaaattttgattgtgattgacaaaaacaaccacccatttgagcaaatgcgcgatttggtacgttggattgtcacgattttttgaattttttaaatttttctccaatttttttttaaatattttcagtgcctggaaaaaggcagaaatttctgaccgttgttcgctaaaaaccacattgatttttgggtggacggcggtgccgttaggcgacgtcgagaaaattttttggttttagcaatttgatcgggaccaggagaggatcccgggtccggaatttaatttattttacatttcttaaaatatggtcattatatattttttcttcttaaattgataattttttttatttttagcctcttggaaaatggtttaattttattatttttggcactttagaattttgacggcaattctttcttaatatgaccgttaaactgggaaagccattttaattaaagtattcaaattttgtagaattctctgctctgtgcgaaattgaatgccgcagcggccacgatggctgacatttatggtgcactgcttctgcatgcgattttcgatggcagcaaagtgtgttatattgaaaaaaagaattttttattttcagttttaaaaaacagggttaggcgcaggtgttccatattcgaacccaaagtcagcgaggggtggtcagccatcacatttattaatgggattaaccctcgaaattcgacatttttttattacttttcgcaaatctatgttcgtgttgtgttttgttcaaaaaaatcacgagtatggttaggcggcgccggataaatttttgttaatttagaaattgtttgtttttttgcggtgctgacaaatttttggaattttgagccaatttatgtaaataggcggtcgtttacctatgcatttttaagcgtttttgtctgaaattatgcgcacacttcgtttttaattgccttcattcatttcaggattacaccatggtcagtgttagcttccgtcgcgagcatcagccatttctgtcggagtttggggcgttgtgtaccaacctcagacattttctgttggacattaaacagtacttggacgaacgtttcccggcggatttctaaatacagcccattttttcaaaagcgccgatgccgctctaaattctcgacatttgttgttgttgtttaaataagaattatcttccgagactgtctgatttgttaaattttcaatggccgagtaaagattaaatgacatttagttaattgaacacacaaatttgcaaaaacgcaaaatgtgcactaaatttaccaaataatggaatttgtaaattgattgaattacataattttaatttttccaaaactgctaaaaatgaatttacaaatgataaattggccctaaactcaaatcgagactaaattctcgaaaatctctactgttctccttcatttttgcttttttaaagcaaaaattttcttaaaatgacgaataattcttatgtgaatttattttgttacgatacccattaattgattttaaacaatttgaaaataaatggactttttgaagcatataaaaacattattttctacgcaaaaataatgaacaatgaaattgagacagcaattgcacaacaaattagggccaatatgaagaacaattgggactggccaatgcaacccttaattaaacaataaaagacaattaatacctattattgtatgaaaacaatttatttgttggtacttatacagtttgcgggatacttttaacatacatttttggatgcctttaaatgtgtttttgaaattaatgaaaataaattttaaggcattcaaaaatgtctggttcacgaatacagcacccagttttgccaaattctaacccctgacacgaactctaacaaaaataaaaatagaaaatttgtatggatgatatcctcattggcttcttgcccatgaggataaccttgg

SEQ ID NO: 4451 - DNA, 2519 bp, Heterodera glycines
atggatgatatcctcattggcttcttgcccatgaggattccttggtacaggaagcataaaattcgaaatttgtatagatggtaccattatgggaatttttccaatgagggtattattggtacaggaagcctatcaattctttgtccctgtacagctcatgtagtgaacggtagcgctgatctgagcccgggtgggttcgtgatcagcgacctcaaaaaccccttaaaacttatttccattaatttcaaaaagaaaatttaaaaaaagccaggtcgtaatcagaaaacgtaattggtctttcgtaaaacccgccgaaagaaaaagcaaataaaattgcttatttgttagtcattttatttttacttctagtgtgatttaatagctctaagagattttttatcagaatttttttaaaacttgctcctaatccgaaaacgtgctggaccgtttcttaaaatgcgccaaaggataattaaatgaaaaaacaaaatcataaaattacttaaagtcatccgaaattttacattcttggtgtcattaaatagttctaagaattgtcattcataatatataagttacaaaatatgcaaaaaatttaaaaaaaagcacaatcaaaaaattaaaggattcgcaggctttatgcaattttatgattattttagaacttttagaaattatcaaaaaaaagaataatttatttttaaattaagtgaatatattataaataagaaacaatacaaaaataattcttttttttatattaaaatatataaaataattagaaaaaaaatttaataaaaattaatgtaaaatcaattgtttggaaaccaactaattgatttggatttgaaacacccaaatgctgcaacatcaattaaaatgtttgtgtttaatggtaatgagatgcgacttttgcataagttcatgaattatggccaaatggtgaaggaccgaaaacgcaacgaatatcgactgtacgaagtgtttcaaatcgtgtttgaaaatcttacgttggtggaggcatatatcatcattttgacaaaaattgcctaacattataaaaaaaagcctaaggacaaaacgccaaaaaaccccactaatttaaaaattttgccgagattttcccttgtaaaaatggaagagccgatctcgagttaaaaacacaacttccaaaaaataaacagggattcaatagagggggtcaaaatatgggcctatgcaaaatttcaagaaaattggtcaataggaaaaattttttttcaaggacaacaaaatcaaatgtattacaaaattttagcataaaaatggtatttacacgtagtaaaactggtaaatttatgaagctaagcgattctgggactgaagcaaagcgaaagcgcaaggaatggcgccaggagcacgcaagaaaagctggatcaacaccaaaaagtgatgaaattttgataaaaatttcatttcaattaaaatcaaaaattttgctctccacgtcaaattcgcccaaaaatttgactttacttgcgtttgggagggacccgagacccgctcggaaatggaagcgcgcctaggtccggtcttggaacagcttgagcaaatcgctgatttgtcatttgatcgaaatttgacgattgaatggtcttataattttttaattcttttgcacaatttttcttaaggttctgaccggcgacatggctttcatatgcgcttggatggggcacatgggaccagcctccgtcttcccttgtgcactatgccgaattccatacaaagctctgggcaacaccatcatcgggacaaggacagcaaaatcgatcgtcggtggcgccgcaattttcagtcaccgaacagcggacacgggcaagcacacaactcgggactcaatttcatgtggcagtcaaaaagccttgccactctttttcgtgccaccgacaaatgtgattccttcaccatttcacacatttcactccgccggacggaaatgcattgacttttttgaaaaaaatgggtcacccgtagaaaaacgtcaattagaagaaattatggcaaaatcgggagcaattcggcatgccaagacgcaagagtatactggtcctgacattcacctctttccttttttcaaattaattttaggtgatcacatgaagcgcctccttctcgcctcaaccgaaatcagctcgatcggaacaccgttttcgatggacattgctgacctccttgacgaaattcgggagctccacatttttggacgtgctgacctgatgacccaagaacaaatcgacaatttctcaaataaatgctcaatggctatttcaaggcaaagatactttttttctgtttttctcattttccccttttcaagaaactttgggaaactcatccggctaaattcgacacaaacaatgccgctggattcaccccaaaattacactggcttctcgcccatggtccagactttgccaagcgttgggggtggttcgcatggatcagtgaacagggaatcgaacaccttcaccacgttt

SEQ ID NO: 4452 - DNA, 5280 bp, Heterodera glycines
  misc_feature (1628)..(1628): n is a, c, g, or t
gatcccgtccggtctctaatgaacacccaccctaacagtgtaaacaatttttcggtttcttggactaaaaacgcgagaccgacgagaaatttcaatgaatcgagaacagaggctctcgcatatctctagtaacgatccagcctcggctgatattatggaaaataaaatatcataattttagcaatgatgccaaaatctcccaaatttcgccggcggtgctctgttaataccttttcctaaacattctttttaatttgttaaagatcaaatattattaaaacatttacaattaataaagataaatattattaatgaataatctagacaattgttctcttcaattattaaatatataaaattgccttatttaaatttaaatttaattattatttttaatttttatacattaacttattaaacaatattaacaaaaaacaaatttttttttatcatttggttattttatgtgcataaatatattatgctttcccactgattcatctcacatcacccaaatcacaatttacatattcaattggtaattacccaaatggacaaaattatataataaaaattccaaaccaggaaagtggttaaaataaacaaaaactaaaaataatattattaaaattcaaagttttttactattttagcaagcttaaagattaagaaatattccaaaatgtgccagccaacgcatttttttcttccgcttttcatcttcagcgccaacaaactgttggccgagaatcttgctggtatgaattagtgtattgaaattgattaggaaagatttttgatcaggttttcacgtgttaaattgttaaaatacacagtcgattattcatatgaaatatttaaaatttaaaaaacaatttcagaagctctcaagtgcaagcagggattcgaaatgcgtccaatggtcgaacaacaaatggatcctgacgaatgtgtcgatgttgcgtttcctcgatattgtgaagcctcaatttgcacaactgctggtgataacattggcgtacgtagccaggcccttggcttcggggggggggggctgaagtcaaaaactcgatttttagggggtgtattttttgttgttttttgttttaaatcccgaattaggaaggtgtattttataaaaaatgttagccgtttttcgcaaaaaaaaaggactattttttgccattaaaatatcggatttttttatttatgaaataattaaaattgatttaaaaactaaagaattaaatttgtttatttttgaataaaaagcaaaaattttccttattttaaaatctttttttcgataagaaaaattgatttttttaatctcaaatctggaaaactttttgacacagttacttttctttaatttaaaaaaagagtccatcctttggtgtttgttcatttttaatgcgttttgaattttaaaaagttattttaaatttttttaaaattaattggacacatcgcctcagaaaatatggctttctctattataactcctgttagaataaatcataaattttctggtcttcatatacagacaaatgagcagcaacaacaaaaaaaaaactcttaaaaatttttcattgctaaacaatgaaaaattgtcctatgaaaattanatgttatttcgcatttaataattcaaaaattttctcaagatgagatgccaacttttgcgagcattcattggaaatgtgttgaagaaaaaaatgccacagaatgtggcgaaagaatgaaacaaatttatgagaaaaacggtgacttaaaaaatgttacatgccaatgccattatggtgaagaaggtgaagattttggcaacaaaaacttcacgcttccgccgcctgccgacccagcggacaaaggtagacgaaaaaaatgagagaaatttgtgaaaaaaatcccaggagaaaattcgaaaatttttttaattgtttaaaactaatgagggaaaatttgttccttaatgagagtgtgccgaaatggaactttggaccatgaaaattgtgtaatgaagtataaattgggggggggggggcgggtcattgtggtaaatttcggcttttcacactgacccttaaacatatcgaagaataatacattgattaaagttttagaaacactttaaaaaattagcaaaaataaataaaaaatattatgaatatatataaaaaaattcaaattttccgttaattttgatttaagaccaatgaaatatttaattaattcaaacggaaattagattcgcttcttctctactcattttgaaagaattttttaaacgaactaataaaataaaagatgaattttgttaagtgccaatgtgcaagattggcatgatccattcggccagcaaaagaggtctcatcgacattggagtttgcaaaaaggatcaccattattgttttgcggcaagctgctcaataaagggtaaacacatattgagttcgacctgtacttggtagtgctgttcgaacccgaaattttctcgagaccgaaccttgaccccgaaaattgagaccgagactcaaaaaacgcgagacttttctcgagtcgaaactcgagagcgagactttttataaattttcttattctttaaaaatcggttaaaacttacatatagaaaattgaaaattcaatcaagtctcgaagacaaagatcgagactgagaactcgagactcaaaccgagaccaaattctgagtcgagacacgcgaccgagagtctcgtacagcactagtacctgctggaccctcctactgaacagagggcgctgcacgtaacttgatttcaaacagaaatccgtagttacagcaaattctcagttacggaaacccgtaatcctcattacggggggggggggggtcaaaaaaggccattcccgtaatccgtaatttcatatcttttaaaaaacaaaacaaattagcttgaatcacttcaaattaagccaaatctcatttacgctcaaattattaaaaaaacacaatgaccgcgactaattaattgaatatgataataataataatttaattgaattggctgaagataatcagtctctcgtgatgtggtcatgtgcaaaaagcgacgatggcagcatctgtaaagagattgaacagaatggcatcggtgccttcaaaggtggcaaaatgtcttgtgaatgcatgttcggtgctcggaatgctgatttggcaaatgagatgatgctggttcatgatttgtttccgctaatggttggacatatttttacggggcaaagtcattaattattattttaaatatcataatagggggcattatttaaaaaactatcgttattaaaaatatttatgaaaatttatttacaatattgctcaaaagcaacctaaattttaaattattaatattatttgatagctcctaattgttctctctattaggctgcaaaatttccaaaaatttcgttaagtttcaaaaagtaatgactagaggaacacaaaaacgctatcattttttgaaaaagttaacaaaaaatttttttaatttggcagagtgatagagaacatttagagctatcgatgatactaatagcaaatttttaagcaaaattattatttttttttttgagtaaggtaagtttaagattttgtccaatttttggccaaaatgtagctgtagaacataaaaggcaactcgcccggtgggactcgaacccacgaccccagcaatccgtgccgtgctctcccaactgagctacgggcgccacttttagaggttctctcaggtcctttatcccactttctccacactccgttccttctggcatcacatagcatttttgagcccattagagttcgatgctccttacagactcccgtaaaaaaaagtcttgaagttatttctaaattcatttaattaagccatgattcttggttttggcagcaatcattgtctgctgaagacgcaaatgagcaaaagatgttggattatgaaagaatattattactattaaatataaatttaattaatttttatattaattgtagtgtgttcggttaaacgaccgtgaacaaccccaattaattattattaattataatatagttaaatttttattatcagccgggataaatttttatgctttgtattttatatttattgatcctttattttattgtttttgggtttttgtataaaatttgcatctaacaataattgttttcgattttttttttgattttactttaaatcatttaaaattggcgttgaacatacaaataaagagcaattaaatattgttagcaaatttcgaaatttcacctctttgttgtgcccaggtgccttttttcaattcccgtcgtatattataaaaattaattgttaaaaaattgatgaataaaatgagtttccaattaatataaaggcattaaaattttcaatttaaaaaaatgcataaacaaataaaataggaacaaattaatttatgcatattaccaaaacaaccaatttacattatccataatttgtatttaaatcttcaaatatattattgaacattattattgtctttgggaaaaagtgtgacgttcgaattgaggattttttgaaaaaatggcgaatttttctaataaatatgaatgaaatgccaatatttttttgtgaatttctgctggctgttgcagtgcaggaaaaatatgcatatgcataattccgaaccatttttattatcaattatcacaaatcctaaaagtgactaaattttaaacatttcttttcttcttttttaaaaaaaaattttcctaaaaatttatttattttttttttgctaaaaaatgtgtttttttatttttgtgttgaataaatttccccaattttgataattccagcttaattatgcagtatagcagcagtgcttatgattttttcgagagagaatgatgattagctttcgttttcattatgtcgttccatttgtaatcccaaataaaatggtcggcttcgtcatcattggaagccatcagcagcaatcagcggcagaacacagcagaagcacatccatttcattttcaaaacgatttacgaagaacacattttttgtatttttttcattaccgttaatggataaagtctaaattattattttttgtttttacacattgcattttttattatatacaattcgttttttctttataccatcgtttttatatggtccggtttttcagaaaggttccttttgggaataattgttaacatttagtgttgattatctcatttcttaattcaaaaattgctaaat

SEQ ID NO: 4453 - DNA, 2848 bp, Heterodera glycines
aaaacattgaaaggaatagcaagcgatatgggcacagtcgcaggaggagccgcaggatttggtgccttagtttgccacaatcattttacctggccttggcctggcagccgctccgctagtgggtgcggcagtcggatcattgattgctggtggagttggagcaatcggaggatttttttacaattttggtaagtcattcgcctgtcatgtgagtaggggggggggggggggtggaatggagcagaaggaatccagggatagaaaaagaaaagcatggtggattatgaaaatgtttaatctctttttttatgatttttgcgagagcggaatgcaacttgggggtcggcaccagggccgttgcggtgccaaaatttgttaaaagttttcgccgaaaaaatctgcaaattttgcgcataattttcttataaaaaagtgatattatgccataaaatttcaaaattgtctgcatcgaaatccccgaaacgacatggccccgaaacttgatgagattttcgtttaagaccagctgtccgcatgaaactgcatgttatcgccttgaaagtgatgtttcatggatgtgctgcacgcaaaatttcagacggaaatgtgtcaaagatttttccgaggtaataaccaaaatgttgagaagaaataatgtttaaattgaaatgtaaattttaaatcaaaattatttctacaacaaatatattttttttaaatttcatgaaaaatgaagtaattaaagttttcatcgaaacaatgaatagaaaaatctaaaagccataaaaaaaattttttgttaagctcaaattaaaatattaatttaaaaaatattattttgaattaaaagaatatttttattgttaaaaatcttttttccaaaattttatcatacatataattttgaaaaatttccaagtttttttgtgggataaattatgaatatatggctcaaaattatatggagtaaaaatgtcaaatatggacataaaacatggactgaataaaaagttcaataattgccaaataaaaattgcaaaaatataagtctaaaccctcaaaaattaaaaaaacgcgtttatctcaaatattgattggatttatatttatggtatataagcaaatgtttatacctaatcaaaaaataataaataaaaatttaagattgaggcgatgtatacgaccacaaccacaactacgactccaacgccagctcctgttgtcgcaacggttggtttaaaaacagaaaattgttattgttttaggaacagagaaaaattgaaggattcaatttccaaaaattttcctctgaacttctaatttttgatcaatctttaaaaatttaagtgattttgaaaaaaaatcttcgaaaattgtttcgttttattttgtattttttggatcaaaaatttgtctgaaattgctatgcaattttaaatagtctttttatttctatctttttagtctttttatttgcgccataattataataaggtgcataatgaataaatttttttttagtttttcccaacttgggcagagacatttggacacggactatcaataaaggtacttgaattctaaaaattggcacttttttgcaataaaaattgccctttttgctaatacttcagaattgcggtgccgacgaaaaataaatttaaattttatttttgtctttactaaagtaaaaaatgtgctgattacgaatatctgagctcagattttgcaaaaacattaattttatttgtgattttcttcaagtacttgatttttcaaaattttttattatttaaaaaaattttcttgtaataattcggactaaaaatgcgctgatcatgaaaatgaacttagattccgaaaataagggccagtaattaaatttcaaaaaatcgtaaaaaactaaaaacttgacttctccagacattcaatagcgcattcgaaagatctttttcagttctacaacacatttatatgagtttttttatgactgacaaattttttttaaattttggaaaaaatcaaattgatgaaaaacatatattttgtaatcagcacattttttacccatgaaaacacacaaataaaattttaaactttatttccatcgggaacaaccacaattctgctgccgtattacccctttttttttgtcttttttattttccgttatgttttaataatgctcatttgtcattattattatattacatatacattatttcaggcagaaggaattacttttcatgcatgtctccggggacgcaaaagtactaaacagtttgtgctcactggaaaccaatgccttttcaatgcaattggctgttattttgttttttgttatgatggtaatgagtgttttatttgatttatttaattgagaattgtgaaaaggaacaaaaatattcaaaaattataattattagggctgtcaaaaatatgcaaatgcatatttttcctggattctacgtagtctaattactaggaaaaacagcttctttttggtatttgcttttatttgcatatttttgcatattttgccatttttcgtcaaatattttacgatttgaataccccataagaaaaaaaaatatgcatattttgcgactttatgcatatttggtgcatattgcacgaatttatttgtatatttttgcgcatattttggccatttttcgtgtatattttttacagccctgataattatgatataggtgtgtggccctatgaaaatggcttgttttatgatgtatcgaattttttccaaaattaattttgagatttttacaaattcatttgttttaacgatgaggaacatttggatctatattatatttatttattttca

SEQ ID NO: 4454 - DNA, 1403 bp, Heterodera glycines
  misc_feature (719)..(719): n is a, c, g, or t
ttttctcttcttttttcctcttttttcccttttttcgaccccctctccccggtttctttcgttaaacatcagccgaccccttacgttcgaaataatgacccacccctcgcgcaggtacggcaataataacatttggacggcatcaaagggtgggcgattggcggttcccccttttaatgggcgggcgggccgccctctttgttcataaaagcattcgccgcccgccgctgccgcaaaggcgacgaaaaaaaattatgatggaaattaaacaaattatcatttatcacacacacatttttatgctgctaatggggcgacacttgggcggcgacacttttcgtcgaataaatgaatggttattatcattttcgacacaccgtcccaaaaaaacaatagagatgaactaataaatagagagtgcagagaaaaaatacacctctcattttggcgcactaaaaatttccgcgtatttttctaaaatttttaagagcaaattaagggaagttattcaacgaaaaaatattcggaagccgataactcttttttatggtacatcaaatcgtttagcacttacttatttgttagacaattctttgcctcgtcatggtttttcaaatgataccaagattgtctgtccaattgtcaattgagcaaattggttgacaaatatctccaaatattgttaaagcctttttaatttatggaagaaaattaattanaaaatattggtgtcgtggagcgggttcgaacctccaccccctttcacacacaaatttttattctgccaatgggacatttttcgcgtcctttttaccaccagcaccaacagcagcagcaacgaatgaatggttactattatcattttcgatgggttggaatggaacaaacacctcagcaaatcgaatcgcacatttttgctttttaattaattatttaatctaattagtgtaattaccattacgtgttattagtggtgagagcatgtaatttgttcattgattataacttacactcttatatcagttagaatgattttgatggtttcaaggcaaaaatttgcacctttaggcagaattgtataatgatttaattagtgtccttagaaaaatctagctaaaaatttctccgaaaaacgattaaaaaccaataatttccttgggcttcttcaaatttataggcagaaatagccattttccggaaaatgctatttttcgtccaccataaacctatgaaacattttgagaatttcttaggaaatttgggagcgaataacaaaaaaaaaataataattattcatttacgtttgactttttcacaattttttggcatttagtttcgtcatcattgaaaaactctcatcaaaatcagctccattgccttttaaatcaaactaaaatgctaaa

SEQ ID NO: 4455 - DNA, 1040 bp, Heterodera glycines
ttttagggaggctgccctccgccctcccccacaatttttcccaacccatcaagtgcatggcgatgtggacgttggtggtggtgaattgttgtcagtggaattttggggcttcgctctctctctctctaatttgtttgtttgcttgcgcagagcgtacgcgcatcgcccccatcaccgcactaatgaattcaaaatgttttttgtttaacttttgagaatttttccgaattcggaaattttttacctatgggcttcgggaccagtcagttcagttgtacccgtttgcataaaaataaaagatcaaatcctctgttcatgttccattgatcaactgaaccgatgatcgaaaaatccgcggatcgaatttcaaatgcataaagatgggggatgaatttggtccatgaatcaatcaatattagattttatcattttcactaaattttttgtatattgaaaaaaataataaattttttacctcattcatacaaacgactgactaattgaaggagacgggcgcctcaaaggttcaaattcgactttgcccactaattgcctaatcagttactcaaaaaaagcaatgaccaaattgccattcattttcccgcatttaatgcgtcattctcaaatgtaaaaattcacaattccccaaatttgatcacataatgttatgtgtgtgtgtatgtgcttgggaatttttttgttgggctgacaaaatgagtgggtgggtggaggagaagtccattctcgacgagaaatgaataatttaattggtcgctctcgcgcctcactcgcggcgtcgtcgtcgtaaattccatttcgacgaaaacgctccgccgcacccctaaagggttaaaaagcgggggggggggggaggggtcgactcagcgcccgccaaattcagctgcgccatgcataattaaataataagaaaattttttctaagacgtgatttataagtatattatgcacttttcgattggcggcgagattttattaaaaatcctaaaataacccctttttcaaaatttttttgagatttt

SEQ ID NO: 4456 - DNA, 1885 bp, Heterodera glycines
tttaaaaaacaaaaaacaacaactaaacagcccattcttattgttgtatgttgacaaaagagtgcttttttgtgctccagtgtgatttgatgattcattcaatcattcatttatttgacgtaccaattaaaaatatttttaaattttaattatttttattggaaattgatgaaatttaataggaaaataataattttatttttcagatttatttattcatttcatcttacacaaaaacaatcgtcttaaatgtaagagaacagattattataaaataaaatatctttctaaaaatgattcattgtctctctatttctttttgtcggctaaattaattagacgtaataattttaacaaaaataagtttaaaaatactgaaaaatttgaaattttttctttaatggtaactaattattattaattggtcagggaacgacgacgtcccattggattgccaagaacgcggagcacatttgcggaaggctttttccaaccgtccgaccatccgccccttcgccgggatccatttgacaaattccaaagctctatcccctcctacaatcgcttccgggatggaatttgtatgtagggggcgaaagcgattaactcgggatccgattttcaaaaaactaaaaaattgaaaaaacaaacacaaaaaatggcgcaaagtttttcaaaaacaatgaaataccaattattggcataatttgatgaagcctccggatactgtaattctgtagtgtacgaggttactgtattttcccaagtttcagcggacccaagctcacgcatgttcaatgatgacgacttgatgttttttgacaattttccgcgtcgccccttttatacggagccggaattttttcacgcgacattgccacgaaatgaagaaccaccagcagcatactatcaaacgcaaccatcgccaccaagggtactgtattttgaataaggaagggtactatctactgtatgagaatgactgtatttcaatgggcatgatatgctactgtgtgagaatatggaaggacactactgtattcaacatacatgagagactatactgtatgagaatgggcaagagaggcaaagaaaggcaaaaggagaattcgaaagggaaaagatagagagagaaaacaacaatgtccttttttcaaggacgtggaaatttttcaaggacacacctaatctgacaatttcaccaagcaaaaaacaaaaaattaatcatcggtgcattaacatgtttgtaacacatgttttatatttttttgaaaattcataaaaaattttgaaatttgtcaggctaaaaatgagtataatcaagaattgaaaattactaataaaatattttattttgagcattttttttttttttttgcattttcatcctttgccaggaaccaatgccatcgccgcaaccaccgccgtcccacaacaaccaccaccaccatcgttccaaatcgcattatgacaaagttggggacaattgggagcgtccattattccatcatcatgggggtggtggtgaaagtgatcagccggaacaaatgctgtttgataataacactgatcagcctcagcagccacagcatttcccgcaacaaaatcaccaaagtcggcataatcaacaaccaccaaatgatccgaatgtgcatgtgataagtaaggagacggatggacggcaaaaaaataattgattgacaattttacgagaatcaaaaaaaaagtgcaaaaatttctcgacttgactcgggacctataatctcggtcaagccagaaaaaaatttcggagcgggggggggggggaatccgaagaacatttttaaaattttcaaaaaatttgctcgttttttcttgaaaattttttaatttttcgttcgggtat

SEQ ID NO: 4457 - DNA, 1153 bp, Heterodera glycines
aaaattccaatctgtgatcatcgaatgtacagcggatgatcaaaaagtgagtattagtgtttaaataattgtttttagtacataattgtgaaatgctttcaattgtttttaatggtgccactaaatttaccataatttttatttaagaaaattcggcgcaaattagcacaaattgttgagcagatgaaccagcaacagaataatcagaatgtgaaaaaaatgtaaagcaattaaaagttgctaaatttgatgaaaaaaaaaattaattttaaatttttttttttaaagtttttgttggacttttgtacttattactgtattctaattgaattccattttgtaagagataaaattgccaattcgtggaatataaaaatttttattttttaataacgaaaaaggattcttatcgtcggttttatattttacaaacaaataaaagaaataattatattaatatttaattatataaatttcgatatttaaaaataataatattcaacaattttttttttaatttttttactcaccaacaaaaatataaacaaaagacacaacagttattttacaattcattgtaatgaatacataaattattttcaaacaccaaaccatgaaatatataaaaagaaaaactataaataaattataaaattatatgaggcaactatgactgaattttcaattttttaaattaattaatttaaatctatttttattgtttcgtctcagccaaatgccgcggcttaaatgtgccgtccgtcctccttttttataggttagcggagagcagggcgggtggtgattgtctgagcacaaactcgagattgttgcggaacaccagctgattcttgacctccctttttgtttttgcgcctgtggaagggacaaaatgccaaattaaaatttaaaaattttacgagaaccaaaaaatattatttaatggaaaggcatggaaatttttgggggtgtttttttctgcttgcctcggctctttttccagtccctacagtcacaaaaaatttccgtcagtgtcgggacagacgggcggaattttgggttttcaggcagatggactcggaaacccaatttttgtaacattttttttggggggggggggggggtggaatgatgttgaggggaattgatccgg

SEQ ID NO: 4458 - DNA, 2112 bp, Heterodera glycines
tcatcatggcaccctgctgttgacggttgaaaatgtccttgctgagcgggaattgttgtgcggcggcatgctgagtgatctgttggcaggccgggccctgaaaacgatcgggaaatttcataaaaaaacccaccgtaattggaaaaaaccgccgtttttttacagtaaacttacacgctgcgatggcggaatctgtgagcacagtgcgtgcaatggggaaagcgaaacgccttgcgaagcaccaccgccgcagccaccgccattcatgccagacatcatggcatcctgtaatataccgtagaacgtagagtgagtacaatttttgtacagtatgcctctcataatttccaaatttttttgtttcaaaaaattattgacaaatccggtttgcctggttgtgctggggcaacaacacgtcggagaatttgcgtgccatcaagtccacaacactgcgccgcttacggccaccaccgcctccaccgcagcaacagcacgggcctggggcagagagaaaattttaaaatttcaaaaaatattccctagtccagaaaaaccgcagcggagaaaaaaaaaattaaacttacagcagcaacagcaaggcttgcctgaaaatggaaaggtttcttaatagagcggggtactgtaaccgtaatttgtttttgtaaaattttgaatgcttaacctcaagtgagaaaaatgctaatttcaaaaaactttacggattggagcagcaagagtacacgactctcgagttcggctactgtaaccgtaataaatttatgtaagcaaatccaagaatttgtcggatttggccagtaaagccccaagactctcgaaaggcgctagtaaattgtttttcttttaaaaagctagcttacagcagcaacaacagcacggtttgcagcagcagcaacagcatggcttgcctgagaaatttttaaaattaattttatttttttgcggaaaaattctcatacagcagcagcatccgccgccgcacccgcatccgcagcagcatgggcaaagctgtggtgtggatgggattggaagaattaatttggtgccattcattaagaggattaaatatgcctatctcactaaaagactctcccctaatttgaccctcccctatttaataagcatagttaggctccctaattagaatgcccctcccttaattagagccaccccgcgtaattaagcgtgtaattggagatagtgggtgcttcatacgaatagagcatctaaattaattaccttaacaggtggtggcggcaatttgatgatgatcggcttacagcaacagctaaaaaaaagttggtgaaaattttgcaaaaatttcagatggggaggacctagggcaacaacagcagcagcaccctgcctctgcgtccctgatttgggccaaaaatggcagcgtgatcaacagaatgatttgaagaatgcccataattttccgctaaaaaatgaaaaacacttttttcatgttggcttaaagccaaggaaattgaaaattttggaaactaaaaaaattctccccatttgcaggcccgtagccaggggaggcggaaattctacccgccccgaaatagaccccaaaatggcaatttagtcattttttggcgaaaaacatcttaaaatttgttatttccccctcgctgaaaattttgaaaaaaatacttaagaaaaaaattttggctataagagcaaaaaaagggatctttggattccctcctccgctggatggattggaggatctctctgggcctctctgatctcgagacaagctttaggttctcgagaattgtgagcacccccttttcccgatgattgcggaattgcaaatgcaattaatatgaatggtttgaacacatgcaaataaatccgcgcttcccatcttttatatgggtataattttgtgagcgcctccccctccccccggggggcgggagcgagctgatgatgcttcctttcacccttccggaaaggatatttttagcggcggtaggaggtccatccgccgctcctccgcgcaccgctaaaagcacaaaaaaaggaacccccggccgggtaaacaaataaacaaatgctaatatgctcatcaattttgcc

SEQ ID NO: 4459 - DNA, 1694 bp, Heterodera glycines
  misc_feature (8)..(9): n is a, c, g, or t
  misc_feature (19)..(19): n is a, c, g, or t
gcctgcannggtctgaacncaccgtagaaaaaacactccaagatacagtcatctttttagtataaagtacgaggaactgtaagactgactaattatacagtaaccgagaattcagaaaaaagtgcagaaattaaatttctgaaaaattccactgcctcctgtaaactattcccgtcatttttttttactttgtccttgggcactgccaactgtccaaattcagcggcactcaggcgaacatccgcttgttcacgtgccttgcatgggtcaaactttaagcgccgtcgaaactcttcaacctgcgcacagcggggaaaatggaattgaattttgggaaaacaaaattttttaatcaaaataatcaccgatttgttagcggaattaaatgcacccgtttttagagagccccccaccaatggtaagagccatcgacaataaaaaggattagttaaagtaagttggccgccacagtaaccacgattagccaaaattacgaagatgccgtaacaaagacttcatcaaattttcggcaatcggaattccgatgaaccaaaaaaagaaatttggtaatcggaattcctttcggcaatcggaattccgaaggcccaaaaatttcggcaatcggaattccgaaggcccaaaaatttcggcaatcggaattccgaaggcccaaaaatttcggcaatcggaattccgacacatccctgatacagacagaccgctattgtcaaacaatctctccagacatagacacctttagttccggcacattttgcaacagttcccaagtgcactcgtcataggacaggcccctccacttgacaaatacgtaatgctgctgctcctggtcatcgtaagtttcgtccaaaatgcgtgcaacaacagtgtaatcttcattgaaatattcctgttcatcatcttcgcccgcaacagtggtcgtttcgccaaacttttgtttgtatcttgaaaaaaatagttaattaattaattttagggtaggtcgggaccgggacctggacaactgagtaccaaggtcccggttttgaccgggattgggaaattcccggcttttttcccggttttcacagccaaaaattcccggtttttcaacccaaaaagtcccggtcccggttgtgcccagaattcccggtcccgacctgccctaattaatttgtttaaaaaaaaattaagaattgccaaaggtttgggggaaaacggtttagaaaacattgaaaaatttctcatcccgttactcgtaaatgtcggatgtttgccgatttaaaaaacggtcgcggtgattataaatttcttaatcaagcttgtaaattgttgacaaaaaaatcttataaaattttttatatgaaaattacaaggaaaaattacaggtgattttttcaaaatgtaatggtgaatttctgtgtttttttgaaattaaaaaaaaaatacttttcttgaatttttatataaaagatttctaaaaaaattttctgaaaagttttttggaaaattaaaaaataataattttctgggagaccgatggtggggagggactgaaaaagggctctgctcccttcagtaggagtgccaccgcgctttcccgtgttgttactgtattgtacagtacagttacactcaccgattcagcttggtaagtgcccgtttgtcgccccaactgctccaactcctccaccagt

SEQ ID NO: 4460 - DNA, 2274 bp, Heterodera glycines
ctgatttcgtgcaagttaaccgatcgcataaaattcccaaactgccggaaccaaagcccattttagactaaatctgaaaactattgcaccgagaaccctcaaaacggtaaatggaatgaaaaaaaaaaattttttttaggcgtactatataattattcaaaatttataaatttttgccaaaaatattttatggactctccaaaaatgttagttttagggggaatggcccgccatctcctggcaagcagttcagttccgcgccatcagcagcttcagcttctcaccttcctggttgatcgccgcttctccaccagcaacatttgttcggcttcggccgccaccattgccgctgccatgccctcctcgtcatcgtcgtccgcttcgtccaccatgcccgctgtttctgctgccgcaagtggtgccgttgcctttcggcctccgcctcctccgctacgcttttgcttccttttcgaggaagacgatgacgacggcactggcactgtatgccgtgacaactttgccctgctcacatagtcctcgtcctcgtcccgccggttccagtccaacttgcgctttttggtgccggctctctgctgatgctgtttgcctgttgatggaggatgatgaataatttaattttttaaatttttaacacaattttcttaaaattttgttaaacttttaaaaaaaaatttcctggcgtgacgcctattggcatcgcccaagggcgattacctaaatccttttaatttttcaaagtttgagccaaaaatgcgggagcctggctccttaggctgctatgcttgaaaagaagcaaatttaatgcaaaatcattttaaaattgcaaagaaaatgcaaacattttaattttcaatactgctcaacctttcgtataattaaaatttcgaaaatgccgcctttttttgattcaaaatctctagcaccggagccaaaaagcaggaattagtagatattttgcgccgaaaaatcacaaagtttgccatttttggctcaaattttcaaaaaaaaataagaaaatgtgcaaaattttcagaaaatttgcccatttttgcttgaaaactttttggtttttcatttcgggggggggggcacgtgtccccccatccgcccccctagatactggcctggggggggggctatattacattaaggcggtagatttgtcattttttacaatttcaactcaattttattcttcatttgtcctgtgcccgcccaccttttgaggacgaagtgccggaggctgcgaattcataattcaattccgcagcggttgaaaatgagcatgacgaatgtttgacggaaaatgggagtttgtgttgcggttgttgttgttgctgctgctcatcggcgtccattggcgttgtctcttttgtggacacttcgggccatggcgaactgtccaccgccgactcatcctgtgtgattgaggatggatgatttatttaatttaattgaatttaatgaaaaattcaatttggattttgtaataatacccattgaacttttttttttaactgaaacatttccatggcataaatgatcgtaatttatgagaaaaaacaaagtaattattttggaagaaattttcgttccataaaaattataattttttgccttttttgacatagtaattacgggttgaaaaacagaaactgcaaattaaaaaaaaattttagtcgagatggctgctcaatattcccgatctcaagtggagaaatttctcggattttttttttggggtctgcgcagggacgtatccaggatttgggcttggggggggggggggggtaccgatccgaaaagtcaattcttaggggtgtattttttaaaatttttcgcccgattcataggggtgtatttttgaaaattcttcgcccgattcttatgggtgtatttttgaaaaactttcgcccgaacgaccgtttttttttttttttgctcataccagcgacgctgggaaaataggggggtatttgaaacgataaattagcattttttccatcgtttacacaatggattttgaaatttagctatttttacagcttttgctccgcccctggccgccagcaaaatgtttctttgtaatttggcgttggaatttaaaattaatatgttgctttcgttatgataatttggcgttaatttaaatttggcattgctttttctctctggggcgctggttggtcttgttgggggggggggggtaccgcctctctttttcccttaccgaggggggtcttgggggggggg

SEQ ID NO: 4461 - DNA, 6460 bp, Heterodera glycines
actatggcggcatcggtggtggcaaaattgacggcatggctttcagcagtagtgcgtttggcattgtcactaccttttgctgcatcctttttcacttccggcggcggctttcttggcacaattttgaccgttccagccaccgattcacgtgcaacaattcgtcgtacggtggcacacgaagcgaatgacgatgcagcatgctttgcaacaaaatgaagcgccactttggcattttgtacgacgaccactgcaggtggtaatagcggtggtggtggtggtggagcacgtacaacaaccgcaggtgacggaggtgttggcactttgctgctgttgccaaacatggtggacccaccaccaccggcataagattgctgctggcgatgacgagcatgtccatgtgacgacggcatggtaaattcaggcggtgtggttgcgcgctgctgttgtgacgacgaagaccagtatggtgatggcgacttttgctgggaatgttgtcgttgctgctggagctgttcaacagcaatttccggttgcggcaccattgcagacgtatgagaacggtgccgaaatggcgccgccgacggtgccatttgggtagaactggcactccggaagcgatgttgtgctgcatcctgctgaactgcttcattgtcacgtgctttggttgcaggtgaaattggcgcattgggtggcggtgatgtggaaagtgacgaagtctgtggaaaattaattagtttattttattttaattttgtaggtttaataaatttccgctaaattttcccaaaaaacccacaaaattagcaattttttggtaaaaatctgttaaaaatggtaagaatttattttttttttctggcgaggcctcaaattttagttgtagaaatggtaaagttctactgacccaaaattcaattactataatacactattcattttcaactatttttagattgccaaaatgccgtcaaaaaatgttgcataatctctgtcgaattcacaaaatatttagggatgcgaaaatatgatggaatgttcaattgtggtgtgccatctaattatctaacccatgccaaatgtcacctttgttggcatcgttgatgcacccaaattgaaagattgctgcttctgttgttgttgctgttgttgctgctggtactgtttgaatttctgcagttgctgttgctcaagttgttgttgctgctgctgttgctggtcctcctcttcccgttgctgcaacaatagcatctgttgctggcgccgcttctgctcctgcacaatgttggacggcacgggctccggtggaatggagtccttaaccgccgccgcagcagcagccattgccaaattttgtgccataattgctgaagcagctgcagaggaagcatctgccgtcgatgacaatgaatatgttgcggcgtgttgttgcggttgttgctggtgtaatgatgccaccggcgctgctgaactgctcacaactgttggcggtgccatgtcctggctgtggtacacgctgatcagcgttcggcccggcatttcaggacggatattaacctaaaaacacaaaacagggcataagcgttgggaggatgactgggaactgatcaaagtcccgggcaccaacttttcatatagaattcatgttgcccaactgggagacagctgatttcactccgccaaattttcgaaatttgaaattttttcaaaaaatcttaaaaatttttatgagaaatttcaatttgtcaagaaaaaattttaaaaaaattatccagcgaattttttcagtttcataatgaattactgttttctcaaaaaaaaaaaatttccaaaaaatcgctggaaattttcttgtattttttttttgaaattttctcataaaaacgcccggggaggggacgtagtaccgcatgcaccgtgcccaactcacctgcacttggctggatgcggacatcactgcaacagacggtggtgccaaatgctgttgcgtgaactgcggctgcggcgcttgttgttgttgctgctggtgggaagcagtaatgccctggggttgttgctgttgttgtggcacaaccatgccaaccgatgtcggttgttgatgttgctgttgcggcgtgccgccgcccgccgccggcgagctgtaccctgcagctgcccctaccaccgtctgcggagttggtggcatgtacgacgatggtgcggacgatgtgccaccaccaaattgatgttgcggtgccgaggttggttgttggttgcttgacggttgcaacttttgttgcacaggaatttgaccggcagcaacaggttgttgttgctgttgtccagtggcaccaggaaagtgtccatgctgcggttgttgctgttgcggcggttgcgcagcgatgccatatgccgaagatggagcagcgtattgtgtgccagcagcggtcggttgcgcgcccataaactgttgttgcggcggttgttcacggctggacgcgttggacggtgatgcaatgatgtcagcaccagcggatgttgcggttggctgttgttgctgcattggaaccatgccagcggtggacaatgatggtggcacaatgttggacgatgatgccatcgacgcagcaaccgcagcggcttgttgctgcagctgaatgaggtgcccttgcaagtagctgcggtgcatctacaaaaaaaaacaattaaaattggggcatttttttattaaaaatttaatttaaaattggcattctattataaatgccaaagaattgcctgcaatttttccacgcgcattgccgcctccgcgttttgttgggcctggggcaacaacgcattcagttgctgatcacactcgtaaagttcacggtaaaattgttgctgctgctgttgcatcatgtactgttgttgctggtggtgttgctgaggattcatgtaactttgatggtaaaatgccgtcgtcggtgcgcctccggcaccggcaccgccgcctccggcaatgtgcgcagcggcagcggcggaggacggcacagcggtgccaccgccaccaccaccggcagcagcagcggccagcatttgttgctgctgttgcaagtagtatgctgaaacaatggcatggcatttttagggggaagggcatggcacaaattttgaaattgtgcaactattgcacaaaattttggtttttcgtccgcgagcaccaatttttgcggcacgcttttttcaaatttttggcaccgacagacagggccaccgaggaaaaaattgacttattgttcccatttttgtgtcccgaattcacttttgtacaaaaaatatttaaatggtataataaaaatttttgaaaaacaaccaaaactctgtgaaaaaatttcaaaaacccccaaaaagtgatttatccggggcaaagggcagtccattttaataatttagcaaattatgaaatggagcaacggaaccattaaaaaaaattaaatgttacagcagcagattttcgaaaacaagatgattagtaattgcttaattaattattcaacacactcattaagataaataatgatcaccggtaaatgattaaattgtcaaattaataattaaaaataataaaaaaaaccctaaattaacggaagtgaagtcaatgatcatcacacaatcattccataaaaaagtgaggtgactgtgacgattccgatttgagaaagtgtcaattctcgcgacagaaattttttttttttgcgcaattttattttaatattcattttgcaatttcaaagaacggtgaattcgcgcaattttggaattagccgatcaaaaatcaaaaaaaaacgaaaatgaaaattaaacttttaattgtaagaaaagtggaaaaataatttgacaccaaaatggcaaaaattggtcattttttggcgaaaaatggctacaattctgcttttttttccacggcgacgaaaactgttaaaacattgaagaattttgttttgcatttaaaagctagggcaacacgattaaaaacacagggcgtcagaacgcgaaaacaaagtaaaattgtccaaaatgccaaaatataaaaaattgttggaaaatgccaaaaagggccaacaaattttacaaatttttttaccctgccgttgcatggccatctgttgggtgtaatcagcggacgttggatattgcatttggggatagccagcagcagatggttgggaaggcatgcccatcatcggcttaaatatgcccaattattaaattttgtattagattagaataaacaattcaaacttagattagttgaaaaaaaaacaacttacaaattcatcttaaaattatgaaaaattctctggaaaatggttcttatttattttttcttgaaattttcttagaaaattttataaacttttttttttttttgaaaatttctgcatgaaacttttttgtttttttgattttcggggggaatggaaaacgaaactgctcccgggggaaagtgacccgaagaagaaatccaggcgcccagtttttctttttgaattttttgtaaatttcccagacgggtggggggtgaccgaagggaaaacgacccccgaggggagggggcatttaaaccccttgccccacatattgtccagcagcagcagcctgctgctgttgttgttgttgttgcggttgttgggcttggtatggctgcggttgctggcccgtgttgtagaacattggctgttgttgttgctggttgtacggttgtgccgccgctgcagattggccaccgcctccggcacccggcgccgtcgcggatcctccgccgcttttgatcatttgttgtgccgcagcggctgccttcgctgcgcttgccgcctgctttgcctgttgctgttgttgttgctgcataccgtacccggcaccaaaattcgactgctgctgtatacggtaaatgatcgtttttgaaaaatttaccaataaattttaaaaataaaaataatatgcccatctttttgtgggcccaattaagtttatgctagttctacttttgggtacaaattggaaatttgtttattgaaggaatgcagggttagttaaaattggatttttttagccatgggttcaaatccgtctgcctgcaaaaaaaaaaaaaattttttttaatatttctcgggctttttgggtccgctgatcaagaatttgacattcattttagcccaattctggacccctaactttaactcgaacaaaaactaattttacaaaattataaaatttgatttaataaaaaatttaataaaatgtggcgaaatttctaaaaaaggtactaatgaaagtaatatttaaatttaattattatttacaataatttcatttgcagaataatgatcaaacttaattttgtccttaattattttgaaagtttttaaaactgtttgaaactgaacagattaatagagaaagaaacctttgtcgtattctgcaaataaaattaaatttaaataattaaatttaaatattatctttaattgaccactttattattaggttcgccctttccctcctgtcgagaatgagcaaatttccgatttttgacaccatgtaactcttgaagcaagcaaaatgcaccgaccctgatttgagccagaaaatggccaattttgcggattttgggccgcaattttagaaaaattcaagtgaaaattagtgccagggctggcaatcatgccgagataggctaacgtcggcaaatttgtttaaatttttcatttcgtccaaaatctgcggcacctgcgctccggcagcagcaacggttgtgccctgttgctgtgacgtgtacaagatgccctggggcggcggttgttgttgttgctgttgttgcaacaaatagtgttgatgctggaacatttgctgctgttgctgtgcctgttgaaaatgttgctgcttttgttgttgttgttgctcttccctgctgtgagcagaagcggactaaaaaaagaacaaaatccataaatttagccaaattttttaagccatttttttgttgaaaaaggccccctccccttaaatgccgaattccgatattttttagggcatcggcacattccctgctacaaaatataacattcaatccatcccggattctccaaattttccagctaatcaacaaataggtagcaagagtgcagcaagtgaagtgctgacgattgactgaccatcatttcggcatggcccagcggcatcatccccggcggcgggccaggccctttgtaataatagcccatctgttggtattgtgccggcgacagcacctgctgttgtggcggcacaccactgatcagtccagctaaatgcaaaaaaaaatttagttgacaacggaggacaaacaaaatttatggattagaagggccaatatggttaatcccgaaccattatcgcctaaatcactttaaaagcattttatcatttaaataaaaatcaaagacagcgaaagggattcgga

SEQ ID NO: 4462 - DNA, 8398 bp, Heterodera glycines
tttttctactcgtcaacggtctgaatttcacacagactttatctcatagatatcgtttcattaattcagcaatctgtacaaagtgttgggcgtttctccttccgcctcacaaagcgacatcaaaaaagcgtattatacactgtccaaaaaggcattcttttgggtttccatttgtttgcatatttctgacattcttttcagtatcatccggatgtcacaggttccaacgaatcgtgcgcaaagaaatatttggaaatcaaagaggcttatgacgtattgcgtgatgaaaaggtggggtgatgggattaggggtggtctccatccaatggaatgtttttctgtggtttttaccgtgctgaaattcagcaacgagaagaacacgaccgatggttagcggccgaagaagttcagcggcaacgtccaattaacggacgacagccgtatgtacgcagacagaaagtgtacgacgatttgtggccaaacaatggaaccttttcggatgaggaaatacgaagggttggtagaattcaaaagaagggggcgggtaaaaggaggttgatggtgtcggtaaggtgcacttcattcacctctgtcattaaatttctaaaaaatttccaacgcttcaaagtgttatggtgaattattattgttttttttaattttaccaactttaaatttttcaagaaattttggtattccttgttttgctacccccccccccctccgcccccttgaaaaattttaaaattcaaaaaatcatagatattttgttaatctatgaccagatatcatcagcagatgtcaaacaaaacaccattttcgtgatcagtgaccttgaaaaccccaaaatatgaattttttaaattttcgagggggggggggggtagcaaaacacggaagtaccgaaattttctcataaaaaaattgtcttaaaatttattaagagaaattggacgacttatcatttcatttgtggggtaaggcttcataccctttgccctattcggctgcatattttccgttaattttaaataataacaattgtcatttatgacagatttggcgcagtatgagtggcaacagcgaatttggacggtcgaattgggaatttgaaacggaggtgaagcgtaaacgacagatggcatatgaggaacagacgaggagaagaaatgagtgggcgaagaacgggttcggccaaaacaatggtcgaaggtgaaaatcgggaaaaatggaggggggggggagtttaccattgaccaattaataccaagaactttagtgattggactgaccaggaccaatacaaaatcattggcaaaattctcctctgttatgtgctcatcactttattcatcgaaattttcaggttacaatgaatttttgtctttatttacatcagatatattttaagcgcttcccttggacttttccgagacccatttctgccgccatataacagagaagaagacatcagaaaaaggattgaagaaagaatgcgaagaatgccgtaggattgacatgataatttaataattactgaatttatgtattgatcgttattttatttataggaaagtagcaaaacgaatttttccataaataataatgtctaaagaattgagactgaagcacagttcataatttattaaacaacaaaaaaacaacgactgacccattatgaactgcttcagcagcatgaatgacttgtggaaaaacaattgtgtatctctatcagaatatccgaattcacatgcgctcgagtgcgcgaattccaaggacattaaagcaccgttgcataatgtcagccgttacctcacaaagcaccaatctgttgaaattgactttggtggtcaccgcctgtccactttctgttttaatgaaaatttgaattattcgactgttttgatttgtcccgtctaattgctctttaattacccccttcggtcggcaatttgcttacgacgtaacattcgccgtaaaagtcgtgaaacaccgtcgccaactcgtaaacgtagtcacatattttgttgagttgcaaactttccagaacggacaaaagaacgtcggagaacttcaggatttgctttgctaatttgacttctcgtggatggtccaaaaacactccgtcgtcagaaggcaatccgttaatgaaggaattaatggcatcccgagtgacttgggcatttcgagcaattgaactaaaaagtcgcaataaaagggaaaggggaatgtgaggaaatagggcggaacaagtcatcgtaccaccgaaaatttacaaaaaaaaattaaatccgaaaaaaccaaatattttaaagacaatcttgcattttttatggactcaccgaatgcgtgcataagcgtatagcaaatacacagcagtgttgcctcggtcgtcaagcatcttaaatttgccaaattaaattgttgaattttgtggttaatgccattagatgatattcccgaaagccttttaaagtgatcataattttaaggaatgttctatcattaaaatccatatattcatttgttttatctcacaccgccaaaatttaataaatccatcgatataatggattggtccaatttgtatccttatgacccccactggtccccctcgaaacggaccctgtcaaatgagaacacatagtcaccggtccgggactgggccatgtccgcgtaacgaatgcatccgtaagcgaccgactcggcaacttctctaaactcttgcggtgtgaactcctgaaaaatattaccaaagaaatccctttgaaaatccctttgccttactccttctttgccttttgtgcgcaatttttcctccgctcggcgtacgccttcgtccagcaattccgtcagtttgacattttcgccggaacgcgttttgaactttttcctgcaacaaattattggcaattgttgctcaatgccactgtcgctttctgtcacctgtcctcgcccagcaccaatccgaattggacatgttccacgcgtttttgtgccgcatcaaaccacttcagctgctttccggtagcgaaaacgttcttcagaacgaataaataccattgtttataattgaaaatgtgcattttaaggattaacacctccaaatgttcggattggccacggtcgacaacgtaaagaatccaatcggcccgttcctcagacagtcgctgcttcagtgtggccaagtcgctggtgtcgtaggtgaaaccgccgtcacttttgaccaccgtcagcggaatgttgcactcgtgagggaagaaaagcttccctagaatgcgataaaagtgaataattagatgagggaaagtagtgagaaatgaaagagaaaaagacgcacttccgtcgtcttcgacgaggagttgagtctgtttcaactcctggatcaacgactgcatgcgcgactggtagaaggactcgccacgctcgacaaggtcagtgatgcccaaacgctcgtaaattgttgcaaagtctttaaaggagaggaaaaaacaaaaattaagcacaaaattattccatggccactgagggaagctttggtaaattaattggccatattagggtaaattttgtttgtccattgactgaccctttcggctaacgtcacagatcattttccacgccttcactgtgtccggctcaaagttttgcagtgcgaccacacattggtaggcttcggatttgaactgcgggtcgttgtcaaatttcactttcgattgctaaaaagtctgtgtatcataaaatttatttgtttttgggtttttttcatggtatttatgtaatgccaatgttcttgtgttgccctgtcctacccaattcgtcactgttaccctttcttatcatatttttaactcaccaactttgtccgtgcccaaaaaagtgatgacttccgtttaccttgtaaaactcttgcaagtcttggataggcggcgtttcattcagataattgggaaagcatttcttcagatgggcaattagcattccgaactgagtgccccagtctccgatgtgattcaaacggaggacctgagaaataacacaaatttaattaattataaatgaaatgattaatttatcgcctatttctctttctcaccgtaaatccaaagcattccaaaagacgtgcaattgcctcgccaataatcgtcgaacgcaaatggcccacatgcatttgcttggcaatgttaggcgacgaatagtcaacaatcacatgtttcttggcaattttaggaagcgaaaaaccctttctagagatttcggcaattcgttttcccaaatgtttacggctgatgtatacattaatataggcattgacgagttggtactgaaaatgggagattatcaaaaggaaaagccaagaaaaaatggaatgaaaaaggtagaagaaatgaaggcttgatttcaagaaaaggtggatttggtcggatcactaagattttcaattacaaagcaaaatgtccgttttcgctgtgttcaatggattttgcaattctctcaaccgccccttccgttcccatttcaaaaacttccattccttttttccccaccttttcgaccaattcgatttgctccagcgcagccacaattttcttggccaccaccgggggcggctccttgacgctttgttcgctgagaaggcgccgtgaaatttgcatgaccatttcgaattggtagtcgccaaacttcgggttgttcgcttctttgactcgtataatcgaaggatccatgccaagagttgggtaagcctcaaaaatgggaatgaatgcgattttattcgacttcctcacattttggacggcctttgcgaaaacatcgctcagtcgttcgatgattgaatcgccaaagtcttcgatttgcaaatgcgcactgccactcggcccatttggaactgtccgattattggcgactttattcccatccgttgccaatttcttttcggtttggtgtccctctgttggcacggcattcgcctaaactttgcagaaaatgggcaatttgaacagaaaggaagtctaatcgcagataataaagaaaaaggttaatcagtccctgcccgggccctcaccctcttcaggatgttcagttggtacttcaatttgtccctctcttgcactttggcagcaatttcaggacactcctccatgagctccttcccaaattgcactttctccatgtcatccaaaatcagctctattcgacttatttgtttctgaattttgaattaatgccccaacggtttctcccaaaaattaacacccattaaatattattgaatgtattaacattttagaggagcgaggacaaaaagaacgtaccttattatcgctagccatgaattggcgttataatcacagtaaaaatgtaggaaacctggatagaaaatgtccggaaaaaagttaataaagtataaaaaataattaggtaagtaaatcgggagaatcttcgaatttcagattaaaaataagatttaacacacatttcctctctttatcaattaggaactttctttaacaacaaataaatgtttttgtcctgctcaaatccggtcaaattgttcgcctccccctgaattcgcatcagaagccctccgaaagaagcgtatgcggtcagtcgactcgtttctgcggtgccctcgtcgttctcaatccggtaaattttgccgtacatcacatattcgaacattcgaacccggggaatgttttctatctgaaaatgacaagcgaaataagcatgtcttccgaaaatactcagccctcataagccgaccacccactgatttgtcgtattcgccctcttcggtgagtccgtcgtcccgaatcgaagtgcaaagcatcaaccggaatttgtcgttgattcccatggcgtagagttgggtgttcacatccaaaatgaggtccattttgaatgattcgctgtcacaaaagagacgactgactctgtcgaactttttcccatcggggtcaatgtttttgacggtgaacaaatcctcgaaatacaggctattcatgtcgaaaacttaaaaataaataaaaataaataatagcaaattaaaaagaattaaaaatgttgaaacaaacactttaaagtagagatcggcctgtacctggatccaggcctgtatttttcctggatccaggtacagatacaggccatttttcggcaacctgtattttcctgtacttttgtacagaaaatacaggtacaggcaatttttggaatacaggtacaggtacaaatccaggaaaaatatatatgtgtacgtgaaagatagacattttaaacgggagtatttttcggacgtcgtcaaatatcctatgagcgcgttgctgagacataaacccgaacggaatcattggtttccaatctgggaaaaatatatatgtgtacgtgaaagatagacatttttaaacgggactatttttcggatgacgtcaaacatcctatgagcgcgttgctgagacataaacccgaacggaatcattggtttccaatctgggaaaaatatatatgtgtacgtgaaagatagacattttaaacgggagtatttttcggacgtcgtcaaacatcctatgagcgcgttgctgagacataaacccgaacggaatcattggtttccaatctgggaaaaatatatatgtgtacgtgaaagatagacatttttaaacgggactatttttcggatgacgtcaaacatcctatgagcgcgttgctcaagactgagaatcccgagcagattactggacatttgcaattagagatcggcctgtacctggatccaggcctgtatttttcctggatccaggtacaggtacaggccatttttcggcaacctgtatttttcctgtacttttgtacagaaaatacaggtacaggccatttttggaatacaggtacaggtacaggtacaggccttaaaaacctgtatttcctgtattaatttttaatcactattttttggcgaaatgtctgaaaaattaggaaaaattcaaaaaaaatatcattttattcagtgaaacactctgggtcaagcccactgtgcagagaaaagcctagtacttgtcaatttggcgcatgctttaataaaaattataatgttcttatgagcacaaaatttttgatcaaaattccgatttgtaaaagctacagtttcaggtagccccgaaaatccttatctcaactctagttaaaatcgcaaaaatgtgtcttttttttgaaaaatctgttaacaaactgctttaaaaattgcaaattttatcccggcgacgcctgccggcaccaccagacccccgtcccctccccaactttcccaaaaattttttttgaaaaagcgcaccgttaaaaaagtaagaaaatcaaaaaagggtcatttaggtatattaaaaaatttttggaaaaaattcttggtagagggtaagataggcacaaaatgtaacctaattaagcttataatcatcttttagtattcgaaaaattaatttttagtattttttatagggtaaattttcaaaaaaatatttgtttttctttctcaagaaaaatttttcaaaaattctcaaaatatttaaaaaatgaaaatgtgtacgaaaaaaaagtttaatacattattattaagcaatatttattgtttaattaataataaatacttttaggtatttttacgttattttattaattaaaaaggttttttataaaaaaaaaataaaaaatacaggtacaggcctggctggatccaggcctcgagtggcctgtatttttcctgtacctgtattttcctgtatttttgtacagaaaatacaggtacaggctttttacaaaataccgatctctaattaacggtatttaacatgaaaagtacagtgggggcacaagaagagggcagcgaaggacggaggaggcggatgaagccgcgaagcgattgagccatcccccccccttccgccgatagcggcacggtgaaaaagcgaacgaacgcccccctcccccgtcaccttaaattgacacccctttttttaatttgagtaagaaatcgctctttgaagtttgcgtggtccgtcattttgtgcccttctttttatatgaatgctcatgtaattatacttcaattaagaataaaactttaatgcattgaaagggatcgattgagtgtcgccctttgagttgagccgccatttgacaaatcgccacagtttaggctgtgaacagcaaatgccgaattgcaaacgcttgtgaaaggccttggcaaaagctgttcatacaattagcgttcttataaagtgccttcatcaaagctgtgcaatgcgcatccttaaacattggtcttccggtcgaattgcttgaaatgtcaaattgctaattgtgacttttggacccgaattgatatgtaagaatgaaataatat

SEQ ID NO: 4463 - DNA, 1606 bp, Heterodera glycines
atttacaaatttttgacttgaaagaccggtcactcttcaaggaaaaaatttcaaaaattgttcaccgatgttgcggagcatttcaaatgaatcacccacctattttgatttatgcatacaatttattacagaatctctgaattttataaaaattcggcgtatatcactcggagctcattcgtgtcggaaaaacatttataaaaagcgcattttctgctatccattaagcactttgtggcatgttttagcctcaagaattttctgaccaatattaaacaatttacaaatttttgacttgaaagaccggtaactttcaaggaaaaaatttcaaaaattgttcagcggaggcatttcaaatgaatcacctattttgatttatgcatacaatttattacagaatctctgaattttataaaaattcggcgtatatcactggagctcattcgtgtcggaaaaacatttataaaaagcgcattttctgctatccattaagcactttgtggcatgttttagcctcaagaattttctgaccaatattaaacaatttacaaatttttgacttgaaagaccggtaactttcaaggaaaaaatttcaaaaattgttcagcggaagcatttcaaatgaatcacctattttgatttatgcatacaatttattacagaatctctgaattttataaaaattcgcgtatatcactggagctcattcgtgtcggaaaaacatttataaaaagcgcattttctgctatccattaagcactttgtggcatgttttagcctcaagaattttctgaccaatattaaacaatttacaaatttttgacttgaaagaccggtaactttcaaggaaaaaatttcaaaaattgttcactgatgttgcgattttttaaatttaaaatccatattcctaaattctccgcactgtccggaattctttctcactcagccggccggaacatcgtacaccggcccatcatcaggcggctcattcgcctgaacaaattttaattttgaaaaaaaaacaaacaaaaatcgcttcacctcgaccaggggggcgccggcggggtgcggtgccacaaatgggcggcggccgcccaacacgaccagcggcgtctcctgcgcgccctggcgacgcagcgatctgagcgttttcagctctaagaaaaaatatggttttttatgaaaacaaaaataaataaatacttactcttttgttgctgacgaacgagctgtcgccgcaacaagcggtttgccaccgcatggcgaaccttcaacccaaaaaggagaagctgtggggggggggggggtggtaaactttaatttgaatggaaaaaaaaaatacctgaagaagaaagagcacaaaaatcaacacagtgctggcaaagaccagagttgacagcatcgggcaatttgaagaagtcgctggacaaattgttgtcacatttggcactgttgctgcgcgcgttgttgtagtcggctgaacaccttcacgcagcagctgcgtgaaattgtcgatcgaacggtgcaagcaaatcacgggctttgtatagccccgtggtctcacgcacaacaaatcacttgggcaagagctgcagagataatacat

SEQ ID NO: 4464 - DNA, 1714 bp, Heterodera glycines
tgctatccattaagcactttgtggcatgtttagcctcaagaattttctgaccaacattaaacaatttacaaatttttgacttgaaagaccggtaactatcaaggaaaaaatttcaaaaattgtacagcggaggcatttcaaatctattttgatttatgcatacaatttattacagaatctctgaattttataaaaattcggcgtatatcactggagctcattcgtgtcggaaaaacatttataaaaagcgcattttctgctatccattaagcactttgtggcatgttttagcctcaagaattttctgaccaatattaaacaatttacaaatttttgacttgaaagaccggtaactttcaaggaaaaaatttcaaaaattgttcagcggaggcatttcaaatgaatcacctattttgatttatgcatacaatttattacagaatctctgaattttataaaaattcggcgtatatcactggagctcattcgtgtcggaaaaacatttataaaaagcgcattttctgctatccattaagcactttgtggcatgttttagcctcaagaattttctgaccaatattaaacaatttacaaatttttgacttgaaagaccggtaactttcaaggaaaaaatttcaaaaattgttcagcggaggcatttcaaatgaatcacctattttgatttatgcatacaatttattacagaatctctgaattttataaaaattcggcgtatatcactggagctcattcgtgtcggaaaaacatttataaaaagcgcattttctgctatccattaagcactttgtggcatgttttagcctcaagaattttctgaccaatattaaacaatttacaaatttttgacttgaaagaccggtaactttcaaggaaaaaatttcaaaaattgttcagcggaggcatttcaaatgaatcacctattttgatttatgcatacaatttattacagaatctctgaattttataaaaattcggcgtatatcactggagctcattcgtgtcggaaaaacatttataaaaagcgcattttctgctatccattaagcactttgtggcatgttttagcctcaagaattttctgaccaatattaaacaatttacaaatttttgacttgaaagaccggtaactttcaaggaaaaaatttcaaaaattgttcagcggagcggagcatttcaaatgaatcacccacctattttgatttatgcatacaatttattacagaatctctgaattttataaaaattcggcgtatatcactggagctcattcgtgtcggaaaaacatttataaaaagcgcattttctgctatccattaagcactttgtggcatgttttagcctcaagaattttctgaccaatattaaacaatttacaaatttttgacttgaaagaccggtaactttcaaggaaaaaatttcaaaaattgttcagcggaggcatttcaaatgaatcacccacctattttgatttatgcatacaatttattacagaatctctgaatttataaaattcggcgtatatcactggagctccatcgtgtcgggaaaacatttataaaagcgcattttctgctatccattaagcactttgtggcatgttttaccctcaagaattttctgaacatattaaacaattttacaaatttttgacttggaaagaccgggaaattttccaggaaaaaaatttcaaaaa

SEQ ID NO: 4465 - DNA, 4008 bp, Heterodera glycines
ttgacccattttgaactgttacaattgcagccagccgctcccctacgagtcggcgctgaacttgtggccattctatgcacctgctggttcgtgttcatacaacaaattgacgagttgcgatgccatcagggcatacgtgcttacttgtggaatttggtcagtgaagttactaagtaattaatgaagtcaatgaattaattaattttttatgatttccggaggactaatatttagaaaaaaaaaattcctgaattaatttagttacaaaaattttcttgaaaatatatataattcctaatttcaaataattttaagtcaactgtgcctgcaaaaattgtttacgtggtagcaaatttgtgccttctcatttgtgttccattgcgcttcaccggtctcattagggtaaataaagaaaataaccctcctttataagcaaaccaaattcggatgtttttcaattttaggggtacccaaccccttgaaatccccgctccctaaaagatcggagacaaaaattttcaagaaattttaagatagaagatgctctgttatcgttcgttttgcctggcagttgggcctatgttcttttttttgccaggtttttaaaaaaaataaataaatattttattttaataaaagtccaaaaagggagataaaagccgcttacacttaaattttagaacaacaaaattaattggaccatttgttcaaatgatttacacaatgattgctggagatttggtggaattttttttattattaatatttaaataatttctcagtttcggtttgtgcttatttctacaatttttatggtaccattcacggaaagttcgtataaaataaattttaaatttatatttaaaattttctttttcaattttagcaatgttttttcttggcaaagacatttcaaccaaacaatatctgaatgaatcagacgccgaattctgtccactgagttacagcacgtcgaattacgactcattttttagcacatttttaactttatttcgagtttgcatgaatgcaatttttgtaagaatttttatttatttattttatttatttatttaattttgggcacttttttagtacgaagaattggcatgtgcaaattatgaacagatgatgaaaacactggtatttaataatattaatttaaaaagataaaaaattttattttttagttcgtcctgttcacatttctcatggtactttatttaattaggataatttaccaggaataattaatttaatttaaaatgcttaaaaggttagattaataatttaatttaaaaaatgtttaacagtttatcatgatgatcactcttctgatagccatgataaacaacacttacagtgaactaatagaggaggcggaactgacctggcgtcaacaggcaaattttaagacatatattttaaatccaaaaaattaaatattatttgttttaattaagtttttaaaattgatttctattaaagcagaaaaaaataaagttttttttttaaattaatgacttagatagagaagaagctttcctgagatgaagattagtggatcaattgtcgttccctaattgatccactaatcttcctctcggggaagcttcttgttctttatctcattactaataattaaggttctctcattcatttagtttgagtaaattgaaaattgagcaataaaatagtttttaataataataaaaaataattttattaaatttccagcaaggccagattgtgatggtgctggagcgtgccataaacgcggaaaaattggcggcatgccagctggaatattcagtgcagatgaatgtgccgggcagagaagcgcgcggactgatggtgatcaagcagaccaccaagacgagggcacaccagcgtaaacaggcactcagcaactggaaggtggggtttaaacacgaaaaaaacacctaaaaatatatctgaatttgttcatcaattaaacacgaaaaaaatatcaaaaaatatatctgaatttggtcgtcgatatttaggtatcaaggattttaaaatatttttatccttaaaaattggtaaatttacacgatattttaaaaaattttcattcaccgaaaatttatcgggattatatccattttcggtaaattggtgaatgaaattctcgttttttgccttttccatcaccggataattacatttgcccgagcactaattttttaaacagaaattcgtcaaactgaaaaatatcccaagaaaatatttttgattttctgaaataattttcagttggttggccgtaaagtgatcacgatggccaaggagttgggcacccagtcagccttgtacttgttgcacagccatgatcggctggtcgcgaacgataccgtaggcggtggcgggaccagcgtaccaagaacgccctacagtagcacgcgaccgtactcggtgtttggcgggagcacggcaacattggtaaaccatcatcgactcatgacaagcattggcaaacggagggcggaagaagaagtggaagaaagggatgcaaaacaacgacggcaacaacaacaacatgaacaacagcacaaagaccaactggaacaaactcagtccgatggtgatgaatcaagtgttattgaacatgtactgcaaacaccatcacctagaaaggttggtaatattaagtaacgataaatttatatatattttttattattttgaaatccattgaatcggctttgatcgaatccatctgggaagttttcaatccatcatcatgatatttttttaaagaataaaataaggattttaatatcgaaaaaacaaaaaccctaaatatgaaagcctaaaaattcttaactaaaaatagaaaattttttaatttgtaaatttttatacactaaacttaggaacttttcttaacaaatcttaaaattagattgtttgcaattctttgaaaattttttggaatatttttttacagttaaattttttcatatattttctttcgcctttgaatttccaaatttaaaattcattaaataaaaaaaagaaaatttttttgaggaagggcgattgcggcttataaaacattcgcattgaaaataaatattataaaataaattaaattattttttctagcgccgcccatcagtgccaaattttcagcaaccaaggctgagcataccaaccatggaccgtcaccagcaccaacaacaacatttgatgatgttcgcggaccagtccaaactgcgcgacgttgtcacacatgcgacggtgaacaacatgaagttgaggcgtgcagagctcgaagaggcacaacaacgccacaaaaaacctgtatcggcgcaatttttaaaatttcttaatcagtttttgatccccttaacagatattgcacgccgaggttggacaccagcgtaaattgcccgctttaagcgatttgcctgggatggtggtgaatgtggcacggaaacgtatgctaacaaccggttccggcactttgcaaattggaagaaggccgtcaactgccggcggagagccgttgagaatggcacatttaagcgttccgcaggaaagaccaatgatgaaactgcaccaaaatgcattaaggtatagaaataccggagcaggtcgttcctccatatgaaaatttcgagaaaaaaacaaaagtttttcaagcttttccaaaattttgtgatttctgtttttccaaaaaatcgctagaaaaattctcgaactttaaaaaaaagtttttacatgcctacctatatttggcttgagtgctttggattttcaaagtccgatcgttaatgaaataaatttgcacatatttttagcacagagccggcattggatcaaatgattgtacgaggcgttgatctgttaccaagtgtaatgccgaatatgccggccacaccgctgaggagctacgacgaccgacggcactctggggtcggtggcatgcaccaaaaattacacagtgttgtcgccatggaaccgccagcagctgctgat

SEQ ID NO: 4466 - DNA, 2941 bp, Heterodera glycines
  misc_feature (2935)..(2936): n is a, c, g, or t
agcaacaacaacaacaatgccgagcagtacccaacagattcttgacgacgtggaatttaaagaacaaaacaaaaaatctgttgatcagataaatcaaaatgctccagatttattgaattcgacaaatgatacaactggcggcagaaaaagggctcgtcggcgagttcgtcccgacctattcagagccaaaaatagtccaccgacaaatagctcaaattctgacagaaaatgaaaaaaactgcgtaaatgaaaattctcttgctgaccagtgaaaaacatttttttttgtggaaatatttatttattttatttaaatatttgtttgaatattacatattatacatatagataaaaatgattttaaacttatattataaaatatttaatcttgaaaagttgcaaacgaaattgataccaattttaagaaaatgaaattaataaaacagttgtttcgagaaatttttttagaaaatttttttatttttttctttgcacttttaccgaaaaaataaaaccgaccgaacccccttgtccggtctctagtaatggaactctgataacgatggatgtctgattttttccttaccagacaaagttacatagcaaaattttgccgttttgggaacgaatttacaaaaaagtaaatttaaaaaaacttgatgattttgaaaaccatttttttaatatttatttttttcataaaaacaaaacaattaataaaacaggcataaacttgtatagaattttccattaaaaatcattttataaaattcaatttaaaaatgcttactaaatgatatgtattaaaaatggttaattaaacacaaaatctcaatatatccgcataatatcttcaattggttttcgttgaatatccggcacataacattcttcagctgagtagcccaatggcagtaaaagagaaacctaaaaacaaataaaaaaaatttttaataaaattgcgaccttctcattgatgggtctttgcaaaatttcgcgaatcgctgcgcccgcattaagaggtgttgtgacgacagtgacgagaccggcattctgaaagaatatcaattaaataaaattaattgaattaattaattaaatgtcatttaataatggcaaaatgcaaataatccaattaagcattgcacctgaattgcagcgagcagtattccaactgcaattgatgtgctttgctcactgtaatatgttggtttccgatcacccatatgatcaagttgataggcctttattcgaaattttaaattttatttaaattattataaatcaattgggatggaatatcctttttttgtttaatttttcatttatttccgtctcacatgcttcatcaccaccagcaggaatggtgcttcggtcaagtatggcttgttccaattcacgttaagcggtgccacgtccaacacccattgggcacccattcgtctgctgtagttcatttgttcctgttcttccacaacctcacgaattgcacgtttgattcgcgcattcctaaccaaacaaaaggtccacggctgcagattggcaccgcttggcgaagtgcctgcaaaaatgatgggtcattgaatgttaaaaaaccaaaatttatggacaaaatagaaaacatggagcataacgatgaccagagtctgggtgctattggtatgtggaactttggtgtcattacaactcgtacaatggattaggctaggcctaagcttcaggctaggtcaggcataggcgcttgcttgggcctatgaataagctttattttggcataaaaccaaaggagtcatggcgaaatgtcacttagtcccagtaaaattttaaaaaatatattgccattttggcgagacactttttaaacacctgccgttttgatgatgttttgcaaaattttcaacggaatttctttggtgctgaagcaacggacgctgcgccgcgttttcatgagctcgtaaaataattgtgaccgtttgagcatttcctcctccccaatttcgttgggatggtaaagcacttcagcacattggacatggacaaaattgtcattttcctcctcaacagcggtgtccttatcagaaccaacctcaaataaaagtttaaaaaataattaaaaataatttttttttctattattggctaacggaaatttttaaaaatttaattttctaccaagtccgagactttttgattttattcctctaaattaaaatgatttaattgcagtatttcgggagggctcttgggagggcggggggatttttgaaatattgtaattaatttttaaaataaaatatgtacatttttatcggcatattgtcggtgtcgaatggcatcagtactgccccttgctacggctctcgatgcgccgccatcttgttgctctcgagactcgcgacgagagttttgccatgcaccaaacaaatgtcgggcaagtgccattgccagcttgaccatccactgcaggggggaaaagtgccaaaattggttgctccagcaaatattatttttaaaaatttatatgttttctacctcctttaatgccacacggaattgaatgaccacaacagtggccacaatggcaaccgccatttggccaggttctaccggaccagcagatgggtacgaatagggtggtggttgaggcgaaggcccatactgaggggggtaagaaggtcgttgctgttgacacataaatttgaaaaaaatcctatataaaaataatggaaaaattaatttttataccaaattcgataatttttcccgagttcagtgaatatatttaaatttttatttaatcaaatggattatttctttgtttttttttgtaataactatgaaaaatttatataaaagtaataaaaaatatataccaatttctttatgcgattgacagcaagcaattcagtaaattaggtataatcaaaagagaccnntgcag

SEQ ID NO: 4467 - DNA, 4067 bp, Heterodera glycines
aaaagaaaggaagaagaaactcaccaacggaacgttgcctccccgaggattttgctctacggcattgtactgatccgcaaatgccgcctccattatttgtcgctgcggtcacatccgttccggtgccgccgccttcacgctccgcttcgtccgtcagatcctccgagctggccacgggcgcaagcggtggcaattcttgcaacagccgtgccttctcccggtctaggaagtccagctgctcctcaaacaattgccgtgccgtctccatgttctgctgctgttgttccatgtgggcatttgtggtggtggtggtgttgtcgcctgttgcggatgtgttcagcagcaatccggcaccagttgcgcttggagtgccagcgcgagtttgatcatcgacagcaatgcattccgttgaaacggcggcactggcggacaagcgatgcttctataatatacaataccgtatttcctaaaatatagactcgcttaaatagaacccctcactgaaataaagccctttggaggagggggagggggtagaaaaatagagccctcgatggatttattttaggaaatacggatttagaaatcgcattagcgggtgcaggagggctctcgcaattaaacgagcgaaaatgtgttggaatgttggaatattgcaacaacaaaaatatgccaagataagcctgattaaattttttttattaatatattcaaacatacttcgatcagtctcagattctctgtcacctaaatattgtataaataaaataatggcatatttttatgattaaaattatagaaatttggtaaattcctactttttcactggctgattccagttcaataatttgggaaagtgtttcttggcaatgacgaagtttgtcttcgatcagtgtttgcacgcaaatctgaaaattgaataatgtcaaaattaaaattggaccccaaaaagctccgaaaacattgactcaccgcctgcttttgcacatccattagttgttcttgggcatgtattgttgatgtgttacggcggacaatgcacggctgaaaattatatttaatttttttaaactaattaattacaatagttattaattaaaaaattatgcaattattttaaaaagtgccattattaccgcaaaaataactgctaaatttgatgccgacattttattgacagattcctgatgagcgacacgggctaaaaaacaagtggaattgtaccaaaaaaaggtgcatcgtaattcccctttttattaagcatggctaccgtaaacccccattgtgttaccgcacccaaatggtagacgagtctgtcaagcacacatttgttgcccttcggcaacatttcgaccattgcgcgtaggcaccgtatacggtcattggtctcttttatttctacagttgttggaggggaacggtaattaaggagcggaaattgagtacggtaattgcctgaaatgttcacaaaattttcatagagatcagcagtgatcagcggctcagacagttcccggaaaaatgactttaccaagctggtcaacacatgaattggcacatcgtcaaatgaaatggagtcgggatcttaggaaaaatgagaattttatatatttttttataaaatctcaaaaatccctaagtgctaaccacccgcttttccaaattaaattatttaaaacttttccaaaaaaattttttttaaggaaaaacaactttttttaaaggccctctcctctaattttcaaagttttaatatttgatgaaattttttcatgctgagaaaatttttgaaattaattcccgacattttttgagggtattaattgcgaaaaaaaaaattatttttacaattggaaatatcattacaaatacttatgttgcactcactaccttcagcgagttcaatttgccgtcttgtctgtttgatcagtgccaattggccactctttcgataaatgccttcggtgaacaacgctttcacttcaatggttgccaacagacggttgagcaaaacgggcactgtttgggcatcatcaagcaaaagattggaaaggtcggcaccgaagaatttggaggaattctaaaaaaatttctttataattatcaagtgcataatttagttgacataaattcaatcaatctggaactcaaggtatgtcgtattttgggttcccaaataaaaaaaattctgtttttttttatgcttaatgaatttatttcaaataaaaattatttatataattttgagtttttcttactggcatttcgccaacagcagttgttgccctggaacacacataattcactttggtatggcactttttatggcaagacaatcggcatgagacacaaataaaaatcttaatttttaaaaattgatttatataaattgttaagacgagacatgactaaccctttcagcatgccacataaacttaaaatttggaattattttaaaattttaattaatccataaattacagtataccaaccatattgcaaatttcgcaatatgtcggaatatgaacatattccaaattgaaatgatgaccattgtgaagcttaaaataaggtgcaaacattttttttaaaagaattcaatttttggcacatactgtaatatcggaccggcggcgcttctttttaacagtctgaaaattttatttaaaataaatgataattaattaattaattttttttttggcctttttaagcttttaataccattctacaatagttccaatataatttttttttagttttcgtatttctttttttaataaataaataattttttcccacctttttttggctgttttatcgcttatattttagaagaattcagcatattaaataattttaaaaagctattctattttatcctcacttttaaaggcaaaaaatcgaaaaataaatacaatgttaaacaaatctttttattattaacaaattttttacaaaaccaaaatttcaaaaatttaatacgtcttttacacacattttttgccctacctttattagcactgctgctgctgtcctccttgaactgctgcgtcgcttccgttgctgcatgaactcgttaaggaaaccgcgaaatgcattcacacccaacacttacagcgaaaaatttttttttaaatttattaaaaaaatattatattttaaatatttaaaaaatatattaaataattttttgacaaatttacctgtcggaaatgtcacttgctcctcatggcacattttggacagtaagccctcaaaagtgttgatcatgtcatggtatttcagcacagtgttgccctcctcaaatgaacagcccatttaaatataatttaaaattttaaatttatttaaatatttttgtcaaaatttaccggatacaccaaagttgtgtacgcgcacagttccatgtgaaactcgcgcatactccgcttgaaaatggcatccactaatgtttcacgcttgttttgttggccaatgtgggtttgcttcttgaagatgaacacactgaattccctgaaaacaaataaacaatttaattaaaataatttttttttcatcgaattttttaacgcctgatgataatggattaaattaaataatatttatgctttaatctttctccgctactaatgattattaaacaaataaaaattggcaattacaagcataattgatgaaaacaaattttgacaactgtacctcagatcgtcaatagtttcaattaacagtgaggttgggtcagtctaaaaaaaatatttctataaataataaaatgttttttaaaggaccatttgcttggtttttgtaagattgaagctggtgaacggggaaaaggtgactcggtttggtgagacaccggccagcgaattccttggcgttttgccaacccttgaaaaaaaatttttttttcaaaaatattcaagatcgaaatcattggcacattatatcccatgggcgtctgaatgccagctcgcgttgttgcggtggaggtgacgtcattggggatgtgcatggaattttggcagcgaaatgtggcacattctttgtggaagatcaatttgcaa

SEQ ID NO: 4468 - DNA, 1907 bp, Heterodera glycines
  misc_feature (1831)..(1831): n is a, c, g, or t
ttgagagagtttattacctcggccctaaagaattatgcggagtcgctcgaatcgattataaaagatggtggatctcatgcaccaataagaagaaagagaagcgcaattgagccaacatcacctcctaatgcacgtattgtgccaaagtcgcgtccgaatgtcactaaaaaagtcatagtaccaacatctcccccacgtgtgggacaagaacatgaagaaaatgcagaagaaatctctaattcattaaccaatgtgaccaagccaccggaaaaacaacaaaaaattgaaaaacaacccgaagtcgtaaagccacaaaatgaaaaacaacctgaagtcgtaaacccaaaaaatgaacaaataaatcaaacacaaaatatttcgcaccaaaatgcacctagtccaaaacctccaccacctgcttcaattccgactacgaaaaaacacgaagaattaaaaagcaccattgatccaactccttcagtttcaaaacctccacctccattgtcagtttctaatccggttgaccagaatagaaacgtgtcggtcaatcaaagtgtttcaaaaaaaaaaaatattcctcctccatcagtttcaagttcatcaataaatgtgcctaaaaagcaggaagaattaaaaaacagcaacggaccaacagtttcaaagcctccgcctccatttccagtaactagccaaactacagtttcaccagttcagcaaataacttctgctcaaagaaatgatactaaaccatcatcatcatcattgattaatgaggagaaactgaaggaaattggcccgccaccaaaacaaagaactgaaaaaagtatagtcgagacggtctcaccgacacctccaccagctgtacccacgcactccaatgctacagcgaaaaaggccacttctcctcctcgagttattgccaccgacattattggaccaccaccaaaacagagaactgaaaaaagcttaaataccaaacatgtgcaagcacagcttgttaacgaaataatcccagagactactaaaaagacaacaataacaacaacaactaccaccacaattaccgaaccaccaaaagacacaattgatgattttattgggcaaattgaaaaaccaacgaaaagaaacaatgcagagcagttgcttgctgtcttgtttggaaacgatgaatggaaaaaagttaacttgagaattcttaggcaaatcattgaaggagttgagttacagtatcatcccaattttgaacgatttaaagcggtttttacacatccgagaattgaatatatctcattttcgcctcagctcggctatgtgttgggttttgaaaattctcaatatgtaagaaataatgaaatagccaaatacggaagtgatctccgtggtggattcgcaagctttgccgtttacgcaaaaggtctaaccgagaatatgattgttggaaattcattgagctcactccttcgtgttgtctctgtgtcgggggcggtaccaggcgaatatacggaaaaaatttacgactcaccgctctatggcacgtgttctaccaaaagaagtatcagaaattgaaattgagttacggacgatgacagacggacgactgggtaccattttcctatggtacagtggtgggtcgtactagatatttaagaaggtgataaatttttgaaatcactcattattgtttttattatcacactcaattgataaaatggtacatactctttatgacacttcggtttcgggctatgatggcattttttgggcaaaatggttggggagtcggggatgactcctcctaccaagtttttcgaggagcgccaccgtttcagcngcgggtggggcccagcacagacgggtggggggataggtgatatttttcgtggactttggcgctttttcctggcact

SEQ ID NO: 4469 - DNA, 1876 bp, Heterodera glycines
atgaaaaacccggtttaaaaggaacgatagaaacgttggcaactgagagtaaacgtggagcggataatgttttagagaagggcggatttcggcgtcaattgggcacaggagggcgaagaaatcgtataaaagctaacaattcctccattctatcacatcaaacgctaattggaaaaacaataacaaaaccgttaattcaaagcaaaaagaggcttcgatcagacgcgtttgggctttattaaaaaatgacatttcacaaaattgacgcgagtagcatcgattcgattaccaatgccgttgattttttcagtatacctccgacaaatgttaccgtatcatcgtcaaaggttttcgagattttgccgagtaatccactcaccgacactccttatcattttaaaatacactcgagccaaaactacattgacctgtcaaagtgttaccttttgaccgaatttcgaatgcgaaaattgacaccaccaaatggtgaatggggacatttggatgctactgatcaggttgtaccgatacaattgatcgggcacaccttcatgcgagacctgaaaattgcaataaacggtcgtgaattttcaattctaattcactgatggcatacaaaacttatctttctcatgaactttcgcaatcacttgaagctaaagtttcgcatttaactgctgctggatacgaccgtgaagatgctagcaatctacaaaacgcaaattccgaagggttcaaaagtagaagacaacggtatttgggaggtcgaacagcacaatacattgcaaaaatcgatgccgatcttttcaatgtaccccaatatttgattaatcattgtgaaattgacataacgatacaaccccatgatgacaattttttgttaattgacaccttagacccccctggtcagccatatagccttgagcttgttggattgaaactctactgcaaaaaagtcagtcttatggatggtttggctcttgagttggcgaaaaaattggaaatgaaaccagcacggtatgctgtacgaaagacgatgatgaaagcactgttcataagcccgggacgctatgaatttaatgcaaacttgttcatggaccaagttccacgtcgcgtaacaatgggacttgtcgcaaattcagattatgtggggaacatcaaaaggagtccattcaactttcagcactttaatgtacgggagttaagtgttgtggccaatggtcgctcctatccccaggccccgtatgacattgactatgaaaattggaaatttgttcgaccctacaatgacacgcaggaggcgcttggttttgccaactctacatatggaaatggaattgattacttttcgtttttgcacactcactgtatttatgtgtttaatatgacaaacagcggagacgatcatggcggtttatttgatctaatcaaaaaaggctgtacagcagtgaacattaaattcaaaaaaccagtacccgatggtggaataacgcttattgtgatgggtgaagcggactctatttactttttggataaaaaccgaacaattgcaaccgatacaaccatttgataaaaatgtaccaaattttacttgcttccttattgtttcaaccaattgtttcattgatagttgaagaaggaataaaagcagaggaaattcctgcatatagtaagtggaaaatagttttgggatttaaaaattcgtcagaatttcgaaacacaacaactacaaaaggaaccgttacgtctgcgttatttaaaaatgtatcaacaactcgaaaaacaacacaaaagactactataaaaacaaaagtgacaactaaaagtgcacagacaatccaagcattaaaacagcatcaaccccagaaagcatcaa

SEQ ID NO: 4470 - DNA, 3391 bp, Heterodera glycines
  misc_feature (3280)..(3280): n is a, c, g, or t
atcaaccccaagaaagcatcaattttcctttcatccctctttgtaaagaattaccaaaagaggcaaatgtgtattcacatattttttgttgggcaatgattatccttttcggattgtccgtgatcagtctaattatctaccaatttcgctcaattctttggctaaaattcactttgacggaacggtacagtaagaccaatggacagcaaccaaatcaccagaattttaacgtcgtccgaaataacgagccgcaagttccttggatgcttcccatgcgatcaactacctgagccgatggccatacgatttccggcatcattgattgttaatttggaccctcatcagtttcccggctctcattgggttgcaatatttgttaatggattaaataagaaggtcgattactttgatagtctatcgttacccattaatgaattggtagttaaatcctttcttaatgtctttcctggaatttattgtaaccagaagccctatcaatcagtttcatcaaattcatgtggacatttttgtatttgttttgtttattttttatccattggactaacttttacccaatttttagacaaattaaattcttttcataatccagaaatgtttgttcaaaattttattcgcaattttccgataaaataaaaataatatatatttttatttgccttggatctttttggctcactccgtagaagggatttagtggagggaagggaaagcaaacactatatgccgttcagtgccagtcaccaatgactgcggagggaaccgctttctttcatttaaatatgctcagagagtggtatatgccaaaaggtcaacagggcgagtgagctttgccttcacaaaattggcgaatgctgattggttgaaggagaggtcaggaaccaatgaatgccgatgggagtcattccattcctccccgaataaatggttttctgaatgtgtaaatagagcgagtgagctttgccttcacaaaattggcgaatgctgattggtcgaatggctcttttcgtattctctcttctatgatgctcattggcggaatttttgtgcaaagacgactgaattaaccaaataaacgattttttgttgaatatattataaaataatacaaatattttatataaaataaagaaattacaaacgaaaattcatcgaagagttgcttcgggaaccatacaacgagctttcgcccccacaaaagtcggcaaaagattacgtcaaaaaactcgactcggaaattgaacacgttccaaaatttcaatgggttaaaaacaagtctcgcttcgccattgaagacgtcccttccgacccagagggcttattgattggcatttttcaacactgtatggatgaatcgattagtgacagccggtcaagaggagttgagccgacacacctcggctgcattgtttccagtgcactccttacttcggatatatggattccaattcggcaaatgacttcagacacaataaacaccattctcaaccgctttaacgacgtggctcaaagcaaaaaacaggatggtgtgacgctttggggcgacccatttaccgtaaccatgacaacagtcaaccgaaacggactaccagccaaacgacaactgaaaggaggcgcagcgcggaagttaacacatgtccaccacagagttcacgaacagtgtctaattaaggtttttaattaataaatatttttaacttatataaatttagatcgaaaattttgatggagacaactattgtctattttatgctttgcaagcaacaatgattcgttctgttgctggattgacacgccaaagattttatgactacatgaatgggaaccgtggattccatggaaggctgaaaagtgaagcagtggacatgatgaatgtcgtcaaagcaccgccaaaacagccaagttatgatgctgaaagatatgtcccgcgggttattgattggtggaacaacgttaaatttgctggcgtttggaaattcaaggcattcatctttggagcaacgggccattacaagcctctgttcaaatacggcccggaggattatgttgtgccaattatcctttattttgaagatgggcatttcaacggggtgcagaaaagcggaaaccttttcggaaggccttattgcttgagctgcgaaaaaacatatgaccgaccaaaacagcatactttaagctgcaagtctcgctgcattaaatggttaaaatattttaaataaaaaattttcaaattaatttagttctcaaatgggaccaaatttcccttgcaagccagccccgggctttcgacaaaaatgcaatggatgcaataaaacgtttttcaacgacgaatgcctgcagcatcatctttcttccaatttttgtcaaatgagcaaagagtgtaaatattgcggggtcgtttgggacatgcacaacaacaagagaaatgggcgagaggtttttttttaatttgttttaatctgttcaaatcaataaattgtataagggtcataagtgtggtgaacgatggtgtgaaaattgccaaatttttcatgaatttgagcgaggttgttttattcggcctttggagccaaacaaaaagaaggaagcagtggggtggcggcttgttacgttcgatgtggagactacgcagcaccaagccgtcgaccctgattttccagaacgacgaaaacaccaagtcaactttgtcacagcaaacgtcgcttgtccgagctgtatttcgtcgggaatgtggaaagaaagcatgcgtggcaaattctgcaatatttgcggctttcatcggacaataacattcagccaaaagccattctgtgagacaacagtcgaccgacagacaatcgatcgtcaccctctcgtcgcattcgtcaaatggattctctataaactgccaaagaaatacgacacagttgtctactcacatttcggtggacgctttgacatggtcttggtctttcgtgagctcttcatggaaggactaaacccgtcaatgatcaaaaaggggaatcgcttatttgaaatgaaggcaaacattgattggttcactatttgttaaatataaaatttaggtgaagagcagaaaaaatctaaacccaaatgtgatatttcgcgactcatggaatctgattccgggtccactggcatcaatggtcccaatgttcggcttggacgtggacgacaagccttttttccctcatttggccaaccgctctgaaaattacggatgccatatcttccccacaaaggccgatttatttggcgacgnaatgaatccggtcaaacgaaaagattcgacaaatggttcgaggaaaacgaaacaagtcgtttttcctcgacgaagcattggcccaggtataatgaatttttaaaataaaaa

SEQ ID NO: 4471 - DNA, 7595 bp, Heterodera glycines
ctgcaaagatgatgacgtcaccactgcgaggggtacggtagtccagggaaaatcgcaataaataagtcgctggacggttcaaaggtttgttcttttgtattcgttttattctaaataaatataaaatccattttagcataccgtttcttgggccgttttatgctggactacatttggaattcgagctacccagaagacgtgttgaagagcctgttcctgttgtgtcttacgtacgcaatgaagggagcagaagccatgaacatcgtggccaaccacttcatcttccttctgacggcacgccaccttgactacgagattgccgtgcacttcaaaaacatcaagaagatcgacggaacaatggctgagacaattctgacgcgctttgagattgtcgaccagagcaacaaggcgaaggaaaggccctcaatctgcgaagaatcgttcgtcatcgacatcacggcgatcgagagcggaaagcagaggaagaagctggctggcaaagggaggagacccgacttcaacatcccgtacagcatctgcgatgggacaactttcgagctgacaaacaatgacaacttttgtctcttccgggcgtttgagtttctacgtgtgaaacatgagctacgggatcgacatcagcgatttactgaatacaaacgaaacagtcagtggcagctgaatgatattacgactttgtgccaaacctgtgaaattaatatgagactgctaatcaatacggagttgtccttcggctcgtcggggccaggccgtacctgtacgcccgtttccaccgtcttattcagcagttgcgcaccgttgcttagctgtaccttgaggggcctgtccttgacctcctttctcagcttcaaatatctcctcagctgctggttgtacagtacatttcgttcgctgacattcgctgtccgtttcctcttcacggtctccagctgtcgtttgacgaatcccaaatttgtctgctctgccacatcgtcgtctcctttcgcaacgccgacaccctctctcgctgcaactaatcctcggtaatgctcaaaaggcaggagaatgagcttattggccatctttgtgcagcagataacgagccgcctctaacagtatgggtgccaacaaaggggcaaacagtgaacctccctcctgctgtggttgttgttgttgtaagatcagctttctcgcactctgctcacttctcacgcgtgccaaccgtcgaatggtgttagcaaaaggcaacaatttttgtttctgtttccgcgtcaaacagaaggatccgttaagtaggtttaagcaaatctccaccagggtcaacagctcttcacaacctgcactgctcaacaaatgacgcctcttcttgtgagatgtcgtcctcccaagggacttcagatactcgtagttgtccaacacccgctgtccaaccatttgcttcttaaccatttttgggtacaaagacaatcttttcttcgtcgtctgggaaaatgtttgtcctcagtcgtaagaggttgtctgtgtttgcgtgtagggtcaccaacagatacccgtacggatcggcacacgcctgcttatacgcgtccatcagaaacccttgctcgcgaggaaacatttggctggccaaattacgaatgctcaacatatcgctgggcgcacgcatcagaaagatgtattgcgcattggaccttggcactctcatcgccttgtcgaacaggttttgggtgaggaatatcaccgaaaagttgttgtggtgtgacttcttggtgtacagatcagccaacttcttcgcgtcaatgtcgcccatgaggtcatcgtagacaataaggaagggttttggcaactttttcagcatttcttcggagggaggaccagcgtgcgggactacgccctgcctctcgagctcggggatctgcgaggagtactcaccgtaagcccaaactaaacccaaggggactgctcattactcatggcattggggacttacctatcactttcgacgggggatcaaacatctcgcgggcatgccccaacaggcgaaggaccaactgcgtcttacccgaagaggagggcccgctgacaacaatcccggagggaatgggaaatttgagttcacgctcatttattctcggggagtccattacgaatgataacaaaatggcttatcaacagactgagttatcactttgggtcaacattatcatcatcatcattgttctcagccattggtggaacttctgccagcagttcattcgcttccgctgcgacttgtgcagcttggtaaacttccgggtgtctcagtggcagggtgaacattttgttacgtgaccggacgcgaaacttggcattgtcgccaaagtccacttaagctgctgattactttttcgcagtagtccaaacccttaccgatctcatcaaatggcagaaagttctctccgtcatccttgagccgggaagagaagatggtcactccctctggctgaatgatgtagtccagctccacgttcccactcttgcagcgtgtacaccgacccggctgatcccatggcacaaaccgaggggtcttcagatggcgagggctgtacaccgtgacacccatcgtgttcacgttgaactcaatctcggggaactcctgcgacggtctcgaacgcttcatctctgtgcgggtcaatagacgggggttggctgccaaacacttcggaagccgaggtagtccaagtagttggtgtctgttggcttttcgcctgttatctctgcactgtcctctatggccaacaactctgaaaccgtgcgagattatgggctttcatcgcagcctaaagcttacccaacggatagtacttgcaatgacctttgctgtggtactcaacgatgcacttcagctgagggtacaacaggcggatccggtgctttatgtagaagtactggtgaactttgacctctgaactttccaaagtgagggaatgcttgcagaaaagacacttgccaaggaatccctcgaaggcgtacgtctccgaagcagactttttcgagaagttgccaaactcgacctcctttgtagtgccgcccttgttcgagtaggttgtcttgagcttctttcctcgcaggtatgcactcgccttgttcacagcttccgggttattcaggtactctgccaaattctcagctttacagttcagcagcttggataaggctgttgtcagtgggggcatctaaatgactgacagggaagtgaatgataaggggcgtggcataggagggcatactgtggatggatttcgaaatcctcccgtctggaggtccctgcgtgctctcacttgagtgggcgtggcctattcccacgtgacacccccctctccatcacgtcacatacagtacccccacacttttcccttctcattttcatcttaacacacaaaaatattcctcgaaatggctcctcgtaagcagaatgagcagtttttggacgaaatccagagtaaattttaaaataaaacacaaaatataagcattttatagaagcgaaccacgtggaagaagcacaaaacaatcaaagaaaacataaaatgggtaaaatttttcacaaattttacaaaaattttggatttttttctcatttttccatgtttcagatagtgatgacgacgtcaagttggttgactctcagtcatctcacgcagaggaacgccctgtgctcaagaagaggggccgaaagtctcgctgggaaaaactgctggaggacgtgaacaacgcaaagaaagccaaccccgcagaggttgaagtcgcagatgtcgacgaacgcaaagcagccaacgtcttcgactacccaacaattttctggaagctcgcacgtccaaaggtaatgtttgctctggtggcagccctacaatgttcttcttccgttgcagtatggggtgttcacctttatgtgcaacgaatgccgtaacgaaaacttcaagcgaggcgacaagcgcttcatcctcaacactggcagtggccaagagaagctggagttcacccaaacattctgccaagactgtgccaagttgaactttgactgcaccgacctgatcatgaaacaccaaaagaaagatgacggaccatctgcacagaagaacggaggacggaacacctattttaagatggaaaagtgatctctgatcattcattcattgatttttcgttgaaatgagcaactctttctttgtaattttgcccagcaatacgccgggatttgtcggcaataaaacgaataaattcaaagtacacttgccaaaaaaattagtgtttgatgggccgggttggatggtgggcatgtctggcataatatatcccaacaggtgtgtgggtttgcacagttctcattgcccttgtacagtttagctgggcgactgtagggaccctggagaggcaatacgtagtggtgcacctgcgcgatgggcgcaagttccggttcagagtgccaaggggcagcttcctttcgcctcagcagctcgaacgtggaatgcaccatggcatgatagcggaaatggaacgacacctgacccgaaaaaggtcaatacagtacccggatgagggggagattgttgacatggaagtcgttgaggaggaagagcctgaagaagcaccattaaatccgttgaaaaatcgcacaaaactcgcccaacttagcttgaagcatgagcgagacaaaaaagagagagaggaggaggataaaaggcgacagcagcgagaagagcagcagcagagaaagcagcaggaagagcagagaaagcagcgagaagagcagcagcagagaaagcagcaggaagagcagagaaagcagagagaagagcagagaaagcaacgagaagagcagcagagaaagcagagagaagagcagcagagaaagcaacgagaagaacagcagcaaaaacagcgagaaaaggagcaagagaaggcaaagaaatctgaggctgaccgcgtagccaaagagaagaagtcagaaaaggagcggttggcaaaggaggaagaagaacgactcgccaaggagaaggcggaggaggaacgcttggccaatgtgaaaaaggaggaggaacgcttggctagagagaagaaggaaaaagaagacgtacaactcgccatggaggcagaggagggccgtttggccaaattgaagcaacgagagttggagctgctaaaagagctgaagccgtggcgtggtggctacatgcgactggtccacggcaaggacccgacccccgacgttcattatctgcacgagaaggatgattatcactttgtgaatgctgtgcacaagtacattgtgcgacatccggaacttccatgggactcgccggagtttaacccatcagcaaacattcaacaaaacatcgcagaattccggaaaatctttgagcgcgaagttttcgacgaaaattatgagctaaagacaagagaggagaagaatgagctgatagagctggtcaagggatttcgattctatttcgcggacgagcttggacgttttacgctaaggattttcagcgacaaaatatcacacatcactttgacggatcagctggcctacgtgttgggctacgaacagcagcaagaaattcataacgaagaccaagccaagtacgctgttgacttggccggtggtgtcagtcacctgtgcatctacttaaacagcggaataatcgagagcatgatttttggcaactccttcgccaatctcctccaagtgattgcggtcgagggtacgtcgggcagtgtggtcgagaaggactttcagtcaccgttgttccacaaaattgtggctagagaggtggacgtactggacgttgagattcgtacgctcacaggacggtagtgttgtgattttcaaaatattttccctactttttttttggtttaagagaggtgccttttgaatttggccaagttgtgctgactcttcagtttaaaaaagtcgtaactttctgatacaatggtccgagttatattcaacgggtcgaacttgcggttggagaattatcatcagcagggtggcagagggaagagaaggcatgaaaaccttgctggacaaggcgtccgcatcgctacagaagggcatagggagaagaaggaggaagagagggacgaaagccgagatcattttaaaaccctcagacattgttggacaaactgttccccagagagctctgttgaaaaagaaaagatttgattcccttggttattattaatcggcatgttgtataaaaaagttgatgctgcgagtgcagaggtggtcaatagcggattggacttcttcagtacaccgccaacaaactgtgcggtgtccaactccagctatcgggagtacttgacgctgaacccgatcagctcaaggcctttccattttaaggcaattgtttggcaatgtataactcttatcagtgtttgttcagattcatccgatcaccagctacatagacctcagcaaagtgtttgtgtgcacggaattcaagctcaagaaaatcgcagaagacggagtggtagttgacgtaccagccaacgcggctgttggccttatacaaatgcccggtgcaactttcatccgcaatctgaaggtgcacatcaaccagcgtgaggtgtacgactccaaccagctgtacagctacaaggtgtacctggacaccgagctcagttaccctgcggcaggcaaaggatgcctactttggcgtggcgggctattttcgagacagtgatccgacaaaagtgaacgaaaaacggaaaaaagcggtggaggagagcaagagcttccaagcgataagcaagctgagtgccgacatattcaaccaggacttgtacatgatcagcaatgtcgagattgacattgagctcgcactgcagtcggacgactttatgatccaccaggacactgcgaataaggacaagtacacggttgagattgttgactgcagactgatcgtgaagactgtcgatttgatggacgggctgagtcttgacattgccaggaagttggacactgagcctgccagatacggaattcggaagtcattcatgaaatcgcttttcatcactggtggtcgttatgacttctcggccaacctattcacggagaggtgccacgaagggttgtcattggcctggtgtccaaccagaattatattggccataatcagaagaatcccttctattttaatcaccacaacgtgagtgccacttggcagctggttatgaatcagattattcaggtgcgggacattgagcttacggcctctggcaggacatatccccagtacccgtacaatttggactacaagaacaacaggtacgcacgggcttatcacgatgcccaagagcacctcggcatggcgtgcacaacggagagcaacgggatcagctacagcatgttcaaaacggcctactgcctctatgtcttccaaatgaccaacgcacaggaggactcgccaggctttgagctgataaaggaggggtgtactgcagtgaacatccgattcactgaggcagtacccaacaagggcgtcactttgattgcgtacggcgaggcagacgggctcattcttatagatcgtaaccgatcgatcact

SEQ ID NO: 4472 - DNA, 5777 bp, Heterodera glycines
  misc_feature (180)..(180): n is a, c, g, or t
  misc_feature (258)..(258): n is a, c, g, or t
  misc_feature (268)..(268): n is a, c, g, or t
  misc_feature (274)..(275): n is a, c, g, or t
  misc_feature (290)..(290): n is a, c, g, or t
  misc_feature (722)..(722): n is a, c, g, or t
cgcactttgctgttgctgttgtgccgccaatgggcccccttcttgcagcggatgcggcaccaagttgctgctgctgaactgcttgaacatgttgatgctgagagggcgacaagacgagtggctgttgttgtgatgacggcgactgttgttgttgcgcttgcgccgaaaaatgttggtggntggtgaaagatgccgacgccagtgccaccggatgttgcagcagaagcggcaccggcaccgcttagtttgtgctgttgncggcgacggnctgctnngggaatggggcttgnctgtggcttggtgctgcgtcagacaagctgcaaaaaagtgatcagaagaagaggtgatcggaaagaagcaaagtgggatttccaattctgatttcaaaatttcattcagaaacaccaccaattatttgtgctctaccccttccatgattaagcggatgtaatgcttattcgggatcggaaagccgaaaaactaagaaaattgtggcaacactcacgaaactggacctttaaaatcctggaaaaatatcctgaatcagtaggttggcacggaattacgacccattaaaagccagggaaaatttcgagggctgaggcgctcgggaaagggactcataagcattcctgacacgtgaatgatctgatcacattgttttccaagtgatcagggcttcaagtctagccaattataccgtgagtgactcaccgatgggnctgtgtcgccggtgttgcgccgccgccgccggacgtgcgcccccccggggcagcgttaaagaacaacagaggggacaacggcgttgccgtccgccgccgctgcagcattgaaaaaactgagcgcttgcgctgcttcaactccgccgcctgtgccgactatgccggttgcagccgccagttgctgctcctccttagtaggcccaccgccgcccgccgccaaaagtgcggcaattgcggcggacagttgctgatgcgcggcagaagcgtccgccgccgccgccgccatggagttggatatgttgttcaactgctggtggtgctgctgctggacatggttcagctgttgctggtcgtgttgcaagggttggggcggcagttgcgaagtgccggacatggcggcggtgctgctgatgcattcgcgcttcacctgctgcagcaccgcctgctcaatgctgttactgcttgacgatgctgatggtgccgaaggtggcggtggcggtgcgggcagagcatgttcctttgattgcttttgtttacgaaaatgggaagaacaaggtaaaatgggaccatggtttatcatactgtatgtataccgtagcggagcctaaagtccgaataccactattggtcctcctctcccccggtctcgtctctctcggcaagttgatgtctcagaaacgactctcgagaagggtacacttcattcccccgccctttggaccgagacccaaaaaagccgagactgagattctcgagcaagctgcacaccccacctctttgatgtaaatgttctccaacggcatgccgatggcttgtctttgttgttgcgcagcgtccaatgccgtcaacgttggcgttgcggttgttgccccgccggcggtgcaaaaatgatgctgattttgcgacgatggtgacggcggcgaatgcctctggcgccgctgctgctgcttctgctgttgttcatgttcctcctccctctcttcctgcttgtgatggctctgtggttgtgttgctggtactgctccaggagctacgactgtgccctcctcttcaccgacgaggccgggcgagaacgcctgttgcttggcaacttgttgctgttgttgctgtcgcaagtgcgcgaccatcgcttgcattcgcaaccgctccaggcacagccgttgctccagtgagtcgaccaggtcaatctgggcatggcactgctgcgccgtcgcactgctcgtggcgtcgtcaacggcggaatggcactgggacaaatgggcgagaaaggcgggcaacgagtcgcagggctgaaaaacaaaaacagggggcatcagtcgccaattgccgtcttgaaaccagagaaggaatggcaatttgtttttatctatcggtccaaaaatgaaaatgttgtcgggatttttcggcaggattttcatgcagattctcattagttagggaaatacaagtttccgcgtggctcagtcggttagagcccatccctcattgtttggagagccgtgggttcgagtcccacacacccgcctgtcgatccccaacaaataattgccgtccacgggtgcactacgtcccccccccccctcggatcagttcccttaaaaaaattttcctttataaattttcgaactcttaatgattcatcataaaattttgaaaaaaaacaatggttcatcagaaattttttgaaaaactactataaaaaattaaataaaatgttttgtttgtaaagaatttgttaatttttggatttttttaaaaaaatttcgggggaggaaacgagctattccctgctgcccacctggtcgcagttgaaccatgcgcagcgaccattctggtacagcggataatgttgctggtcatgatgatggtttgggtcgtccgcgatcagtgacgcggccgactgttgctgctggtgttgtctcagcatcagcagctgtgacgacggtgccgtcgccgccgccgttgttgtactgctcgctgtcatcgtcgccgccgcccgttggaactgttgctggagcatctccagcgagttaccgacgccaccgcccgctgttgttgctgcaatcgctgtcgccgcggcggccgccgctgcggcgactgcgcccccctcaccgccgagcagtgcgtggtgcagctgctgatgttgtggtggcactccgacggcaccggcaccgccgccgagcaacccgagtgccgtcaactgttgccacagctgcaagtcaatgccgccggcatggccacctatggcgaattgctgagccagccgatcctggaccgcaagcagcaacagttgctgctccaactgtgttaacaatggggggcagtgagtaattagtggttaattagcaattttttccgttagatttttattttattttgacattttgccaatccattcgtaacagcatattaacaaatacaataataacaacaaaagttagcgctttcgtcaatagtttgggttaaacattggtaaaatttgccataaaaactttcggaaaaatccctttgacttggtcctccgttttagcaattctcgtaactactcgagactcaacaaaaatgattcttaggggtgttgtgccgtttcatcgtgaatctcccagtctcacgggtctttcccgggtaaattaaggtaattgttgggggaggggggggggggcgctgttataacggaaaggtgtggtggcaaaggtacgccacccctcaggcagtctgcagaaggatatttattggttttctcattccgaagctcccgtcgagagtctcgagagaccaccaccaacgcttacggcactgttgctgagcagtggtggcggcacgtcacgcggctgaccaccaccaccagcagcggcggggggagggggtaccgcgtgggcaagaatgtggtgaggcggcacggaattcggcgcaatagtgccctgctgttgactttgcggatcgccgacgacgacggcaccggcggtgtcgtagctggtgccagccgcagcgttgttcctcccacttgtgccagcctcgccgccggcaccgatggtaccgtcgccatttctgtgcccgccgtcgtcgctgccctcgtcgatggtgttggtattgtttgacggattgttaccattgccattgccgttgttatcagtgctgtgcatgtcgcagcagtcgtatagaaagagggatatgctaaagcgacggaagcgacctgcgctgattcgatcaggcctgatcactactaatcaatgtgtgtatgaatgtcactaattgttgtgtgtcaagagtgagatatatgcataataataatggaaatgagaaggaccataacgattaagcatcaagtaatcaatatcagtgatctgatcagaaagtctgatcaattacttttaatcagcaaagcacctttttaggcagtgtgatcagcaaattaggacagtgtctgatgatcaattgatcagagttccggttggaataaaactgattaaggcaatacaaatggaaaaagacaatgcacagattacaaaagaaggcatgcaaaaatttatgagacgaaaagatttttgagcaaaaaaaataaatcaaaagcaattaagatttaatgaagtgattgattagtgtgagtggagtaaaagagaatattaaaaaacatcattaccaccaaaaagtgcatttcgaaacatttttaagtcaatttttttttgtcaaaaagcaaagttcgatcgatcagaataaatattagcaaaaatgtgtctcagcaccaaacactaaaaaagaaagcaaaatattacgtcaactaaacccgaaaacaacaattttcatacataaattttaggctattagggccccacacaaaacgcttaaatcgtaaacaaaagcacaggcccccgcggggggggacgacgagggggggggggggggggggcccattccaaccaatgtgtccactctccgatcattctttgggaatggttaaccactaccaacaattcttaaagaatttgcggtgcattcgccaaccgttggacgaccttttgaaacaggacacggactggaattggtccagcgaatgtcagaaagcctttgatcaggtcattggcacgcttcagtcggaccaactgctcacacattatgacccatcacaagaaataattgtgtccgctgatgcctctgagcatgggatcggagcagttatttcccatcgttatgcggatggaagcatcaaggccatcgcgcatgcgtcgcattcgttggctccggcagaaaggaattatgcccaaattgagaaggaaggcttagccttaatttatgccgtgcaaaaattccacaaatacctttatggaaggcattttatcctgcaaacggatcataaacctttgctgtcaattttcggcaacaaaaaaggaattaatcctgcaccgccaatcgattgcaacgttgggcattgattttgctcgcttatgattttgatattgagtatcaaaacacatcggagttcggacaagcagacgctttgtctcgattgatctcaaaaacgacgattgaagacgacgaagtgatcgtggccaatttgatgaatgtggaaacggaacttttgaatgctgttgtaaagcaatttccgttgaattccgatcaattaattgttgagattggaaaagatgaagtgctaaaaaaggtcatgaagtaccttcgcactcaatggcccacttcaaagaatatgtctttagaaatcattccatttcaacgcaggcgagaagccttatcaattgagaatggatgtattatttatgctgaccgggtggtgatccccgcatcacttcagaaggaagtcttgcagcaattgcaccagggcacccgggaatgaaacgcatgaaaaatctggccaggcaatatgtttattggcctggaatggaccagcaaatcgaagacacgaagaacccgtcgtggatgaagctgatcgagcccccgaagtgcccgctcaatcgacgaccgcctgatcgctacactccatcatgaacggacggatcagacggacgaatcgaacggacgtgtaagacggacggatcatggaag

SEQ ID NO: 4473 - DNA, 1538 bp, Heterodera glycines
  misc_feature (29)..(29): n is a, c, g, or t
cacatcgaaaagttgtgggagagagagancggggagagttcccaccccggcttcccccatcccattttacgccgccgccgtcggcgtcaaaaacataaacacacacacacacacacaccaaaataccgtaaccatgtctcgagagtggggggaggtcgagagtgatcggatgggaaaccgcttggggggcattacggatcgatggacagatctgccgcacggcccctcgagcgctgcaaccacagcagcagttgaactatgcagcagcaaaaacatcgattctcaatttggcttcaaatttttaaactatcgctggcgctcagttggcccggggagggtcaactgagcaccgccacggcagcactgacaggggctgaaatgagggggggggaacaggtttcggcacatgatggacatgcataaaagatataacacatcaacaatgtcaacaacccaagggggagagggaggaagtaaacatgcacgaaggcaaaaggggtgatagcaatggcatcacttttagtgattgatgctcgagattcgagaccaattcattcagcagggaccagtggagagagggagagactcgagagtggtgagagagtgaaggagagaaaaggagagagagcgacagattaatgaaataggggcagagagaggggtgggaagtgaaaagaaccgatttcgaaaccggcattggcacggaaaaggcccaaggcaattgtcggtggacatcgagagacgagactctcgagcaggtaggaaagcaaaaacaaatatgctccgccggtggtgtgtctgtacattaaaagtggcattaggacgggggcgggaaaggaattgccttaatcggaattcggacaataagcggggcacatactgtagggcacatcatcattttgattattgccaatatgccacctccccccgccccctcccgtgaatggcaggcaattaggatgacggcacaacacacacaaataattagtgagagggtggggtgtgccaccggtggagattgactgactaattggcagcatcactccgtgccatttttgtagcccaagggtttcgaaatttgtacatagattttggtggtatgatcgacgtcaacgaccggcagaactaccgtatccacgctcatatacagtaaaaatgcaaagatggtgaaaaatacagtcgctgcgcgggtaattcacgagtgccgagaaatttacatatttcccgaattgttggttctcgaatacaaccaaaccaaactctcgtcgaataataatggggtcaattttcgactttgtgtcaactgaaagtgatgatgatcaccagtgatgagtgatgagagaattaaatttaaatgcactaaaaattttgaaatttttcgccgcgaggcaaaaacacaaaactccattagtcggtaaaagcctaattaattttaccggaagaggtggggggacaaattaatagggagggaaaagaaaaaagaaaatcatcggtggtgagagtcgatgagagggggagagtgaatgggggaggaggat

SEQ ID NO: 4474 - DNA, 726 bp, Heterodera glycines
agatgactttcgtcggttcaacagtgactattttcaccattagttatgtgtgctctcgtcattaggttgcgaaaacactaattacaatcattggtgctcagttcagttcagaggagtataatgaattcgggaggaggaatggatttttgcgtgggtgttagtgaatgggggaggaggagagactcgatgagagggggagagtgaatgggggaggaggagagactcgatgagagggggagagtgaatgggggaggaggagagactcgatgagagggggagagtgaatgggggaggaggagagactcgatgagagggggagagtgaatgggggaggaggagagactcgatgagagggggagagtgaatgggggaggaggagagagttaatgagaaaatggggaagtcgagagtaaaagagtggggagggtatataatcgagaataaagggaaaggaggaagggggtagatgaagggaagaaagtgtgtggtgatagccgagagtggagagaaatgaacaggaagggaaggtgggacattgaagaaaggaggggaaaccgaaaatgggtgggtcagtagagagtgttgggagagagaggagacagagtcgggatcggaagggagaaatggaggggtgccaaaataggaaggaggggggaaagaggaaggaactgtcgagagtgaggtagagggccgggggtcgagggcaatggatgagacatgtgacag

SEQ ID NO: 4475 - DNA, 1473 bp, Heterodera glycines
gagcgggaggagacaacgccgcccatgtcaacaacaacaacaacggcaaattaacaacaaaacacttttcaaattctcacgcccttttttcgcgcctcgcctaaaaaacaacacaaaaaaacgcaaagtttgacaaaaagcaagcaaaaaactgtttgtttttttaaaggagtgggtggttattttgttgttgtttttttcgactctaattttggcccggtgccaattttatttggacagtctcgaaattgtgtacaaaactcactccgagattctcgagttttggtcactaagagtctcgaggaacggtcccatttcgagaggctcgggaaattcttgaccttcaaaacaatctcgagatcccggccccggcttccttctcattgtcagtctaaaaatgatcacagggagggtgtattaataacctaagttatggctctgaatcagtctcgagattcgcgaccttttcggctctttctcggtctgtcgagactctcgactaaggcaaataaaaggaagcaaaaaaaacacattgaatcactcacacacaaatacataaatataaacaaatgctggggggggggggggggaatttgtgcactttttgttggggataaataccaaataaataaatatggccccgcggcatttatttatttatcaatcaccgcccgccccgacaaattgccacacaattataattatttattcaattagtgttacattgtggtggcggcaacgcgcaaaaagtgcatcatcacacaaagccaaccgaccgaccaatggacaaataaataaacaaaagaaaataatgccaataaacaaacggcgggggcccggtggtgatggcacgtgccaaatgccattcacaaagaaagggggcaaaaattgcgctaattgctcctttctttgttcccaaaaacaattcttaaaatggattttaaataaagttttacatgaaataataaaagtcctttgttcagattaagcataatgaaaatgaattagcgttttttgctaaattttttgcttaattaaaattcggtgccattcatttcaaaatttcttaatttttattgacttggatcgttttaattgaccactttaattttgtggtttttattttggcggcttttgcgtataaatttttattttatttttttgccggattttgaaaaaacgccgccgattgaaagaggcacaattttaaattattttgttttttttgtttaaaaggttaaataagataagaaaagtttttttaaatggagggatttttttttgattttggatgctttaatatggtcattgctgtgaataataatgattatgacgtgacaaagtgccaaaaacaaaaaaaaatgccaaaaatggccaaaaacaaacaacaaacacttgggcattgaaagattaaagagaaaaaacaatttaaaaaattagggaagggtcggcagcctggacacacagcggggg

SEQ ID NO: 4476 - DNA, 7188 bp, Heterodera glycines
aattgtaaagcctaaccagaattaattaagaatacccatctcaaactcctaatgttggaggtggtgaaagcgcgactagtgaaaccattgagaatactcaatgaattagaaagtgccgatttaaccatcatcacgaactatagcgaaaattgaactggacaaatcagtgaacgtttaatatgataaatggactttatgacaattaaaatgaaataactctgtctaggtaaacaatcattttatgccaaaataaatagtacaaattccaagagacaaattttcatatgacacttctctgaacccggcctcattaatcatttgagcaaacttttcatgagaagggaacattctgatactttccaccaggtacttataactgttgaaatctccaactaaaagctgacccaaaactggaataaattggaagctgtaaatgtcatagatccgtcttaacatcgtattctcaatttgtccaaactcaaggcaagcaaaaacaccatttggcttcagaacacgataggcctcagaaagtaccttagaaacaaaagaaaatcagaaacaaactcgaccaattcaaaaattgacaaattattagccaaatttgcaaaatgacaccgtcgaaccttgtccaaatgtgtgcagttcctaattccgaatgaaatcgtgtagaagtcgtaagtgttgtcttcaaattgcaaattttccgcatcagcacagacccatgaaagtcgggcttggtcagatggggagagtgctctggtggctcgagtctttcctgtttccagcatattctgtgaaaaaaaacatgagaaattcatagataaatagaaacagtgatcactgacatcattgatatcggcaacagtgattgatcccttgccgatcggttgtttgcgcatttcttgtacaattcgaaacgccacatcgcccgtaccgcctgccatatccaacaccgttgagtcttttgataagttcagctgctgcacaaaatattccttccacaaccgatgaattcctaagctcatagcatcgttcatcaggtcgtattttgtagccacattcgcaaaaacagtacgaacttaaaagcaaaaagtacccaaaatatgaaggtgaaatattatcaaggaaatacccttttcctgcttgtctgctacatcaatttttgtaaaaccaaagtgcgtagtaacgttccttgtatttccaagtgaaaaaggacgagaaaaacaaaatttaacaaaagatttttgtaaattcgaacttaaaagttcactcatcaatagctgcaaaattcacgtaaataatgtatgttttttggtatttttgagattttagggcgattcttagtgggtggttttatcagaaatttttgggttgattcttacaattatgggtgcatttttcgttttattgcattttgctaataaattttgggcaaagcgccaaaaatagttttttttcaaaaaaaaaaatagattttttaggctttaaaaataaaaaattagaaaataggccctaacaactcgaaaagtagcgtaacaaccaccaaaaaaaaaaaattgtcgtgcgtttcagaccataggagttcaggaaaaaataggctaaaacctaaaatcttatctttaatttattaaacaattttactaattttttcatttttatcagctgttgagaatgatcggctcaaaattcatcggcaataaagccggcatgagctccattgacaaggagcaagtggcgcgcataattgctgagaataccagcgcaaattttgagggttatgaaaagaaaagggcgagtcgcattgatgaacaaataaaaagaaaccgacaaaggcttgattcattgacggaacaacaaataaaacaaactcgagaagaggtgggacaaattcctggaaatttaactaaattattaacaatgaataataaacatttagttggacagaattgttgaagacatggagaaatggcgtcggctggacaggattaaagtgcacattgacatggacgcgttttatgctgcagtcgaatgccgtgacaatatccatcttcgagacgtgccaatggctgttggcagcctttcgatgctggtgcgtcattttattttataccattttaagagaccatgaattatgagtccatgcaaactttccttcattgaatggtttaggtatttgattattctgtagttttaccaaaaaatccattgataattactgccgatttaagagcacttccaattacgctgcccgtaaatttggcgttcgttccgcaatgcccgggtttattgggaagaaactctgtccccatcttctgattgtgccttgtaacttctccaaatataaacgggattcgtcagtgtttcgggcggttttccagcgctatgactccgaagtttcaatgggaagtttggacgaagcctacttggaccttacccatttcatctcacagcgaaaagaaccgggtgggttttttcgccttttacttttatttgaatgtttagtaatctgtcgaagggttcgttttatgggcccatgcgtttgtcgccttcctttggtagcaaatcccagtgaaattgggcccgaagtcgaaaaaactccgacaatttgtgcaaaatgtgggaatgaacgtattgaagttgttgactcgattgaatttggacaagacgttgactcaattgtgcgccaacttcgttttggtatgaaacgatgcgtggggaaacgaattgttgcggactaatggggacaaacctgtattctgtaggggcatcctaaaagttttttttgctctcattgtcagtccaaaatttgaactaactattcacaatcgacgacatgaaaaaaagagagcatttttagccctttttattttattcataaataaactaaaaagttattgggaatcggaatggaaatttcagaagtggagcaagcaacaggcttaacatgcagtgcaggtaattttccaaaatgagttgaaactgatctctgtttctccgtttatttttttcgttgccatttctcttcaggaattgcctcaaattccatgttggccaaaatttgctctgatctgaacaagcccaatggccaatttcgccttggaaattcccgagaagagattgcctcgtttatgcattctttgcctgtccgaaaagtgcccggcatcggtgcggtcaccgaatcgttgttgaaagggttggacgtggtcacttgcggcgatttgctggagaagcggtccattgtgcatttgttgttcaccaaacgctgttccgagtggctccttcgcgttgcgcttggcatttccggccacgaaattgcggacgatggcgagacggagcaaaacgaccaaaatggtggggtcaaaaacagtaaaactcagaatcatcagcaaatgatcattgccatttgtgtccagacgaggacaacccgaagagcacgagcattgagcgcactttcactccgacaaataattcggacgatttgctgtccattgtccgttctctatgtgcccgtcttatccaatcacttccatcctctgaaattgtgggaggtcgtgctgtgacgctgaaagtaattgcgtaattttttttttttcatttttttcactcagataaaattcgccaattttgatgttgtgactcgctgcaaatcggttaattttgttgtcaccgccgtcggccaactcattccaattattgaagcgatgctgcgcaaggaattcaaagagcgaagaaacatggcggtgtgttgttattgttcattttaacaacaacaaaaaatagtcatactttttgagattcgccttttgggcgtaagactttcccaattggtttccgctgatgcaaatttgggagaggaggcgaaaaagggcgttcagctgagtttggccgggtttatgtcgcgacgtcctttggccaacaaaaagcgacgagacgaaccccccgaggtggtggaattaagctcatctgatgagatggaaacgaaggaggaggaaggagacgaaacaatggaagtgaaaccaatgccattttcggaggaaaaagagccggaaaatggccaaaggaaaagtgaaagcccaaacgacggatgtgacaaggcggagacgagcgaacgcagtcggagcaacggccaacgtatgcaatcttctgacgaatgaatggaacggatcccatgtgattttgccaatttcagaagcaagggaacgcgacagcgcacatggagacatcattgtgatagaggacgatgaggagggggaggatggcattgtgaacattgacgaatactttgactttgttgacgacgacgacgaagtgattgactgcacaaagtcagggggagagaaaagggcaaaaaacggaagaaaagggggaggacagaaaagaaaaagacggagggaagagagcgagaggaaaagggatgggaacagaaaaacgaacaatttgttcaaatatttccatacaattcgttaatttaacgacttttgccgtacaaaagaatctgatctctgaaattgacaaatttcattttaaaatttttcattatttttaactttcgtgcaaaataaaattctaaacttaaaacagttcaattttttatattcggtttattcacatgttcaaaaatgatgaggaatttcgctgggtgccttgggggagagatcattttgcatttctgctgattttccataaaatattaaaatatccgtttttcgctttcatttcgtctcccattcattgccttttaaacaacggttgctcaagcagtccgtgcggggtcgccaattgttgattcactctttgtgcggacttcttcagcttggcccgtttgttctgaagcggcaaaatgaaaagaaaaaatgcatttgtttttgaatcttcgaaattttcccgcctcgcaaaatgcccctcaatcaaaattccgatggaatcattaaaagcggagatttttatcataaaaacgacgaagagtgtaaataaatacatatgtaagtgagtgagtgcgttgtgtccgccaaataaatgtgtcgggggggggggggagggcggctgtcaattcaaatttttcttttcactagggacagtcagtcaattcatttgctacgtttgcgctaaaagcggttgtaattagcggggaaatgaatgaaaaaaagggagaatggagggtaattgttggcattggtaggagaaaactcaatcaaaagtcaatccgatcaaaaggaaacctttaaaatgggcactcattttcccaattcattttgaaaaagtggtaattaaaaataaccgtgttctttctccgttttattacgctgatttgtgaatgagtcgaaaagtgagcatctgaacccatttattcaaatgattctgttttaaggggcgaaggtcacaaaaggaggataaacgatcagattaagacgatcattattaatcaaaacgtgtcaatttacgagcgaagaaacggcaaaaagcgagaaagatggggaaaaggcagaaggaaaagccgtggtaattggctataagatggcaacaatcaccaagcataatgactaataaatattctcttctctaattggctgattcgagacggacgaattcaaattacgggagggggggggggagggacgtcagactcttccattattcagttacattagttttgttttacaacaacagtctttccccccccccattctctccctccagcgaacaaactcaatcaaatcaaatcgctttgagcgataatatcatcgcgcctcgcttcgctactccctccccctcccccgccatccatcttttgccgacaagcggtaaatgatgcgcacatttgcacgagtggggagagaggtcataagaaagagacagacagacacacagacggacagaggcaataaaatgagagggacgaatgaacgaaaggacggagagagagggggggggggggggagagagaaagagggaaaaggtcgaactcgacccgagtctcaactctcgaaagagacatcgcaaaagttgttagctcaagtcaaactaaaacacacaacaaagggtgtaattgaatacggtagtcggaaaaagcttagggaattggcaaaatttactctttgccccccccccctttggcttacctgaaaccaaattttgatttggcactcattcagtcccaattcgtgtgccaattcctgccgtttcttctccgtcaggtagcgactgtgcacgaattgcgttttcagccgttccaactgttccgttgtgaatgccgtcctcggccgcttttcctcctccgtcaattcgcgccttttgcttttccttgtccttggcccttaaaatggaaaaggcaaaggaatccaacgcaacagaacaaagaagaagaagccaaaacccgacctgaacttggcctgtcggaatagcgagtgcagaagatccaagaggggagagaatcgcaattggacgaaacgaacgaattggggggaggaggagagcaaaaggaaagcggaggagggaccaactgagcatgggcatggccatggtgaggggacggcgtcagggaagaagcggactgaaatggaaaagccaaaacagtgagtgataagcagagagagaatggaggagagagaaaaagtgatcagatattacggtgagagagtaaaggagaatgggagagaagtgatcagcgaatggaaaaggagagaaaaaattgaataaagaaaggaaagtgatcagagaatggtaaaggagagggaaagggttggactaaaaagcgattaactgacagtgccgaactcgggctgtagaatgttctcaatgccgaatttcagcgagctgttcaatgacagtgctgctgctgttgtggccgctgtttgtgttgttaggcctttgttctgtcgattttctttgccgtttgggtcgtggagatgctcaacagaactcatctcaagcagacgagcaatgttcatgacagtaacctgagaaattgaggtaaactctgaaaatgagggaaattaggggcgggggggaaaggcgaaagaaaggagaatggacagaaaacaattagccagctaattatagcattattggtccaaacgatctgttcaattgatttaaaatatgagccaattaaacactaattaggtacatagcaaaaaacccaaaggtagtctccctcaccaatgcctcacttccattttctgccccccc

SEQ ID NO: 4477 - DNA, 2145 bp, Heterodera glycines
  misc_feature (2099)..(2099): n is a, c, g, or t
cgtgggttaatgggaggccaaaagtacggtaggcaaaaactttaaaaagattgggtaaatataagaaaatggcaaaaaataaaaatgccaaaatggacaccaacaattcaatgacacacggcctaatgataatgaccctgtccaatgaacaacagtctattaaataagcgatgatgacagacacttccattgagcggttcaaataaaagaaaaactttgagatttaccagcgattttttaaactgtcaacggagcgaaaacatttccgaatggacattcatttcattgcccttctccccaattacccccccccccccccgaggcgttaagcggcactaatagggcgacttaaaaaagggcaatttggcgcaacgcatgtggtggacaaatggataaatatttaattatccaacgcgtctcccggcgtttgttcgacaccgcaaattgtcgggaggagcaattaaaaggacggaaggacaaaacagtcgagaaatggagaatatccaattaggaggggcaattgggaaagattgacaggcgaattgaggcaaatgcaaaagcaaacgaaagggagggacggaaaggacgaaaccgaacgacggcacggcacggatgaatttggcacaaaaagcatttcccagggattgttgtgcaacggatactgtcggagaaggatgacgaatgaataaatgaaaggggcacaaggctcagaagccgacggcgaagggataggcatggggaaagatcggccggcactttttttgcccgtcagcaacggtcgtaccactctcttcaacctaacaattttgcacatcactttttatgtaaaagatgaaaacaaatgggaaagggggcggataacttacgccaaactaacaaaatttatttttcgccgtttgcccttttggttttttaagtaatggcaaatacagtacattctcattggtccaccgtattccgcaaaagaaccaacaaaatttataaaaaaataaaacaacggaggcaaaaatcactcggtattttgagaatttaaaaactcgttgtatttcttctcaaagtcgaactcatattcaatgccaatttcgcgcagtttcgccattctctttcgcaattcccccacaaatctctccttaaatttgcaatttccatttgcattattttctcaattttcccaccattcgtcgcttttccttctccggcgttcgttgctcattttgttctttcgcctgtttaacgccttaaatatggcaaactcgatgattaatttttctttcgttgaggttccatttttgacttacgcttctcggcgatctttggaattttgacgaagcaccggcccttccgaatgcatttcggcacttcctcttggcctaacactttgcatctgagccgattctctgccagcaaataattgtccattgcgcgcgccgcgattttcgccaccgctgcctctttgaactcgacaaatgccgtgccgttgtgacctccctgacaaatgagaatcgaatggcgattggcactatccgacaaaattagagaaatcaaccgcacctttttgttgcgcatcacccgaacgcgcttcacatcgccgaactgactgaaaccaattcaaaaataaataaaagtagaacacaaccaaaccgtacctgaaatagccatgaatttgcttctcaaaaaatccgtacggaatgtgtctcagtcggacgacgtgctgaacagcggcaacttcagaggaaggcccggcctccaacttctgcttggattttcgcattcgcttaattcattaaaaagcaaaatggttcatttgctaacgatagtatcacattaattatggcaatttataaactttaaccaacattaatattttctcaatttatttttaaaagaaaataaatgctgactaaatgtaaacgatggatagatagattaatttgtaagtgaagaagcgaatgaaaatgaaatgtgtaattggtaaatggcacaaccaaaggcatacgtagcaaatattgcgaaaaaagagcacaaagaatgaatgggagaaagaaatattgaacgaattctggggaacgtgaaaccgggcgaataaaactcacaaatcngtgaaaaattaacattttaaacttggaaatttgcgtctgaaaattt

SEQ ID NO: 4478 - DNA, 1953 bp, Heterodera glycines
  misc_feature (192)..(192): n is a, c, g, or t
  misc_feature (1923)..(1923): n is a, c, g, or t
atatttaatgatttatcgttagacttaatatcagaaaaacaatgagttttgtgatattttttaagggatatgattggctacgttaaaaaacttaccgtatatttggaatgcatatttcagcttcagctgaagcggtgccatttcgctgaacactgaaaacatgtccaagaagtcatcaaagctcaaattgcnctggccatcctctgaaaacacctgaaaataggacaattatgtttaaactgggcagatgcagtccattaaaaaaatcgaacaatatatttagacttaattattattttattaattttatgcaacaaattaaaatgaaatattttgaaaatgacaagaaatggaacccggatttttctgggatcattcgatagatttaaaatgttttctattaggctgccaattttaaaaataatattaagttacaaccaaaatattacccgcagggccaaaatgataaaaaaaagtaaaattttagagatttttggtgatgtctttttaattatagtaattttttataattttgcattcaaatggagctacaaagtgcctttataccatattaatttttctttatattatgtaacaaataaaatgttaaagcatttgtcgcaaaatgacccgtcctatgtccgccggacctgacaaattcgctccttgaacggattctcgcgcagctccggcatttgactgatctgctccatggacagtttgacctacagtatgaggaacaggaaacaattagaaaaattaaatcatttaaacatgttaaattaaagagcgattattaatgctaagatttaatcgaaaatatttattaaatcaatttaaaaaacattgtatccatctaccgtttgcgcttgtccgccttgaatatttgctggcacaatgcgcgagtccaactgatggaagcgcttgtacaggcgcagaatgtcttttcgcgtgaaaaatgtgcaatcctatgaatatcaaaaataaacatttataaaatagagctggaatccgaagcagcccaaaatgacgcaaaactcgggagtcatacacagttggaaaacaaaataaagttattttatcttagaaaaataaaaatttgtcatatttgaaaaaataaggcaaagatgcaaaaaggggtcataaattattgaaaaaaaggaaataaaaaaacacaattcatttcttcaaattccactttttcccgaccaattcgttttgacttgggaatttgatattgtgaatgataaaagtttttttttcgaaaaagattttatcattttttttcaatgaattcgactattttaatggggagacttcaaatttttgagttcatttttaaattttaaagaacaaatttgtaataggcgcccggaaaaattagctgattcgtttagctgtcacctggtattcgtccaattgttgggggctgaacggtgcgcggcccttccataattgaagctcgccaattttgcttttggtattccccattaccataaaaagtatttgtgaaaatcaattttttaaactgataaatttagaaaaatttaaaaaactttttttataatttcaaaaaataaacttttttcttttttgtaaatttgcattcaaaaggcgcccaattactaaacccaatttaattggacatcacttagtaagacaaatggacaataggccttgcgttaatgtgaaattgaagtgatcagtgagtggtccattaggacgaaaacactcggaagaattatttattgatcagtgatcgcacaagcgaaacaactgacaaatgggaagaggattaaggatcctttaaaaaatatttttaaagacaaaacatgcaattagttagttaaatcaaaaattattttttaaataattatgtctaaccatactttactaattttttatttaatttaaatttttaantttatttttaaatttatttgtactgccgaa

SEQ ID NO: 4479 - DNA, 1026 bp, Heterodera glycines
taaacatcagttctcaaaagaagtttgaaaaaggctgcctagaccagtaggtgttatgaagttactcaaaaattttcatcttttttgagttcctctggccataacttttttgaaagttaactaaattttttgaaattttgcaggcttgtcgagaatatttacatagggtttatcaattaagcaacgtctggtttcttagtaacgatgaagcatcaaccagtaactttatctcatgattgaccggcacccttttttcaaaaacaacactggaaaatttagtgtaggaaaataggctgtccaaaatgtcttaaaccagcacacacctagacacagaataatccaggccaatctttatccagcggggttcacatgctgttttttatatttcaacaaactttgttcatgttctaaaagaattcgaaccttgaaaatttaaaaaattaccaataagtaatctaaactgagataactgtttaaaattcaaataacaattaatcaccatggttctattgagtttcgtttaatttttgtgtattagataaattttgaacaataaaataggagttactgcaaaaaaaaactcacaaataaattaataacaaaaatagaaaggcaaaaattttaaaagcaaaaaaatgtttgaaaaaattaattattgcttagaaacatctaaaatatatccaattaataataatgatgatttttaaatttatttaatcttttttttatcgaaaacttgaaaaaacaccggtcacttgaaataataaattctaaaattttgtccgggaaaatacaggggttttcgtgttttgccttgaagaaactggcgaaaataattgactcaataaggcaaacatttattttccttcccctttagaaattgtggataaatttttgtcgtaaatattcacaaaacaatattttattttactgtaatcttgttccaaggtaagtgaaatgcaataaataacgcttggagataaaagaaactggcgaaaataattgactcaattaactgtcgtgaaa

SEQ ID NO: 4480 - DNA, 4160 bp, Heterodera glycines
  misc_feature (16)..(16): n is a, c, g, or t
agcaaacataaatttntcggacattgggaaaaattccaaaaagccaaaatatatggcaaaatcaaaaatattaaaaacataagcaacagatgcggttcaatcatttgaaaatataaattaatatattaggcaaacatttattttccttcccccttagaaatggttgattaatttttgtcgtaaattttcacaaaacaatattttattttactgtaatctttttccaaggtaagtgaaatgcaataaataacgcttggagataaaagaaactggcgaaaataattgactcaattaactgtcgtgaaacagttagggaaaaaacttgccaagaaaaggcgaaaatatttccaacggctcatgtgcggttccaacaagtgaacaacaaaacatgaaataaaagattctaaaaattacttgacttcctttttcgaaattgtcattaattttttgatgtaaatattcattaaacaaactttgtttttattgacaatttttttcgataaggccttgagcttaaacaaataatgcatatgcgtagagataaaagaaatcagtgaaaaaaattgtcacacaaatctgccgtgaaacattacaagaattctggagcagtgcttcgtgtttatgcgtcacactctgctttgattggccatatctcgcctgagagtggcgataggcccttagttgatacgtctgaatatgaagagcgcgccgagctctttcgaacctgcaaaactccatatttttatggccagcatagtaaaataagcactgaatgaaacgggcaatataaattgagatgaatggagttttcaaatttaaaaaccttctgcattttctgggaaaatagttgagaattttttattcgagatttatcacaatactaaggggcgggcgaagcgaattcatttgttgagaaagtattatttttgctgaggaaccttctattaaggggcagaattgaaggcgcaaccagtgctatactacatgtatagtgcaaagaaaaatattgttaaatcagctgcagaaaactattttcattagaggggatgaatggctaaatgactttcatgatgaaaagaagaaaaatacaaaaataaccaaatcattacttatcatgtaaaagcaaacataaattttcggacattggaaaaattccaaaaagccaaaatatatggcaaaatcaaaaaatattaaaaacataagcaacagatgcggttcaatcatttgaaaatataaattaatatattaggcaaacatttattttccttcccctttagaaattgtcgataaatttttgtcgtaaatattcacaaaacaatattttattttactgtaatcttgttccaaggtaagtgaaatgcaataaataacgcttggagataaaagaaactggcgaaaataattgactcaattaactgtcgtgaaaaagttcgggaaaaaacttgccaagaaaaggcgaaaatatttccaacggctcatgtgcggttcaacaagtgagcaacaaaacatgaaataaaagattctaaaaattacttgacttcctttttcgaaattgtcattaattttttgatgtaaatattcattaaacaaactttgtttttattgacaatttttttcgataaggccttgagcttaaacaaataatgcatatgcgtagagataaaagaaatcagtgaaaaaaattatcacaaaaatctgccgtgatacattacaagaattctggagcagtgcttcgtgtttatgcgtcacactctgctttgattggccatatctcgcctgagagtggcgataggcccttagttgatacgtgtgaatatgaagagcgcgccgagctctttcggacctgcaaaactccatatttttatggccagcatagtaaaataagcactgaatgaaacgggcaatataaattgagatgaatggagttttcaaatttaaaaaccttctgcattttctgggaaaatagttgagaattttttattcgagatttatcacaatactaaggggtgggcgcagcgaattcatttgtttagaaattattattttttgctgaggaaccttctattaaggggcagaattgaaggcgcaaccagtgctatactacatgtatagtgcaaagaaaaatattgttaaatcagctgcagaaaactattttcattagaggggatgaatggctaaatgactttcatgatgaaaagaagaaaaatacaaaaataaccaaatcattacttatcatgtaaaagcaaacataaattttcggacattggaaaaattccaaaaagccaaaatatatggcaaaatcaaaaaatattaaaaacataagcaacagatgcggttcaatcatttgaaaatataaattaatatattaggcaaacatttattttccttcccctttagaaattgtcgataaatttttgtcgtaaatattcacaaaacaatattttattttactgtaatcttgttccaaggtaagtgaaatgcaataaataacgcttggagataaaagaaactggcgaaaataattgactcaattaactgtcgtgaaacagttcgggaaaaaacttgccaagaaaaggcgaaaatatttccaacggctcttgtgcggttcaacaagtgagcaacaaaacatgaaataaaagattctaaaaattacttgacttcctttttcgaaattgtcaaattttttgatgtaaatattcattaaacaaactttgtttttattgacaatttttttcgataaggccttgagcttaaacaaataatgcatatgcgtagagataaaagaaatcagtgaaaaaaattatcacaaaaatctgccgtgatacattacaagaattctggagcagtgcttcgtgtttatgcgtcacactctgctttgattggccatatctcgcctgagagtggcgataggcccttagttgatacgtgtgaatatgaagagcgcgccgagctctttcggacctgcaaaactccatatttttatggccagcatagtaaaataagcactgaatgaaacgggcaatataaattgagatgaatggagttttcaaatttaaaaaccttctgcattttctgggaaaatagttgagaattttttattcgagatttatcacaatactaaggggtgggcgaagcgaattcatttgttgagaaagtattattttttgcggaggaaccttctattaaggggcagaattgaaggcgcaaccagtgctatactacatgtatagtgcaaagaaaaatattgttaaatcagctgcagaaaactattttcatttagaggggatgaatggctaaatgactttcatgatgaaaagaagaaaaatacaaaaataaccaaatcattacttatcatgtaaaagcaaacataaattttcggacattggaaaaattccaaaaatcaaaaatatatggcaaaatcaaaaaatattaaaaacataagcaacagatgcggttcaatcatttgaaaatataaattaatatattaggcaaacatttattttccttcccctttagaaattgtcgataaatttttgtcgtaaatattcacaaaacaatattttattttactgtaatcttgttccaaggtaagtgaaatgcaataaataacgcttggagataaaagaaactggcgaaaataattgactcaattaactgtcgtgaaacagttcgggaaaaaacttgccaagaaaaggcgaaaatatttccaacggctcatgtgcggttccaacaagtgagcaacaaaacatgaaataaaagattctaaaaattacttgacttcctttttcgaaattgtcattaattttttgatgtaaatattcattaaacaaactttgtttttattgacaatttttttcgataaggccttgagcttaaacaaataatgcatatgcgtagagataaaagaaatcagtgaaaaaaatgatcacaaaaatctgccgtgaaacattacaagaattctggagcagtgcttcgtgattatgcgtcacactctgctttgattggccatatctcgcctgagagtggcgataggcccttagttgatacgtctgaatatgaagagcgcgccgagctctttcgaacctgaaggactccatatttttatggccagcatagtaaaccctggtgggagaaacgggcaatataaattgagatgaatg

SEQ ID NO: 4481 - DNA, 7460 bp, Heterodera glycines
  misc_feature (7426)..(7426): n is a, c, g, or t
  misc_feature (7444)..(7445): n is a, c, g, or t
  misc_feature (7454)..(7454): n is a, c, g, or t
aaaaagaggggtggggacggagccgtcccatggcattccgtgcgctgtccttttcggggcgctcgctcatcagtcacattttgggtgtcgatcgggttcagcggttcgcctccgccgagtgggacgaagggaccggaagggaaagaaaggaacagcgaatgttgcgctttttgatcagtggaaaaatgggactgatcagagaagcggggacggagccgatcatgcaaacagatgctgatcagttgagcggagagagagagagagagagagaaagaaagagagggagagagagggggggggcggagagagagagagagagagagagagagcgacgaggaaagagagagagagagagaaagaaagagagagagaggagaaagagagagagagagaagagagagagagaggggggggcggagagagagagagagagagagaggagaggagagaggggaatagagaggagagagtagaaagagagagagaggagggcggagagagagagagaaagagaaagaaagagagagggggcgaagagagagagggagggggcggagagagagagaaagagagagagagaggggaatagagagagaaagagagaggagagagagcgacaaggagagaggagagagagagagagagggagaaagaaagagagggagagagaggggggcggagagagagagagagcgacgaggaaagagagagagagaaagaaagagagagagagagaggagagagagagagagagagggagaaagaaagatagagagagagagaaagaaagagagggggggggcgaagagagagagagagagagggagggggtggagagagagagaaagagagagagagaggggggagagagagaggagagagagtttttgctggaaatgagcaattttagcgatttatcccccaattaacgcgataatgaagaaaatttgttgataaaccggcgaacggacgacggaacaaagcgagtcaagaaaagctaagcgacggacatttgacaaaaaacacgccgaattaattgcctccgggggaagggaaaattcgccaaaaatacaacaacaaatgcatcgattcaaatctaatcatttttaaattgactttgctcaaattgtggcaccacagcaaaataatttatgggaaaattgaggcaataattgcaaatttaaacataagttcatagaaaaatttaaaattcggtgatgctttattttaattattttctgcgtcaaattgctaactttgatcgatcggcttatttttatttcttcttttcaaaatgggaggacaattgaaggaattggccaattctttaattcggaagggaaaattacattatttccttttcaaaaaaaataattattattttccattttttgaatttaaatttaaacaaaaatcctcttggtaattggctgtttatttgccaaaatgctcatcgtttgaccttaatttactcgattactttgacccatagtcactttttggtggtctgttaattttttgtactctttcaaatgcccccccccccttttgtcaatttgtcctctcacttcccgacatattctttccgtatcgaattttgatttagtaacagaaacaaagtattaattaatcgtttattttattatgatagtgaaaaataattttggagaaaatcgcgaaaagaaacaaaagaaaatggtataaagtatgtgaacattgaaaatgatgggaaagtgctgcaggtaatggatgaatgccgagttgaccaccgctttgaactcctcaaaagggcaattggaacaattaggcaatcattgcaaatggtccattgatagggcaatgcgtttgctaattatgccacctgtacataattatacggtaacgtgcgatgttcgcccttcgcagtccctttgactggctctgttgaaaatgcttcgtcgtgccgatggagaaaactggagggaaattaattataaaacgaagaatgggatgccattgttcgcatttggcctacttgaactgacaaaacatgtccgtgtactccttgggaacgttgagcaattcgacgacagtcaaacggaaaatgaattcactgcctttggcaatgtgtggggggaactgaacgtcaaggtcagtgccggaagaatgatctgcaaagtcaaagctcaaaaaaagaaggaaaagtatgggaatggaaattaagcattgaaagccctcttctcaataaaaattggttctattttcgttttgatgctctattaaaaacccaaattattaaataattgtcaaacattatgccaatttatcaaaatttaaaaagattctgaggattttcctcaaaagcctcaaaaatcctcaaatcctcatattccaaaaaaatcctcattgacctatcaaaaagccacaaaatgaggataaatcctcagatctgggagccctggatatcatagtgattcaaatatgtttcacattgcaaaactttatcttctcaatattttactcagatccccattcttaccggtgcatatttttttgcctatgcctcgggttgagaaaaatttcgggttgagaaaaacctcgggtttcgggttggcatcactgccgcctacctacttgcaaaattaaagaaacttttagagtgccacgggaccgggaattttgggcaaacccgggaccgggacctttttgggttgaaaacccgggaatttttggctgggaaaaccgggaccttggtactcagttgtccgctaccaggtcccggtcccgtggcactctagaaaaaatacatacataggtatgtaaaatgaatgtagaaaaactttgttaactgataatatttgtttttacagttttttccactgataatatttgtttttacagttttttccacttttctgcaatacaataaacaacaaatgcaagcagtgacgcgtccacccattgttttggagcgtggagtttccgggcgtgtaaaatggttcgatttcagtaaaggtttttcacattttctcgcactttgattcaccagaacggttgtgtttcttgtccaggttatgggttcatcacgcgggatgacggaggtcaagatgtgtttctgcacgcatcatccatcgttcgcaaagtcaatatgtacttcgtgctgattgagggccagcgggtgagtcggactgattttgagtcgaccgagggattgggacacggagaatcaggggagtacaacgatccccgaattcaggtagaattcgacgtcatcgatggtgagaagggcagggaagcggccgctgtgtcggggcccggcggaattcgcgtgggcaccgccatccaatacaacaacactgcgcgcagtcagccgttgccggccaatgccaacaattccgccggacggatgttcatcgccggcagatttcggcgccccgttggcaaggttttgttcggtgttaaaatgcgcttttttggtcccctcacttttacaccaaacaaatcatttttcgggctatcaaaatggacttctaatggactcgtatgtccgtacaaatgtgtcctgccttcggctgattccccgccaaatttgttttccccatcagccgaacaacaaagccaagtcggccgtcgcttcggtccccgcggtggtcaatggcggcgacgacggtgcaaagggtccgccgctctctctgtccggcgtcactcgcaaaggccgtcgcatgttcaaagcgaatgatggcgaaaagggcaaaaacagcgacaaaaaggaaagtgccagtgacggcgttggcaaagaaaaggacaacggaggacgggagggcgaaaacgacggaaatcgtggggaaaaggaagggacgaacggggcacagaagagtggcagtagcgaggcgtgaacgacgacgacaaatgatttacgattgttttattcgaccccgagacattggcaatttccatccgtccacatattgttgatacaaatattccaataaatcaaacgaagacgcgttggactaataagatcagaacctttcataatatttctttattaaaaatgcaaatcggaaaagaatgcaatgcgacaatagaacttaaacaaggcgaaatagaaatttgtgataaatgtgcaggttctgtcaccaaaacgggcaccacccgacataacactggcacagattatcattcagcgtggcttgctcaatcagccgatcggcctgcgaattatacgcatcggtagagttatgaatgtataaccacctgttcctgcacggagatctccacacacgggttgaagtcgcgcccgcacaatttggcacggactcggctgatcgcttcgctgtccccgcgactggtgccaagccctctgtgtgggtgttggaagacatgtctgaaattgttaaagttaaatgattggcattgggtgggtcagtcatacctgtcctgcgggtttaagtgcgtcgcatcggaattgtcctcagtgggagccgctttaagtgaaaattattagagtttggaaggaaacaagtaaaaaaatcagttttttttgccagtttcaaaatatgtgtgcttcaaatgtcccatcccccacccagtgcgccggttggcatgtgatgtgttccgcccgcagcgcgtcgcgctgtcccggcctcttgtgtaagacgccagttaagcaccggatcgtagacgaacgcctccaacacggccaacacactgtcattgtggtttcgcaagaggcgaagaacgcgttcgcaggtgatacggtagttaccgtcaatcccagtcacttccattgcctggggagagaaaataatctttgaacgtaaaaagaggtagctcatgttttaggctttcacataatcaatgtcgacagtcaactatttatttttgtttatttttccacctgaacaagcatcctcgtgagtcggaacggaatcttttccggatacttttcccgtttcatcgccacttcaaaacaatcgccaaaatcaatatgcacaattttcccgctaagccgatccaacatcaaatttgatgggtgtctaaagaaactgcctttaaaaaacaaggttccccgaaaatcccaactcaaccgtacctgtcaccaagaccgagaatatagccgaccattgacatgcaagccatggaacgcgtgtaattggtacgccgatcaaaccaaatctcagaactgaatgaaactacaatatattaacataaatcagaaactcttgaattcaattatattaatatcggtactaaaaagtatagtcataagtcccctcctgcgctgaatggactggactcactttggcgatttcatccaaagcattcgtcgtaagtcgtcacccgacgtggtgcgcaatgcttcctcaaatgcttcgaccttttgcagcaaagtgcttttctcaacgtcaacagacactttttgcattttgttgtgctcctccgaaatcggaattttacgtttttcgcgatagtctctaaacaaaatggaaacaaaaaatatttgttttatcaatttaaataaaaatgacataagtagatcatgagcattgactaataaactgaaagttacttgatcagctgatgtaatgtgtcacagtgcggcacccatccgatcagtccgctgctctgactcagtgtggtgatcgaatagcgttggatggtcaaattgcgacgggacgtttccgcttcgcgcaaaattagcgaattgactaacccgaacagttgcatcacccgttctgacaccaaaggaaatataaaattaatcaacccacttttaaaggttaccgtcctggcgtggatcttcatgccctttcaacagaaagatgtactctttgccgtcgcttccgcgaatgtaaattttgcgtggccgttgtttgcttgtgatcacttgcaaatgcggatggatggaggcgatggtgacgagcggcgccgtggggtcgtaagtgcccggcacggacagttccagattctttgcggcacacagccgaggcgcaatgtaattcaggtccaacgtgctcatctggcgaagttggccgatgatccgtttgaacaccgtgtagtacaaatcccaagcaattttctaaaagcagttttcgtcgaagaactatttaaattgacaaacgcacaatttctttggggtttcggctgcgccggaatgcttcacaatgttcaaaagcatctttgagatctttgtagtaagcctaaaaataatttaatatattaatcacaaatttgagacgatttttattacaacctaaaagccgatggatcacccaatcccattttaaattccaatgtccgacctggttgaaagattgctccttaagcgttgtgtggccatgttcaattttctggtgcaacggtctcaatacgttcatcatttcctccacgtttttgtcttcaaaatataaatgagatgcgttgtccaacgcctcgtgccacagctcgtgccaaaggatggcacatcggatcagctcgtcgttgaccaagatggcctgttccaccagcaaaggccgagtctccgccacaatgtccaaaatctctttggccacctgggaacgctgtgtgtttcgagactttgtggcagcagtcagcgcgagaacccaagcctaaaggaggacgatagaacgagggaattaatgggcaaaagggatgatgttttaatgtatttcgaatcgaatgaaaatgataattttaatggggccgagtctgatcggaaagtgtctgaagagagtcgcacctgaggataaactttggccacgtcaatgaccaactgtttgacaagtaatccaatgttttgctgggagtcaagacgtccgatcagttgagggaccacttccaaccaaacttccagaggaatcagcttgaccgagtcacgcagttgttctttaaatatatatcctttttaatcaaagtcacaaaacgaagtagggaacaggggatgggagccaaagccggtccgggaatctacagggaggggtaatgagttactcccgcagaagccgccatcccaaaaaacggaattcattcattaaagttagaaattggattgcatcctaccccttgtaaggaattgctattttacagaccaaatacttccggtcgatcgccatagtcaaaccaaagcatcaaaagtcgaagggtgtcgtcaaggcgtgagcctaatttcatattaataaaaaaataatgaaaacgaaaattgttttataaccttcagcaagttgaattgttttgaagaaacagcgaacggcattcaatgcgtaaacagtgatcagttggtgacttttgagaggcgactgaattgtgctgatttgttgtgctggcattgttggaggtgcaattccctgaagaaaatagcaaatagaatgatgacattttatttattattttttattaaaattcaagcgtatcaaataataataattttttccatcgcgattcactntgtgctgttgtgtacaanntgttggcantatttg

SEQ ID NO: 4482 - DNA, 3126 bp, Heterodera glycines
  misc_feature (21)..(21): n is a, c, g, or t
  misc_feature (3083)..(3083): n is a, c, g, or t
tttatttttcatttattcttntggtgaaaatttcaattgtaaatttaaatatgagtatattgttaattacttgtcttgtgccaaccctggaattttttttatttccatcaactcggaaaacatcaatgccaatgttaaaagcatgtttaaacagtttaatgaaaccttgatacatttagggttattctgaaggttcgaaaatttacatttattttttaatgcttgtcatttacaatttttagctatttgatattggtttttagttgattcatcctttaaaccttgaatatgaaattttataataaattatttattatttatatttaaaaaatatattatttgttgtaaaaggtgagaatataatttttttatttatctatgaattatttgaactatgttcgcaccgctgtgcgtttcatctttattcgaacaataatttcattattttgctgatattatttaaattatagttaattacataaaaaaataataattatgattagggctgtgatttttaggcaaatgcctaaaatttctgcgcacttaatacgcacagataagcacgaaaaatgtattttccgcttggtttggggtgtctacgatgacttttataatgtctaactttgcctattttcaggctttttggaaaaatccacaacaaaaatgcaataaaaaaatacacccctaagaatcaactcgaaaatttttagaaaatacacacctaagaattgaaaaaaaattttcacaaaaattgatcccaaaaaattattattttttcatgataaagatttttgatttaaaaattatccttattcgagaaaaactttaaaataattgaaatataagtaaaataaagtggtttggttaagttttcacgtgttttgcaacctacaaaccgttaataaaaaattttatttgcctatttttgtgcctatttaatgcctatttagctattttttctgcctctttaggtgcctatttctcgtttttttttgcctaaaaatcgcagccctaattatgataaacagtaatttttttgagtgatcttgtcgatggacaacagctgctcatgaacatagagcttgatcaacttaatatttatattaaatatatttggacttttataagtttttatagagtttttaaattttttttgttctatttttaatattagtagtaatttttatgtaagattattgcccgcattgatgtcaaggttcaatttagatctgtagtcaacttgagttcgttgatttttcatatatttattatttggggatttgtaaatatttctatatatttttgccatttttaaaacatattttacatattaagcgactgttcttttaaatttaattttcattatataataattaaataaagcataatttgtagtgaaaatgtttagcaagtcaattaccaatttttgttaagattatttcatttgattatgaaattttaatttcaaactggtcttggcaaaaagttgtgttttttatgaatttaacaaatttgttagaataataattgggcattatttataaacaattcataaatatattcaaattcttaaattttaatttctaatatattattaatacatgaactgaacagtaatttgttaagtttcgttaatcgattaattttataaaaaatagttttcgcataaaaatttaaattcgtgttaagggcgatcgccaactcagcttccacgggctttttactccgccgaagttttcccgtcgaaattaggtttctcgtgtttctaataaaaggctaatagagttagtatacataaaatattttattttttattaaattataatcgattctacgaaagagttataatttttttatttttacgacaaatacatatttattctcttaagcaattaaattgggcgccggacttttcgacagaaatatttaaaatttgaggaggggacttttcgacagtaaagagtaattaagtttctaaattagaggtgtaaaatcgtaaaattttatcgaaaaagcaacaaaattaagccagatcagtattgagataaattatttttaaaatcaaaaattattaccaagaaaataaatagctaaattttggagattaatttttgagaaaatttttcattcttcttagaggtatatttttgaaaactttaggggccgattcttaagggtgtgttttctgaaatttttcattgtaaaaaatgtaaaaatcgtatccctagtaataatgatttagcaatacattttagtatgttaatttaaaataaatttagtaaaactgacaagcaatataattcattttaataagaattagttgtttttgtgtttctgtcgaaaagtccgggagccaattaaatttattttccaaaatttttaattattcaatatttatttcacaattcacatttttttttagtatttcttaagtttaatttacgattgttttaattttgataaaaattcaatatttcatttattttattttatttaaatttaaaaataagtcttttgcttttgcatttttataaaattttattatttttccaaattttgcagaattattttttcgattttattgttcattttttaaacttatggaaaaaattaatacaaatgccatttcctaatgtcaaatcgatggattacgtggcaaattctatatgcattaatattcaggcaatgatgacggactgtctcattccaatttcctggcaaaaaatatctttttaattttaaaaaaataaaaattattattttcttattttaaaagaatgtcaactttttcatttctgtccgtctgtttaatgttttgtgtgattttgtgctgtcaatacggttgctcaccagcatttgcccaaggatgtgtggtcggactgctcaaatgtttgaaaataataattaaattatttaaaaataaaaattgtgtcatttcgtaattatttatttaaacataaatatttttggagaggtcgttttattcttcttaatttgaaatttgtaaatgttgctgctttttctgttctgcttcaaaatttaaaattgctaaaaagaccaaaaaataaattcttagggaactntcatcaggcacatgataaagcaacatttatttgttagcgcaat

SEQ ID NO: 4483 - DNA, 4097 bp, Heterodera glycines
agtccatccaacaaatttttgagttttttgcattttttaaaattttctagttattttgataacgattattaacatttaataaatgataagaatgaatcattttatttgcaagttatacgataatcaattattgttggagtattcttactacttttagttagagtagagcgggaccgggaattttgggcaaacccgggaccgggaccttttcgggttgaaaaaccgggaatttttggctgggaaaaccgggaaaaaacccgggactggtcccggtcaaaaccgggacctcggtactcagttgtccgtgttttggtcccggtcccgctctactctacttttatgtagtgtatcaattttttagtccattgtttctcaaagtcttttaatgagttttaccaaccatgaataagcaacatttgcctaaatcctcttattctatctcaagtagcctcgctagcatactttggaatttttgaagttaataattattgttccattctcttgatttataataaaaattatcttaccagaataaataagactagatttattaacaaaataatctttcttttagatgaaaggttttatttctcgattttaattacttacttttttatcttttaatattcaatagtttatcttttaatttataatttttattttaaaataaaatatatcaatgctacttatttttattaagtcttaaaattattttaattcgaaaacatgcataataatctcaaccgtggataattaaatccataaatgtgatttttgaaaacaagtatacggattaatttgttgcatctcttttctaatttaataaatccagatctttagaaatagggattatgatatttcgacaatgttttaggtgcagttttttattttaactgtattttaaataaattaatgattactttttttaattaataaagtcttaataaatgatgttttatattaattttaatttactttcttataattaattagattaatattttaattcattaatatgaaaatgacaattgaaactttgagcatagtttatgtgaaaagttttcaaaaatttatcgtgacttcaatcccgcggaatcccgcgggattggcaaaatggtcgggagggatcccgattcgggatcccgatgaaatcccgatcccgagcaatcccgatgaatttaaaaaatcgctcgggacggatcccgaggtcggtatcccgaatttaatcccgcgggatcccgaagaaatcccgcaggatccctatcccgtccggtctctaatttaaaacctccaaaaaaaaaattcaatttctattcttttataaaatgacatgacaatttcttagttttttttttttgcttttaaattgctctttttgtggcacggtttttgaaaaaaactttttgggaacattggggggagggggagcggcagtgccgataggcgctgccggaaaaaaaatttgcaattttgagtgcgatttgttaacaaattttgtcaaaaaatgattttgactgagggttttttgaaaaaaaatgtttaagatttgaagaaaaagaacattttgccaaatatacctaatttttcaaaaaatcatgcgtttttgtcacttttttatcaaaagaccacaaaaatcctcaaatttctcaaaaggtgttgtgactggggagagtagtccactcggcttggaatattttttttaattaaaataaatgaaataaaatttaattttttctcaaaaatttctccttcatcaccaatttcctattcttttctcgaccagaccctcattcttaccagtgcaaatttttaccggcggtaccggtactagacaaaccggtaccggtactttgatttttgaaaaaaccggtaccggtaccggtaccaaaaaaccggtaattacctgccagtaccggtaccggtaccgtgcaactctagctgcaattgcgcaccattcattctcttcattcacttacacaataattctttccttcaataattaatttttggattttgaatgagtatgttggggattttaccaaaatgttatttttagagttttattcgaaaaaatgccttttgacataaaatcttatctctaaaaaaatatattaacaaataaattatacgtaaaaaactttacgacgaataacaataaataaattaacagaggcaactcaacttgtaccataattatcttcttaattaatgaataataaactattcgatgtaaaaatttagcgagaaataaaaatttatttgaattcatattattgaatatggtatatatttctaaatcaaaaagtaatattcacagaagctgttgaggcaaaaaatcataaaaaataacacaattataattcgcatattatcaaactttgatgaaaatcattttataaacgtgaaaaccataaatctgatataggtataaaataaaaccattaaaatatcatgattattttcaaatacatatttttaatcaaggtaatattaaatcacttcacaatgaatttttcacctcatgaaatattactcaaataaatgttaataatttacaaaatattttttaaacaaaaaataaatataaacttaaataacaatattctgccagcaatcgaaaaatgttatgaattcattggtctaatttaataaaaaaaatccgattaaaaatttgacatcaaaaaaaatctgttcaaaatatgcgggagcatctattaaaagataaagaaaaaattgaattaaattaattatatagacaatataatagaattcttatccaaaatcgtcaaaaagatggacatgcttagattatgggagaaggatacagccgttttggttgatctaattgataaatttaaaaaaatttaaaaagaaatcattcagaaaggaaaaatatttatttaaaaatttttagacataaaaataaatgagtatgaaataaataattgaattttagactaaaaaacctccttaaaatcaatagatttttttaaggcttatgtggcgttatataagaaacatcaccatcaattaaactgaaaaatttagtgatctggatcaatttatgaaatcagcgtcaaacgtaacagatactataatttttttatttctcggcgtaaagctgactgatatccagcatttatgtttaccttctttaatttttaataagttcattttcatttttattgatgacattttttcgtaagttatgctgatttttccttgcataaattccatcaatatgattttttattttgaaatattgatttcaaaaaatttctttatcgtcaaatcagcttttcttgagatattaaaaattcctttgttgtttttaaactgggtttatttttcgtttggtttgatttatttcttcctcattgtcgcatatctttcgtttatttcatccgctatttaaaatttaattgttttgttctttctttaaatattccttaaaaaaatgaacgtagaataactaaaaaattaaagttaaataatttattgataacacaaccttacaaattagggggttcttttttatttctccttggaatttgatatataatgacattgaccttaaaatatttttaaaatttctttgccagtttttatattatttacactaaaaaaccaaatatgcgcataaaaagccttaaaaactgccaaaatggctttaagccttcaaaaatgccaaaaattgtataaactttcaaaattgacttaaaagcaccaaaacaatggctaaggagctttttttgataattaaaaaaaaatttaacaaattttttttcaaaaagtttaaaaattttgattttaagggtgtattttttaaaatcccaaaaagtctatccttaggggatgtatttttcgtttttattgcatttttcttatgaaaatttgccaaaaataaacagaaatatgctctaaaacgcaaaaatgtcaaatatgcatttattctcgaaaagctccaaaaataagcttttatatgcactaaaaaccttcagcaaaacaaaaaaattttaacgtagaaattctatttttgtgccctttcttcgtaatagcatatgcgcataaaaatatgcaaaagcatataatttata

SEQ ID NO: 4484 - DNA, 4793 bp, Heterodera glycines
  misc_feature (105)..(105): n is a, c, g, or t
  misc_feature (4763)..(4763): n is a, c, g, or t
aaataaaatttaattggtttgaatcaaggtaaaaaataagcaagtgattgaaaaaaaaatcagggacgtgtccaacagcgctcaaatgcccaaactaagctttanccaggctcttagcgccagttcagatttagttgtaggacccgtattacatttgtggaggattatggacttttttaaaataaaaaattaacaattttgtttttaattattgttcatcaagaatcaatgtgttttcacaaggttcatttaaaatggcaatgaccaatgacggggaggctaattaacgaaaaagcattcaattagtaatttatttttgtctttaaggagcgccgggctccagcaaatcaaaatttgcgcaaaatatcgccaaaaaatatgatggattcgtgttcatcagcatgggcgaactgttgcgcagaaaagtgcagcaaaatggggagaatgaattgtgggcaaaaattggcaaaaagatggacgccggagaaatgattcccatggtgggcgaagtccaaccttttttttaataaatatttattcaaatatgttattaaaaattttatttattatactactcgtataaaatatggtgcgtttaatctgcaaaatttcattaaatttcaaaaagttatgactaatgaaattcaaaaaattttggttttcaagtttggttgctttagcgtaaaattataagcaaaattttgtagtttttttaaataacggcatagcacctaaaaatacgccttaaatggttgcaaaacaataaattttctattttttttaaatcatcatattttaaggaaaacctcattttatttcgtaaagaaatttttcaaataccttttttaatctggcatattaaaaccaaaaaatgcactcactaatttactaattaatgccataatttgtaaattcactcactaatttattaattaatgccatcattagtgtgttttcgcctttgtcagagaatatgccgtgaattgatttacgcgtctgtccatgaacgctgtcccaacagttggggcttcgtcgtggagggctttccgcgcacgttggcccaggccgaggacatcgaggcacagctgggccacattgacttggcactgctcatcgactgcacggaacagttctgcaaggacgcgttgcgaaagcgttacacgcgggacaaggaggagggagcggagagggcgggtaattggggaaaaaaggggaaaagccaaaagactaatagccctaattgacgaacaattagccaattaacagcggataatgaagaaaaaaggggaaagccaaaagactaatagccctaattgacaaacaatagccaattaacaaacgaccgattattggagtataaaacccctaattgtgcaaccaattagcaatttgaaatgttgctcaaattaacatccagggaacgcccttctgatcaaatgccatttgcgcctatgtccacatcggttaaaaaaatgttttttttttcaaaagtagctaacctaaattaaaatattgttttacaaatttaaaatatttgaattaataattattttaaaaattctataagaatgcgagtatcgaatgttatcttttcatataacttaatgctttttaactaggattgaaaagaaattggaaccgattttggacatgaacttaaagcttatggtcctcccaaataatgcgataatgaatcgaaactctgccttagattaattttggaattaaattcggtcattgaatgtgaatcaaaaatgaaaaaaaagagacggggtggacaatcaagagtaattagtgaaagaatccaaccccaaaatttgaccgttttatttcttctaatagtcaatttgaaggatttctagtccaataaattttgaaatttttgaattttattatgttgtaataagcatgtttatttatttttcttgactcttaagatgatgacgagggcgtggtccgaattcgcatggcccagttcaaggcaaacactctgccgatgctcaaacatttggacgaccagggcaaactacgcgtggtacgcttggaaagagcggcacacattggggcggtgtctgaaatggcaccgatgggaaaggtcggtggtctgcggcccagcaaattagccaattaaaaacagcaatttttaattgtttttctttttggaaatcaaattacataaagttgaatttaaacgaaaaaaggactcttaaaattaaactctttttgataaattgtcaaaaattgccatttttagaaatattttatgattggcatacggcagtgccagaaagtgccgttggaagatttttgggtttttgacgaattccccagaagaattacgcataaatatcgccgtattaaattaaacaaattattttacgattaccaataatggccgcagatcaaaaactgaacttcaaattgtgtggtttgtgaaatgttcgcactcaaaaagaatgcacgagaaaattttctgttcaattacgacctgaaaacctttggttttggtaattatttgttcgactttaaaaacaaattataatgggattaaaaaccggagattccgggagtcttccatttattgttagttcattttgatttgacttgcaaattagtagttcattctttgtccctctccataattttatgtttatttaattttaaaaaataatgcccttttggacattgcgttcaacatacaattatggtcatatgtttagcataatttgcgcctttttgggtttttgattgacaaaaaaattttgagattttgggctaatttttttaagaaaagataggttttggtgggggccggcggtgccgataggcgccgcagtgggaaaattttaagaatttttaatgaattttgttaaaaaatggccaactgatttttcataaaagtcggtcggtggggcaattgaactttagaagaaggaaaaaataatggaagggataaccactgggccaccgacgctcacattggattaacattctttgtaaaggatattatatatcaaaaaggaaaagcttcatatctcggccagaagcttcatttagcaaaaataaaaaaattttataatacaaagggggggggggggggaggggtaaatctacctaccctgtaagtttcattcggaagtcccaccgtcacttgggtacctctcctttgtgaggatcgacctttttggaaattaaaaatatacccttgaaaatcgaaaaattttgatttttttgtaagaacttttggaaaaaaattgttgatataagaaaaatgtaattttgttttgcatatgataaaaattttaaaaattcgaaatttcgtatataaatttagaaaataaaaacgctccttagccatttttttttgatgttttaaaagtcagttttgtattttcacacaattttggcattttttgagggttataagccattttggctaatttttatggcatattttagtgcatatttgggcatttttcgagtttttagggcatatttggggtattttagtgcatattttattcgcttatttggcattttttagtgcatacaacttataaccatagttataagtgattgacacaaactccaattttgttttgatgtttttgtagcattttttgtgggttttcaaatggtaccattagttggacaaaaaatattttgccaaatgagtggacaaaagacccaaaaaaaatatatatatattttctaaatcccagcacaacttttacacatgaattggttttaatgtttgaaaagatctcacataacctgcacaattcacatttaaaggcaccaacttacatttttttccatgttttgtttattctaatttggtataattaaatattagagatttatttaattagatcgaaggcgacaccaatgaagaggccgtgttcattaacatgtgccagataattgagaacaccatattcatacaaggtggtgaattgaatgaatttattcttattcattttctgagtcgcctccggggtaaaattgtaatttttgtttgaatttgttaagaaaattgatgtaaaaaaatgaaatccattatttctttatttttttatatagaaaaaaaattttttcaaattccttaagagtctaataaacaaatattttacaacaaaatgaatttctctcaacaaactatttaaataaagaatggaatttttcttaaaagctcttcgaaatttttaaaaatttaaatttttacgtatgtttaaaaatttgtgggacttaatgtatactcaaatttgagcaattagttaattgtttcccctctttagatgatgggaacggcaaaagtttggagtcgagcaaacaaaattcggcggatcttttgccgtcgaccagtgaagctcaaaaggcgaaggaataataaagcaataacatttaaagcaattaattaattactcatcaaaaaatgaatcatcacacattcttaatgaatttttatttctaaaatatattttgcacgatggaaaaacatggaataaaagtcaatcatatgtattgcgctcgaagcgcataaaaggtttcgcccacttttggcattcgcgggttcaaacgatggatgctttaagaaaaaaaaacaaattaaaattttgccgaaatttcctatttttatattcccatgtttaatgtagaatttaaatgaaggagcccagcgaggtcaccttcggagaattgggatgaaaaatatattttccaaatttttactaaattataagaagcctaattttttgaccagngctgtgtttttgaaaaagctcaaattttta

SEQ ID NO: 4485 - DNA, 4503 bp, Heterodera glycines
ttgagtttccatttaatttatttaaattttcatttaaatgataaaaagaatttttatttaaaaataaaatatttttatttcaataattaattagaaaatatgcaaatgtatgtcggtgtcagtctcctttaagcaattttcaaattggcttttatggcaaaatgctaatttcaggcgtcctcctaaaaatatttgcacaacaaattgctgcaaaacaaaaacgttaactgtttgcgacagctcacttaattaggtatctctgtaaaatatatttatttgcgctttaaaaatgataaattcatatatgtatttataaaaattattattttttttttaattttacaaattttttattaaacaaatgcaaaggcttttcaaaattaattcggttttattagagtttcattgtcacgaataatttttttcaagaggaaaagctcgcattaaattaatgtatgctaattggcatgataatttacatttgtggcaaaatctcatggcaaaacgtataaatgtaaaggtacaaattattttacaacttaaactttcaaatttatttatatttttctaaattatttagaaaattttcttttgaaaatatgaacctttttgtatggtctttaaaaaaatgagaagaacatttttagaaaaagttttttttaatgaaaaattacgaagcgttggcatttaactgaactttactttaacattgtcatttagtctatcaattaatttaacaaaaatgccgccttccattctggatacgtccctgcttccaagcaaatataaaatgcatctgtgcgccgaaattgaataaatttcaattttaattaattgaatttatttttttgctttaaagaaagttgaatgaacaaaaaacatggataaaaatgccgatataataaattaaataagaaaatattgtgtaaaacttaacctcaatggaatgaatattcaatggaaattcatttaattaatttgaacatttaattggcttcaattttatggactaattaaagtcaattaaaacgtttaattactttcggaggatgaattattttttttttgaattataattgaagtaaattggtcaaacaaaaatttgtacccacccaaaagggccgccatcatttaaataatgaaataagaaaggcattcaattaattattcacgtaaagacaatgttaatgttaattactcagctaattgtttccgaattttaaagtttatgcattttatgcttaagaatatgaaatattttagctcatttaacgtgtcgaaaaatttttaataatgaattgtcaacacaatggggaaagcttacttgaaaaaagaatcaagaaaaatttttggcactttcattttgtcaaattcttaatcaatttttttttctttaaaatttaggttaatatccttttcagcagttaaaattgtttttatcgtgtcgataatgactttgattccttgaattatttgtcgcactgcacgtcatactcttaaatgacttttgaaaaatttgaaatgctttctgggatgtattaattcttctgatcagatgttcaaaatttgcctggctgactttgccttcctcttgggcaaatgtgaatcccagaatgaagcggattgtggcagaaagtgggataaaggaaatgggagaacagcagtgaacgcctgtagctcagtcgttttcagcattctacgatattgaaatgccgtaggttcaatgcccaccgggcgagttaaattttatatttcttttaaattttattgcaaaaaacattttttgttgattttttattaaattttcaattgtagaccaaatgctgtctttgaaaattttcagttgggagcactgataatggtaaacctcgctaattgcttttgttaaaaaggctgaaatatttactcacattaattgccacaaaaaatgcatttatatattttattttatttttgctttgctgcaaattaaatctatataaaaaataataattaaatatctaaacaaattgacttatacaaagtcactaattattatacccatcattttcataggtttcactcatcgacaattaaggatcagatccagaacattggacccatcatcggatatctgtcgccgtcattatgcaaaaagtcacgcggatcttctaaatttttatttgtttaattttaccttggaattagcagctaattaattcattagctaatcttttgatataattgttctcccctattaaccattttgttgacgttcggctggcatattcattatgacataacgacatattgggcatgaattattcccaccttgaagccttaaataaataagaaacattcgttcgtttgagtcgtcaaaatttaattatatgaaaataatctaattgagttttcaaaaaataccaagtgcttaggcaatcttcatgaaaaatatgctaaaaaatgaaattttaaattttttaaaattctaaattggcttaacattgcatgctggcaaaggcttcacacttgtgccactcggaattggatcaagacaaattgcacaatcgaattcagtgccaacaattgttgacggaatttcgttgaaagcatttaataagcctaaaaaatgttttaaaatgactaattgcccattcttaaaaggaattttaagcctataaaagtgtatctgtccattattattgacattattattattttgcaattactcaaaattatacgtcaaattaattatttaaaattcatataaattattttcgtacttattccattaattgtttgctgcgtttgatgaatcgccgccattggcgcccgattaaaaaattggttgattcgcgcatggaaaaatataaatccgagagtaattacaaaaaccgtgaccaaaagtgccagtaaaattactaaagccacatttaaaagtgaaaatgctcttctgtgacgtcgaaatgagcctaaaatacgttaaattgcttcatcctgaaatattctcaaaagaaatgaaaaagaaattcggcacggaataaaaataaaaaaagaaaattttttaaatcgaaaaatcaaaaatcgaaacaaaaaattgttatgagtacaaatttctgtatataaattggtttggattaaatgggatttgaatgtttttatggattaactctcatggaatattcaaaattaattattataaaaatagaaattctaaattaatttattgcacgttttcgtctctttgccgtgccatcctcgcaaatttcaattgtttttgccacaaattgcaaaaattgctttgtccgctttttctcgttaaattttttgtcattttcatggtatttcgtgcaattatgccagcatttattgtcattttgactgcatatcttgacctaaattaattttaaaaaagcaattatttatttaaatcaataaaaaataaacaataaaaaaaccttttccaaaaaatgactcatctctcgcaacagataaatttgaccattttctgaccaaaaatcgaagttacttcgttcgtcgaattggatttggagacgttttgcaacaaaattaattacaaattttaagcgctgtttcaaaatttttatcccaaatccatcaattttatctgaatttaaaaaaaattcttattttatattattataagattgactacaattttacctttttctattccatttatcacgctcattacagaaataattagtttgtttaacagttggctcaacggtgggtcattgtgataaattgataggatacggtatttgatcaaattgtattcgtgattatttgcaaaatattcaattgaatgggaagaattctttaataaaaaaatttcaatcattttttaaataattatttttactttgattggttcatttgctgagatctttttcaggatcaaatgaagtttattcatttcacagacaatgttcaccagtttcgcatctttttcgacattgttttgtccatctttttgtttataaaatttaatttgaattgaaaatggcggtattaataagtatgatcaaattaaatactgatcacttctgatcaaatatcataaaatcacctttatacgttcgttttatgctttcataaaccgaattggcaaatccttttttgtcgattgattggctttgctcattattattattgcattttaatgagacaatttctgttgattttgcataacaaagtgatgaaaatgtaagcaaagtaaggagcattaaaatgcaattattaaatgttttgttattaatattttataaaaaaaataatattttgatttaattaaattcgtatttatataatgtaaaattttgttggctttcatgtatttccgtctgaattctttgaaaaaatgaatattataaaatttttgcacattttattcacattttttaacaaatgatgaaataagaaaataaattacaaaaaatttgatgctgtcaaattaaaaaaggaattaattagtaaattaattcttttcatagaaattta

SEQ ID NO: 4486 - DNA, 2411 bp, Heterodera glycines
  misc_feature (20)..(20): n is a, c, g, or t
aaaaaagtttgtatcacccntaatgactaaaatagagaaaccgatggggtgtgcatttattttggggggattcggggaataaatccatttttacgttatccatttttttcaaattttaatcctttcaaatttttcttttattaaaaaatgtttttatcattgaattggttctgcggtttgaaaaggccatgcattgaatttgaatcccccgaggcgaataattttaaaattgattaataataataatgatatttaatttttcaaaattcagcgaattttagaaatacctagattaactgtgattattagaaaaaaaacgtacaattgcaaaatttctaattggggatggaaaattcactttggaggccagtcacattatccatccatcgatttggcctctcaattgttggatttggccacaattcgcctttcccgcccaattttggcattgcatggccattcattcatccacgacatggcactaatctgcctcactatagcgatcacattatcatccatcgattttgccacagccccacattttaatttggccacaaattcgcctttccccgcccaattttggcattgcatggccattcattcatcgacggcatggcactaacctgcttcattatccatccatcgatttgccacgccccacattgtttggtttggcttcaaattcggcgccccccccccctccaaaattaggcatttaagcccagtttgcccctactaaaatcaaactttgccaatttgttcgatttggcatggcttctctccctgtgcttcttctctgcttctgcccccgcttttcaatctctataaaaaaattgcataaataaaccaacctgctctcttccctcggcagagcattcaattttttagaaaatctaataacaaaatttgggatttgaaaaagctaaaaaaactccatccccctaactcaacaaaatcctcagcctccatattttgtttccaaaagggtagggggggggtaagaattttttttacaaaatttttctctcttaaaaatgacaaaaatccggttctattgcagtttagactagagttgagcggtaatcggtaattgcaaaaaaaccggtaccggtactgaccggtactgcaaaaaccggtaccggtaccggtatcaactttttccaccggtaccggtaccggtaccaactttttccaccggtaccggtaccggtaaaaaccggtaattttagaacataaaaatttttggacaaaattttccaaatacaaaatttttattcagttttcgcgcgagtacctgttttttagcattagaattgttcagaagtatatgtatattcaggttgaccaagttttttttttcaaattcaggacatagaacactaaaattcagatatagacctcaaaattcagattattgcaaaacaagggatcagcggccaattttccaattttgcgaaggggtctccggccatgtaaattattctatccaagtggggaattgaacccaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccggtaccggtaccggtaccggtaccaaaaaaaccggtaattaccggccagtaccggtaccggtaccggtaccgctcaaccctatgtacataggacataggcgtatagatggtaaatattttttgtttgttttttaaataattaataaacaataaaattcactatgacataacaatagttcgccaatcggtacaaattagccgataaaacttttttttgttataccttatgatactgatgagagacaaatatttcgagtctcgaggcacaattaatcatgagccaggatcccactctcgcggatggaaggaggtgattctcggttgttatctcgggggaggggggtggaggtttcggtattaagccattaagaaaattattattttttaaagcttactagacattattaaacaaataaaatttacataactcttattcttttatccttcaaatcaaaaacatcaaatttgcaaatgtaaaattaatttattgtaattaaaattatatgatcaaaattctggtcgaaggtctattcacttcatatgacctgacctgctccgaacagatgctgagctcctgcgttttcgagcatttgaccgcatttgaagaagaaagttgatttctagtaattctcttagaaagctgtgcaatttcatttgctattccattaatgactccg

SEQ ID NO: 4487 - DNA, 2256 bp, Heterodera glycines
tttaatttattatgcttttgcaagattcgttttatcttttttgggacattaatgaaacattttcactcaaatgaattttggcgaatatccaagcaaaaaagcgtggcgcaatttgcttctgatcagttggagctgcgcgatcagcggcacatttgttggctacgccacttccagcattaatggtgccattctgttcatcgcgcgcgacatgcaattggagttggtcggcatcggcttgctgacctcgtgctttgaagttgaaagcacaaaatgagaaaaaataatagaattaaatttacacttaaatacattactcatttcaatgcaatttaaaattttattttttttgataacaaatattttttaataaattaatttaaaacaatcttctcatttttttaaaatacatttttttgaaccttttcttatcaaagaaacaaagaattatttccattttttaaaatttttgcattaattttcattttcttttttttgcaggaaggactattttcgcattattatttttgacattattcagtttgtttttaatttctttcaggttggtgctggcactggcagcattttaagcggaatcattgcggacaaattcggacgaaagcccactctgctcattgccgatctgttctacatcattaccatctccgccactgcgatggcaccagatttcatcgtacaaaaaaatttttttaaaatttaatttgctttcgtttacaattttttgtgcaccttttgattgtattcaggaaggacacccacgtggttgggtagggggggccccagaatttttttatcacttccataaaaaatattcatgaaaaaaattccttatgataagaaatcacatacaaaaaaaggtaaaaaaaaatttctcagcggagaagaattactgataaaaaataaaacacaaaataattatcattttttaatttaaaaacttttaatggttcatcaaaaaacacaaaaaacaactataatttttaatttgcaaaattcattggtttcatcccaggggcgtaaattttacaatttttgattattttttttattttgttaattttgattgtttggcttagtctctggttctgtgccgtacgatgctcggcttcgcctccggcgcgatcaatgtaattgcccccgttctgctggccgagttctgtacggccaacacgcgggcacgcgcactgaccggcaatcagctgctgaacacatcaggcgaggcactggtgttcatcgtgggcgcactgcttggcaatctgtggtttgacaagtgagcaatgcgagcgaagaaattttattccttgaaaatcaaacgataactaaaattctccattaaactgctaaatttctaaaaaaagaatctatggccaaaactgtttaaaaaccaggttttttcagactataacacttatttacttttgagcaaattagcggataattatttgtaaaaaatttgttttgataatttttgatgagtacgacatagaccgacgcgacctcgagaatccatgtcgagaccaatatccaaaagcccgagacttttccaaaaacacgagccttttctggaaaaaacccaagaccaaaaaaaaaaccccagaattttctcgggtcaagactcgagaccgagactctcgagaatcatttatcagtttggatcactcgttcatttgcagttcctccatttggcgttggatttattggctggcagtgccacccgccattttgttgctcattttgcatgcatccgttgtgcccgaaagtccgcgatggctggccaaaatgggtaaaatggaacggtcgatggaaatattgcgcaaaattcggcggacaaatgccgagattggcaccgaaatgtggtcagttttggtgatgaaaaatgaaatattttaatgaaacggggacaaaaatttgaccaaaaatacaaaatttaatattaaaattagaggccgggtccggtaccgggttttcccgggcccggcaacccggtccggcgatttttggaaaaatccgggttgaccggtttaaccgggtgaccgggttttgagaggccgggcccggaacccggttacttctaccagcccggcccggcatttttggaaatctcggtctctaattaaaattatgaaacatttaagggatttcatgttttaaaataaaaatatcacaaatttttattatttaaccttttatcgtttcttttaaaaaaattaattaaatacttcttttagtgaaattaaa

SEQ ID NO: 4488 - DNA, 3831 bp, Heterodera glycines
  misc_feature (54)..(54): n is a, c, g, or t
  misc_feature (184)..(184): n is a, c, g, or t
aaaaatgcactcttaaagaaatgaaaaattttgtctccaaaaattttttgtgtntaattactagggatggattttctaagttttacttatttttttctgcggctttaactcaacgagaaatacacgaaaaacacattttttgtctgaaaattttgcattttcacgcccttattcgaccttaganatccttatttttgatgttcgcccttaaaaatccttattttggatgtttgcccttaaaataattttttacccttagtactactgtacttgttgtcttactgacagtatgaccggcttacaaaaagtgccacattgttgcactttccctttgatcaactggcatagggcccaaagaatgagtaaattgggtgactgacgttacaaaagtgcatttcaagcccaattccttggccctaatatggcacggcatacctctttccattttaagacacgtggcagcaaaagtttgtgcagcagccgacaggacgagagcgcattcggtgcggcattttcggcagggatgagaggcacaatttcgaacaaaagttcgagcggaaggcatttgggggccattgttgggagaagcatagttttgttatttggggtaattagtgagcaatagctgattagcattgaacaaaaaccgccgtcgtcgcattggcactttgaacttggtttggctcgcttcgtcccggcactaacaatagcagcagaaggaatggccgtttttcttttctctcatttgcgtttgctttatctcttctgctttgtctgcctttttttttcgctctcactctctcctctctctctctctccttctctctctctcctatgctctcttcactctctctcttcactctctctctctccttctctctctctcctttgctctctttttctctctcttcactctctctctctctcctttttattgtctctatgccttgcgttgcgttgcgttcgtcgtttcacaatgattcggtcgcttttcgtggtcccccaaggggttttgtgaagtgtctgctaaactgtctcactttcctcttcttctaacgtgcacactccttgtctttgcttctctgttctcgctttttctctcctggggcaacactctttgcgttctctcgcctttccttccgttgtctatctttatcacttattcgttttgaataggagagagaatacaacctttgtgtttaatgtattttctagagtccggaccgggccgggccgggtaccgggttttcccgggcccggcaacccggcccggcgatttttgggaaaatccgggttgaccgggttatccgggttgaccgggttttgagaggccgggcccggaacccgatcgtttttgaaaatccaacccggcccggaacccggcatttttgaccgggttttaccgggttatgatttagccaaaatttgttctttttccattcgaaaatctctttggcataatgtttataaatgttttttgtcaattttctggttaaattttttcattcgaacaattctactttatagaaatgagaatttacttcttttttctttttaatttaaagataatgagtcttatttgggaaattggcctatttaaaaaacgtcaataaaccagaccctaaaaaatcattaattttcgtgaaaaatttgctcaaaatcgctaaaattagtcctttttgggcaaaatctgtcaacaaatcgcattaaaaatttaaaaatttcccctcggcggcgcctatcggcaccgccggacccccttattccccaaaaggcttttggaaaaagcgccgctgtaatagtcccttttcgaaaatgttctaaaacaatgtaaaatgaaaaaaaattttgatgaacatcattgaataatttttcaagcaaatactaaaaaaataccaaaaaatttccgatttcgaaaatttggtacctatgccaaccctgatgcaaaacattatttattacaaaaattcagagcgcgaggaaagttttctaaaatttacttcttggtttttctcttatagaaaatttaagattttttttgttgaaaaatttgaagttataattgaagatgtcgatttattgacgcctgaagtgaaatagagcagaaatttaacgattgcccgagctttttttgttaattttggagttgaaatatatgtgaaaattaaaaattttaccgacccggaacccggtcccgggcccggcaatttgaaaacccgggttgaccgggttttgagaggccgggcccggaacccggttacttctaccagcccggcccggcatttttggaaatctcggtctctaattaaaattatgaaacatttaaggaatttcatgttttaaataaaaatatcacaatttttattatttaactttatcgtttttttaaaaaattaattaatactttttagtgaaattaaattggtgctaaatgatgaacataagcactttaacagtgggggcgtaaatgtgctaaggtcagtgtactaaattcttacacttttttttgtcaaatctcaagaattttatgggacaaaagaaaagggggacgaaaatcaaaaaatgccattgattaaattgaaaaaaaaaattttccaatttatttggcttactatttattattttgccaatttgttcattttaaatgctcaaatctttttttgccgtttcagtcgtttgggcactccgtgggtgcgacgcgtgcttttgttgggcattggagttgccataatgcaccagggcaccggcgttagcattggcatgaaattcggcactttcatgctcggcgaggctggcctttcacaacgaattgcactccttttgaacattttgattggtgttcgttttacatcattattagagaccgacttttgaggcatatgccttctttctttctttttttgcattttcgggattttcatgccctgtaatgacttttttggcgctttggtgttttcatgccttttttcaattttttggtgtttattatagtgactttttttgcgatttttggtgcctttttagtcaaatctctaatcatttcgacatatttgattagattaaactttttacatcattgggttaattttttagaagtcagaaacgtagaagtttttggttagttgtgtcgtcaattgaaactccaaatttttaaattgttttcacttttttcaaaatttaccatttctaattgcccccttttcttcgacaaatgcctatttccggcacagattgtctctgtggtcgcaatagtctgccggactttggctggtcagccgggcatcgcttcgtcgcatgatggttgttgcgcagattgtcatcatttgtgtccatttttgcattgctgccgtgtccatttttctttcaccggatttgacccgcggttggctcaccttgggccttctgctcgtccttatgaccgttgtgcagggaatttgtgcgccagttgacaggggggagggggggggggggggggggggagcgtcaaggaaaatcccggtgattatcccgacatttggactcctgtgaaaatgcagtagacaaaatatattatggtaatacgtaaaatatactgatttgattatttttactttaccatccattaatgagtcgaataaagatgaggataactgtcgttataagaatttttgaacttttaaaaagctcgaatagacatatctagtggttttcgagggcgttgaccataaatttgagctaagaaaacttaaagcgaaagcaagacataccttttcatgtgttcgaagtgatccaattgcataaatgtgattttattgagaataggatttcaacattctgttcacattcgtgtcc

SEQ ID NO: 4489 - DNA, 2176 bp, Heterodera glycines
ttcacattcgggtccgggttttggaattggtcgaaacatgtcaaatccatgaccagcgagctagaaaagctctataatcatgcttttacaactttttaatttccaaaaattttcatataagggaaactgaccacaacaagcttaaatgtgaaatcagcataataccgtatcattttaattcagtcttttgatgaatgaaatattccccttggatatgcgtggattcggaaagggcgtcgccaatttggccatttacggtaccgcgtgcgctctcgaccaaatgtttcctgtaattagtttttttttgccaatttttcatttctattttattttcgcagatttttctcaaccaaattggccaaccgcagacttttgccatttttgcgctgatcggtttttgttcactgtttttcacgtggcgatgtttgcccgaaacgcatggcaaatcattggaggaattggagaaacaattcaaattaggcgattggaatgcgctgaaaaagcgccggcaaattcacaaaacttacgacgcagcgatcagaacagcccaaaatggatcaatcaataatattcaaatcaattgagaacagcagggtctcctccgtattttggccatttattataataatgaattattttggtgtttttttttgggaaagccgtaatgaatccaaaaaatttaagcaaaattcgaatatttaatgtggcataagatttttgagttattatgattgttagcaattttctcttttttaacataatgtcccaacagaatttatcagtacgttccggtaaaaaggcatttaaaaaattcatcgtttttgaatttacacagaaacaaattaagcagcaaaaaaaaacatgaacaaaattgtcgggagggatcccgatgaatttaacaaatcgctcgggacggatgccgaggttgggatcacgaatttaacaggatcctgaaaaaatcccacgggatcccgatcccgcccggtctctaatctaatgcacttctatgacataaaaatatatattataaaaaaaggacaaaaaactttttcactttaaattaaatctaaccaacatcggcggtgcttgttcagttgccaagtgccaatggaattaagaaagttatcaaaaaaacgagtaattgtttcgaccaaaacaaaggcttctcggactcgcacctgcaaaatttgtctacagttatcgagcgaaaagcttaaaactgttcataagtgaacccaattttcattttttaataatacgcccactaataaagtcaggagtctgatctccaaaataaaagcgtaattactaattttgaattatacaactttttttgaatattattaatagagcttgcattttgaggcatatgcctattttctgcgtactagtttcgaatattaagttaaaaacgcaatttgcaattggtttaaggcttctaccttgacttttattatgccttcctttttcgtgattttcgtgcctttaatgccttttttggcattttgccgttttggtgcctttttagcgttttttccgaaaaattccattaaaacacaataaaatcgggaaaatacacctctaagaaatgagtttttttggttaagttttacttgttttgctccctaaaaatccttaataaaaaattttttaatgccttttttcatgcctttttcgggattttcgtgtcttttcatgcctttttttcaattttttggtgcctattatagtgcccttttcgcgatttttgtgcctttttttgcgagctctagttattaaatatattttacaaaatgctagatgaccaatattattgttagtaagtttatttattggattgtggtacagtattgaactcttcttttagtccaacacagcttctccggttcgatgttattaaagtgtttttatgtccatcccaggctgcgggggtccctgtttccgtggatgggaaaaacgggacggggaagtggatggaaactctgtgtctaccctggttgggccccaccatgtttttggactataacttttttctttgtcatccaaatcaaacataattggtatcattccaaagctcttcagatgctctattagtctgaaaaattccaaaaaatttcgtcaattttgaacaaatttatggccaaaaaggttggaaaatttggttgttgaattcttc

SEQ ID NO: 4490 - DNA, 2061 bp, Heterodera glycines
  misc_feature (24)..(24): n is a, c, g, or t
attgatttgttaatattgtgattncattttcttaaaaatatctcgaaaaaatagggtcatccaaataattcgttgagagtgagtgcttttccaaattgtttcctccgtcatcgtcaatatcctggtgccaatcttggcgttggacaatggtcgcacgaccctcctgcgccggcctgtccgacttggcctggtagtcctggaggtccgcttggcccgggtggtcctgcaaatgacacggtgactcatacaatgctttttcctcttaccccgctgtcccggctctcctggcggcccggggggtccattctctccgtctttgcccacctgaattcgcacattatttcccccctcttctcgggatttacctgtcccggctttcctggcggacccggcggtcccttaacgaatcgatccattggcatttcgtcctttctctctttaacttacgggtcttcccggctgtcccggtggtccttaaaaatggtctttttcttttgtgacttctcatttctcacctggcggtggcttttctccaggaattagctgtcctggttctcccgggggacctcgctgtccttaaattgtttgaaaggttttggcttcgtttgtccttccgttcgtccttctccacctggtggtcccggctgtcctggcggtcccactggacctgcgggtccaattggccctgtggctccgtcttctccatctgtggccataattaataatcattgtcactttctctcggttactcacttcttcccggtccaccggggaggccgtcgttgccggggggtcctttaatggtgtgactaatagcccttcaattttcccttcctcaccaggtggtcccgggggtccgggtggtgcttggcatggacattggggcgggacgggcagcactcggtcgtgcagttcggcatcgactcccggtgccccaggggggccagggccttctcccggggctccatcctttcctaaattcgccggttttgaaatattttgttgagtaaaattggtaaccagcttcgccgggtgctcctgaatgaatttagttagttaatgcgtcgcgttgacttggttttgctgtgtttatcaccgtcgggccctggtggtccctgttggcaggtgcagcacaaagtttcgtcttcggcttgacgccgttggcgacgtgccattccgagcagttccgtcaccatcacttcctcctcggcacccctcttcgatggtgtgccgcccacttcgtcctctgtgtccagcgttgccatctccacatcgaccatttcacgccacatgtcccgggagcgggatttgcaatattccacttcgccctttatttttttgttgcgcgtcggtgagagaaggagacaaatcaaaggagggaccgacctgaaccgtcgcctggagagtttggacgtaatggaagacgagcggaaaggtgagcagacaggacgaaatggccaccgtactgaacaccacggctgcaaaggcaaccgggcggagagtgcttttgcgggggcattgcttttccggggaaatgtccgcggaagacgaagaaacgaacattgccttgggatactgatggaccagcacagagagaagcaatttatatgcccgattcaaagctacggcaacaatttttctttttgtaaaaaaaagaaaaaagagacaaaacggggagagatgcaaagagagagaggagagagagagagagagtgggggagagagcgaggggagaaagagagagacaacagggggaggggcttttcctcacaaatagtctaatggatgtgtacgccttttgaataaattggaagacgaatgaatggaaggaatgattctgatcactgaagctgacgacggctgcggggaaaataatgacggttgagacgatgaaacaccactttgtccattgacgacgaaggcggaggaggaaaagcaaaagcctgtgggagattgcctcagggctaaggcagtcgcttttggtggaaagcaatgattgttttgcgcaagtcgttggaaaattggagggctttttgggagaaagacggggcgcagtgcgaa

SEQ ID NO: 4491 - DNA, 1342 bp, Heterodera glycines
atatatatttggtcacatattttgctatataaagaaaaagaaaacacacaccacaaatttatcaggtcattcttctcattaacatgaaatctaaaaagtgtaaattagaaataaatagttataaaaatatttaaatatcttatgaaaacaaaatgaaagtgttcttttaggtataattatagtaatttaagttcatctcataaataaataaaaaggttaatgaaaaggagcagctaaatggggggggacgaacggctgcagaaacggagggacggcggacaaatcggggtccggacaatccgtcagtggataattcgtcgtggtcaatccgtcagtagacaatccgtcagtgaaggacaatccgtcagtgaaggacaatccgtcagtgggtaatccgtcagtggacaattcgtcagcaagtttttgtttgagcaatgattaaaaatcttgaaaaaatgattgttaaatttaataaatatattttttttagattcttaacatttctagttactttatatttcaattaattgaccatatcgagaaattatcatttaattcttttaaaaatggttatttcatatattttttaaaataacacaaattattaattcagatttttagcgaattaaattaattttcacatgattttaaataaatctgggtattttaaaaataaatttacttatggattagttactgacggattatccactgacggattgcccacttactgacggattgactactgacggattgtccactgagtcctggagccggacaaatcgaacgaattacgcacttttgggaaagtgttcagaaaagagaattgaagcgagaattaatgacttaattaagggaatgtacctaaccaattaaaaaaagagcaaaattcgcccaaggcgacaaaatgtgccgggtggcaaaacaaacaatggacaaaaaagttggatgaatgcatcttgtcaattacactaacttttttatttttgaacaaaaaagcataagttttgcttcccctcatttatttatttaatttttggtgataaattattattttttatttattttttttattttacttttggtgcaatatttgagtccgatagcaatttttggtctttcgacatttgatattgtgaaatggaacaattatttatttccaatggaattgtgaactgttcatacatatgtttagttaagctgtgtttattgtcatctgctgctgcggatgatgtgtgctgctgttctcagttctcaccatcagcagcagccaaagtcatggcaaagagaaagtcatccgtttcacccccccccccctttatcctcctttctcctctctttc

SEQ ID NO: 4492 - DNA, 2490 bp, Heterodera glycines
attaaaagtttgaagaattctgaattttttcaaaattcaaagtgtttttctcccccgtctaacttttttttgtcaatttttttcatctgagaaaccttttagcctgaattgatcgcttattggggttatccagtggaggtgcacacagtgaccacagaagacggatatgtgctgcaattgcaccgaattccctacggcagaagtggcaacggtgtgattgaatttgctatttttcggcaaaattcccccccccccccaaaaaaaatgtcaatctttaggccactccgccgtgccttcctcgccccgtccagttttcttccttcagcacggtctcattgcttccagtgctgattgggtgactaatttgcccagccaatccttggcatttattttggctgatgccggcttcgatgtttggatgggaaatgtgcgtggaaatttttactccgacgcgcatatcaattggacgaaattggagaaaaaattttgggaatttacgtgagtgagccaaacaaagcaatggtcggaagaagaacaatttgagatgggacgaaatggcattcaaagatttgccggcaatggtcgaaaagtccttaaacattagtggccaaccatttctttattacgttggccatagccaagggacttcgattattttcgccaaattggcatcggaaaacgaaacattcgccaaaaaggtgttacttttttgtttgggaagcaattgaacggctttttcttcagattcgaaaggtttttgctcttgcgccggtcgcttcggtgaaaaacatcgatggtttaatcgcctttttgggccgttatttcgggaggaatctttgggcgagtgccgccgtctctctccgattgtttcaatatttctttgctcctccttaggcgcttcgcttcgttttcggcactcatgacttcctcccccacaattggatgagcataatgttcgccaaaatcatttgcggaatgagttggcgaaatgttttgtgcgaaaatgtcgcctttcaaattgccggccccgaaagcaatcagatgaatcaggtgggaaaaggaaaagcggaaggaaaagctaagctaactaacgcagagtcggctgatggtttatgcggagcatatccccgccggcacttccacttggaatatcatccattgggttggcctaattaacaaaaacaggaagtaattaatgatgggcaaacatcccaaggcacaaatgcgcaactcgggaaagatgcaaatgttcgactttggagacaaacgaatcaatcggaaacactacggacaggcaaatcgcagattaatcccagcaaagtcaaatccgatgacattttgcaggactctccgccgctttacaatttgagtcgcatttccgtgccgatttatttgtattacagtgacacggattggctggcggatgctcgcgacattgaggtgagaaattggaagaattgggaggaaattgcgacggacgccccctccaacaaaaggaaacgattctccgctcggtccgtccccaattcatcaaaagggcactgaaagtgaccaagtttaatcacttcgacttcgtttggggactgttggcaccggaaaaaatatacaaagaaattattggaacggtgaaaaggcacgaaaaagcgattggaaggaacaaaaactaatttaatctctttttttaataatgtgtataaaaattcgactattttcgcaattaatcccttttccattcaatgattgacaagtcaatccaaggacaatccctgcgcaaaacggataatgtcctcgcccaattctttggggcattcgaatgccgcgaaatgacctccgtcttcaaaaagggtcatttgggtgaggttgtactgacgagagaccatttcacggggcaaaacaccgcccaaatcgtagggaaaggcggcgtacgccgtgggcacagcgacgtattttctgaaaataatgaaaaaataaaattcaaaaaaaactaatttataagcattcgttggacctgtacagtttttcggtatttgaatcactggcgaagtgttctttgtaatagcgttgcgaggagagaatgtttccattgaaccagtaaattgagacaattgtcaaaaggtcgtctcgagtgaattttctaaaaatggaatccaaacgaagaaatttaaaaaaagaattcactttccgagtcctccgtctgccaatttcaaaaatgaagggtttgtccaacatacgaatttctctaaaatataagccaacagacccaacggagaatcattcaaagcgacgccgacggtgtcaggtttagtggcctaattacaaaaaaatttaaattcaatcggaaaggattttaataggcaaaggcaacgaaatcgccagttgttcacctgaatgtgcatatatccactctcgcgaaaaatgaacgagaaaatgccggccaagctgaaagttgggacgtctggcccggagaatatccaacgggggaccaaagaa

SEQ ID NO: 4493 - DNA, 776 bp, Heterodera glycines
ggaaacatgctttcatgccttttgaacaaaaaaaaactttcaaaaaaggggggggggggtaccatcgacagtattacccaattccgacttgtaagccttcgatttgcgtccggaaatggtctcccattgcgttcagctttttctccgcttctctccagtcgtactcattcagccaccggtccctccattccatcaattctccgatgggaaaaccatactcaaagtcatgcacatcctccagctgttcatgtccaattcgacatttggtcagcctgtccttcagaccagccaattctttgttcgacacattcacagagaacggaacgatggacagattgtcgacgaagggattgccccgcccgaagaagccgttcagagggaagtcgacctgaaatgaggaaattagtgaaccgcccacaaaaatggcaattgatataccaaagagttgtctcggagttaagcatgaaaaatatgatttataggccctaagctgcaatatgtcgccggtgcggaaatgaaatattatgagatttgacaaataatgttaaaaaacattttgcaaagataggtttaaactttaaactcatttccgcaactaaagacttatttttaatgctaactcattgagactaatcgattggtaattatcatttgccttattaatgaaagtagagtgccacgggaccgggacttggtagcggacaactgagtaccaaggtcccggttttgaccgggaccgggactagtcccggttttttcccggtttcccagccaaa

SEQ ID NO: 4494 - DNA, 2670 bp, Heterodera glycines
aaatacaaattaaatattttactcatttattttctgttttatatacaattgtaaaatcaatgctcctttctgaacaaaaacacccagaattaacactcaaaaacaaataaaaaagatattactattgtttgtgcagttttacatagtgtaatctgttaattgacaacatgttcacgtgccttttctgcttttgccctgttatgatgaactcgtttcgtattcgtcgctggcgggggacgacgacgccgacgcatggggaggccttcggaccgtttgaagcgtcgccgaattctcagcaagaacctgaaggaaaagcagcaattcaatttgggacctaatttgtggttgaaaaacctcgtcaatgaccaccccggggtcacgccgcgtctgttgcactcgcgtggacatattgtggccgaaaccgcccggcaccgtcgaatatgtgcacacattggcacttaacgtactgctggccattgcacttgtcgaactgatcagttgggcaggaactgtgtacagcgcttgaaccaccacattttgcgaagccacttaaaaggcatttcttatttatttagtttgatttctatggtaccggtcgaatttgctgtattttcttgtggagttgagctgattgattttgggtcgggagacggaggaggtgcctttcggtcggcggggtttaaaaaatggcccaattggtcagaacggctatgaagactttccatggaattgctgcgacggaaaattgtcgatgaattaggactgaaaagaaattatttatttgagtgaaaatttttcttagatttctctaaattgatgacattttgaagagagggtcggccgagttgtgctgcattctgacaaagacgtacactcgtgagttgtccgcgcgctgattgttgtcgtatccgtccaccaaatatgacctcgttatgcctttagcaccgctgtaggcaaattctgtcaaattcagaataacaaagccaagcttttgcggagttcggcccgcacggtcctcctgaataatatgagacaaataattgctttatctgccatgaaaacggactttcctgagagaaattttaaaacgacatgcctgaaaataaaattcattgaatatttctggttttaactacaacctccaacattccagtctgttttgagtcaaacggaatgcaacaactgaatttgaatggttgcgggtccttctcgacaaaaccaatttgaccaccctcatcgtgaccaccatttccgacctgaaagaaacgaaccaactctttctaaatcactcatttgttgcctctccatttggtccaacctcattgctgcccagcagccgttcctcattctcctcctcctgttcgtcatcatattcacccctttggttgccgttgttttcgactagtcccaattggtgcgtttgttgtggcttcgaaattgtccgattgctttcctcagaaagtgaattccgccgtcctggcaaagggagttgttccgtagcaaagcaagtcacactatgcctgaaaaatgattttggtgcttaattttaaatctcatttacctgtgaacgccaccattttgctgtgatatacttgggagatccaaagttttagcgcgaatttgcacattttctaattcattttgatgaccaaaagaggaggacggactcgtcgtgaagtccacctcatgtgaacagacaggtttatgcaatgtgatacccgcaaaagagccgcaatccaacagacggacctgacaagatcgttttccgcaagttaaaattttattgtacctttgcaaaaataattgcatttaaaagtggaatgtctgtcagtttcagaacacaaagctcgacgttaaatttcacttttttcttccgtaaaaatgatatagacatatgaaggcggctcacaagaagcaaaaatatttcttaatctttgtgtaaaataatggtactaatgtcgtttacagaccataaaaaaatagttttaataaatcatacatttaaacatttctggggggttttcgggatcgctgatcacgaatctgacatccatttagaataatttcgaaccccggacccgaattcgaacagaagccgaaaattaatttttcatcaaagttcatttttatgttagaatctgaacagaattcaggtccggggttcggaattggtcgaaatgtgtatcaaattcgtgatcagcgaccccgaaaaccccccagaaatgtttaaatgtatgatttattaaaactattttttttatggtctgtaaacgacattagtaccggttcgataggtattgcgcattggcccgttcaaaaatcctgtttttttccgaacacctaacaaggtcccgactgaactcgtacgtgattttgtcagtcaaagacccaacaaaaattttgccctacccaacccccaatcccaagtctggcaaacctggacgccagtccgctccgcgtacgccttcttcagcttgcccatggatgtgccgtatttgacccggaaatgcacttcatttgagtcctaaaaacggacaattaagtggttgcgccatcacacaatgcaaaaaacagacctggccaaccaccttcagtttgatgtactcggcgggctgagcgccaccagcggcgccggctcctcctgcattcgtggcactttcgtcggccatt

SEQ ID NO: 4495 - DNA, 1329 bp, Heterodera glycines
gttgttaaaatagttttaaagcttttccataaaacggcatgattcaatggataataaaatgctgattaaaattattaaatgataaatggaatggggggaaaaacaattaggtaccggtagctatttaggttttttgaatgttttttttaaagtaagtgtttatttttaatgttttatataaataaaatgccaagaaaaacaaatttaaatttcaaattcaatgttttgttccaaaagcaaaggtaaaaatgcaaaacgaaattgaatttgtgttttttgattcacttaattccttcctttctgaaaatttacaattgctctcccaacaaattatttgccccttgcaaagcctggcgaatttcaaatggaaaagtaatgggccaaaaacattgttatgccatgatcaccggggagggtatttggactatgaaaggtgggcgaatgttgaattttttaaatttatcattgaatgactcctaagtttaaaattgtggatttatttaaagcttatatggaactcgaatatgctctaagggcagtgaacaaagtgctgaaattcccttttacgccttcttccattggtggcacattgacattttcgtttacttctcccaccgtttcgtcactattccgccctttgcttggactaatcaagcacacaaacacggcgttctgattttgggtaatatttagcggttaattatattttagagattccattttatgtaagtctaaatgaatacacattttgtttttatctcgttgcattttcattccttggtcaatttaggaacatttatcattgaaaaggctgaaatttgccagcaaactttttccaatagagaaacaatcgacagattaatcgcatcactcgtcgattgctgtgtcgtctttaagtttggtaatttcacaaatgaccccctaatttgcattctaatattaataaatccctttttaaatgggtggttaatcaacatcgaaagtgaagtgaattcggactctgtcgacaatttggaatactttctgttctctttgcggaatgctttgcatgataatgttcacaaagatgccaaaagtgttatatttttgtcttttgtcggttcttattgggttttaaattgttcagttgtttggtatgactcagtgacaacggacgggaaattatcgtggcaaaatgcattgaatgccaacaatttgtgagtgtactttttgtggtgtaatagtttaaaattcgattttattcagacgatggggcaaaagtgtcgatgccttctacacaaattacgcctaggggaagaacacattcagcaaacggttcgaacttttctt

SEQ ID NO: 4496 - DNA, 1631 bp, Heterodera glycines
tgatggcggatggaattgcgtccaaccgatggaaatccttcgccgttacgctttgtccgttgccatttttgcccccggatggatttgtgaaaaattttccggccaaagtcatcgcatcctttttgacaacagttttcgtttttggaattcgttgagtacatttttgtatccccatgctttgcgacaacggaacttccgaaccagattttgcggttgccattcgcatcggaacgcccccaattggcatttctcgcaattaccagagaatgtactaattaatatttgttaaattgggaaaaccgtctgttgctctaaccaatttctcacgcacttttcaggaaatgggtgaaaatcacttttgtcttcaaaacgctgacctccaacccttttacgggtgctctgcggcttttggcaaagacgatggaagcgggacttctcgtgaagggcactggcgattcataagtgagttgggctgacgggcgaaaatccattttgacattttaaaatgatttcgctttggagtttggaatgagtcgagatgggtgtccgaatctgatcctcctagccgaaaagcccgaaaaagtattttatttgaaaaaaaaattcaaaattttttcttttttcaaaaaagggctaccatcacaactataatcgaattttcagactttttatttgcgacgattccgattgaggaaaaggacgagaaaatagagctacggtacgttcattcacttcactaattgcagcatttaagctgattattgctcggggcaaagttgtcattgttattcctttgcatttccgttttaaagcaacaacttcggaatgttcccccatctttcagtttcgattgttctcatccaattggtctcgttgtgacgatctccgatggcattgagtcgctccatttttgtcaacattcttttgacgacaatccgtccgatgaaacaaataaacggcatgaaaaatccattgtttttgatgtcgccggaaagcgcgggtggaaaatttcagacatttcaatatttaacacaatgacagttcctatccgtttgtatacggtacatatgaaattgtactgaccagagaccgaccaaataaatttaaaaaatggaattaacaatattaatttagtaaaatgttttccaattcgcatttctgtcatcgattctccgagactaaacgcatggcaaaagcacaaacacatcgaagcatgaaaattaggggttgtaaaagtgatgagccgacgagtggcgggggcggggggcagcgaatttgcagtcaattccattccgtgttatgagcaaattcaattggccgctgcacttcttcccatcccttcccctccaatgcttttggtttccattcactttccttgggtttgccaaaaaaggtcaaatttccattatttccgccctttccctttttcgtttattcgtcaatgcatttcatataaaatgccagcagaatgcgctttcctttagcacaaacattctcctcgaagaattcggatgtcgtaaccataagtttgaaatccgcttgttgtccaatgcatttgtgtgggttcctcccgcatttttaatccgttggacggatgactgatgggaagggggtgcggttgccccgccccc

SEQ ID NO: 4497 - DNA, 3217 bp, Heterodera glycines
  misc_feature (1142)..(1142): n is a, c, g, or t
  misc_feature (1198)..(1198): n is a, c, g, or t
tttcagtgccgttgttgctcacttaattttatttgcctcttctagtgtctccttttgtaattcaaattggatgaattgcattttttatagcttctaccaatttaaaaagttccatttcacattcttgggctgatcagttgctgctgatcactccttttaagactttctccacataattaacggccgatggtggcacaaattccactgatcaaatggacaacagttttcgacgagcttttcgttcaattgccgtcaatttaccccttaaatttcatcgcaataactttaacaaatattttgatcagcacagtccacgcgacattttttgacagggacagaacggcacacaatccaattcaaatgccgacgcatcaactcattcacacatttgaaacgaatgaacagttaaataaaaagagaaataatgcaaattatttaatttaaaatagttttgcaatttctgtttaaaataataattattttattaatattttgtcatttttgggtatatttattgccaatttctctcacaaaaagatgctcaacaaattgcccgaggccttgcgttatgcaaattttggaagaattggaaatgatgccccggtggatttgcgacccgtcgagccaaagcaatgtcagtgcaacggaagaggagatgaagccgcttcatccccccccctcaggcgcaactccccccgttggccaaagggacggcccaaaatgcgcgcagtttgaggcctttgctcaacgacgacggcggcgacacattcagtcacagccaaattctgctggccattgcgcccatcgtttgcctgctgattttgtgcgtcgccatttctctgcggcggtgcagcgcttccgcggcaatggccacaatttgaacgaatgccttcagagggacagaatttacatttaccctttttaatgtaattaattagattgagaagaagcaaataaattcttaattttcaccaagttgacaacatatttctcgtgaaattgttacaccacaaatctgattaatatttatttttgtaactggcaacagagcctaaaaagtacaaatctcacattaatatttaaattaattaataattattttctaatgcagaataatgaatcacaacttacaattagcttanacatgatcaaattttaactaaataatacagaaatctttggtctatctattcattanagaaacttatattttgttgatttattatttgagcttgggccgggactaacggggctaaatttcaccagtgaaaataactcagatttgaaaatatttaataattattttggcgaaatgtctttaattcgaaattttcaagatagaactttggatttcttgaaaatttggggcaatttcaactgttaaaaagaccctaaaattttttggacaaactctgttaacaaaaacaaacaaattttcaaaaaattttccccggcggcgtctatcggcaccgccggacccccccccccccccccctcttgtacgacgaaatgcaaaaaaggtcgatttacatggcttgatataattctaagctaaaatgaagactataaaattttttcgaatttttaatcaaaatttcaaaaatttttgaaaaaagtcccggtcccggtccaaaaactgggaccgggagtcccggttattttggacaaatcaccgggaccgggagtcccgggatcccgtcccggtccattttccaagtcccggtcccggccatttcaaaattccgggctctagatgttactacatatcactgacacttttttaggcatgtttcgtttttttaaactttgaatttaacacattgtttcaatttggaacgaacattcattttaagcattactaaattgagaatttcactgttttggttgtaaaaattaaagaaaaataaattcgagaaatttaatacaatgtgaataaataacgacaataattaacgggaacccaacagaacacaaagtcacatattaacaccaacaggaaccctcttcagtgacaatctgacggggcttaatcgggccaatgtcaacgacttgttcttaacaatgaaaacagataaatagggtaatttatccattttaattatttttacttgcgtccgcagccttttccacctcaatgccgggaagtgcgctggcaattcgtcggaaaagctaaatttgtaaaaataaaaaaaaccagcaattcattgttgttcgttcggttggtccacctgcttcacgttgtaaccagcctttgccgatgtctcgatgaacatcacattcagctccttcgccttctgctcgccctcttccgttgaaacttgtctaaaaatggcgtaataataaaaactcagaaaacgaaaattaaattcttatcagtttaaaaagtatttgagtagaacggcaaattgcataaccttttgtccgcgagatcagttttattgcccacgagcatgatgatgacgtcactgccccgttcggtgcgcacgtcgtcaatccatttggacgtttgatgaaaggaattcgcatctgaacaattttacagcggtgccatcaattcaattcaaaatttatcttatatgcatccattttactctgtgtacctttacggggctttaaaaatgaatgataatgatacgcattaatttgttaaatatcttagtaggaaacttaaatttctatttttgtatttcccaagagaagtcttacttgtaatgtcgtaaacaacaacagcaactaaaaataatataaattaattttaaaaaattcgagttttggccacctgtggagtccctaatgtacgacggaatgagcgaacgaaagcgttcttgaccagcagtatcccaaagttgaagtctgaccttaaaaagcgagtttagaattggaaaactcatttaccgttctgtcctcaagatacatagttttgctcagaaaatctatcccaattgtggcctggtacgtattgtcaaagctgtcatacataaatctggtgataagagaagtctttccaactgaaaattaagacattaacattttgtatttaacggtaatttaaggaggacaggaagaatgaagatggcaataaatttttataacgtaccgctttgttcaccaagaaacacgagtttgaacttcttcagagggtttccaaaatcagatgacattgccttagttaatactaaaagtgtattaatttgatcaatgatcgttcgggaaaaag

SEQ ID NO: 4498 - DNA, 1925 bp, Heterodera glycines
  misc_feature (166)..(166): n is a, c, g, or t
gagtttgacttcttcagagggtttcaaaatcagatgacattgccttagttaatactaaaagtgtattaatttgatcaatgatcgttcgggaaaaagcaaaaaacaaaaaacggattatggaaaaccataagcggtcttttccaacatgacaattttaatttatttntgatgcaaacaaaaggccaaaaattaacttttcgtttctgtttctctcactcactttctcttcattatccactctctttctcgtttgctctttcactctctctgtcctctctctcctcacacttttttcctttctaatgatcggctgattgctgctttatattacatactcctcatcaattagcccccattaccctttcattatctttccgtaaacatttctttcagtggcgccgccaccgccacagagtccaaagttcgctttggcgtttttttggcctttcttctgcactttccttcttttctgcccatgagaatgaccttttcccctcatatgtaaaagtaatatttttgggtcctatcatttcccccgccgcggttttctaggatatacctatataacgttttacttattcacccaatttttaatttggtatacatattttctcccatctgttcaccaaatctggaattatattttcgttagaaataatgcaaccatttgtccattggtcgaaatgcatattcaaacgtccattttctaattcttcaaaattattttcgtcgtcattttcaatggggtttaattttggtaagttttatgcatactaactaatacttcatatcacattttcaattcttaaaaatcatattgtattaattttcagaatttaccgaagaacaaaaacaactccaagcggctgtaaagaaatttactcaagatgaaatcattcctaaagcgtcacattatgataagacaatggagtttccatgggaagtgataaagaaagcacacgccaatggatttatgaacgttgacattccgtcggattgcggtaaatattttggtacaatgtgaatgcaatttgtaaatgtttatatttaaagggggtcttgacttggaacttgtaagcaacgtgctgatcagtgaggtcattgggtatggatgcaccggaattggaacggcaattttgggaaatgacttagccgcgactcctctggtcattggtgccaaagaagaagtcaaaaagaaatttttatcccgtttgattgatgagccaataatggctgtgagttttttttgtgcgctttttatacctttctaatttagtcttattgtgtgactgaaccaggcgccggttctgacgttgccgcgcttaaaacgaaggcggagaaaaagggcgacgaatgggtcattaacggatcgaaggtaggcgatattccccttaaagtcaatcttcgattttagatgtggataactaatggtggagttgccagttggtattttgtccttgcaaggactgacccggacccgaaggcttcgacgggaaaagcatttactgcatttgttgttgacgggaatactcctggaattgttaggggaaaaaaggtgggcaagccaactaaaacagatagatagaagatcactgacaacaaaccattgctatgtctaaaggaaatcaacatgggccagcgatgttccgacactcgtgccatcagttttgaggatgttgtcgtcccaaatgcccaggtcatcggtgcgcccaatgaaggatttaaagttgccatgaaaacttttgacaaaacgcgcccaattgttgctgctttgtccgtgggacttgccgctcgagcgttggatgaggcgtcaaaatatgcacttgagcgcaaaacatttggtgtgccaattgcacaggtcgacaaatcctaattttttgtcagtttattctttgattgtttccatctttagcatccagggtgtt

SEQ ID NO: 4499 - DNA, 1313 bp, Heterodera glycines
  misc_feature (71)..(71): n is a, c, g, or t
attaaattcatttaattaggataactatgaaaggaatacttttcaagaaaccgaactggcgcccatttggncggcactcctttaacggttttgactaattgtcaactttcagcagatgtttttctcatattctttgctctcttttcaaatttaaattgatgaaaagataaaattgttaatttcaaattatgtacaaaaaacaattatacatttgtttttgattttcaatcatttgtcatgcccaatgataaatataagcggcgctaaaatttattggcataagcaaagccttaaaaaatgccatcaaaattaggcaaatgccacgccatgccggggcatatccatgacactcggcattccaaccccatatttaatagcatgggctaacatctctgcattttatttaaaaaaatataaaaaaaatattaataataattttgcaattttattcatggatatcatgcatattttttattgaattgatttgtattaattactcttcttctcctcaataataattttatttttttaaatatatttttcaattgaataattttatatttataatttaattaataaaattccaaattattatttaatatgcatagataaaaaaatgatgatgaataaatttgtgattctaacaatggcatttgcaattttggcattaaatttcattggaattgcaccggcgggaacagcagaaggccaacaaacaagcaaaacaggtaaaagattagtgcaaatttgctttatggaagtgcgtgccaaattgtgtgaatttaccgttttggcaatataaggcacaattcaattattattttgtttctagggctttatttaaatttttttggctgcaagcgaaaatttataaatttaattatttttaatttatttgatataacaattattaaattacgatttaaaatataaaaatataataataaattgaggatcaccaaaaataaaatagaagtataaatttgtttttaaactttgttttaaatggttttattcacgcaaatttaaaaagaaacaccgggtctaattaggcacgcctattaattagattacataaaatacaatggttattaatttattaaaaccaattaaattgatatatttattccctctcttccgcaggaagtggcatttcttccgcacatcgaagtgacgttggcactgcctatgcaatgattgcgaatgacacgacgccaaatgatgttgccacattttagtccttttaaaaaatttgaattttttaatataatttcatccataagtgcccaaaaaagacgggaatcggtcgttcg

SEQ ID NO: 4500 - DNA, 3331 bp, Heterodera glycines
  misc_feature (3320)..(3320): n is a, c, g, or t
cgcaagtttttctgtaattaggggccaattcagccttacccaatgtgctgcaatattggcataatgccaaatagctgaatgcggcatttgtaagggccaatttaaaccctttacagtacccgtacaagcgaaagcactacggtagtggtggtggtagtcgacgacagcgtcgtggtaacagcgaaagtaacgaagattcgccgcgactgaagcagcagcaggagcccctaaatttgccaacccgtggcaccacatcgctccggcgcaatggaaacgccaaatcgggccaacttttggccatcgaattgctgacggacagagaggcggaaaaccgtgcagcgaaaaaagtaaaaaaaaaaaaagcgaaacaaaaaaaagagggggggggggagacgaatggattaagctagcccactgtagatataagccaagatttgttattgaatacagtatcatatggcaaaatattggtcaatctgtacacctttagtagccagcttacttgtagatccatgattgttgattgattaacagtataatatatgtataaatttgctcatcggtacactaatggtagctagcctattgtatatataagccaagattattttattggttacattatgataagatcaaattaacctactgttcacgacattggcggatcaaaaatttatttggcccgaaaattattcttcgttgtcaacacaaattcaattcgttgaatatgaaccatggtggcataaaaaacaattttgttgcaccgcttacatcgcctacccccaactcccccccccctcccataggaaatcgcaattacggattaacggctacggattacgggaattacggcaatttcggctccccgtaatcacggattagggatttccagaatgaaaaagcctccgtgattatggttaagtatttccgtaattgaaatgcagctgcgtgcagcactgttggtccccccagggcttggccttttggcagctccaccagcgcttagcctctggcagtgctcacttggcgggcctcagttgtcccgctccggacaaattttttccttttttttagattaatgaacaattgtcgtaccttacgcttggtgttgtgcttgcacaaagtcatgaacaactgacaaaactgaaggaactgctcaaattggcactgtattttgagcaattactggaactttttaatgtaaaataaattttaaaaaatttttaaatacaaatttaaaattttacgaattagaaagaatggcttaatgagagggaactgttagaagatgccaaaacagtactgatccaaatggacagttcaaagaaaggccaaatggccgaccagcagaaacttgtggccgatttgcaaaaaaatatgaaccaaatggaggaaatcagtggaaaaattaaaaagtaactaattaattagtacataattaatttaattaataattaattgatgaataatttgttaaatgagtcactagtcactataattcggtaaataattcactttaaattttataatggttatttaaattattattacagaaatgaattcaaatatttttaatttattttggttattattagtttaaatttggtaaataaaattattataaaaattaatcaaaataattaaaattgtattcaaaaaaaacaaatattaatttaaattggattcataaatcaaaaaatatattttaaaatatcttttttttaatcaaaatcccccccccccaaaaattaattaaattaaatatttaggcattattttataatcgttaatttaatttttacataaataattaatttttaattatttagtgaaatggacggattattaaaaatggcggaaagtgacgaagaattttatttcgcccggcacattaaccgtatgaaagagcgtgacaaccagtcaccgtttttgcacaacacaattgtcaattgggagaagcagaaaccgtacgaatgggaccgtcagcaaatgcgcatttgggtgaaacggcactccactaatgaggcggctaatgagcgtgagcaattaggtgctaataatgtcaatcaaatgaccaaaaagcgtaaagatatttaattttattttatttaaaaattcaaaaaacatttagattaatttgctttgttttcgtttctgacaggaaattttttggatcacggtcacgattcacgggaccaattcagggtcacggtccacggttcacgggttttttcagtgacggcgcaccactagaatttagtgtctattttaagagcccggatttgtatggattttaaacttagcaaatctggcatcatttgaaagctctatgtgttctctatatttatatttcaaaatagaaatgaatgattcaaaaataaaaaagttatggcacacggcgccaaaaaagccaagaaaaagtcaatttttgaggtttttggccataacttttttgtaaactgacgaaattttttgaaattttgcagcaaaagatatcgaacgatactaagcgttttaccctcgtccatattttgcgattttttttttgcgatataccgggttctagtcatgagaataaaaaatttaaaaaaatgacgtccgtatcactggcgcataaagctgttacaaattgccaaaaaatttcaaaatgccaaaattgtttggtgtaaatgccaacaaaaaattttcaatttcctcatttgccaactacgcttttctgcagtgcatccgctttacccacttgcgaagcgcaacgcaaccaatgaacgtctggtgcggaatgtaagccatctgctgatgcttgacgcggcatttgaccgcgaggcgcgcgaactgtgccgacagttcgccgcgcgggtgccgttgcgcaattgggccgcaattgcgaagaacatggacgatgaagcgattaagaaatttgtggtccgcccattaaaagtgaatttcctaatttcactggttaaccaaacgagggggggaggcctttggcaaaatttaggaacattagaaaaatggatcttgaaaaaacctgaaaaatttgtaaaaacagtttttttaatggaaattttgtaaattttaacagctaatagtgtaaatttgaatttttttctaaaatttaaaatttttaggaattcatttaaagaggcatttgtttttgttgaaatttcaccctcaaaattttcatgaaaatatttttggcgcctcggattagtgacaaattttcccccaaaaaatagaatccattcgaccggataatgtttttttctgacaaattactttttttcatataatttgatcgtcttaacgttttatgggaattntggcaatccca

SEQ ID NO: 4501 - DNA, 4560 bp, Heterodera glycines
tgaatccttgtgtatcggtgccattttcgaatggcacccatcacaattgctatcaaaacaaataattttgcttataactttgctctaaatcatcaaccatattttaattcaaaagaacattcgatagctctaattattcgctattattctgccaaatttcaaaaaaaaattgttaaccttattcgaaaaaaggctttttgagtttatttggtcataggattttcaaaatttaatgaaatttttgaaattatccacactaataaagaacactttatggctatctaattatataatgaaattaacattttgttgcttttaagcaaagttattataattttcatcaaaaattttcataattggttttttaaattacgacgactccgcaccttttgccagggatgtggacacacatcagcgtgaactgagtgcgcagcaggagaagtgcgtgtggggcatgttgaacgcggtcaacaagttggagttggacagggccaaggaatgtgtgaagggcgcactgttcattcagctgttcattgagcaagtgttttcggaggaacaatcacaaaaattgcaagaggccaaaggtgccgtttatttatgttcatgcaaaaattatagaatttaaatttaaaaaaattaacaaaattaaatatttttaaagatttaattggttgaaagaaaagttttttatgaaaaattatagaatttaatttaaaaaataataaaataaaaatattttttaaagattttacctttcaaaactaaaaagagaattaaagaaaaaaaagaaaaaaaaattaaaaaaaagagaaaaaaaaaattgacagaaatattttgtatattttctttaaaaaataaaaaaataattttaattttaatttaaaataaaatatattatttgaaataattaataatttcgacaattattatgtttttcattttttagttttttacattagttgataatttaagttctcattcaataattttcttgaatttttttacaacaaataaaatattttggatttaaaattcatttcaattctttgaaattgtttgagccaaaaaagtgtatagataagcttcagttgcatattaacttttcaaggccttgaaaaaagttctgatttgtccttgaattttttggaatttaatttattttagacaacgttgacaaactcaaagatgagcttgcgcaattggagcgcaaatttcaagcatttaaagcccaacagcagaaagcggagagaggtgccaaagaagtcaaagaagcctacgaacggagacgaagaactcggcgcggcattggcaaaaaaagtggggaaaaagtgccgaaatcggcggccaaaaacagaggcaaagccaaaatggaagaagcgcatgatcaggatgatgatgatgattttgatgatgatgatggtagtaataacgatagtgaaagtgataccacggaaagtggtggtaatgaggaagaagctgaatcctcgtcggcaaagaacaaagggcgcagtgccaccagcaagtgggtcgaccgagcggtggtgggacggacgttagccaaaaagccattaaatggaaattttttgaaagaaaatattcataatttcgcccagaatgaaccaaatttttaatacttgatatcattcggtagccctaagagttttctattttcatggaaaatattaaaaaaaaaatttgttataaatttaaaaaaagatataacctcagaactcaaaaaaaaaaaaaattcatttgatagtttttgacggtgctgggacgttagtcaaaaaccatcaaatggaaaatttttgacagaaaattattcataacttcgcctaaaatgaacaaaattttaaaattttgttatctttcgtatgcttatatttcgggcggcaccgatccaaatctcggcaccggtccgaatctccctccaacctttggctttgaattcttttcctattccatctaatcgccccgtcccctaaaggtttaaaaaaattatgtcgggaattacgccgaaacgaaaaacgaaggcgggcaaatcatcaaaatcatcaaaagaagatgaggaaaagcatgatgaaatgatgatggcatcggaagatgaagaaaaaatgatgaagaagcaaaaacaaaaacagtggaaaatgccgacaattcagccgcccccgtccgcccggcggaggagcagcaggccaagaaatggtatccaattattgagcgcggactttcaaaaaattcgggatcagttcgggattagataatttgacccgtaccgggtttcaggactggatttaatatcaggttttccaggacttctgcttgatccggatcccaaattttgatccggatgctggcccagaatgggtgaaagtaggataaaggataagagaggatccctaaatggggcgcccccgtatctcagtctgggaatcagagtcccgaggcctaaaaatgtcgaattttctgcaattgaataaatttagaaattgcaaaataaatgcaaataggttcactggctccctgaaaatgcgtcagtgaaaatttcaatgtcatcaaaacatgttctttggcttttcggggtcatttataacgaatccggtatccattttggccaattccaaagcccgggcctcgattcggggtcggggtttggaattcagaacaatgttcttatagcattttgcttttatactatgtacaaatattttccggtcatgggtacactcccaaaaaaaaaaaaaaaattaaaattggcagaattttgtttcaaaattttgaaattaaatttaatttatgtacccccccccccttcaaaaaaactcttttagcatcatcaacaagcagcagaaacaccaaccgccagcatgagccgttgagacaaattgatgaggactcgcgggagggggtacacagctcggacggcagtggcaccagcgccgccggcgctggccgtcgccggctgaccgaaaacgataatagcaacagcaattattatgttaatgagtggattgatcagcagccggaaggatatgatacctacaatgatcggatcagcaaattgcgtgccaaactccgagaggcggaggacgagtacaaaaagcaggagaaaggattgaagggaatgctcaagtgaaaattttgattattttaatttataaaaaatagaatttttagcatttgccataaaagatagcttacattaagccattaaaagtttcaaaaacaaaaataaatgtaataaaaaaaggcaaatgatctaaaaatattgtaaaattttaaattaaaaaatgattttttttttcttcatttgtttaaataaaattaataattaatgtttaaaaaatcaaaattgatcaaaatagacgtcagtgatcaaagaccccaaaaatctctttggaaacaaatttccattaatagacattattttacaaaaaataaattaattaaaagggtttttataaaattcaaaagatacggcggacttttgcgctaattgaaatgtaacatctgaaaattttttcaaaatttacaataaataaaaatttaaactaaaaaataagtaatatttctaaaaacccaatattttgtagatttcagtgggtttaagcattacgaatgtcatctattgcactccaaaatcgaatgaaaatgtgcttaaatgagtttctaagaatttcatttttgttttaaaaaatttctgtaaattttttttccatttttatgaaaatctacggtgttggtacgttcaacaaaaaaccatcaaatggaaaatggttgacagaaaattattcaaacttcgtccaaataaccaatttttaaaataatgatatcgtttgatagctctaagtgttttctattacaaaatttcaaaattcattaacttgagaagctcaaaaaacgaagtttttttttgaacatttttgatcataaccttcttgaaacttaaagaaactttttgaaattttacaggctaatcgaaaatacttagggctatcgaattaaggaattaaaaaaatttggttgctttcaagcaaatttttttttcattttatggctttttgactaacgtcatagcaccaaatttactccccgtctcggacatttttttaaaatttgtccagccgtttacgacaaattttgtttgggcaattttctccccgatttacggtatttaataataattatttaattaaaatttgctcaaattttaatgcataaaattcaaattttgctgacagtgtgcgaaaacattaccgccgcttgcgcctgaacaaaaagtccaaatcgcacaccaaccaacagccgattgtcaacttttttggcctacacaacgaactgatggccgaatggggcccaagcagtaacagcaacaactgtgaagaggaaaaggccattttcatgaaaatctatgatgatgtggtggaaaatgcgaaaaagcaaattgaagagaaatggtggcgatgccaaaagcgtaaaaaataaataattattaaatgttttcaattaaatatacggatgaacaattaaataattttcaattaaaatagaaataattat

SEQ ID NO: 4502 - DNA, 1369 bp, Heterodera glycines
tgctgatttggaaaaggagtacaattcagtgagttcaattaataaattaattattaattaatgccttaaaaataacatttattaatatattattattttttactttgatgtactaaaggggaatcaaattaaggaatcaattaatcacagttaattaattaactaattaattagttcatttactcagttgtcagttgcttcgttaataattatactctttttctagtgaattataaattaatgtcccaaaattagcattattaatatattttgttttttttaattttgatattctaaataggcatcaattaaagaatcaattaatcgcagttcattaattaactaattaattagttcatttactcatgtgccagttgcttcgtcataattaattatgctctttttcgtgtgaaatataaattaaatgctccaaatagtatttttgaatatattatttttttatttctaaataggaatcaattagggaatcaattaatcgcagttcattaattaatgaattaattagttcatttattaattggtcagttgctgtgttaaatcagctcttttcctattggctaattttattcgtaatattaaaaattaaatccacttttatttatagttaaaacaaaaaatattaatatttattaaatattattaactgattttcttaaattttttataaaaatattatatttaaaataaagttccataattaaaaacattaatattcgcaatgttgtcaatatttagctcaatgaaaccatgaatgctgaattgcccgggactgaatcgagcagcaacgattcggccttctcggaaattgaactcgagaacaaaattgagtccgagattgtgcagaaaaacatacgcacttcgaaaacgccattgaaaatttcgacgcgacctgtaagggttgaagccaatttttggcattttgaaattttttaattcgtaaattaggatggtactgaatttgtctcaatttaggaggaaatttttttttacaatttttggaatttgttatgattaggagggattcggatttctatggacaaaagaaaaagaacaaaatttggaaaatgtggagataaaaaagcatcatagaaatatcaaaataagctaaaaattcgtttaacgtgatttttttgacgaaataagtgtgcaaaaaatggaaatccatataaatccggtccttgtcatggttttttttgaaaaattagaaatatttttaaaacaaatatttttagactcgattgaattaaaacattaaatcaaatgtccttttattaaatttgttttttagatgtttaattgttttttaaacagcttaccccttaaaaatttgtatttaaaataaaaatta

SEQ ID NO: 4503 - DNA, 7236 bp, Heterodera glycines
ccagtgtcagacaaaattgctcataacgccaaatagcgcatttggcgtaaatttttgcgcgctatttcaaaatttacactggaaaatgcctttttgtatttttttattttgatctgccataactcgcttcattcccaactaaactgaacaaatttggtatctaaaaagtttttgaaaaggagaatctttttctaagtgaatgctaagcaatttgattttttagaaaaaagttgtgggagtatctttattacgttataactcaagtcttaaactgctgatttcaaccaaaatgcggaaagtaatcatttttctattgattctaaatgtccaacagattttgtaccgtatcaacaaaaattaatagaatttgcgaatttcatgatttttaatgtgttagagacatgaaaatagtacgccaaaaagagagaaaaaaaatgcaaatcttttattattccataacttttcaattcgacctattttaatattaacttgacctattaaccgatgcagaatttttttctcaatcgatatgcaaaatttggtgtggatttaacaaacagaaaaaaagttaaacaggatgaagtaaatgttgttttttacataattaaaatgaagagatagtacgccaaagagagagaaattacaaagaaaaagagaaacgacgagatagtactaggcttttctctgcacagtggggcgtacccatagtggtgacgttaacccatagttgtgcaaggtacataccatatttatttctaccagcacctccagactccccaagttcccaaaaagtttttaaagaattttgccataataagttcgaccgccgacctctccaaccctcggtcgaccggttaaaggcgaattcaggaccctaaattaatttatttggctcttttttcacagtcaggctttttgattatttttgtgactttattcccatcctaatgccaccaacgagtaaaaaaacaggtattaataaagcaaattgaatttgactgggttctttaatttaaaaatttttaggaaaggctgtcgcaaaggctgtggaggccaagaagaagctggccaaaggccagcacattgtgcgcaagaaaaagatgcgcacgtcggtgcacttttaccggcctcggacgctgaagctggcgcgttcgccgaagtttccgcgcaaagcggtgccgaaacggaacaaactcgactccttctccatcataaaacacccattgaccaccgaatcggcgatgaagaaaattgaggacacaaacacattggtgttcatcgtggacgtgaaggccaacaaacatcagatcaaaagtgcggtcaacaagctctacaacatcgaagcacagaaggtttgtccactctttgttttggtcaagaaaatcgagtatatgcaaattggatgagcgcaaaactgaatttttggggccaaattttaattttaagtttcaacttttcgaacaggcacttttaaaatagcgccgaaataccttttgctcacttcaattttatttattcgtatagatccgcattcgacttaggcgacatcaatgatatcttcaatttcttaggccataacttttttctttcttagtcaatgcctaattctgttgccaaccgaaaactttcccagtattttttaaacataagaaaaggacgacattggtaacaaaaaaaagctatagcataaaaaaactgaggatagtcattgattggacgcctaaaagtcgattgaatttcgcaattgtgaccataaatgggaaaacgtccggtcctctaacaaaaaatcagtatttcgtcatctgtattaattatgttgcttgaataattatttttttttaaatatttaatgactatcaaatatcagtcacaatcacttgtatgactatgtctaattctgtttaggctatcgtgacttgaaaaaaaaataatttgaacctgatttttgacataggctcaaatgtcgggactttaagggaagggttattcggatagttaatacgctttatctcactgtttattcgtctaaggtcaacactttggtcacgcccgatcatacaaagaaggcgtatgttcgtctagccgccgattatgatgctttggacgtggccaacaagattggtattatctgatttgattctgcgctttgtttttttgttttttgcgcataaattgttgctgtttttctgtattgaattgaaggtccatatggaaaaacttccatttttggggtcggaattccgaaatttttgataaaaaacggaaagttttgtttttttttccaaaaaattagcaatttttacaatttgtgttaaaaaattgcattgaatttcaattggttcggttgcacccaatggatggatgcgacatgggtctccctttatgcccacgtgtgcccctatttggcgattccttcggcgccgtttccgtccctcgccctgcccagcccctctccaccattcactcaaaagggtccaacttgagcacgcgggtcgcggcatggagatcagttgcgctttttcaaagggtcgaacttcgacgggcggaccccgcttatccgtccgaattgctttgtcgcaccagggacaattgttgcgacaattcgacatcgatgactgggacgtcctctcctttgtttagtcattcagcacgagtgacgattctcggcaaaaatcccaaaatatgattcatttaaaaatcgttttttcatcctttgtttgtttcagatgcttccatttttaaatgcataaaatgaatttattgaataggtatttagtagaccggacgggcccgacgtgcttttaccgggcggcccggtctcgtttttttttgaaaaaacgggccggtaaaactggctttttggacttacgggagtacacgtaacgcctactaccgtatgcgtttacttttccgtgttattaaatcaaagaaaatttcagtttggaaaaatatttatgttagttatattcgtccacttctagaatattcccctgaatcgtggaatccgcaactaaaatcacatattattaaaattgaaaaatgtcaaaaatattttactcgaattgctttcagaaaatgttgtcttccatatattccctatgaccaacggctccaattttttaaattagctactcttgaaaaacgaagaaaaatttttgacctcctaactacttacaaaattttacatggttttacacatttggacccaaattctctgtttaaaagaactaacctaaatactcgaaataagtcatttttccggttaaatgttaaattacaatctaaaaaatcttccaaatcttttgttaacagatcagtcaaggcctggaatgcccttgataaaacgttaatgtctagctccttaaacgcctttaaaaaattattagaattgactcttgattctgaaagcaccaatgtataaagaattattaacttttgaggcattttattgactttgacctcgattttattttcatataaatttttcgttattgtttatctttaacctgtgatctcacttgatatttattcacttactctgtgactattttactgtgatcagtcatcagagtaagtggttcccgcccttctgatggcaatttttttttttttttttctttatcgaaaaagaatttagacgagtggcaacggtcgaagaggcgacggaaacaatggacggcacttcgacttctccgacgggtgccgcccttttttatcttgttctttccgtcttatttttcattttagctgatcttatttctgtacaatcgtcatcgaaacgtgccaaaattgccgaaacttacgctatttccatagaccggtctgtcgatttttatttatttttattctgttcataattattgaagtggagtgttgcaatttttcccctttttagttacaaaaaattccgttcgtttttgcgcaaagcttttgacgaaacgaatgtgtccgcgaatgaacccgcgcaattgacgcaaattcaaaacgaaattcagcaacaggccgggagtcagcctttctcacgggccgagttgaaggcggcatttgaccaattgtccgcggagaatatcattttcatggatcatgaccaaattcttctcttgtaatttcgttttatttattttattttttacttgtgtttggcgttttgataaatttggcacttttttcttttattccaacaaattgctaccgattcgtcgtctttaatcattttgtttttttccacatagttataaccgttaagcgtattttgtaatggccgctgataattttgacgctcaacgtattttgaacattttggccgagagagacaatttccaaagtaatgaactcgccgatcagttggccattgaccaccagcgactgatcggtgccatcaaaagtctgcaggtcaaagaaggggtgagcttttgtctgtttttatgcgtcatttattatcaaaattcattttatatcgtatctttacagaatgaccatgttttggtttttaaatagttaagtttaacaaccccgaaaacatttttaagagaaactttaaaaaaatttagaaattaatttctcaaaaaatgttcgagttcgggttagggattcggaattggtcgaaatggaggccggatttgttcacagcgccttaaaaaaacccctagaaaagtattagtattagaaaaattttcagaataaaaataaaataaaaattttcgggaccatgatcttcacaattccctttttagttggtttgcacttcggaagtcaaaatcaaacgcatcgaattgaccacggaaggcgaggaaattatccaaaagggctcccacgagttcaatgtgtacaaaatcgtcggagaaaagggcatttccaaatcagaaattgaagtaatcatgcaaaaaatagttataaacatttaatggatgcattctctgtcagaaaacatcctttggtcccatcggattgggcaaggccatgcaatgcgggtgggtgggcatggacaccacgcgacggagtgcctttggtggtgcggaaggtggcaaatgccgaggacggggccaaggagcaattgaaattggtgaagaacggaaagggcgaccaattgacggcccaatgcgtggcccaactgaaaaagcgcaaatggataatggaaaggtgcacaaaatgacattcagcgaaaagaaattgttttgcaaattttagcgcaattaaagccctttccgttgccaaagggccgaacttcacgacgactgtgcagaagcaggaattggatttgacttcggagatgattgcctcgtaaattgccaatgatgaccattttatttactcaatgtccatttcatgggttcgtggcgtggcaagcagttcaaacagtacaatttctccgcgatgggcgtgccgcccccctccggccatctccaccctttgctcaaagtgcgtgccgaatttcgcgacattttcttccaaatgggtttctctgaaatgccaacaaatcgctttgtggagagtccttctggaactttgacggtgagtaatttcgcttttccttacctccccttccctccctttagctttgttgcaaccccaacaacacccggcacgcgactcacatgacacctttttctttcacgtattgccccttttcttttacgttttttgctttttcttttatgttggtattctgaaataacctctttttccatttaggaccggcactttcaacagaattcccggaagattaccttgaaagtgtcagaaaagtgcattctgagggcggtttcggttctattgggtgggttttttcatacattttagtttttttacaattaattttcgctgattgttaagctatcgctacgattggaagttggaagaagcgcagaagaatttgctgaggacgcacaccaccgccgtttctgcccgtcagctttaccttctcgcgcaaaaagtgtcccttttcgatttccatcataatttctccgttgtttttctccgtccctccagcctttccaaccgtccaaaatgttcagaatcgaccgcgtgttccgcaacgaaacattggatgccgctcacttggccgaattccaccaagttgaaggcgttgtggcagaacgaaacctctcactggcgcatgtcatcggacttttcactgaattcttcaggaaatgcggtcaattagaaagattctttgtcttcctcatttgttactaattaaaattggaccatttaggaattgaaaatctccgcttcaaacccacttacaacccgtacaccgaaccatccatggaaatttacgcttttcacaccggactgaacaaatgggtggagattggcaattcgggcatgtttaggcaagaaatcattcattttatctatggctaattttgcatttaggcctgagatgttgcttccgatgggacttccggaagatgttgccgtggctgggttcggtctctctcgaacggtgggggttcggttcggcttaaatcagtctctaagcccccttttcaggccaaccatgatcagatacggcatttccaacataagagagctttttggccataaggcattcaccatttgctcactaacagataaattttttatattttcagattgatctcgaaatgatctacagaaaccctttgtgcaggttggagcagaaaaactagtgacgaaatgggagtgccaataaacattcgatgacttttttatgttgactgagctttttgtttgttttgttgttgactatgagtgatgagtgtaattaaagacattttattatctcacaaaattcttaagcaccacgaccataggggccactttcgtggcgagctcgtcgcccaggcgaaacactgcgcgcgcgcggtgctggctaaaaacggggtttttttccatttcctattcttaatcgtttcgttaccgtgccgaaaagaagatgcgatgcaagcgccaaattgaaatcaattcggtgctgaacatctgggaccccttcatctctttgctgacgcaagacaataacttcttgcagcaaggctcggacttggtcttgcacattttgcattcggacgtgcaattcctaagagagaggaataaaaagtgggaggggaaggaaagaaagaaaaggaaagaaatgggaggaagtgaaggagaaagagagagcagcaaggggggaggaacacaggaaaatgaggaaaaagagtaagctaaaaagagaggaagaaaaggaaaaaaaggtggaggaaaaaggaagtg

SEQ ID NO: 4504 - DNA, 1520 bp, Heterodera glycines
aatttcagcgcgtgttcgaactgtttccgttagtgatttgtgccagtacgcccgacttgctccattggcgaagtccattcagaatgatggagtacagcaaattgcgatattcggccagaatttcacagctcgcggggagaatcagcgagtgaactgcaaagaatggacaatatgattttgagagtttgtcattagaatatctaaacagttcgagacttgttgtcgacgtgcttgacgaagtacagcttctccagaaacagttgatgctccatgtgcggcccgacgcacgtccattcgatttccaacagcgggtgcgacttggacccgttcacacaatgtttcaacacatccgtcgacgacagttcgacgccgcaggcgcggttccggtgtgtggccgagttttccatacaaatgtcctcaaatcagcgccgcttttgcctaccctcccgcctccgtttacctgtgccgattttgaaaatcgatcgtgcagcagagcctgggaccagtagcggtcgttgtcgaatgtcttgtagaaggcactcagcttgttgacggcgacctgctcgaacttcttggcattgtcttgcccctcccccaaggggttattcgtcggaaggttgaaaagttcgtccaacgcattgaccaacgaacacctatttagagatgactcattctttggaaaatcaattcgcgtattcactgactttgagtcatccaaaaatttcctctttcgctcttcgtccgccaccgtcggaatgtcctcctttccctccaacaatttcagcgcgtgttcgaactgttctccgttcgtgatttgtgccagtacgcccgacttgctccattggcgaagtccattcagaatgatggagtacagcaaattgcgatattcggccagaatttcacgctcgcggggagaatcagcgagtgaactgcaaagaatggacaatatgattttgagagtttgtcattagaatatctaaacagttcggacttgttgtcgacgtgcttgacgaagtacagcttctccagaaacagttggccagccgtttggggtcttcgctgcacagtgtgcgccgtcaaatcgcagcattcgacgcccccggcgatgcatccgttggtggcaatgtcattgcgcagctccaccacttgaatgccatcttaaaaggcatttcggaatgggacagcactttgtctgggctgtacctcgctcttccacacattccaaatgccgggtggggtcaatgcgcaaatagcgaacgcgtgttggcagtcggagagtgtctgcacgttcggccagcagcgcggtttggagcagcgagtccaagaaggtcacccaattgccggtccagtaaagggtgccgcgctcaccgctgttgcaagtccggtaaatgccttgagggactttcgtgtcaaatggcgcggaatgcgggcgcccgttcacctttgaatgcctgtccgtattcgtagcctctcaacaaaaactctttgtacgcgtcctccgtgtccaactccgtccgctc

SEQ ID NO: 4505 - DNA, 4771 bp, Heterodera glycines
  misc_feature (4675)..(4675): n is a, c, g, or t
  misc_feature (4684)..(4684): n is a, c, g, or t
  misc_feature (4704)..(4704): n is a, c, g, or t
  misc_feature (4722)..(4722): n is a, c, g, or t
cttctttttgggtgtaaaaaaacttatacttgtaggcacttttcttaaaaaaactaatgtcttgacagctttcccctaagagaatagaataaaaaatagtttaaataatgacaaaaaaatttcggaccaaaattctggtatgtagaaggggagaatttaaatctcgagctaatatgaaataatcagaaagggcacctaaaataatagtttatggaattgtgccaaaaattgaaatccatgtactatctcaaacataattttggtatctggtttatttataaatttatataaattttttatccaatccacatgaccaatgataggttaaatagtgatagttggcacctcttggctctcaaccttagctttgcttgacgacaaggttcgttttaaagattaaaggttctcactgttcacttgaggataatcgaactgttttaacactttcgactgcaattaaataattttttttaatagctcctgtcccttcattcttgacagagttgcccgagggctttgatcataaaaactcagattggaaatggctcggatgagcggtcaataattcaaatattaaatccttcagcttcccctgtgaggtctccttgttaataagctgctgtgagtcatttgtactgaaagtttcatttcgttttttgctaataaacctatctctatccatgatgatttcttccattaaaaaatcagggatttatcgggtacctaaggagccacattcgcatggtaaacccagtgttttctgaacctttagattattctcacttgtcttttttggtttgccaatacagttacagtaccccttaaaaattcggaaatggtccatctttgaagctaagagatctccaagcttctcagtctgagaatagacttggtataaaattgatcaggtttaagaaagccaaaaggattaaaaaaacaaatccatgttaggagcctatcaaaaatttcaaaattctcctttcctgtgagcttaatgaggaattcgcaaaatccttccgctttttgaatttgcaaagagccctttgtgattagtgaattaaggcttgatttctgttttttgtttgtcatatcattaaggatttgtatcattcaaaatttgagattagggtaaactgaccaaaagaataataattataattcaaattttatttctcttccataacttgacagattgccctagagacaaaattctgaaaaataaatattcaataatttgtgatgactaaactgtctcacaaaaaaaaaagtcaatgccataattataactccggtacagtcggtgagagtaataaaaaaaaaaaattttatgcatgcacgggcaaacttcatcatggcgaaatgggtatccaatgacccaaaaaataaaatgttttcacccaccatattttgacaaaaggcacaaaagccgtgaatatttttttttattcagagagccgagagagcagaatcagaatttttggccttttttcaactaaattttgccttatgcaaaaaatggatcatcacaaaaaaaaattgtacttctgctgatcataacaatgttagggcggtctgaaagttcctcaatgtaaaaaattgaaaaaaaaaattggccgtgagcggttttaattttctgtttaaatttggaagcatataaaatatttttttttaataatttgagtggcctaataacttccggagcagtctgttttagtgcgtgcacgcagggtaaagctcagcaaaatgtctccaatattatgtccaaacaaaaaacatcaaaagcggattttttttctcttataaggctttttttttggcgattaaatttcaaaattttaaatcgcccgtttaacaaaacattttctgccttagtttggattcttaaggctctttggcacataaattttcaatttcgccattcaacatgaaagaattcccgaaggagcgacgttccttaaatgtctaggcttttgctgatatgaattaaattgcctcacaaaaaagaactaaaaaataattattattgcctgtaaaaaaataacattcaattgcattaagcctcattcactcaaagccattgaactaccaaattaaacgcttgaaatggtccatttttgggtagctaaaagagattcaagtttctcagcttgaattttgtttgtccttaatatatttggtagcctttcagcaaaaaagtttggttttaaatttcaaattcttcacaaattatatcgattaatgaattgagctgcttgtaaaataacctatttatgttaatttaatttccatgcaattaaggctctgactggaatagtttcggataaaaaataatggcatccacaattcattttctagtccaatttaagatagtcccaaaattgaagaattagactaaaatcggaatcaaaataattctctgataagaaatattgaattttttttaccatttcttgacaaataaccctagggccgcaatttagttaaataaatatttaaaaagatacaggactgaatatgtaagagagacttagaatgttagcctttttgctaaaataaataaaattcctcaaaaatctcaaaaataacaataaaattatattgacaaatttttgtaattaattgcttttgcattttaatttgaaaggctgagaaaatttcagaaaattgctttaagtggcttgccttcacattccattcttcggcgttttcaggggtgtaatgcatttccggtacagtcggtgagaataatgaaaagaaaaaaaaattttatgcacgcaagggcaaagttcacaatagccactgggtattcattacctcagttggcaaaataaataattgagtactttttcatcatccaaaacttgacaaatggcccaaaggccgcaaaaatattctttattctgatgagagccaaaagcgagcagaaacatgctgcttgaatttgtttggcctttttcctcatagacttggcctggcctataaaagaattttgacttagcataacattaggcggctctgaatgccttttcctcaatataaatttaaaaaataatagcccggagcgctttgagtttgctattaaattatggggagcagcacagaaaataaatcatcctttcgcttaattatttccggagcagtcggccttttacgcgcagggcaaagttcatcaaaaaattccaaatactagggcaaagatttttatgtaagagaaaaaaacgctaattacaattattaaataaattatacattaaaattgccaaagtaccagttttaaaaaaagtatattaacatataaatctttgccctcttaatatgcccaaacaaaaattaaccaatcggcgcaatcatcaaatctgtggcttcaactgataaataaattggggctgtcctcaaaatttataaatttatttggccattgagcgcgcggcaattcataaaagttatttaggcttaaaataggtcttttcacggcacttcacaaaatcttggccattaaaaaattggaccggtccttgacagaactcccgaaggagcggcgcgcctcattccgttctcgttcccctacacacgcaaattcccgctcgtcctcctggggatggattgccagcggcgtgccagcaaccatccggtgctaccagtgaaggtgctgatgtccagcccagaatatgaggaagggacgagggaaattggggattggatttgggggaaaaaaggaataagccaaaatccgggccctggataaatgacctccccaaatttgtaatcccatgggcgcctattagatctaatacgcgtgcggggatgggcgagaaggagtaaaataataatataaatattggccaattacattaataataattccgccgcgttctgctctcggctctcgctcgccgattaactgcccgctcaactgaccccttatcgagagaatgctcccgattaaatagttggacttatggaacggaataaagatggggaaaagcggggataaatggtgtgagaaagagattgaacggatgtgataaattgcgccttacaatttgaatttatattttaaatttagtgaactatttttgaactcaatgaatttcgacatttgtttaattatataatagtttatcgctaaataatttaattttttgttatatttttattagggttttcactaatcatttaatttttctttaattcaatcgtggaaagcgacaaaaaaatattttggcataaaattccagagtcaaaattgcttaagcaattttaattatctacgctttattttatttatttattattcataaattatctttttcattcttggaaagaattatttacccgtggcaagaggaaaatctaattttagcaaaatatttttgaatcattttaccattgttctcaatcggatgaaaatataaccctatatatttaattttgccttctttgccttttatcattcaaattatcataaaataatttttaatatttcattaatcataatattcattataatttttttaaatttttgtttaatttttgaaattaacaaaacttgatttaaaaatgcagaagttcgtcgataatgtatggcacgtgtagatcaaataacccaataataaatatcatctgttattcgatattttaaaagttaattttttcttttcattattccacttanatttcgaanaagcattctcaataatgttntattttttatttttttanatttatttgttaatttttaaatgaagacgaaatttataataaattaata

SEQ ID NO: 4506 - DNA, 4552 bp, Heterodera glycines
tgtaatggatttccggtactcggataatgcactgtgagagaaaaaaaactttggccgattaagcaatttaaagtgtaaagattaaagtttgtcagcataaaataaaacaacaaaataaatttaattaaaaatcaacaaaatgatactcagcaattaggtaattaaagcatatcgaagatttttatttgatctgacggattatcatggattgatttacaaattttaattttggcctcttacttgacggtactcccaaaggagttcaataaatattaaacttttttttgctgacaaaaaaaaggaatacagaaaattcttatttcttagcaattattcgaagagagcgagcagaataaataaatttcttataaaatggtcacggcgaatggggcagagcaaatagaaacgaattttggcgcaaataaaaaaaaggctcctgcttttgggcgcaacattagacttgccgtttggcgcaaaatatgtaaattggcctattatttttttagcgcaaaatgaatttggcgattttttaaatttattttttttttaataaaacaaaaagccttcccattataggggcaaaaaaaaaaacctgaaataatagacttactgtttggggcgaaatattaaatggtcatttctcttttagcgcaaaatgaaatttgcgatcttttttaaaaataaaatgaagacttcccattttggggcaaaaaaatagaattgccattttgtcgcttgacttgcctttctggcgtaattacttttagcgcaaaaataaaattgtttttttagtaattataaattgacttcccattttcggggcaataaaagtatccaaaatataagttttcccattctggggcaacaataatagacttcccatttttggggcaaaaaattttaaaatattttcaaattagttcgaacttggccatttaatttttttgatccgaacatgactgatctcccgaaggagcggtgcacctcattccattctcgttccccaacacgcgcaaatcccactcgtcctcctggggatggattgccggcggcgtgccagcaaccatccggtgctaccagtgaaggtgctgatgtccagcccagaatatgaggaagggaacgagtgagaacgaggattggatttggggggaaaacggaataagccaaaatccgggccctggataaatggcctccccaaattggtaatcccttgggcgcccactagatcgaatacgcgtgcggggatgggcgagaaggagtaaaataataatataaatattggccaattacattaataataattccgccgcgttctgctctcggctctcgctcgccgattaactgcccgctcaactgaccccttatcgagagaatgctcccgattaaatagttggacttatggaacggaataaagatggggaaaagcggggataaatggtgtgagaaagagattgaacggatgtgataaattgcgccttacaatacccaatttaaagaattaaataatttgccacaaaatattcaaaatggcgaatgctttggcattttaattgagccagaggatgaggaggccgaaatagagcattactcactccattttgaaattcatgtgaaaccaatgggaaatgagtgccaaccgtcacaggcggatgaaaatgatcaaaatccaccggcggatcaaaatgatcaaaatccaccggcggatcaaaatgatcaaaatccaccggcggatcaaaatgatcaaaatccaccggcggatgaaaatgatcaaaatccaccggcggatcaaaatgatcaaaatccaccggcggatcaaaatgatcaaaatccaccggcggatcaaaatgatcaaaatccaccggcggatcaaaatgatcaaaatccaccggcggatgccgaagacaatcggacaatattccgaaaaatctcattaaaattgtacaggccaaacatggcacaggtgtacacggttaatttgggcaaaattgacccgcccgaattgtattttaaccgcacaatttttgtggccaaagaaaatgatttgaccaattatcatgccttattgtatgccctaatgcacaaaaatcaagaagattctgatcaatattatgatctgttgggctatgtgcaactgattaaaatcaaggacgaagaagaacaagaagcacacgccagctcacaatcagaaaagaaagtaaacgcaaaaagcgaacatttttaaatttgaatttggcattatgtcccaaaatcggattcgctcagttggacgctcaaggttgagcgccagcaagcttttccactacatatcacttttttatttgtcatccaaatccaacaatctttgtatcattcgaaagctcttcccatgctctattagcgttacaaaaagcgaaaagattttcatgcctgggaaaaaaaaattcaaaaatttcgacttttcgcaattttcatgtataaccttttttggtaattgtctaatcgcgactcaatagtttagaaattgcttgcttgtaaacatgttaagagctttcgataattatattattattattatgcaattttcagttcaataaataccaattgaaaattccaattaatcaaagtgcgcttttcaaacattgcattcataccttgacgttgcaaatttgttcttttgaaaaggtacatttattaatattgcaaattatttactaataaatgaaaattaaattttaaaaaataattgaaataattttaattttttgtatcttaaatttcgaaatatttcaatttactaccgaaaaataaattatcaaaaaacaataataatgtgtgctaatcacttaagatgctgtttttgcaaaaatgcgttaaaaacgaaaaatatacccttaagaatcgatcctaaaatttccaaaaataagcacccctaataaatgtaaattttcttaaaaattcatctccaaaatttattaaatttttgttgacaataatttttgattttaaaaattatttattcaatattaatttggcttaatttcgttacctttttgaataaatttgttcattttacacccataaatttgaggctttttagtgcctattttggctgtttttaaagcctaaaaatattagctctagtaatcacatccaaattatagaatgaaaatcacaatgaaaaaatggagaacgaagaagaaactgagccgaaagaatgcccaatttgttatgaatcatttgatgatgatgacaaattagcaatgaaattgcatgaggattatcaggctaataatctcaattaattaattaataattaattaaattaaatgctttagcatgtgtttcacaaggaatgcatcactcaatggtaacaaaaatgaattgaatgattcaaataataaaaccatttttaggattttatccaacggacaattattacgatgtccaatttgtaatagaaacgcatttcaagtcattttggtacaattttaatcgccataaaatattattattagctggtcgcaattcagggatttccgtaataaataagccgtaaaattaccatgactatgggagggcctgaaatgcgcgaaaaacatattttagcttggtttgaagcttctaggatggatttgtatatccatattgtggcattatgttttcatttgcagatttatgtaattaaaaaatctggcacacaaaaaaaaaactgaaaaattttgactcaacaattttgtcacaaatttttttaaaaattaataaaaattctaaatctcatacaaaaatgcaaggtcgtttaaatgaattcttagaggtgtattttggatttttttttctcgtttctttggggtgtgttttcattttttaattatatatttttgttaaggatttttcctaaaagcatgaaataggcgccaaaagtggcaaaatatgcataaaaactccgccgaaatttgcctaaaattgacagccgccctaattattatcattgatagttttttcggttcggctctcaacacgttttaacttatttaggtatatcttcaaccaatctttgatggacctgctgctgtccatctgccatcaacttcatttttgtatttggaccctttggcatttttattcaatttagcggcgaatggaggacaaaatgaaaattatgacgaatttaaaagaaatcaagcaaaatttgcaattaaaatgtgtgaagaatttgtgcaaacatatgaagcccaattaaagcaaattgctatggaagtagcagaatttgtgaatgtgaaaaataatctgtcggcggagcaaaaattgttcgaaattgggccgaacggagtgaaaaacaatgacccaattgttgaggagattaagcagctaattgccgaaacgctttcaaatgggcaaaattattcggcagaaataaaagcaaaaacccaccaaatgaattctttgatctataaaattcataatttggactcttatctttatttggcttcattcattgaaactatgcaattgatcagtgaaaattgagaaaagagacaatggaaagaatgacgaaagaaaattgttgctgatt

SEQ ID NO: 4507 - DNA, 1210 bp, Heterodera glycines
aaaattcggcaggttaccgccaccaaatttacgattcaggaaaaagaaaagacggtcattggcattggtaaaggcggttaccctccccctccttcctcccgaccattcgcccttttggcggcgaaacgtttcttttctcaaaaagggctgtgccgtgtttgcacgtcgttctaatgccaaatacttccacttcgatgcactttcgtccctcccctcagatcactccccaagttcgcactgctctgttcggtcccaatcagaaccgccgcttcttcgactgatcggtcccttcgcttcgaccattccattttattctgttcacttagccaatagtcacaaaggtagcgacttgggactgatgctgcaaattcggcccttcttttggctcttgttttctatggatttcgccggacattcgcttttccacccattgatcataatttgtcacttgcaaataatgcattaccaagtaataaactgtcatttcccatgccaattgggcactgttttctctttccatccttcgctgttgtcgttttgtcatttcctccccccttttccccttttcttatcgctctcctcccccaatcgtttgcctttccttttgcttccccccaatcacttctttcactttccgtttttggttgcttcgttggcttaccttttttgccttcccatttttcccctttttggtggtgaattattttctcaatttttcgccttctctttgagcaattgccaattgtcccttccttttcgaccgttttttctatttccgtcgcttttcctcccctcccaaaatgggcgaagttcgctttcactccgattacgtttcctccaaccgcggaatcaccaaaatcatccaaattgtgctcggttttgtcgtctgttcggtgctttgttcgaattggtgtcaaattgcaaattaacgtggtaaaaacacacaaaacattttgaggtatggcgggtacagctgtttcggggagggccgcctcggttatgtgagcggattgaactttgtctgtttgatgattaacatgtgagttgagggaaggcggcactgacaaagagcaaacgcaaatcatcgcctgaggaattgtttgttttcataataataattgatataaattgtcggattcccccccccccccaatcggttgtcttttggtaggctaattgatcaacaattcactgatcagcagctgataat

SEQ ID NO: 4508 - DNA, 3601 bp, Heterodera glycines
gacttttctcgagtcgagaccgagatttttttaaaatcttcttgttaaattaaaagtgtattaaaactttttacaaaatttaatcgatttttgaggcttttctaataaacttttcttttttgaattttgatgattcaattacatttttatcaattcaacgttaaactaattaaaaataatgaactttttttcgataaactaaatgaaatcaaatatatatttttgtataagtacaattgcaaaattgaaagtttgatggattttttcattaaatatataattaaattaacaatacttgatatttatttattataattgaatatttactaaaactttaattcaatcggcattgcttatttggtaaaattgaaatttctccattgcaacctcgttggccatctttcgtcgctccctccactcagtcttctgtcctttgtccatccattgcttgctgtgaattttaaggccttttgtatccaccaatcgctgctgccgtgccgttcttttgttcaaattcctagagtggagggggaaggggaaccagagggggggggggggggttggtgctgtggtgtaatgggccaacactgtgtttttgaacggctgtcaccattccgaatccccaaaaataaaaccgaaaatggaagaactccaaaatttcacaatgaacagttttttaacttttggtcccaaattagcgttgtatatccttgtgaaagaatccaataatttcttgttttttactcacacatttcgtggcattttaattgattttttgcagtaaatgtgaattttgttgaaaatttggaatttcaaatttttgttcgaattcgggtccggggttcggaattggtcgaaacggatgccggattcgtgatcagcgaccccgaaaacctattaattggcattttaatcatgaaatacgaaaaaaaatttatgggggttaaactgcataagagccttggcaatgtcttaataagctgataagattttgttttccttttgtcagtgtccgattgttttgtttggttttgtttttgggttccattttcatttttattgccttttgttgatcttttgagcatccttttcctgctcaatctgttcaacattcgtccactgaaacttgaacaattgtacaatgtcgccgccgcccttcttctgctcgtcggcatcgtccttctgttatggtacatgatacagtactcttactggaacatttggatgataatcgcagcggtaccttttgctaattgcctttcgccttggatttgatcacttttgtttgctttttgggtctgtgtgctgatcatctttttgctctttcaatgggacttcaaagggaaccgcacaatgtccgaagggcacttgccaatctgacgagggacggaaaacaaacggaagacataacgccaaactcaccgcattttcaaataatgccaaatgcttttctttttgaaatgctttttgaacatgaaaatgcctttccatttctttatttttcccgttcgaatgcttttcctctgccgtcctttggtctgtccccgcccattttcgcctccgatgagataaaatcagccgaacgacgcgggaagagagcaaatgcccgttttgctcattcattcatccgtattccctctcaacccccactcgaataaatcagtcgttttgttgggatttgctttgattagcccaactttgctcctcctagccttgttccgttttccttcttctgatgtcagagtattccaaggctttgctttctgaggaagcggagtatccgtgccaaaatgtcaaagccaatgaacgcgtcgtggtaagtgcccaattcggcactcccaagacggaatgacttaggctttggctgttttgtccgcgttcgtcgacgcggtcatttccgctgttctgctgtccctttggctgcccttctctctgcccctttggcccctcttcggtgccattttcctctccactttttacgcctttcgtcgctccaacccaattgctcttcgtcctttgctcattttgctggtttttgagtgccacattttccattgaccgtttgtttcttcgtccctttcaaatgttcgctttggcgttgtgtcccactctgttcgttgcgatcgtccttttctctgtccacgaccctttccgtgccgtctgtttcctcaatggtcccatttccctgctttttccccaactttccctccgttaagtttttctgccatttgtcccttcccattcgtcgcctttcgccgtccttctgcccttttgttttgtcctcttctgttcgattttgtacttttactggcaattgcacagcttttggcattgccaaaagcattttgaggagacaaagcgatgggacaattcaaaaatgaagggatacgccgaattatgtgagaagagaagcgattggcgcatagtcaactgatgatttgagaacacattcagatgtggccgacccctttctcagttgtgtttctgctgagaaacagcgattggagcaaaaacagtgagtgccatggacaaatccatggagagggcacgggaaagggttcgggaagaaatgtgggaaaggattcggggagcgtaaggggtaggacatggaatgtgccgcccctgtgcataattcagaaaatttaagcagcagccccccacaattttttgcgccaaaggtactcgctcggccgcttcgcggcctcgtactggtgccttcggccccccacaattttctgcgccaatccaccatcatttaatcactgggactcaacccaccaacattccaatcaacgggactcacccaccaacattccaatcaacgggactcaactctccagcattcaatcactgggactcaactctccagcattcaatcactgggactcaacccaccaacattccaatcaacgggactcaactctccagcatttcaatcactgggactcaacccaccaacattccaatcaaagggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcatttcaatcactgggactcaacccaccaacattccaatcaaagggactcaacccaccaacattccaatcaacgggactcaactctccagcattcaatcactgggactcagctctccagcattcaatcactgggactcaacccaccaacattccaatcaaagggactcaacccaccagcatttcaatcagtgggactcaacccaccaacattccaatcaacaggactcaaccctccagcattcaatcactgggactcaacccaccagcattccaatcactgggactcaacccaccagcattccaatcactggcactcaattctcctgcatttcaatcactggggctcaaccctctagcattcaatcactgagactcaacccaccagcattcaatcactgggactcaacccaccagcattccatcactgggactcaacccaccacattccatcactgggactcaac

SEQ ID NO: 4509 - DNA, 3421 bp, Heterodera glycines
agtgatgccatcaaccaacaaacacaatatggagggtggaaataatttcaaagcctaattaacggcacatttctattcgaagccgtccaaaatctcttcgaacagatttcgaaattaactttgttaatagtgccgatggtacggcaaccctaaagaaggggttttccggtggtgaacacaaatctgactaaaacttttctcttcaaaagctaaactcagctcaatcatttgaataaaggttttctctcttgatgaagaagagccaaaagcgaagcgacgagccgaggaagagggccaacagcaaaagcaaaaagagacgaacagtcaaatcagaggcagcggatgaggagaaaaggaggaagataactaatgaagaaagtgttgatttatcgaatatgaaatgcaaaccaaaaacgacaaatgcaaacaatattaaagaaaaggactttgggttgtgctgagggagtgccgctgaaaagcgtttacggcacgctcatttggtcgagaatgggctcattacatttacaaaattagtaatgatatttaaacgaggaatatcaaacacagaaaatgcatattcattcatccatacaacaaaaaaatctggtagagaaagaagcgagcaaaaaagagattcggagggaaattggcaaagaaagaacaaaaaataaaaacattaaatcccgccactgttataattagcagtgttaacggagaaaagagagagagtaaaaccattccaatttctaatttcaagttttcttttttaatacaaaaagctcacttcctcttttcctgtttctgctggccacatttccacagcagagggattttccgactgacaaaaaaacattttttaaatattgtacaaataaaatgccaaatatagaggagtgattaattggaagctcaaagaaagctttaatttgttgagaggcagcacggaagacggtggaggaatgagtgaggagaacaaatattacagacaaatgttataaaggggagaaggaatccgactcttttgaaataaaaaagttcaccttacaaatgccaccttacagctgctattgtcgtcggattcccagtccttttgagagagaaatgaatgattagaaaaaagaaacaacaaagaaacgaggagtgacgcactgaaaggagaaatgatgatgatgaatgattgtaatggtgcaaattagtggaaaatataaaatcattaatggggggggggaagaagagtgcctttttggtgatataggacaatgaatgataaaataacaaacaaaacaccatcaaaaacggccgacaaaagctggagacgacggtcggacggaggaggtggagggtcctcagctcagccaatcactttaaaatgctggaggagagcagaagggcactgtccgctgtgtccgtgccaccgccgacggggagccgaggcaaacgacgtctgaagcgagaagggtgacagggaaagggcgcacagcacacctaagccaagggtgtttgagcgcctgtccgggcgtcatcctcgcctcggggtcccagtcgagacaccgcttcagaaagtccagaaagaggtcgtccccctgaaaaggcacactttcaatatgaaagagactagcaactgcaggacaacgaaaaagtcacgtcgcggggggggggggggggtcagagaactttacccacctgatttttcagtgcgctctgcattgttcgtgacccgggcggtcccctcagtttgcccctttttgatcgtcccccagtcagaacggtggtgccgtccataagctgcaaggatgccgaatttagacggagatttgcccgtcccacctgagtgacttggcaatagcgcgggtgtcccttggatgaaaagaagttccgagatcgctttgcgccctccaatagtttcggatttggcattcccaaaagttcgatgaccaatgctaactgaaaatggaccaaacgtaaaccttaaaaaatttgctgatttaaacatcgaaatgtcattgtgcatttcctttcaccaatcgacctgatcattttcatcttcgccaggtaacaatgggtagcctgtgagcaattccgccagaatgcaacccagcgaccacatgtcaattggcattccgtattttgcgccaagtatcactaaaagaatttttaattcactgcctaatgggcgtgtaaatgccttctggcgccctataaaagcgcgattggatgtatgtgtaaatacgctggtcgtcaaaacaagaggagccgaagtcgatcactttgatcgaagatcggtttggcattttgagtaggacattctccggtttcaaatcacaatgaatgaggtggttcctgtgcaacaattccagacattgaagcatggaatgcgcaaattttctgacaagctaaaaaagagacaaaattcagaggtgtcaccaattggcgatgaacactcacggtgagattgaacccttggaacttgtttttcttgatcagttcgtacagattgatgctcatcagctcgaaagtgatgcatttgtgatttcgaaaagtgaagtggtcgagcatatggatgacattgtgcgacccgtccccgtcttgtttcttcagatggtccaaaatccgaatttcctcctccgcttgtctatggaagcgtttctcgttccggacaagcttcagcgcgacgtattgctggtgcttgtgatcgtacgcttttatcacctgacgaacagaaaattgttgaatggcaaattgtgtaatttccatttttacctgtccaaaactgccctttccgatcactttgagaatttcgtaccgatatgcgatgtgatcgtgggaaaccaacgcataagagccattctcgtcgtcaaaatttgagttgttggctccacccgcaacgcaaagtcgtttcttggcttgtgaaccaacgaaatatacctaaaagtgatgccaaagtatttaaggccaatgacaaaggcgcgctttgcccggctcacccgttggtagttgaacagctccgtgtgttcataaggagtgagcttggagccgaagatcctgagtgcttcgtctggtcggtaccctttgttggcggttggtcccttaaatgatgcgttcgttagtttctcaatgattgcattttggttggtctgttagcagcgcactgttaacctctagaagccctgtggttaacccgtggttgtcttattgtatttattcaatttagctcaaacgctcatcgtgggggaaagaggcactgaaacacaagggaacccaaggcattaaaaatttagaaaaaattacaatatgcaaaaaatttttggaccggaagagcaagcaaataaaaagaaagctccgggtgcccttcccgaattttttttggctacgagcgacttcagcaatatttgttttgtgtgtaaatcatatggactctaga

SEQ ID NO: 4510 - DNA, 1924 bp, Heterodera glycines
  misc_feature (20)..(20): n is a, c, g, or t
ttgcccagttcagtccccgnttgaataactcatcagtctttgacctgagcgcagggtggccagcggacttattgtatagctcggtgagctcgatttttccaaatttaaaaatttcgaaaattttcaaaatttttcgagctaggcctaaaaaacggtttttgggtttttgaattttagtattttttaacgaattttcccagaaaaacgaagaccacttccaaaacatagtttttcgagctctatcgactggtatttttttcggaaaaatttcgattttttcccggaaatagaaaaaaattttggcctcagcgggacatttgagtcctgggaccataactggtcaggggttggttttagccaaaaagtgccttagaccaaaattgtagagctttttaagctctatcgaatggtgtactacatgatgtaaaattttcaaaaattttcgagctaggccccctagaaattttcaaaaattttttttgggttgaaaaagatggtgaaaaatatttttctggggttttttggggtgctgagtacgaatatgatgtctattttaagtttcataatttttggaattttttaaaaattctttattttttggcaattttttggccctcgggattttggcctaatatttgaaaattcataacaaatcgaagggttgatcaattttacaggaataaagccttaaaaatagagaaaaataaggagaattttatgagatttatttggttttataatgttcgaaagaaaaaaagttattccagaatttctggaaattttcgatttttcagaaaaaaattcataactcggttctgaaaagtcatactgtaaaagtaatatacaaaaaaaatccgcaattttttgctctattatataaattttatttggcatttttatcacttttttgagagatgttacaaaaacaaaagtgattttggggttcgggaccaaaggggggtgacaggatttttgactggaaaattttttttcacaaaaatcttccaaaaacatgtcattaggggttaatttattttataatttttaaaaaattattaacacattcaatttttaattatattttttataaaaccatttccttatttatttaattttgaaaccatgattttacccttttaaactattatgtaccattcctacaatttttgtacctactaataactgttgtactcttctaatcactgttttgcctcttctgatcactgttgtacctcttctatttcctgttgtacctcttctaatcactcttgtacctcttctaatcaccgttgtacctcttctgatcactgttgttgttggacgcgtgcgggcgcttcgcgcccattaaaatccaaaaataatgtaaaattacttaaaatattttgatctttttaaaaaatatagaaataaactaaaaacagtttgaaattaccttttacatggttaaaaatttaaaaatttagcctattaaatatatttttttaaatttattatatttttttttgaaaaattccgacttccgacatttttggggtcggaattccgacttccgaaaatttttggggcatcggaattccgacttccgaaaatttttggggcatcggaattccgacttccgaaaatttttggggcatcggattccgacttcccacttccgaaaatttttggggcatcggaattccgacttccgaaaatttttggggcatcggaattccgacttccgacttccgaaaatttttagtgcctcggaactccatccctggtgcttagcgcccgtttttaaatattttaattttttttaggcctaagaggaagttttgcaacaatttcaaatttaaagaaaaatttaattaccagactttaaaaattaattgaaaaaagtaccggaaaaaaaaaatttaaaaaaaaaaaaaaaattaaattt

SEQ ID NO: 4511 - DNA, 4812 bp, Heterodera glycines
  misc_feature (47)..(48): n is a, c, g, or t
  misc_feature (60)..(60): n is a, c, g, or t
  misc_feature (62)..(62): n is a, c, g, or t
  misc_feature (65)..(66): n is a, c, g, or t
  misc_feature (4795)..(4795): n is a, c, g, or t
tttttctggggtattttggggtgctgaatacgaatatgatgtctatnntaagtttcatantnttnnggattttttaaaaattctttatttttggcaaattttttggccctcgggattttggcctaatatttgaaaattcataacaaatcgaagggttgatcaattttacaggaataaagccttaaaaatagagaaaaataaggagaattttatgagatttatttggttttataatgttcgaaagaaaaaaagttattccagaatttctggaaattttcgatttttcagaaaaaaattcataactcggttctgaaaagtcatactgtaaaagtaatatacaaaaaaaatccgcaattttttgctctattatataaattttatttggcatttttatcacttttttgagagatgttacaaaaacaaaagtgattttggggttcgggaccaaaggggggtgaccagtatttttgagtggaaaaattttttcacccaaaatcttccaaaaacatgtcattaggggttaatttattttataatttttaaaaaattattaacacattcaatttttaattatattttttataaaaccatttccttatttatttaattttgaaaccatgattttacccttttaaactattatgtaccattcctacaatttttgtacctactaataactgttgtactcttctaatcactgttttgcctcttctgatcactgttgtacctcttctatttcctgttgtacctcttctaatcactcttgtacctcttctaatcaccgttgtacctcttctgatcactgttgttgttggacgcgtgcgggcgcttcgcgcccattaaaatccaaaaataatgtaaaattacttaaaatattttgatctttttaaaaaatatagaaataaactaaaaacagtttgaaattaccttttacatggttaaaaatttaaaaatttagcctattaaatatttttttttaaatttattatatttttttttgaaaaattccgacttccgacatttttggggtcggaattccgacttccgaaaatttttggggcatcggaattccgacttccgaaaatttttggggcatcggattccgacttcccacttccgaaaatttttggggcatcggaattccgacttccgaaaatttttggggcatcggattccgacttcccacttccgaaaatttttggggcatcggaattccgacttccgaaaatttttggggcatcggaattccgacttccgacttccgaaaatttttagtgcctcggaactccatccctggtgcttagcgcccgtttttaaatattttaattttttcttaggcctaagaggaagttttgcaacaatttcaaatttaaatgaaaatttaattaccagactttaaaaattaatttgacaaaaagtaaccgtaatagaaaatttaaaaaaaataaaaaattaaatttacttaattatcgatttattggtatgaaaaattttcaaagacctgttgtttacttgagtaaacaaatcgtgggtcaatattattgtttgttgaataaagaacgtaatcaaaaacttacgtacttttaaaatttgctcatgttaatggtcatttggtttagctgttctcatatttttttaataattaaattattttactataattttttattttacatttttaaatcattaatttataattaatatgacccgttttgggccagtgaaccaaagggccagtatttcgccgccccgtttggttgcgccggagttcgtcgtgctacaaattgggcaagctgctgtaagcagccaacaatcgcaacaaattccagaaaatgtccatttgattaacaaagaagagggggaactttcggattctgggggtgaatcatcagatgaaattcaatttgttgcaaatgtccccgctcgcggacaaaatccatccgcagcttctgagcaacgccgggcccaatcttcagtgccgagaatggcttggaaccgacgcccaccactttctgtcagctattatgtttttaatggggtgcaatagaatttattatttatgaaatatttttttacttaaatttattaaaaattgtgctcatttaaagcgacgttccttcggcattggacaccaaaggcagcaatatcgtcacattttgccagtatgtaaaatttaatttaatctattaaaagaattttaatatgtcaaatttaatttaaataactgatggaaaattttgaaaaaggtccgcatttataatggaaaaaataaaaaatttgtagaaatgtactctaaaatcgattaaagaaatcctctttttttaaatactgatttatgtaatatttttgattatttacattctctctttcgttaaatttttgttattacaataaataattcatgcccttcttattaaataagtgcctttttcttttagccggtccgtatcacgcccggaggtcctcctcagccactttttccgccaattgttcaacctgttcagccatctgttccgctaaacgttccgtcgccattatcagtatgaatagaattttctgtccaaacttaatttctttgctgattagctatggaaaaagaaacacaaaaaagcattttctccgtacaattttgctttaactgactaaattaatacaaaattcatatttggatgttttggtatataatgcatattgcacatatgtatttttgcagtttatacagcattttaaaatttcttaattacttcgagtgccaaaagaatccaattataatttattaactggtcattggactcccgtttgaactttcttattaaaaaaactatttttttttaataattaaaccctaaatccatttaaatgtatttgattttaacacatatttaagcaattttttatattttttcgcttttaaccactaatgggttttttaacacatgtcttcttcaatttttgagactaagcatataatattcccttccccagtcatcagttccaccaaacattccgccaccagttcaaccaaatcttgcgcggccatcagttcagcaaaatcaaccggcacctgttccgtcttctgcttctgtgcccccttttcttgtaccgaattatccccctccggcgcttcttcgtccttccttttccgcttctccgaacaattgtcttcctttttgccaattttttatcaccgacgtgaaaacatttaaaaacaccaacaatttcaaataatttaaaggtttttatattaaaaaagtttataatttaatgccgttttcgcgcaattcatgtttccttattatcaattgttttttccattttattgttgatatttatcctaattttattatcaattgtttatttattcatcttatcattttgcaatattcttttgcttccaattgtcaaatattatcatttttgattttaaactataaaattcaatttacgaacagacatttctaattctcgaaatgaaattacatttttgaaaaatttttatatttattgcctttttcgggcaattccttttccttattttcaattgttttttcattttattgttgatattcaacttcttttatttgttatactatttatttcattttttggacattcaagccactcaaaccttggccgcactccaccagcacgtcgttttttcccttcttcggccctttcttttccccaaaattcttcctcaacttttccccaatcggccttttctgttccccctcctccaatttcatcggctattcctccaaatctcgctgaaaatattcattcaaaatccaattctacttttgttatcccaaaaccgccatctccaccttcttcaccacaccattgtgtcaaacagtacaatttcttttagttttgtttgttaaatttctgctcaatttttgcaaaaatcggtcaattttttttttgcatttttgaacaaatttaggggttttaaggttcattgggcttttatttaatctttaataattgcatttttacgcgcatatggctttaaaaaatgcctcggttcgaaattagcaatttactatttagaaaaaaatctaccaaaaatggccacattttttttcaattttttgaagaaaatccgggtctcgagggttcattggattcttttactaaaaaacattaaatattgcttttaatttaataaatttgtatggttttctaaagtatcaatgtactgtttattaaaaaaacttgctaaaaaccgaccaaatttttttaaaattttacttttcattgttttcctttatactgggtcacaaaatctcaatgtaagctttagttaaaactacgctattcagaaaaattttagaagaaaattcgtaaataaaattttgcaaaaaatcgtatttttactgataatttttttggcagaatttcataataaaaaatggaagttttttgaatttaaagttaaatttggtcgtaatttttacaaaattttctttttctctttttctttttttaaaatttattttcaataggcactacggagggcgacgcgttggatcagttgggctgcgccactactgctgccgtcgaatgctgttgtcgcacgtgggcctgatcgaaaaactgttgattttttggtaagctgggttgtgtttttgtggttacttatttgcattttttcacgcatttgacttttctgggatttaacatcccgtttaacggctacgaaaaaaactatagaaatgtatttcgtgttctatagctttcaaactacaaacaatcaagcgaattttatctttttgacatcacaattgcccanaatttattccttttata

SEQ ID NO: 4512 - DNA, 5183 bp, Heterodera glycines
  misc_feature (5131)..(5131): n is a, c, g, or t
aaattataccaccccccttatttgttccccctagtgtgtttgtccatccgaaatcgtctcctcgatcgaatggtgtatacatgagcgcagctccgcagcggggtcagcacatttgtcaatttcctcgatgacgaatttggattttgagcgcaccagttgatattttttactttttgaagtgaggttatcaattttacgaatacatttattggtttgagattttttgggggagggagatgaagattgggttttggaggcacgcttcatatttatagttttttttttttttttattgattgggtaaaatatggatatatgaataaaggaaagttttttttttaattttatgaagtaaagtttttataaaaattttatgatttaattaagtttattggagttttttatatttttaaaattgagagatttatattaaaattaagtggtgaaattggtttaaatagtgagcaaagaggaaaagcaaaagcaaaaaagggtaagtaggtaaaagatgtaaggatacgtagaaaattaaagggatgagcacgaacttttatttttgtaattaattatttaattgtaatattatttaaattatattgttataggtttattggaagattatggaattatatttttatttggtgaattcggtttaaatagtgaagaaagagggaatgcaaaaatttaaagggatggtaggaaacaaaaggttatggttaaattggtttaaatagtgcgcaaagagcgaggaagcaaaagggaaagagcgctttagtcgtttgcagaaaaatttcaaaatttccaaatgaatggaaaaaatgcacttttgctggaaatgacaggctatttatactccaccgagtaggcggggcttatttttcggctgggttaaatttggcaccttgccaaaagaggcagctgtctcaagcacagaatatctgatgttgggttttgcatagttacaactgtcacaattaatcattgactcacagcttgacctcaattccaagtgggatattattgacacttccgtgggcattatacagtcaaaatgcgtccaaggggttattaatgaccattccattggctttggctcggtcagaaatgcaccaaaagaattcccaaggggataattaatgaccactagcttcggttggacatatatgttcacaaaagaatggttaatggcgctcagttggcttttggtacaacagactccacatttcctaatgggatatttatgacactttcggaggcatcagttagaaatgcactcaaaggaaagattaatgaccctccgtaggcttaggtttcggcagaaatgcactcaaaagaatgattaatgaccctccgtcggccctgtgttggtcaaaatgcatttaaaaggaatgttaatgacactccgtcggccctgcgttggtcaaaatgcacttaaaaggaatgttaatgacccttcgtagactttggctactcaataggctttgggtctcagaactgaaatatcccgtgggcactgggagtgaaatggctaaacttaaaaaataactctggtgctcaaatggcaaaaagaaaaataactctggggctcaaatggcaaactgaaaaaataactctgggctcaaatggcaaaaagaaaaattggcggtgaaatggcccacaaaaaatctggactgaaaaaataactctggggctcaaatgactgcgctgtaaaaaataactcaggggctcaaatggcaaaaagaaaaataatcttggcgctgaaatggcccacacgcgggcgctcaggtggcatgcgtccctttccttccctataaggtatgacagctgacgtcctccctctacctccctttccttctctaataggatttagccttgggttttatccttcagatgttttttcaattatttaactcttctgggattggatatatttattataggtgttttttaaggtttaaatttggtactgaaatgtccctttccactgggactgaaatggcgggactgaattgtcacccccaaaatcttggtgagtaactactactggccaccggaaattttgatctgcgacgtgcgcgagtgtttcgactcggaaaacaacacgcggttgaccattgccgaagcagtgcgccgaggaattttgaatctggcgaccaacacattcgttgacacaaagaatggcacacagctgacccttccacaggcacatcatcacggattcattcataaaccgtttactctgacggaagcggtgcggatccaccttttggatgagaacggacagtttcgagatggcgccaacagtcacacactgctacaggcaagggcgtatctagggggagggaattccccaccccccgaaatgaaaattttttaaaattttccagcaaatggaaaattttttcaaatttcccccccccccaacgaaattttctaagcaatttttgtaacaaattggactcaaacttgcaacattttgcccggcggcgcctatcagcaccgccggacctccatttccactattttttacgttttttgccttaaaacggccaaaactgggtcattttgtcgggtcccccccccccgaaaattttttctagatacgcccctgccttcaggcaattgcttccgggcttcttgacccagacctgcggcacatttcagataagagaggcattggagaaggaactgttgctgccgaatggaattatcgtcgttaaaagtacgtgtggcgagggcataccttaaataggggggtgtcgccccccccccctgacttcgttcgtatgaggggccgaaagaggggggacttcgtatttgttgggacaaaagtgtgaaatattgtggggaaaggtcggagaaaaagggaaaagaaagaggcgacttcgtaatggccaagcgaatttaaataatgtaacaaaatcctcttaaattagccaattttgtacaaaaatttacgaaattgagtaatatttcgttatttatttatcaaataggacttcgttttttaataaattgcaccccatttttgaccaatttttttctggtgaccttcttttttttttgctattcagccacactttttttgcggcgtgttttccaaaaaacttttggggaaggggtgatacgggcctgaagaggacttggtaaattttcgtctccgagcccccgtcgatcacccctggacttcgtttgtattgagtctggtcgaccccccccccccccccctactatttaaggcatgggcgatggtgtgcagcacctcagttttcgtgaagcatacgagaagaaccttttgctgtatcgcgttcgcaacactgtatttgacatgaagggtttcagatgttgtgaagtgggagctcagtggttaagcttcaacgaggccattaaagctaacattctcaaaatgtgcaaggtgggtaaattcggacagtggagagacaattaccgttcaaaaattgtcattaaaaaaatttaaattaaagaattatataggtagctacaaaatttttgtacaattttttttcgagatttggaaacttttagcttcgatttttttcgcggtgtctttttacgtgcgccgctctgagacgcatatttcagaatttttttatcattgttcagctgaatgaattagcctgattgaggaaaatgtttttaaaaattaaagcatccgtattcaaacctagacggaaaatgatggcaatgttgtgcagttcgttcgagggcggcaaaggatgtccatcgaagaggcggcaaatcgagggcttgtagttccggcactttcgattattcttacgactcccggcttaatcatccaagaaaaacatttctctttgatcactgcggttgctaatgtgcgtttatttgtacaatcaattccttttaaaaatagtggcattggacacgcatcccgaaataaggcggagtggggatataatcagtgatgactagggctaagctaaaaacttgaaggctcgaattcaaaatagcttaatcgaattcaaaatagcttaaaggacctattttcataaagctaaaaaactcaattttcttatactttttttaaatttttgaaagtcgataactgacgatgattttcatttttattagttaaattcattttttcattaaatcgattaaaacgggttagtaaattaaattgagccctgaatttaaggcagaaaatcgcaataaaaagtcaaaaaaaattctttcctcctttaagtcggttttgaacgcgtcaaaaggagttcttttgaacaatggccgtgaggtttctgtccgcgaggcatttgaccatggatggttcaaagatctgggcgctgcgcttcaccttgccgcgctgctcgacgtccattcggcatttttgacgccggcaattaacccgtaaagaatgcgcaaaaatggcgtctaatggatggactttccgtggtcgatttcaatcgggatgaaatcaatttgttgtcttcttgttcaattcacatttacaattcgcataatttgttttgttttatttcactcaaaatattacgttattttttgctaaatatcacatgcccgtcaagggcgtagccagacccttggctttggtgggggggctgaagtcaaaaattcgatttttaggggtgtatttttggttttttaaatcccgggtccggcggtgccgataggcgccgccgggaacatttttgattattttaatgcaattttgccctttggttagctcaactttggctggtctgtcagcaagttccctcctcattttcaaatatcgcctaagttgttggttgtaattgacattttttgtagagggattagttcgctcacccctggctcggttcagatcgtgttgaacagcatccagattaaggtcacccgtgtcagacattgaagtgggacccctataaatttcttgaggaacaagtaaaaatttattcaccatattgtcaaatgaatgaatgattaagaatggaaacaaaattgttgagggtatttatgtgtttttagtcataacagactttgccaattcaattagaacaggggaagcacgcgccgggcgccccgctcactcctcgctctgctcattcggcgtacagtataaacatggggcatcagtcgctttttctgncgagttgacactaaagagcgtgaagcgacaaggttcagacaaattccaccag

SEQ ID NO: 4513 - DNA, 4090 bp, Heterodera glycines
  misc_feature (33)..(33): n is a, c, g, or t
tatggtacgggcctctttgttggtgcatgtttntggttctattttggttgtcgggggagggaagtacccggcttgcctagacgtggatggccgcgggtccagcttaagttctggctctcttttcgcccgaggcgctggagtagggtgttggtttttcttccaatccagctttgcctgttgtttttctctcttggcggtaggacgcggtggaggtggtcttggttcaatttttgttttcaaacgaggcggggatgtgagccgtggaggtgaacggtgataaaccaaaaatcttttgcgtcgtaaatcatcatcatcattatcatttgcctcatccttttgtaattttcttctggtggcaatcctgtgctgagcagtgtccatctcctcaatttcgttcgcgttgtcgggcagcacaggcaaatcgccataatattgtgacggcgctggcaacgcgaatccactctccagcatatagtcatcttcatcgtcactttcgggcaatggggcagcagctgcttccgctagaaggtcccgcaccaccggctgccgttgctgtatattgtatcgacttttccgccatttctccagacgaccacctctccgagaagctctacttggtctttgggggcgttcaggacggggcggaggacttccgggtggggagggacgaggaggagttggtccagagggagagcgtctcccagtcggtggaggagggggtccacgcggagtgcgtctccctggcgatggaggtggtggtggtggagcagggggtcggggtgtagtgtccacaacctcaccatcttcatcttcaccacctctcctcatcagtacactgattcctttggtgagctcaactttggctggtctgtccgcaagatccctcctcattttcaaatatcgcctaagttgttggttgtaattgacattttttgttgagggatttgttcgctcacccctggctcgattcaaatcgtgtctaacagcatccagattaagatcacccgtgtcagacacggaggtgagaccacgataaatttcttgaggaacgagtaaaaatttattcgccatattttgtcaaatgaatgaatgatggaagcatacaaaataacaatgtcgatgggtatttatgcatttttgttcatgatagactttgccaattcaattagaacgggggttaatacggcagcaaacaatcctccaaatcctgcgcctttctggacaagcacacgccgggcgccccgctcacttctcgctctgctcatacggcgtacagtatccacatggggcatcagtcgctttttctgacgagttgagagtcggaagcgtgaagcgacaaggttcagacaaatttccaccagtgcgagcagctgttcggagtttgctttccctatcagtttcttacattttttagcggatttcgtcctggccaaggcacagagccaatcgcaattgtcttttatcagctctccaatatttacttgttgttgttgttgttgttgtttatgttgctccatttttggggatgaacacaattgttccttcatcttcctcctgttcatctttaaatatgtttgttcgaagccgtaacgatgggtccgatgaagcatgcatatcgatcaacaaatagccatagggacgggtagtcgctttgcggtaagcatcaaggaaaaaagatttgttgtatggttgctagatgcctaaggcatttttcatagctttcttatacattttttaaccatttttgatgtagccgacgcagcagtgtttgttaaaaaactttttctcattaaatttttttaaatattaagcacacacagacagcacaaaattttatgcaaaaatatgaaataaccgtaaatgtgaaaccaatagttagttagctaaatggacagttgtaataaaagataactagccattgaaagaaagatagccaaaagggggaacatatgttggttttttggaaacatctaatctaataaataatcagcgattggatttttaggcacaaaaaattgaaaaaggcgcttaaattggcacaaatgggccttttcgtattttttaatgtacagaaactttagttgcctaaaaattccatcccttctaaggataatgttttcgttagcaaaaggagcgatgaaagatgaactttggtgagtgccattccgcatcataacttcatttccttcactttaaaggtgtgtccttcttcgatgccacattgtttcactgttttcacattctcatcacccccggaggcagtaaggcattcgtggccactgatgaattcgtagtgaaatacgtcaatccatgacatcatggcatcaattttatgcttcaaaattgccacagtgtcctcgctgttcacccaaacattgcgcgtgttctcctttttcaattctttaagtttcagaccttttttgtgtgtttgctccaacaaataattcacatgaatgacaaattcatccaaggccaagaaaacgattgtacctttttcaatgacataaaattccattgtttttttattgtcctcaagcactttggcagttggaaggttacgtctcagtgtttgacgctcgggcggaatgccaattatgcctttgattttctgcttcagtgtctgcacagtgtttcccttgttcaccacaatggtgtacggtttgccaccataccaaacacaaatttcaaattcaaaagtagaagcgtaaacggttccaagtcttccaatgccacaatctttcattgttttgttgtcctcaagcgcaatgtcataatggctgccaagtctcactgtcagttcatatgccgaaatagcacgactagggtgaaaattgttaacctgattcgtgatcgtgcgcttcaaacttgccacagtgtcggtggagttcacccgataaatgtagtaggggttcgatttcaatttcacaacaccgtttttgccaattttctcctcttcatattgcaccaagatttcaaatccatccactgatacataaatatttgccttttcctcaatgccatattcgctcattgttttatgactggccacttcatcaatcaaagcaccatttacatttctcattgctcgttcaatttttctcggttcttgtttctcgtccgttgcatcaaccagtactcgttcattaattttctctccaatggcactttccagctcagcaagatcgaattggtacaaggtttgtcttgcggggtcaatgctgatcacaacttggatcttcttcttcaaaactctcacagcgtccgcgctgttcacccaaacagtgtgctttttgtgtggattccacactgaaatttcaaattcgtccaacgacaagaaaacgggttcattatgcgaaatttcaccagaacacggaatgccatatggttttttgcatctcaaggtttgtctttcgggtggaataccaattttttgttcgattttatactttaaatctgccacaagaatagagattgagcccttttccaactcaatggtgataaaaactatatgctttttaagcagttgttcattcattgtcatcacagaaagcttataatcatcagcggatgaaggctttatcatctgcatgaaaagcattgacattagcacagcagcaatgccaacggagaacaatgaaaagccaaaatggatcttcattgagggaaatttattggtaaatggagaatgagagggtaattacgaatgaatgcatgcggggagattgttgcttcaccattgtcaagggatgccttttatgggcagagttatagtgaattattgcattggctattgcgtaatcactttcatctgactaaatcagatgcaaaaaaacgataaatacactcctaagaagtgaaaaaaaaattcagaaaagtgatcaccatgtttactattattttcatgataaagagtgtgtgactagaaaatcgtacttattcgagaaaacttaaaatcattgaaatataagcaaattttcacttacggagacagggaatttttgccaaacctggtaccggggattgaccgggacctaaaaagcggggacgggaacctccaattttttttctgggaccgggaacgcaaaaaaaa

SEQ ID NO: 4514 - DNA, 486 bp, Heterodera glycines
gagagggtaattacgaatgaatgcatgcggggagattcttcattcaccgatgtcaagggatcccttttaggggaagagttatagtgaattattgaattggcaattgcgtaatcactattcatctggcaaaattagatgcaaaaaaacgaaaaatacactcgtaagaattgaaaaaaaaaattcaaaaaattgatcaccaagtttactatttttttcatgataaaagtttttgactaaaaaattgtccttattcgagaaactttaaaacaattgaaatataagcaaattttaatttacgggaccgggaatttttgccaaaaccggggccgggacttgccgggacctgagaagccgggaccgggacctcgattttttttcgggaccgggaccgcaagaaaaaccgggaaccgggaccaaccgggaaattttaaaaattcaaaaaaattttaaaaattaaaaaaaaaaatcaaattttaatttatatca

SEQ ID NO: 4515 - DNA, 2126 bp, Heterodera glycines
tttaattaaaaaaaatattccaactttttttctttcattttaagcatcctaaaaacccaaaaattaatcaattggtctttttttacaaattctgttaacaaatcgccttaaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatgtccggagaccccttcgcaaaattggaaaattggccgctgatcccttgttttgcaataatctgaattttgaggtctacatctgaattttagtgttctttatcctgaatttgaaaaaaaacttggtcaccctcaatatacatatacttctgaacaattctaatgctaaaaaacaggcactcgcgcgaaaactgaataaaaattttgtatttgaaaaattttgtccaaaaattttacgttggaaaattaccggtttttaccggtaccggtaccggtaccggtggaaaaagttggtaccggtaccggtaccggtttttgcattaccggtcagtaccggtaccggttttttaacaattaccgattaccgagcaactctaaatagtatgacaaaaaaatttgatcggctgccaaacagcaaaaaggtggtggctcgagtgaagtagtaccacgattttttatatcataggatgtaattggaaaaaaagagatttaatttttatgttttttgtttttttcttcaatattttgaatgcatttaaaaaaatttaaaaataattttttatttttttaataggaaatggatattcatttaacaatcacctgcactaaatttttgaagtggttgatcagattgcctcctgcgatcaactctccgctgtccctgctcgctcttcgtgacgatgcttttcctcctcctcccgtggtcgtgccattgttgttcatcgcgaatgccgtcgttgtcgatgtcgccattcccgtcatataatcgtcgaccctttgctgctgttgttgctggtatggacttgactcggcactcgcatatttgttgagccgatcccgagaagcttaaatttaaaaataagaagaatgaaaaattatgttcattttttaataataaaaattaaaaatgttatccattatttaaattaaaattttctaaatcttttgtccatttttaatcccaaaatcatttcgatcttttaaatttaaaaagagacagaatttaaaattttcgaagcatatcactggtcaaaatggtcaaaaaaggctttgggaaacaaaaatataagcatatttttaaagcgcaattaaaaagccttaatttgcatattaatgaaaaaataagcgttaaaaagattttttatcaattttttaatgagcgtacttaccatttagagctttctggtgaaaaaatttaaagatttagtattgaataggccattcttgaagcttttaatgtaattagtacattaaatattttaaaaaatttaaaaaaataaaatttgaagactgaagctaacagcaagaataatatcagtaaaaagaaagaggtttccttttcttgtcaacattatgctatcatgacaaaaaccagtatatcatggaaccgaccttcttggcgatattgctgttggcgatgtgatagcagcggtgtggagggcgatttggactgactgaactcgccgccatcatttggcattcccgtcaccatgttgtcactacttttcaattttcgcaccgcttaattaacgatagatttttatggagtcattattgagggctccaattttaattgttttttgttgtaaagatattaaaaataatctttaaattattcctaatttctgtgtaagttttacaaaacaagacatataatgccttgaattgtaaaattttaatttaattttcaccatttggaaatggcactttgccgttgccagcatttgtcattgtttttgtggagctgaattgaggtgaccatccgccgttttcattggcactgttgctgttgttgttttgctgctgcttggtggaggcggtggtcgccaaatgcggcatggatccgcagaaattgtttttttgttgatcataaaaatctat

SEQ ID NO: 4516 - DNA, 7271 bp, Heterodera glycines
ccccccccccccccccccccccccccccccctttttttttttttttttttattttttacccacacaaaaaaaaaaaaaaaaaaaaaaaaacacctttttttttttttgttttttaaaaaaaaaaaaattttttttttttttttttttttttttaaaaaaaaaaggaaaaaaaaaaaaaaaaaaaaaaaaatggtcttttttttttggggggggtttttttttttttcccccaaacccccccaaaggtcgtttttttgggggagattttataaaaaaaaaaaaacaaattcccccgggccggtttttttttaaaaaccccaaaaattttttctcaaaaaaatttaaaaatttccccccccccccgtccccccccaacccaaaaatttttgaaaaaattccttgggacccttggcattttcccttccccccccccccccccgcttttgggaaaaggcccctttgcccctttccgttgggcccaagaaggggattgcatgggccgcttttgctgcttgtccccggggagattgaagcgggcggagcccagcttgcttccatgggaataccgcgacctccccactggtctggcggactggctgggcaccttttggaccgttcattgaccgcactgatcgctgcggcactgctttgcacgttcgggtgatcgatctttgccctacaacaattcaaatcacttttgtaatcacacgatgtcgaagttgcggtaattggtgatgcttgacagtactagattttgtaatcattgaagaccagaaattgaaaatttttaagacttttataacttgtttcagtttttctgaaatgtttgaaattttgcagtcaaaatattttagcctattagctaccgcggttaatttcccgaatgtttaatgccaaggctgtagtgattctcttcacttctctatggtggtaaattaatttcgtaatttaataatattcaaaaaattaattgcttataatgatacctcattaaaactgtttatctatccgtctgatatttaaatatgaacaattttgttctctactcacctcataaactcttgccgtttgtacttcggctttgcttcgtcccgcccatgtgatgagtcattgtgcggcgcagctgccacattttgggcataaaaattgcccgtttgctcgtcacagtcctcgcgcgtcatctgttcatcggttaccggtgcctaaaatgcaaattgcatttgtttttatcttttattattgaattttgacagttagacaaaggagcatactgtgttttgtttaaagcctatggattagaaaaaaacggaattccaaccgcaaaaaaaacttttaatttaatatttcaggctctagtagtgatgctcgtgagtctcgtcccaagtttcgactcgagaaaggtctcggggttcttttttgtcggtctcgagattgcggtatcagtttttggaacattttttacaagttaaaaaaagatattcatttaaatgtcgtggacaagtcttggtctcggaaaactttcggtctttaacatcactaggctttggtaataattttctgaaaattttcgcatttggcattttgtcaatgcttttccttctttttttattggacctgtgtgtccaggcctcggttggccttctccccggctggcccatgctcgcgtactgccgtggtgtgtgagcgtccgcccattttgctggtcattttaccatccccaatcgcctgttgtaagccaacggtttggcgattgttgtcatggatattcacgtagttgttctcccaatctttaaataaaaaataaatgttcaaatatgttggctatttgacaagaattaaatttgaacgttttggaaataggcatattaaaataattaattaattataaatgttttgataatggtcaattgaaatatttaacataactgttttgataatgggtaattaaaaagttagggattatttaatgttttaattaattctggtatttttcatttatgcccccctccttaaaaaaacgtcatgatcccgaaaaatgaaagcatttttctataaatatttttcaggattttttcgaatatatacaaaatcaaagggtgaaataatagataaactatgtagtattttacagtttggacaatatcttcttaatttgcgcctaaaaattaccatagaaggtgttttgatttgtcagggatatgacatttttgaggggggataactcaaaaagcaaatttttaatctaatgaatttcaaaattttatccgttagaaaagatatttttaaacgattaattatataattgctaaccgaaaggatcattaatgccgatgccaagccttttcatggcgacttgcaaacagttctccaacagttcatagtccggctcgtctgagtagcccaagccctttagatgatcagcaaaatgatgcaattctggtgggctgtaaacataattaaatattattttattagaaaaaacaatgtttttttttattttcttaaaataaaaaagtcgaaaaaggtaaaagaaatttttccaaatgcagaaaaataggctctattccaggttataggctcaatcaaaaaataccctcagtttcttaggctttaactctaatttgtaaaaaataaattaattattcagcttatttaagaataatttttgttgtagcctatgaaactaaggatggccattgtttgggcacggaaaataaaaatcgctatataagacattcgttgttccattccatgactcgggccggggatgaaaaccttttttaacattgtttttttttaaatttcaaagttctataataaaattgagaaaattttttactttccactgagcaattcacgaatgtcagcttcttccttcatccggccaacttcgtctttgtcctttatcctccgccacggtaacgaaccgttgagaaattcgaccaacatgtagaacaaagaccacagatcatcatgacgacccatttcctggattaataataatagttttattggggctgggatttatgcgctaaaaaaccgaaatgaatactgctaaaattatgtttcaaaaaaatcacaacccagggggtcgggccatattctgatttatactcaattggaaatctttgaaaatgagtatgaacattcttgagatctttgggtaaatttgaggattttttttcaaaaatccaaatatttccaaaatctgataaaatccagtaaatttaaaaagttttcggcactgcctaacctcaaatcctagaatttttttatagaattgactcaagatcctgaataattgatcatttagtcgatttatcctactcaaagcccacccccataatgcttataaaatgacaagaagtggatcaatttagtgttttttcaaatgaaaaaattactttaacctagttttgcttgaaatttttaatgttttaaaaattaggattttcatgcgaatagtcatttttttaatgctctaatgaaaatttaaaaaatttgatgcgagcatgtgaactgtgctaccgtactttgtttttgtgcgcagaaagtgcagcataacgtacagtaccacgaaagcccgctgctgatcctaaattcaaattatcaaaaaaaaaaaatgcaatttggcgtttcgtcttgtgcctacttggacttcgcacttcaccctttgcattcaaaaacagtcgggctaagccaaaatcgagcatgtaaatacaatgctgtgttggcagagtgcgcccgatggcaaaattggacggcttaatgtcgccttaaggatcaaatttttttaaatttcaataaatcctttacaaattaaataaaaaaattaaatttttaaaaaagaatgatttaagcattttctgatgtgccctttatagttacaaaattgtattacggtgcaaaaatccgatggagtgaatgtcccggatggattggagtatctgaaaagccactcttaatgctgttgacgtagaaaaacgttgactgggcgattccctgtaaaagaatttatttgatttgaaaaatttaaattaatctgaaaaaaaatttaatttttaccgaaggattctttcccacatttttgggtaatccttaaaaaagtacacataatctcatttttgtcggtaaaataattgacacaaaaacaaaaaattgttaagcttcctactttcttaaaagttttcataaaaaaatcaaacgcaattgtttaaaacgtgtaaagctttctaatgattatcaaaaatatgtttactaacaataagaatttggtttaaaacacgaggccaaaaatttgacgtccaatttttgtcaccaccgaatcccctataaatctctaatcatttaatattattctgatcactgattaagccatgcttttttgttcccactaccttctcagatcagccaggtttttggcttgcagccccatcaccaggtaattgaatttgtcattccggccacaaccgaagaatttgcacgcgtgctttttgccttggagtctgcgcaacactgccacctccatcttcagcacttgtttgttggcctaaaatttcaataaaaattaattttaaaatttaataaaaaaaattttctttttttttggcaaaaaaataattaccttgctcgactcaacctttattgccacgcgttcattgtgattttgggtgtcaacagcttcgtaaatttcaccgaatccaccgccaccaattttttgtttctaaaatagggaaaaataaaaaacggaatttattttttatttttcatttattaatttttttttctatttacttacaattttccatcgttccctgatgacttgagaaggctgcaaaatttcacattcacttgagcttgtcatttcaacaaatttaattaattaatctaaataaaaataataatttttttaaaattattacagcaaattaaacgaaataatttttaaaattcaggaaattttactttcttttttcgaaaatttggaaataaaatgtcggttcattgaaatcaaaatttgacggctgctgggagatttcaatttattattttaaaaatttttattaaaaaataattatttttccataataaaatgcaacaaggaagtcccattcaagaatggccaaaacaaaagaatgttgatgagcccaaaaacattcattattttccgccattttgtccaaaactttcaatttaggcggagcaattaattttgatcactttgtccgagtgaaaggcaaaagcatcagttcagaaagcattcccatttaaaagccccaacaaatgaacccccgtctcggcgctgccacacattttataatggggggggggcaaagaaagttaaggatcaacgcggcgacagaagagcagcggagaagaaattggagggggggggggagcaaatgtttgagacggggaaagagcacaggtcggtgtcgggtcaaagtgacaagccgcttcttcttctcccgccgtgggatcggcgggggagaggcaaaagttgaaagttgaagcggcggcaaatgaatgatttcgagggcggcgagaggataaaggcattgatcaaagggaggggagagacggacgcttcagaccagccactgaagtgatcagtctcagtcagtcagatcggatcgatcagaaagagtgatcgaagcgaggttcccgtgaacaaaattttgggggcagaaatggcatgatagggacgaagattttgcacgtttcttctgactgaatgaataatgcccgtcgtccgcataccaagcactcttcttcactcattaagcggctggcacgaagaaattgggcagcggtgatcggatgtttgaagccgaatcaaccgacaaattagtgggaaatcagtctcgagaaagtttttattgagaaaataagccgcaaatgcaatgaaaaatagagttttaatgaagaatttggataaaagataaattgggaatatacaattaaaatagaaagatatcaataagaatttaaaaataccaaaaataattttcgagatctaatttattattgaaaatcggaaaaaataataaaaagttaaatatttaaaacattttttgaactaactgtaaaaacaaaatttaataggccaaattaacaaatggaacgctcggttcaagaaaataaaaaattgctgcttttttaaactctctagcttatgatcttcgacccttgtctcgtaccgaaatgtcccggtcacagcggggcggtcccaaaatatgtgtaaaagtgcgtttaaagggaaagcataccaaaaaatgataacaaaaagcaccaaatgaacatatgaacattttgtgttgtgtgccttggcttttcaggggggagggggtgggaaaagcagtcgcctcccctccctaaattctcgagactcattcgcccctcactttcactctcgacaaaacgacgaccaccaccacgtaactgaagaggggtggggggaggggacaggatgggaagaagccgcttttccttcccttcctcctcttccacaaaatgatgaagccgctcccctagcagtgcccccccccctcggatgcatccaacaaagagtcaactttcttcattttctcctccccactcactttcttcccactctcccccgccccacccatcctttcggccccccggctgaggggtgagaaactgagaaaccgcggagggatgtgtgagaagaagccgatgttggtggcggtattgatttagaaaaatttttttgacacggcagaaaacccctcgggggccggtgcaaaagtgcggtggaaaggaagaagaggatatgatgttggttatttgttatttgtgccttcggcggcggagcaaggcaaagtacaagtgcacaactcacacccataaatgattgcctcaggcgtcagcaaaactgaaaacggcacatttatgggatgaggtggcggggggggggattaaagcaagcacatgagatgttttatgagcgaaaatgacgatttttaatttatttacgaatatttaaaaaaatttaaattgaaaccgaaaatttcattaaaaaagacatataaatgggagtagagaaaaaggcattttagagagagttgtgaaagcacatttggtaatattaccgatagtatcacacctttttgaaaaacaatttttttagatttttctaagtcataagaatatgtttccaagggtttgcagggtcgcagatcaagaattcggcatccatttcgaccaattccgaacccctgacccgaattcaaacaaaaagtcaaaaa

SEQ ID NO: 4517 - DNA, 1553 bp, Heterodera glycines
ttgattataaattttgtacatgcaaattatatattaatatattaattcatgtgtgcaataattacgtaaaaaattaatttaaagtactgtcgaaatcaatcactgtcgaaaacacctggtacgatccatgttgtgtgtgtgtgcaggttgaactcagcccaataattagtgataccaccacaacaaaaggtcatctgctcaatccgctaaaaaataacgaattttgctcctatttctggactggaatgaaatcccggggatcccctccccattccggacccgagaaaaaaaacatgaattttttgttttctgcgtttttattgataaataatggtaccggaagaactaaaattaaaataaaaaaacaaaaatttgctaagaaaaactcaaaaaagttaaaacaatttttaagcgaataaaaaaattttttgaaaaaagttttgggtctcgggggttttttttgtgttttttgcttcctctatacatacaaagcaaaaattctcgaaaccttcgtttttcttcatattttttgatgggttttccctatcactttttccaaatttttttatcaattttctcgatttatcgtccttttcccaatgttttgccccatctaaaagacagaatttgttggtgctgctctttctttcctcctcttatcattatcagcaattcagctgctaaacccccctgcccattttatagacattttggccctcttccgttgctggaccctccccctccccgctctccaatttattgcaaaaatttggtaaaatttcggaaagcccaaaaactggtcgaaagcgaccaaatttcccagccaaaatggacatcatgcacaaagcaatgattttggcctgctttggtaagtgtaattttcgttcgacaaaaataccgtattcaatgggaaattgagaccaaaaaaaacttatagtattctcgttgctgttgccattcgtcagtactgcaacaaaagttaattcttggtacagtaaccagtggtggtcaccagcagaagaaagcggaagcattgaggatgaaaaagtgagaaaatggtgaatgggtgtacaggagagacgggtgccacgcttcgaatcccgaatgtttttttcgtccggaaaaagtgccgctttctttttggccaaccgaccttttcctcaacccttgccaaaaccctgtttttcacaatgccataaaaatttttacaaaaatttacaaaagtaagaaataaaaattaatcgttaggcctttcggagaggcgcgcatcaacaaatcggcagcagtcgaatgttatagggaaacaaaattggaccctttttttttttgctgttgaaaccgctttttttgcggcacacttttttcaaaaagaattttttttgtacgaaattgactcaagttttaaaggaatctgatgaaaaattatgtacttaatatttattaatttgaaaaaataaattgcgaaattcatgttaaattatttaaatcctttttgcctttatgaagtccccccccccctttcttacgcttatacaatggttcttggggggggg

SEQ ID NO: 4518 - DNA, 3952 bp, Heterodera glycines
  misc_feature (3595)..(3595): n is a, c, g, or t
  misc_feature (3598)..(3598): n is a, c, g, or t
  misc_feature (3604)..(3604): n is a, c, g, or t
  misc_feature (3606)..(3606): n is a, c, g, or t
  misc_feature (3618)..(3618): n is a, c, g, or t
  misc_feature (3622)..(3624): n is a, c, g, or t
  misc_feature (3636)..(3636): n is a, c, g, or t
  misc_feature (3638)..(3639): n is a, c, g, or t
  misc_feature (3641)..(3642): n is a, c, g, or t
  misc_feature (3645)..(3645): n is a, c, g, or t
  misc_feature (3647)..(3648): n is a, c, g, or t
  misc_feature (3656)..(3656): n is a, c, g, or t
  misc_feature (3665)..(3665): n is a, c, g, or t
  misc_feature (3668)..(3668): n is a, c, g, or t
  misc_feature (3670)..(3671): n is a, c, g, or t
  misc_feature (3673)..(3673): n is a, c, g, or t
  misc_feature (3675)..(3675): n is a, c, g, or t
  misc_feature (3682)..(3683): n is a, c, g, or t
  misc_feature (3690)..(3690): n is a, c, g, or t
  misc_feature (3692)..(3692): n is a, c, g, or t
  misc_feature (3703)..(3703): n is a, c, g, or t
  misc_feature (3710)..(3710): n is a, c, g, or t
  misc_feature (3721)..(3721): n is a, c, g, or t
  misc_feature (3723)..(3726): n is a, c, g, or t
  misc_feature (3731)..(3731): n is a, c, g, or t
  misc_feature (3741)..(3741): n is a, c, g, or t
  misc_feature (3744)..(3744): n is a, c, g, or t
  misc_feature (3752)..(3752): n is a, c, g, or t
  misc_feature (3763)..(3764): n is a, c, g, or t
  misc_feature (3767)..(3767): n is a, c, g, or t
  misc_feature (3794)..(3794): n is a, c, g, or t
  misc_feature (3833)..(3833): n is a, c, g, or t
  misc_feature (3851)..(3851): n is a, c, g, or t
  misc_feature (3855)..(3855): n is a, c, g, or t
  misc_feature (3863)..(3863): n is a, c, g, or t
  misc_feature (3873)..(3873): n is a, c, g, or t
  misc_feature (3888)..(3888): n is a, c, g, or t
  misc_feature (3897)..(3897): n is a, c, g, or t
  misc_feature (3899)..(3899): n is a, c, g, or t
  misc_feature (3901)..(3901): n is a, c, g, or t
  misc_feature (3910)..(3910): n is a, c, g, or t
  misc_feature (3913)..(3913): n is a, c, g, or t
atccatcctgtatgaatcgggtgtcgtcgaattggcatcaacgtttgtatgcagttcttcggtaaagttagggaggtatcccattgaaaatgatcccttttccttggtgatacgatacgatatcacgcgattttgaacatttttctgtttcgaaattttaaatcccttccccttgtatgatttttcgcagagctcacgggcggggcgggtcatcctgccgtgccccccccccctttattaatgatgtaaataaaatttagcttgtcaaacaacaattaggatgggactccgattacacgtacaaaagtgtgtgtttggtggacggaaagccgacagtggtggacggatttgattgccgctatcaaggtgaaaaaatctaattgcatttttgatttcggaatcaacttaaaaatcattaattatattacctaattaaattaatcattaattttttgagcataattatgacaaatttaaacgatgctttaaacaacacttttaagttgctgttggacgttacaaaaacgcgataaatatgacgggatggtcttacttggaggtacagcttaaaatgaaaagcctattaagcgctgaaaacattattgaatttgttgtcaggttgaaacaaagcccgacgctgacccggacatgcaagcatacgccgctggagttttggaaggcatgttcaattaagccatcgaaaatgccattttgtgctttttaaggagtttgaggactattccttttttaaaacaatttattaattttttgaaatctgctgttattaattcagctcgatttctattttttcagggtagtgccaataacttttctcattaaaattaatttaaaaactcgaaaattaattgttcattatttttccaaatctttgttttttggcatttttttgttgttatccttcatgggttttcgaaaatttggtaagattagaatctctgctagtttcagttggtcaaatcactttattatttattaataatgagattcttcgaatgtcttatctcaattagcacttttcatttgtcaggcattttgacccaacctgtgttgaaattgcatctgatgaatgtgatggacgattactgcaccggctatcagacatactgtagcaaactgaagccgtacctgaagcagaacctggactttgtgcagcagagattggccaactcagcggccgatgacccctattggcaaggggttagtgaaaaaatcggaaagaatggcaaaatttttattttattcaccattcaggtaaagcgggcctatctgcaaatgaccggcgtttggcatggctttagcgatgcgcagtttaacgtgtccattgacttttcactgaacccaattttgatggtaattaattaagtaattaacacagagcagcattaattattaatgaaactaataagaatttaacgcgatcaatagcataaggttgatggataatttaaggagtcagtgttttaatcagtaggacaaatgtttgtttgtatgctttttcttatttttatgcgcatatgcaattaagaaaggagctcactaatagcatttctgggctaatatctgcaattaaccgaaccgagatgctcaattagtccaaaatgattcacattttgattatgtgttcagcttaatgcgcatggcgatttctacgagttggagaccaaattcaacagaagcaaagacccgcgagacgaagccactggcggaagatgctcgggactggtcaaagtgagtttgtttcaaaaaaaattatgcccaaaagagtttgacattttctaacaccattttacatgccgatccgcaaccacggcaattttaatttccgtatttttcaaaatagacgcagttcaaaattctaaggaagtcaaatgtcctacatgaattggttaaagttttaattacctttatagaaattttaaaaatttagtatgtttttttaaatttcatttcccattttggggtgggaaattccctccatgctccgccccgcccctttcttcattatggacctgattcagtaccaatttaatcgagaattgactaaaagaccgagagacaaaacatttctcgacacgacactatcaagcgttctctattgagacgaatacgttgaattattttacagtaggaaagaacagtttccccattttgaagattgcgcctaacaatgccgacattctgttctcccaagtcacaatgtgcggctttgaaagccttcttcgtgtgctaaaactgtacaaatttggttacggtaggctttttaaatagaatttagtccgatccgggtcaattagcgaatatctggcacaaaagcttgaatcaaaagcttttaacacacaaagaaccacctattattaagaccgcgcactgtaccctggccacacgactaccatatccagctacccaggcctattgtattcagccgacgattttgcactgatgagctccggattggtaaaccaaaaatttggaaatcttttaaaaaatttgctttttaggctatccttgagacgacaatgaaaattttcaacaacacacttttgaacgaaataaaaccagacggagtggtgggttaattaagcgctggggctaattcaaatgtaaaaaatttcaactgtccaaatttttaaaaaataaacctctaaaattgactttttgacaattacaataaactcaaaaaaaaattctgtccgcgtcgacactgtaagaatttttccggtggcgtttcagcactttccatgctttgccaataaaatttttcttagggagtctattggttcggcatttaagaaatttttaattttgattttttggaaaaataaacatgacgcccggtatcagaattcaggctaaacggcttttaaaaatccaataactgggcttagaatctcgctaaaaccggatttggcccggtaatccaagcccggaatgttttcacagctcgaggaaatggtagggtcggaacgcaatatctcaggaaaattgccaaaattggcgagggctgccatactttgattaattcaatctgctttatcagcttcattgttgggtacgagcaattgttgccaatcaaatggcacggacagcgcgcgagtggtgccacattttcaagcggttcaattcgggcacgtacaacaaccagtggctgatcgttgactacaacaagttcaaaccgtacaccgaattgcctgaccatggcctattttatgtgctcgagcaaatgccgtaagttacggcaccgtctagccacaagcattggattgaattcggggggacacactccgtaaaacattcgaattgatcaaataatttcgagactgtttgacaaataaccccaagcacaatagcatacatttaattctgaatttccccaattcaagcacaattgttctataccaggacatgacccagtggctaaaacagaatgggtattttgccagctacaacatcccattcttcaagaagaccagcctaattagtggctttgagcaaaaagtttaaaaaataaattttttaaattaaaaattcttaattaccctcagggcaacgaattttattggttcagctggaaaanttntccacncncaaaaatttttnccannnaccaacacaaantnntnnacntnnacattctnaccaaactnatncnntnantatcatnnaaaactntnacaaaaaaaanctttttnccatttttttnannnntttcnttttcatccnatnccattttnctttttatttnnccnaaaaaaaataaattacacaaaatattncaaaacatccacaattataaaaaataaaatttaaatttnaaatattctcctcctccntcanttataacnattacacccnccacccttaaaagcntctcaattncncncctcctacnctncagcctttaaggaggcaaaaacaaatgggaaaattagtt

SEQ ID NO: 4519 - DNA, 4514 bp, Heterodera glycines
  misc_feature (47)..(47): n is a, c, g, or t
  misc_feature (71)..(71): n is a, c, g, or t
  misc_feature (129)..(129): n is a, c, g, or t
caaaaagtttaaaaaataaattttttaaattaaaatttcttaaatanccctcaggggcaacgaattttatnggttcagctggaaaagttgtccacgcgcaaaaaattttgccagggaccaacacaaagntggtggacgtggacagtctgaccaaactgatgcggtgagtatcatggaaaactgtgacaaaaaaaagctttttggcatttttttgaggggtttcgttttcatccgatggcattttgctttttatttggccgaaaaaaaagaaattacacaaaatattgcaaaacatccacaattttaaaaaataaaatttaaatttgaaatattctcctcctccgtcagttataacgattacacccgcgacccgtacagccgttgcaattgcacgcctccgtacactgcagaggcgggtcagtgcaaaaacaaatgggaaaatttgtttaattgaaaattgacaaaatttttttttgaatttagcaatttctgcccgaggcgatttgaacccggcaaatggcaccttcgaaatacccggcatgggacacgtcaaccacgcggcacttgattataaagtcggcatggattagcatataacgcttaatggttttaaatttttttcgaaattctgaggttttccattcttttatatatatatatatattttttttttttgcaaaatttgatattcgcttttttaaatgaattctaagaaccgggataagaatcgcaaactcgggatttgagtcggtaacccaatcccggattttttcgatcccgactttattctcataaaatttaattagtctttgatttaccaaaatagtccaatgttgagcatctgaaagtttttaaaatttttgcacctttttcataacattttccccacttttagtagccaatttctgttaaatctatgccattttagtcaacccaatgattattttgtaattttcattaaatttttccccgcagggcaccggctacaaaatgttcaaaaaattgcaattccgcgcatggagcggaccaacttatgacgatgtgcccgtgtttgattggcttgaatgcgatttggcaaatttaaaagaatgaaatgccaaatttcgacgatagcgaataatttatgtttgaacatagttcgactcacaatattaatactatttttatgcaaatttggctgattttaatttctaaaattttaataatttaccttttttaataaatttttttgtttttggcgtgcggtcgatgccccggtcgggttaagctggtaatgtttttcccccacaaaagtcaaatcgtacgccggcactcatccggtccaatccaaagtcattttgacaaaagatatgacgatttttttgtcgaacatagtacgaattgaggcagtacaagttggcctagtatgaattggcttttccgaaaatgatttaccattcaaaacagcaaaaaatcattagaaagttaaagtgccatttcttaaaattcgcgacctcaatacctaacgctcggaattgtttttctttgttttttaaaatttttatcgaaaaaaccaatgggatcactccaatgatggcgaaattaaagatggtgctggacattaataataataaaataattaaaaattaggcactcacaatgaaagtatttaaaatttcatatttttttcatttttaacatatattttattgactcaaaaacacacacaatgagcacaagcacaccgaacacatcactcacaacattcgacgacaaattacagcagaccaaagtgacgacaaaatggcatcgcaattaatgattgtaaaattggaattgggaatgaaagtctcgactggacttgagttcaggcctggggttttccaggtccaagtttaggccatttttcgacaacctgggtttttctgaaccttccagaaatccagctcctgatcaatctggaaatccttgtggttcagttccaacatggaacccaagtttttgttacttttttgaagaacattttgtcatttacacccgtaaattagagggtttttagtgcctattttggttttaggatctaaaccctacctgttttggcagtttttagcaccatcatccctactaatcaattaataaaataaatgctgtgtaaattaattaacatttgtaaatgcatataaataattaatcaatttaataacttaaatgcagtgcaattaattaatattataaatgcaattgaactaattaatgaacggatcacttttaagcattgtttggcaattcactcagttcaaaagtggaagagttgagcagaaagtgtgcgcaattggagaaaggacagaatattgtaaacggtcagggtcgttttcgtaccgccgttttcgtacgagttcatgtacaagcgtcagattcaattagaaaaacttaagaactaatagaaccaaaatctatcattttttgtttcccattcataaaattttgtagaaaattcataactttaaaaaaataacaaaatccgggactaaataggtcgcatctcatagtttaggaaaataccagcgagaaaattgttaaggttttcgggactgacattggcattggcataattgtgatcagtttttaaaatttttgcaccttttttcataacattttccccacttttagtgccaatttctgttaaatccatgccattttagtcaacccaatgattattttgtaattttcattaatttttccccgcagggcaccggctacaaaatgttcaaaaaattgcaattccgcgcatggagcggaccaacttatgacgatgtgcccgtgtttgattggcttgaattcgatttggcaaatttaaaataatgaaatgccaaattgcgactatagctaataataaaatgccaaactggacgcaggcgcccgtccgatccaatccaatgcttttatcatagataataaattaagctaaaaacaatctctttttacatcatcacttcaatttggattttccaaccaaaataaagataattattgcaaaatccgtcatcataatccatttggggttcaaatggccgcgctgagatggccgttactcgcaaattcgcgcttttttgttattgtttttctttgctttaggaaaaagttcatagtaacgggcataaatttatcttgtgcttcttcgccaagtctgttcatttcattatgaatttctatgaaatttttgccataacaaaaatcttcgcgtcccatcgaattcaaaattaaaatctaatttaaagattaattatttaaatgaaaatattttgcctttgtaattggcaagttgtgattgaaagcgaagtgaaagcttcgcactttggcattttgccgttcaccaaaaaatgagaacatttgccaatgacttcgtcaaccataaatctgtcggccaatcggaggacattttcaacattttgatcaaaaataatattttataaaaaatatttataaagaaaataacccaagaaaccatttaaaataatatcgccaatgatcaaaactgcaatcatttgttgaaaatgttccaatgttgaagggggatcgagctgaacaatatccggcttatgggtgacggaagtgccggaggaagaagtcgcctgatccgtgccgaacaacaatttgtcaaagaacggcgaatggagtgccaaaagaagaagcagccattaaatgatttgaaattacataaaaagaatgtagaaatctagaaagtcgaacgattgttgagagccaataggaaacattgatttgtttattttcgagtcggctgtgccatcaaatttaaaccggttaatttttaatatttttatttttaaaaaactggccaaacgagaatacttacaaaatacgagatttttatttattgttttttttttattagtcacgcatttgttggttagaataaaatatttccttcattttattcagtttgatcaaagacagaatttgatttaagtatttttgttgagagatttcacgactttttcccttacaaaattagaattttcaccaactgattaaaatacgtactattaatgcttctgttttcacgaagaaatattggcaggataacggaatagaaaaataattcgacacttttcaatcccttgcctttttcatggccgaaaacaattgagcaacttaatttggtcattttaacaatttcattcccttttgcccaaataaattgtttaaaaaagtcaacattttcatggaaaaaacaataaatgaaatgaataaagcattgagtaattccgatcataatgcgattttgaatatcaaaatcagatgcatcaatcattcatcatcaatcgcgagcatcagccgcaatggcacacatttgttgggcacaatgtctaaaatgaaggccggacaaatgaacgacaccttttaagggtggtcttaatgtccgagtatttttcgaaatgaggcaacaaaattaaattaaggagagcttgggttgctttgaaggaccgaaccgccattagcagaggtcattagcc

SEQ ID NO: 4520 - DNA, 1846 bp, Heterodera glycines
gatgttacttgaaacataaaattctaagatattattcaagagaattgtttttcgtgcacaacctggacttggattatatttgacctggatctaggcccaggccgatcccttttatataaaaatatcaatcccagctttccaatgtttcaaagttcggctttattttcaggtatgtggtcaaggatttggtgccggatatgactctgttttacgagcagtacgcttcggtgcagccgtggctgcaaaagaacaaaccgaccaaattaggcgaagccgaaaacttccaaagtcaggcggaacggaccaaattggtgggcattttcaaccaatgggagaagggctggtccatcaaattggtaatgttcgttcgctttgcttttgaggacggtctctacgagtgcattttgtgcgcctgctgcagcacttcgtgtccttcttattggtggaactccgacaaatatatggggccagccgcgcttctccaatcgtacaggtccaattggcaaatgcgtccaaacatatggaaaaaggggagggggtccagcggtgccgatagacgcctccgggagaaattttaagaatttcaacgaaatttgttaattgtaagaattagccaaatttctcttctggaatgctaattttttaatttaaagcgttttctttctttttgtcagatggattatcgactcgcgcgacgacaaagccaacgaaaggttggaacggctgaccgaccctttcagcgtgttcaaatgccacaccattctgaactgcaccaaaacgtgtcctaaggtgacggacggtccttttggtgtcgaataatttgtttttagcaccttaacccggcgaaggcaattggcgaaattaagaaattgttaaccgggatggagtaagaggaaaggcattaaaacaattgaaaattgaatcttttcagaacaaagccggcaccaaaacaggcgacaaacgcataatgatacttttgattagaatatgtattttatgcattagttggtaataaacacatacattgtgattgccacttccatttaatttgtgctaatttttgtaactaaaaaataaaaatggacaccttctggggccgtctctggtgatttaaaattgttttttttcttgggatttgaactttgtgtctttttgatccaattggaacctgttgacctgtttttgaagaatgtcttgaaaagggttcgctttttctattctttgcttcgactggttctcccttctctttggttggtccatccattttctttcgtttcgtttcgtatcattttcattgggtggttttttcgcgcggactgacaaatgagtaccgtttaacaattacaatttaaaatgtgtgcattattaatgaataggacaaaaggagaaagtgttaagtatttcctttgggacgaaagaacgaacaaagtcattacagcggaagatgatgagttactttctgttcttctcgtcagcactgatcggctgattacataattataggatagcatttgcttaatcggcccaatacccctgggggggggggccggtggcccggtccaaatttgataaatgacaaacatttcccgcagttgaaaaaaacactccatcgatgggagtgggcaaattaaaattgaaatgggcggggcgtggcctttggccgcggtgtttccgcccttttaaagtgttcccttggcgccaattggccatttgattttcgctgtctttcgaatttaaaaattccttcgcttttcccaatgtccccacttttccttctgctcagtgcttttgctttgactgcgtttagcctttttcctccttcgttcgctgccaaagatgcgcaaca

SEQ ID NO: 4521 - DNA, 2362 bp, Heterodera glycines
agcaacaaatgttcagtttcgaatgccaatccaagggggtcgatgcggctgaaatggtcgcggttggctgtgtgacgaacggcggagagcatcgacgaattggccaccaatggcaggtgggcccagcaaaacaatgacattttatggggaattaaagcgaaatgagtaaaaaaggaaatttaaatcaaaaaattaggaagttaaatgacaatttcattcaaataaaatccaattaatgtgatctatcgcttttcatgtttatttaatctttgaattagaaaaggaaaattcgtcgctgtaaatccaaaaattgaattggacacgaaagaatggggggggggaaagaaggaaatgaaaaaaacaacaattaccctcgagcaaactcatcgcgggggagcggggcaaaaggggggcaatgagtgtaacggaggagcgaaaaaaacagtggaaatgagaaagggaacgataattaattattagtgattagattttgaaactcttttaaaaggacgattatgatacaaaattcaatgagaaaaacattggcagagaatgcccaacggacaaatggggaaggcattttcaaatgttttaaattgccgaaaaatgctttaatagggaaactcattttggcatcattcaattggtgcgcactttgcctttcttttttaggacggcgattttctcttttactgcaaaaggaaagccgcgggactttgcgagaagagctgtttggggtccgtccgtccttttccatttgttttcaaaatgattttccttttagctgtttgctgcagggccgccgtttgtacgacggcgaccgtttccgccacgggcgcaccgttttccaatgcgaaattcggccaaagcggcacgcacttaaccccgtcgcgtgcgtttctacgaatggcgtcgagcgattggtcaactgtaaatggtggacaaatgccgagggatcgttccactgatcactttgcttttaaggagtgatcggtccaaggacgacacttttcgagtgaagcggcactgcgtactgcgcgaagggcgtgcggagattgacactttgggctgtgtgttcgagaagaacggaatcgcgcggtacatttcccccgtaaattgggcgcttttgccaaaaatcaccgcattttgatcggtcaacagcaaaatattctctgaacaatgccttacttcctccaaattgatcacatttccgtgcattttcaccactttttcagtttgtccctcaaggccggcactttctcaatttggcgtgaagcattggtctgtgccacgccgttgttcggcacaacacctttcattttgccaatttcagaatgcttcccctctggccgtttcctgtcgacgtgcgctgattgacggggacgaatggcctttgctggagacattccccgtcacggaaatggccgaacggaccaacggactgagggaggacaaagacccgcgcatttgatcaaattcaacgctttaaaagaataatgcgaatgttttccttttcatcagtcatttaaattaattacttcgatttttttttttttgtccaaatttccattgttgggccataataataataataattaatttcattttaattttgtttttggtctatggcatttttttcctttttttcaaaagacctttttcagcacctccaaactgatcagacaaatgattccccagtgttttcaatcattaattttctctgtttttgccatcccattctcttttttccccttttcctttctcaagttcataaatttttctttgtttttccgtttgatccgtccggttttctcccattcattcatttgcattatccttaaatccaaagtgtcgttggatttgctgtgcatattcgccgtccgttttcacttcgtcccttcccctccctttttgcattttggctttttcttctgaagcgaactcgctttttactcgccactcactttcgcttgttttaaaagcgagatttgcatttggtaatggtaaacggcggattttgcacagatcgccgggaggggaaatgggcgagttccccggggattcggggaacctgattggtccgcagcagaagggagcagtgaaatgccgaattgaaattcgaaacaatctttcaaagaatgtttagacggatatgaaggaggggttttgccaataaattttccattttcaataattatccaaacggagtgattcccccagcctaattaattgctttacttaattacatagctgcttcgcttctttgccaaatgatggcaattctcactaattttttatatctctgctcgtccatctcttttcttatgccaaatgcttctttttcctccgttgggatttgctt

SEQ ID NO: 4522 - DNA, 1252 bp, Heterodera glycines
caaaagcaccccttccagcagcctccgttcgtacgtgcggatcgatcagagatttgtctattttttgtcctccgttcgttcggggggggggggggggaattgcgctgctcaagcagcacatccatggcgaggcgcgttcttttgcccagcaattgcaaggctttaagtcccccccccccccttcccattcattcgttgggcggaaatggaaaattatttttataaaataatcaaaaagaaacattttaaagtccggtaaataattaatgtcaaagatggtggacagaaggaaactttgtgtcggcgtaaaaaaagtttatgcgttttctcccatttttcgttttgttgtgtccaaccgcacaatttcattacaataaaataatcgaagtggcaaccaaaaaccaattagagaagaacttttttaaagatgcccaaattaagttaatttttgcaggaaaattcgtacagtaaaaacgaaatataaatttattatttaaaaatcaattttgttgttttcattttgattttaagaatgggcttaatttttctcatatttttggcctttctcccgcgcactttggccacaaatttgacccattacccggagagtcgcgtttggtctttcatacgatcggtgccgcgccaatcggtggacaaacagtgcgccaaaagtttggacagagtcagccaattttaaaatatgcaaatataaaaaagcattgcattttcaggtggaaacgtatttgcaagaccaaaggtgggacagaataaattaattaaataaattttaaaaagttaatgaattcaaaaggacgctcgagcagcagcgacagtttttctccgaagcattcagcacgggggtgagcagcaaatgcacaataataattaattgaataattaaataattaattaatcaatgcttttgctgttttgggatgaattgtcaagtatttttgccttaggacgcctcccaattcatcagccgagaccaggacagatggctgtacaacgcatttatgtgcatcaaagcggccggggaacagacgtacagtgcgtcggaatacccactgcattactgtaaggagagggaggttacggtagctgggaaaacgaacgaaacaaccgacttaaaaacatcgaaaattaaagcttaaataattaaggttatggtgaaacgacggaagggaatgaaagcgatgggcaacagcaaattgcctacggaatgtcattccgagcacatgcagcggagaga

SEQ ID NO: 4523 - DNA, 2162 bp, Heterodera glycines
atcagcatgggccacagtgttccactgggcgacggggcggccgaagcaagtcagtgaaccaattccattctatttgtcatcgacccttggcaaaatgccaccattcactgaacagccaaaaaagtgccaaatttaaatttgagttcacagatcactacgcgtccaattgcttctgtgcttttccgccgcgcgaaacatgaagaaacttgttcagatgcccaaggatttgcaggtcccccccccccctcgggggttcattcgattcgattctgtttcagagtaccatcacttgcatgttcggccttcgttttctgtccatggtttggaccctcgtaggtcattccttcatcttcatccaagcctttctttccaatgtcgacgagttcaaagatgatttggtggaccatttttggtgaaattctaaaaatcatcgctttttaaaatacttaaaaccacaggaaccaatggatcaccaacttcactctctccgtcgtaaattttctgaaattcgaaattgtgactaattattatttatcagtgcctctggaggagcaattaatgccttaatgaaatcaatttgccacttcttccaattccatcccttcggctcctcccccctttaggacgttttcctcgtgctgtccggcacactcaccgcttattcgtggttccgccgggcccagcagtcgcattcggacgagtcgcgcgtgggttgggcctcgtggccgtattggctgcgcttctaccggcatcggctcgtccgactttggcccgcttacatttacactcttttcgccgtcaccacccgcgtcagcgtatgaagcactaattattcataatgaaatcattgaggagattgggaaatggttgcacaatttggccctactcaccaccccttccccttttttctctcccttttttctccctttaggtcactcattaccatccgatgtggccacccactgacccggccgttcaatgccccaagcactggttggaaaatgtgctgttcatcaacagtttgacagacaacaggtgccttccgtggacatggtaagtaaaactaatcccgattaattgggcttaattagtgatttgattgattgatttgtccaataatgatcaaattcgtgcaaattatccccctctgaaggtatatcggcactgaattcatcttctacttgctctcccccgtgtttctactcgcccttcgccattctgctctttacggcctttctctggtgggcctcgtctccgccgcgtcggcgcttgccaatttggtggagaatttcgaacataaaaaagaaaattgttcaatttgaatattcttatccgatgaacttttcagatcataatgctccaatataatttccctcccactcaaatgttgtggaaacagccgtcaaatttttctcccgactttatcaaagtgaataatttggggaccctttccaatggcttttccttcgatgttcaaattgtcaatccctctgttcgtttagcaccatttggtcatttacatcaagccatggtaccgcattggtccttacttggtcggcctcgtgcttggctatgttttggcatgcccaaattcccatgatttcattaattccattttttctgctcaggcggtgcattccgtgtccccacagcgaaagcgttcggacggaacgcactccgcccgttttgtttgggtcggatgggcaactgcgggctgtgccggcttttggtcggtgttcgggctatacccggcacttcagggatgggattggtaagtccgtctttgaattggcattttggtcttcgcttacgctttctctttaggcctctctaccacctcttttacggcagctgcgcccgcacaattttcgcgcttgcccttggttggcttatttatgcgtgtcacacgggcatcggaggcccaataaattgggtgggtttgtgccgtgccgagtttattccgatgggtttgccttttcaggtgctcagtttgtcgcctttgctgcctctgtccgttctttcctattccgtttatttggtgatttatttttcaccgttttttccctctaattgtttctaatttccccacagtttcatatgatccccgtcgttttcacttatatgatcagaacattccaattcattacaactcataaattatt

SEQ ID NO: 4524 - DNA, 2822 bp, Heterodera glycines
ccggccccccaaaaaaaccttttttttcttaaaaaattagcccaaaatccctaaatcttgtcattttttagacaaactctgtgcaatttatgctaaaaagaattgaatcgaggtgatacagcgactaaaggaatgtggagccaaatacatcattcatttaatttttttgtgagattttttgaagctaattcaaataaaacccccgcccccatccccggggcaacggcagatttgctcatccccgccgccgcgactctgacccccgccaacccccgcccacgggactggagagatcggaccggtcggtttttttcggtatttttcggtttttaaccgaaaaaaaccgaccgagaaatttttgagtttttcggtttttttcggtttcggtttttttcggtttttataccgaaaccgacgaccgaaataatcaaaaaaccgaaaaaaccgaccgacttttttcaaaaaccgaaaaaaaaccgaatcaaattggagcgatataacctgttaataataataaatttattgcttttttgtgctctttttcattttgaagaattttttgtaaaatatttctgctattttgaaaaaaattattaacaaaaatgcaataaaaacgaaaaatacaccccctgagaaatggaaaattttatcaaaaattcatattcaaaatttatttatttatttacttgactacatttttgatttttaaaatatttatctcatttccattttgattaaagtgaaaaaaggaagatttcgagcatttaaagagaaaatttggtctttttttgttaaaaaagtttgttgatcactactcaatcggggtccccgaccaccgacatttgcgctccccccgagatttattcgagagctattaaattattgcggtgcggcgggtagggggagagcggtgttaattagctattaattagctaatttaaataatgattcaatcgccgccgcttcttctgcagctaaccgttggctgatggttgttgtcgcccatcgacggctgtcttttcgggtccacataaaagaacagtgctttgcacgcgccgcgaaggccatgatgaagcggttccttttttgaatttaatttggcactaataaggggattaattgccaagagtgcagaaaaaaacgcaaaaattcgggacccgggggtcgagattttgccaaaaaatgactggtcgggactaatgtattaaatgttcgcactaaatcccgttcccgggctatcttagatttttgttaaaggaagaaaaaatcctgtccaaaaatgcttggggagtcggtaaaacaattacggtaacaattaaatggaccaactcattaggttaattaattaggtaattacgcacacatttgtgccattcacaaacaggaataattatttatgtgtgtatgttaccttcacattgacaaatgtgccgcaaattaacgactcggacagaagtcgccatagggcaaatgccgtgatcgccgtttggaccaatttgtgcacatagaaaaagcgaatgcgcatcatcatatttcaatttcaaaagaatgttttttgattgatttttggcaaaaaaaaatgcctaaattggcccattaaaatattcgtaaagctgtggcacaaacaaaccgcggaaattttgtgccaaaaattcggaatgccacaccaaactgtagcccagaaaatactaattaaactggaattaagggggaaattgaaagcgaaagagcacgcaaatgagagacaaacaagcaagagagggggctaagcggattagctatggatgcttcttgatcagtttttgatgggaaaaaaattgaaattaatcctcctactcgctccccaaagaggaaggtattttttcatagggatggatggcaactaagccctggcaatcgaacaaaaagtgaaatggaataattattttggactgctcgaatttctcggcctgttggggcttctcgagttgaagagcattttactctttgcaaaatttgaatgtcttgatcagctctgctactaataaattgtggatttcatacccaaaaattggctctgatttctcgtaattttatatattttttttacccatttttagcattcaaattatttcttcatcggtgaattttgcacccaaaatttgcatcgaatttgccaaaaacaaaaattttaattttttttttaaatggctaacaaaaacaacaacaacaacaacaaaagtgcgtgttcaattggcacacataaaatctcgttttccatccttccatttttgttcaattcgcctccaaaatttgtgggttttcactttgcttttggtccaacaaaatttgggtggcctccgtgccgaaaatgttttccagacgaagacagtcaaatttgctgaacaacagccagcagggcaaacgttgatgatcggaggccgacttttctggaaaaaattgttttttttttcaaaatttacgatttttttatccccctatataaaattttacccaaatttctcgcccccatttgcatcaattcgttgtagaaatgcgcattttgtggtgcctggtagaacatgatcgcgttgacccctttgattgggtagcgaaaatagtagtggaacctgcaaattttttttttgtaatttaggttttttttgggaggggggtttgggggaaaggtacggccgagaaaaaaacccattcattgaacccatttttggtttttcttattgcattttttgaaaatttcggtcaattttcttaaatttagctaaaatctgcaaaaaaattattggtggcggcacaggtctcttctcactgtctcagcctcgact

SEQ ID NO: 4525 - DNA, 5296 bp, Heterodera glycines
cccccctcccaccccgtctctctcaccgttccgtcattagcattatccgtcggtcgccccgggcaaacaaattgcgcgccttggccactttgccggtctgcgcgtactcatgcaactgcacaaagtgctcacactgacgcttcagccaattgcgcacgcgcacaaagtcaaaataggagggcacaaacaacaaagtgccggactgacctggcaaaaaaattaattaaaatgaatggacaagcgaattttttaagaaaaatttaaaaaattttcaagaatgggcaaatttttttttttgataaaatttccaattttttcctagacaccgccaaaacaattccattttttttttacgtttttcccgtacattttgggaaaatttgtcgcacaaaatattggaagcgctgctccgcctgctcggccggcgaagcggcgtcaaaccgatggaattcctgcacatacggcatggaaagctggcaaaaaatagtaaattaaataaaaatagccaaaaaaaaattttttatttttattttttttttttttacttgcgtaacaaatggcgggtccatgggtttctgcacgacagtggctaaaccggcaaaattggcacagtgttgggcaaaactgtgggaaaatgggtataattattgagttggttattgtcaatcggtaaagcactggcagttgggtacagcttcaacccctcctctgaaatgttttttttatttcaaagttaaaatttaaaaaaaaactcacgaaaaaattctttgaaaaaagttcagcgatttttttgaataatttctttaaaaaatttatttcatcataaaatttagcaaagaaaatatttttaaaagttttttcttttagggtcggggagaagaacaatccccagaaaaaattaagattttttttaattaaaaaaaagatttaaaaaatttcataaaggttacttcaggcgtcgttttttttttgaaaaacatccgcccttggcgagtgttttttggttttttagagacagcccaccctgggtccaaaattcgaaaattttttttaaaaattgtaatacagtgcgtgcatttccaccgcgtgcgtgcgcgtgaacagcagcgtctggcggtagtggcgcgcgtgcgtgccgtccccgctgagcgcccaccgtcgcacgcgcgtgatgtcggtgcgcacgcggcacggcacgctgttcagcagtgcaaacaccgactgcacatgctcccagttctgcatcaacagaatgtccgccttgaacatgtgggagttatagtgtgtccgagcggtctatgcgtttgtttaacacagagttttgcatcccgggttcgggtccctttgccatcaaataattttttaaattgttttaaaaattaattaaattttttttcatgggttaattaatggttcaggttttatgaatgaaaattaatttttaaattaaattactctttccacaattagcaattcgatggatgccaaaaagtcatttggtcctccgtcgtcgtcgttagttgcctcgtcggttttccgccgcttttcggtgccgagacgcaaaaatggcgcggatgctttttggcgtttttgcttttttggcgtcgtttcgtcgccctccggcgccgtttcgtccagcaacattttgaggccgagcggtgagcaaaggataaaatcggactgaaaaaatgaatgaaaaaccgaaatttaaaaaaatatataaatcaacaccccatttttaaacaaagttgggttttcaaatgaaatttacagaattttcattagagatcagaaaggggttaatggcagttcgtatttcgtataaaaaattttttaaaagaaattttcaataaaaactataattttttatcaaaaaaaataaaaagaatgtgttgttataaaatgtataaacccctaaaaaaaacttctaagcttttccagttttccgagttcgctcacctcgttgaacggtgtgtacagcttcaagcatttcttggccaatccgatgcccaaacggaaacagtcgtccacattcccatccatcaactccttaaaaaaattttaatgcgagacgttgaaaacacaaaaatcaaattgtttggcacacaaattatgcaccaaataaaaaaaaatttttgaaaagtgccaaaaaaaaatttttaaaaatgaataaattcgatcgttttctccagaaaatatccgttcgggaaaaactcagtccgacaaaaaattcaaatttatttgcataaattatgcaatcaaaaattattttttaaatttaaaatgggaaaaaaccaaaatttcaaaaaaatattttttggttaattttttccataaaatttttgtccgtgaaaatcccatccgtccataaaataaacaaacaaaccctgtagtcctgggccaccgcccgtttctcgtggatttgattgccttccgtgtcgccaaattcggactcaaaccgtgacaaccgttgcacaaatggacgatcctaaataaaaaaaaaatatataaatctaaaaaccgaaaattgtgccaaacctccccgaacatcagtgccaccattgtctttacaattgcgtacgcaaatttgcgcatcggtgccaaaatgagcactttcggccgtgccaacccttggtcccggcactgttccatcagcgcttccgagacggaaccataaaatttttgaacatatatcaaatagaaaaacaaaatggaaattttggcagtacccaaaattaatgggttttaaaaaatttacaaaaaataatttaaaaaaaaaaattagagacggtagggtaaacggggcggcactatcccactacccggtaaaacaaaagtaaacattttatgggggggggggggggggtcggacgggatcgcaaattttattaattttcttaataaattcattaaaattccagaaaaattttcccgagggatggcgccttggggaattttgttaaatttcattttcgggcaccgccgccagaattaattccattttaaattgttgccccacaaatttgcaaccactacctgttcccgggccttctccagcctctgtttgttgctgatcaccaaattccgtgtgcgcatcacatggctcaacgcgtgcaaacagaacaggggctagaggaaaaaaaatggaaattttccaaaaaaattttttttttttttttgcaaaataccttatagtcagtgtccccagtgctcgcacagcacaaatccatgtaacgaccaatgtattggtaaagtgcttggtcaatgctgccaacaacgccatttgatggtgtttgtgctggaaaggatttatgattttttttttttagtaatttttataaatatttcattggaattttttgtggtttcaacaaccccaacaatgcccgggtaagatttccctgatttttatgaaaaaaaaatttacaaaccaaaaaggatgtgtttcctggaaggaaaattttacaaataccgaaaaggtacatttgccccttggttttaatttgcaaataaccccccccccaaaaaaaaaatcgtctaagaaaaagatgaaaacactcggcaaaaattagagagtcatttgacctgctcgaagtcgatgaaaatggtgcaaaatgcgcttgaagggaatgcaatcgtccggtgaaatctgatggtccaaatccaacttaaattgcaaaaaaaaaacatgaaataaagggtaagagattgtatagcgagaaaaatcaaaaattcgagtacagagacaccaaaatgcgtcttttttttttgacaattttgtacaaaaaatcagggcatagatagcaaaacagttcatttgtttgcactgactcttggcaaaatgttgttcaacgagcatgtgtactgcttgctgagctcggtgtcctcgaattccactcgctcaacagcagtggctggtggtcttgaccgaccatgtcctggaaattgtgtgccattttggcaaaaattttgtggcattttttacgggtgtgttctcccggatgcttaggcccccgaaaacccaaccccaaatagggaccttttaggctcgaaattttttccgcttttcataaaaattcaatatttgtcaggggagggcccatccgtaaaaagtgccaaaatttttcgagcccccccccaccctcgatttttttttaaaattaccatcatttccatttctaatggaaatttgttgcaattcatgctcagatatgccaacacaaaaatgggcattgaaaaagtcaaatttgacggaggacgatgaaggagcagcaacagcagcagcggtagtattgtcaacagcagcatcggacgggcctacatatttttaagaaaatttcatgaaatttttttattgtttcttgccttcaatgggctccgtaattggaatttgagttaatttccgtcgtttttccataattttaattgacttaaataaattaaataaatacaaaatgtaaatatttttttgtgaaacagttcctttaattgagagagcaaggcaagctgggagaagaatagaaagaactcagaaatagcatagcgaactaagagaaaaagaaaaagagtaattttctgtataaaataggaagaaaagagaaagaaaatagaaaaaatagtgtgagaaagtttttggttcctctgtcaaagaaagagaggagagaagagaggaaaatgaaaagcaaagatagagaaattttagaaatagtgtagaaaaaagagagaaaaagaaataaagtatattcttttgaatggctgcgctgcgtttcctttcgcttacgaccataccacgttgaaagcacgccatcccgtccgatctggcaagttaagcaacgttgggctttcttagtacttggaacggagacgtcctgggaatcgaaggtgttgtaagccttttttttttttggttttttaaattttttgtatgtaggtatttttttatttaaatataacccaaaaatttgcgaaaaaaagagaaaaataataattaaagcttttgaaaggttttttgaatatttgcttaattttttaaaatcaaaattttttttgcttaattaaatttttcatttcattaaagcgcaattaattgacaattaattaaataattgattgcctacaaattcagcacacaaaacattctttctttcaatcactatgcattttccattttctgttctgctgttatcaggggggatggatgggccccgggggcgggggattcatcggcgtttaccgatcgacgacgaaaacggctgcgacgaagcactggccattccctcgtcctccgtccccccag

SEQ ID NO: 4526 - DNA, 3497 bp, Heterodera glycines
  misc_feature (62)..(62): n is a, c, g, or t
  misc_feature (67)..(67): n is a, c, g, or t
  misc_feature (91)..(91): n is a, c, g, or t
  misc_feature (93)..(93): n is a, c, g, or t
  misc_feature (98)..(98): n is a, c, g, or t
  misc_feature (102)..(102): n is a, c, g, or t
  misc_feature (107)..(107): n is a, c, g, or t
  misc_feature (112)..(112): n is a, c, g, or t
  misc_feature (114)..(115): n is a, c, g, or t
  misc_feature (124)..(124): n is a, c, g, or t
  misc_feature (135)..(135): n is a, c, g, or t
  misc_feature (143)..(143): n is a, c, g, or t
  misc_feature (147)..(147): n is a, c, g, or t
  misc_feature (161)..(161): n is a, c, g, or t
  misc_feature (163)..(163): n is a, c, g, or t
  misc_feature (167)..(167): n is a, c, g, or t
  misc_feature (176)..(176): n is a, c, g, or t
  misc_feature (182)..(182): n is a, c, g, or t
  misc_feature (191)..(192): n is a, c, g, or t
  misc_feature (195)..(196): n is a, c, g, or t
  misc_feature (198)..(198): n is a, c, g, or t
  misc_feature (209)..(209): n is a, c, g, or t
  misc_feature (213)..(213): n is a, c, g, or t
  misc_feature (223)..(224): n is a, c, g, or t
  misc_feature (226)..(226): n is a, c, g, or t
  misc_feature (231)..(232): n is a, c, g, or t
  misc_feature (235)..(237): n is a, c, g, or t
  misc_feature (242)..(242): n is a, c, g, or t
  misc_feature (250)..(251): n is a, c, g, or t
  misc_feature (253)..(253): n is a, c, g, or t
  misc_feature (259)..(260): n is a, c, g, or t
  misc_feature (265)..(265): n is a, c, g, or t
  misc_feature (269)..(270): n is a, c, g, or t
  misc_feature (272)..(273): n is a, c, g, or t
  misc_feature (276)..(276): n is a, c, g, or t
  misc_feature (279)..(279): n is a, c, g, or t
  misc_feature (283)..(285): n is a, c, g, or t
  misc_feature (288)..(288): n is a, c, g, or t
  misc_feature (294)..(294): n is a, c, g, or t
  misc_feature (302)..(302): n is a, c, g, or t
  misc_feature (307)..(310): n is a, c, g, or t
  misc_feature (312)..(312): n is a, c, g, or t
  misc_feature (320)..(320): n is a, c, g, or t
  misc_feature (326)..(326): n is a, c, g, or t
  misc_feature (331)..(333): n is a, c, g, or t
  misc_feature (337)..(339): n is a, c, g, or t
  misc_feature (342)..(342): n is a, c, g, or t
  misc_feature (348)..(348): n is a, c, g, or t
  misc_feature (357)..(357): n is a, c, g, or t
  misc_feature (368)..(368): n is a, c, g, or t
  misc_feature (372)..(372): n is a, c, g, or t
  misc_feature (381)..(381): n is a, c, g, or t
  misc_feature (386)..(386): n is a, c, g, or t
  misc_feature (395)..(395): n is a, c, g, or t
  misc_feature (397)..(398): n is a, c, g, or t
  misc_feature (402)..(402): n is a, c, g, or t
  misc_feature (407)..(407): n is a, c, g, or t
  misc_feature (412)..(412): n is a, c, g, or t
  misc_feature (417)..(419): n is a, c, g, or t
  misc_feature (422)..(422): n is a, c, g, or t
  misc_feature (424)..(426): n is a, c, g, or t
  misc_feature (434)..(434): n is a, c, g, or t
  misc_feature (437)..(437): n is a, c, g, or t
  misc_feature (442)..(442): n is a, c, g, or t
  misc_feature (444)..(444): n is a, c, g, or t
  misc_feature (446)..(449): n is a, c, g, or t
  misc_feature (451)..(451): n is a, c, g, or t
  misc_feature (454)..(454): n is a, c, g, or t
  misc_feature (456)..(456): n is a, c, g, or t
  misc_feature (458)..(458): n is a, c, g, or t
  misc_feature (460)..(461): n is a, c, g, or t
  misc_feature (464)..(464): n is a, c, g, or t
  misc_feature (466)..(466): n is a, c, g, or t
  misc_feature (471)..(471): n is a, c, g, or t
  misc_feature (483)..(486): n is a, c, g, or t
  misc_feature (491)..(491): n is a, c, g, or t
  misc_feature (494)..(494): n is a, c, g, or t
  misc_feature (496)..(497): n is a, c, g, or t
  misc_feature (501)..(503): n is a, c, g, or t
  misc_feature (505)..(505): n is a, c, g, or t
  misc_feature (509)..(510): n is a, c, g, or t
  misc_feature (512)..(512): n is a, c, g, or t
  misc_feature (515)..(517): n is a, c, g, or t
  misc_feature (527)..(528): n is a, c, g, or t
  misc_feature (536)..(536): n is a, c, g, or t
  misc_feature (539)..(543): n is a, c, g, or t
  misc_feature (558)..(558): n is a, c, g, or t
  misc_feature (562)..(563): n is a, c, g, or t
  misc_feature (570)..(570): n is a, c, g, or t
  misc_feature (572)..(572): n is a, c, g, or t
  misc_feature (578)..(578): n is a, c, g, or t
  misc_feature (583)..(587): n is a, c, g, or t
  misc_feature (590)..(590): n is a, c, g, or t
  misc_feature (594)..(594): n is a, c, g, or t
  misc_feature (601)..(601): n is a, c, g, or t
  misc_feature (610)..(610): n is a, c, g, or t
  misc_feature (613)..(616): n is a, c, g, or t
  misc_feature (632)..(632): n is a, c, g, or t
  misc_feature (635)..(636): n is a, c, g, or t
  misc_feature (638)..(638): n is a, c, g, or t
  misc_feature (641)..(641): n is a, c, g, or t
  misc_feature (647)..(647): n is a, c, g, or t
  misc_feature (653)..(653): n is a, c, g, or t
  misc_feature (657)..(657): n is a, c, g, or t
  misc_feature (669)..(669): n is a, c, g, or t
ccaaggaaatcggttttagccttcggtccccaatcctccattaaagcaccaggctgctcatngcaanaaggagcagcccctttaccaacancncagangganggccnggagngnnggagaggancaaccagggancatcccgncccnaaggcgagcgaggnanaaanagagacaanaaaaanccggagaannganncnaaaaagaaaanagcngagagaaaannanacaanncannngcgangaccaaanncnagaacnnggaangaannannaanaanaccnnnggngaaaanaggcgggnacggnnnngngaaggaangagggnacacnnncccnnnganaagaangggacgganaaaaggggganaagnaacaagganaggancagcggggncnncggnaccanagcgnaaaannngancnnncacacaancanaaggnancnnnngnacngncngnncgncnagagnaaacccacgaannnncaaancananncaannncnccgnngnccnnncggcgaagcnncagcccgnagnnnnngcagccagcacggangaannccaaaanancggggncaggnnnnncgnccgnaagctcnccaaggggnccnnnnccagggggaagggggncgnngnccncgggangaacanaaanaacactggcggnatcgtagtaaagaatttcacagccaggagcgtcagcgacctttttcagagcttcgtagaggtatagtcgcgccattgaagtagtgaagagggaaatgacgacatttgagtacttgttttcgtcgacaaattcttccttaggtttataggtgagcatatacacgtcgttgtcttcgtccattagctcgacatcaattagttcaatctttttatcgtcagagtattggcggatcaggcattcgtcgttgtcaattattgcttttgagaggagatttcgcatggagaagcggccccagagtgagttgaggcaaagcttggcaatgtatcgttttccggggtcagccttcattttgttatcctctattttaattctaaattttctccagcactcatcaatgaattttctcttctcctcttcattattacaccatgatggatagccagtagcgtgtatcttcaaggccatcatttcgctcacgtaggacttgaagacattgtcactccattggtcgtattgtaggacatgaaaaagttttctgacggtatagccagcctccaatgatgcatttaattcaagatgagtacaagttgatacgaaggcgcggtcgttggtgttgacgtgggggcaggagtagttgtcgtctttgagaccttttgggtatttgttgctaataactttggcgcatttttcacagagagggaatagcaggcgctcatcaaactttattggcattacagtaactttgacgttgttgtctggtggttggagaagaattttaagtaatcctttgtaggggttgtcagttggagaacgccaattgaccgtttgctcattggtcgtgaaagaaataatttttggatgccctaggggatattttgtagagaagttggtaaacgggtagaggctggtgaagtccttgtagctgattttctgccccggttttgctgtgtggattagtttcattggtcctgtccgtcctccgtgaaatgcttctcttattttgataggtgaacaatccttccagttttcgaaatactccctcatctctttgtctctcttcatttgtttattgatctcgtgctcccataccacctccaagtcgacgtaccgcctaagtatttcatgtttcctctgttcccttagcctaatctcccccagtgtcttcccgtttggcatcctcgtctcttcatccatatcatcaaaacactcctcacacccatgccataaacaaccattcacttcaattattttgtcccgctgcccatttgtgcctttaatgtagccgtccacttggtatatctgcccttcacgtttaaacatatattctccgtagcgggaactggccgtttgtacatgaacgttgtttatgtgagagtaccagtcaagaaatttgttggccagtgcactttggttttgttgtggggtgtagcctttctccgggactatagctagagagttggatctcaaatgattaagggcaaagtttttgacgcaggcgctggctatggtcattgcttgccaaagaatgtcaattcctctatgatttccttctctttgtgttaattgtttgaattcccggcgcaactcgacgagggcgtgggtgagaattttgacgtcgttgcagcagtattcgggcaatttttcttttaaatcaaagtgttggtcataattggtgttgtaccattcgttgaacttttgcagatcagtttttttcttttgattgggacagtattcttcgcgcggcggtaaattagtaagaacattttcataattagatgatttgttaaacatgtgtggaaagtgttgtttatcctaaaacaaaaaaaattgataatttttatgaaaattaatcacttgaattttgagtccaaatgatttgatgagacccgataatttgataggcatcaaattgtagctgtcatggaaaattgttagtggggcatgctcattatccttaattttgagttcataaagacgatttccttgtttgataatttgtggatcgtgaacaccttaaaaaatatataatctatgaatattaaaaattgtaccttgtgcaataacttccttgatgatcattgtcatgtcgtagcgacccccaaagtgtgcaaaggctacagttgggtattttttattttgttcaaatagtagccattggacaaattcccgtagagtttgctgggtgacaattttttgatctactgttgtctctttgtaatcaaatggtgagaatgtaattgtacggttggggccacatatagcacattgttttccctctagtgagtttttccattctccattattaatacaattggtgcagatgacggtagccgctgcaaagttgacttcgtgttcgaaactatttccaacttttttgtcctgtgttgcctcgaaatcgtaagctatgatccggtacggtttgattttttgttgtttaagaggttggataaaacagctactgcagggattctcgtcgtcttcctcttttacgtgaaattgtttacataggcgacaaaacttttctccacattgatgactcatagttgaatgatatttaatgttatatattacaccacagtcattgcatcgttggaattttgtgcagatatcatttttaagatgtcgttcatagcagttgatgttgtaaaatttattgttacagtgctcacattttttgaagtacatttgctgaggctcacacggatagtcgacgcccacctcccggcagccgtgacagagtgaagtacagttcatagaatgtgttgttttgcggtggtagatacattcacaagagagacaatagtaacgcttcttgaagaatttagaaa

SEQ ID NO: 4527 - DNA, 2633 bp, Heterodera glycines
ttcttcaactgaatggtgtatacaagaacggagttccgccgtaggggtcagcacatgtctcaatttcctcgacgacaaatttagatttggagcggaaaagttggtgttttcggctctttgatgtaaaattgtcaatttttctaatgcatttatttgattgggtctttttaggggatgaaggaacttggtcgtcagaagttcgtttcatttttatttatatttatttatttttaatgatagaattgtaaaagtaatggaattattttgtatttaaatactcaaatttatttttgttttcagagaataatgtaaagtggagtgggattgaaaatttttttttttgaatgaatgggagaaatggacttttggttgggaatgctcgtctatttatactctcaatagagggcagcaataattattttgatgacggtaaccagagcaaaataggtcactgtaaaaaatggaatttgagagcaattgtaacataaataattactatgaaatcaccgaagcataacattttgaataattttcataaaattggtcatgcataatgtacgagagataattactacaaatacacatgtgtaaatttaataataggcaggagctaattgttatgaaatcagtcaagcgtaacattttgatgtactactagctcagtcatgcaaaacagaaaaaaaactctaataggcatgggtcggacttaattggtctggtactgacttgcctgggactaaaactacgggactgaattgcctgggactgaaacgacgggactgaattgtcacccccaaaatctgggggggtaactactcccactcactcgcaaatttggtcggcattgttcctttgaaaaataaaaagtgttatttccagggctcccagattaaattttcaaaagcctcatttggcagttaaaaaagcctcatttttacaaaatttattcaaaacacgcttcttaaaatattcaaatgctttgtttttaattgtccatgatcaatttgagaaatttttttcgaaataagcattttgcgatttttggcccactttaattcctttgaattcataataagaatcatgaaattttcgttccggcgaggggggcggggacgagctgctccccggcgatagacgccgaaggttaaaattcaataagtttattgatgataagatgaaatgctgctttgggagacaagtctcgacaggagaaaggtgggattctcggtctcgagcagcataaaaaaatgaaaaaattccgtattccaattcgattttatgcataaatggcacaaaagcataatgccagaaaatggtcagtttaaaaattaatttttccatcatagcaatcattcgcgctacacttcctctttctcttgatccctcctcattcatctgcgtatttttgattcgcctaaaattaaaaaaaaaaaaattatgaaatttataaacttttagcacaaagggcagaggcctaggcattttttggaactaggttttttgggtctggatttatttttacagaaaaataggcactttatcaatgcttttaaaaaaacgaattctaataagtattgcaagaagtggccaaaatcatttttttggcatttcgatgtaaatttattaaaaaaaaattttccattaatctcttttctccaattttcatcaaaaatttaaaaatatgattaatttatttttatttttagaaaaatttttttacattaatttgttatttctgcgagtttttacgtgctgatctgttgggctagaaatttggccgatatgtattgaccaactcctgatctgatatggcttgtgtcgctcagatccaattcggtttcgggttgcagattgtccaagttcacatggatattgcgaatctatggaaagagatataaaattattgaaagagagccaaaaattaaaaaaatacctttgaaaatttaaaaaaaaatccgttaagaataggaaacaacttgagaattcattaaaatattaaaaattggtttaagatttatgattgaattatatccatgaaaatgagaaattccatattaatcccctcacctcaatcctaaaaagtttggaaaattagaaatatcaaatttatcccttccctcatcctaaaaattcacatatttttttgaaaaatatgacagaaataaattgagaaagcggaattttacggaaaatggaaaagaaatttaattaatattttaaaaatttatatgcaaattagctttattttcggcaaatcttttaataaaacagaagaccaattaggtccggtggggtcccttccataattattttaaattaaaaacaaataaatatatttttaaataaattaattatataaaaccataactaattaaagtaccaccaaatttacctgcatgacgtggtcattgatcatcatatttttctcgaatttgtcgatggtcggaatatggatgctgatctgaaacgggaggaacataaattttttaaattttttggggggggcgaaggcccaccacgaggccgcgaagaggccgagtgagtaccttcggtgcaggaaaagtattaaattttaaaaattttttaattgctttttaaatatggacaaataattcagttggtggactttattt

SEQ ID NO: 4528 - DNA, 2032 bp, Heterodera glycines
atttgagccacacaaattgagccatttttttggaaatcttttctgtaaaaaatcaactcgttttaccaaaattgatcaattccaagccggaaatttttttaaaacattcaaaaatatattttttaccccactcgaaggggggggggctttatttcaggggatcgaatttagggggagtattccgcaataagttagggaaatgcaaaaattttataaaatctgcttcaaatttgttttttttttcttcatttttttgttaaattgaaatcacgttgtgagtgccgcggccgtcagcccggccaaactgccgcaggcggcggatgccaacggcgaacaatggcccatccgatgggccacacgacgcttcagccactcccaaagtgggaattcgatgaaggagaatggaatttctcgggccacggtgctcacataaccttaaaaaatgtgtaccagagcgatgtgtcggcaatgcagattttcaacatttttggactaagaattacgaatgccgaaattttttgagccgttgaaaaaatttcgattgccaaaatttttgagggcgtcgcacacattataccaccttatcaagggtaatgtccagcagaattgaaaatttcccgaaaaacccttggaggggacctgccatgggcgtgccagacccttggcttcggggggggagggctgaattcaaaaaatatttttaggggtgtagttttctttcttttttagaaatcccgaataggaggtgggttttgcaggaatttgtaaccgttttcgcaaaaaaatgactattttttgccattctggtcgtttttttttcaaatttgctaaaatatccatctccaagtcaaccaacgctgctctcacctttgtaaaagcctctgatgcctccccgtgttcggtacaattcggtgacaatttgtaacagtccgctggcccggctcgtctgactgcgctgcttcacaatttcggtcggcacacggaccaaacacgcgaccaattcgccaaatgttgcgctcagtgcgtccaccaatggcactgtcaaacaaagataataccaaattgggcggatgaaatatttttaacggtcggcaaaatgggtacatttcatttattcccgcgtcatttcccctcagagaaatttttaaaaaattatttctaccaaaaaaaaaaaaaattaattttacatggaattgatgtgccaattcgttgcgcaagcatttccttgccattgcaatatgtgatgaaaaacagtgccgagccgggagccgagcccacagccacctgacaatgagagacagtgacaaattaaattttcaaaaaaaaattttttttttttttagaaaattaccgccggtgcccctcggtaaatgttgcggaaaccgcccgatgccctgaacccggctttgctttgcatcctggtctgaaagaaattggattgatcatatacgaggtatttggcattacgttgtccaagtatagccggagggaatttcggcaattgtttgaaaaaatttttatggagatttttaaaaagccgaaagaatagcaaattgaaagccaacaaagagaacgtaagggggaagggggggggaggctaagaaaattggaacaaaaaaaaaccaaaaataaaaaaaggcgtaatactttgattgtgtccaatgggtaaaggctcaaatcgaccgcaaggccagccgaagcgccggccaaaagccaacgcatttggcgcgtcgtttcttttccaccaccgacggcatcgctgctttgttgtgccgccatttccaaacgctgttttgtttttttttttgttgctgacaatgaatcaatataatgaaaattttattccggttttaaaaaaaaaattttgaaaaaaaattaaaatggctgtcaaacaaattaaaagacgagaatgttgtgcatttttaatggcatagtgtaccataattgttttaactaaagtgaactctgtcaaatgctaattcacaatcaaaaagattgatgtccgttatgagccaacgggccgcgtctttct

SEQ ID NO: 4529 - DNA, 4395 bp, Heterodera glycines
aaataatcgttttgttatttttagtgaatggccactattatgtgctgtccgttttcacttggtactttaaaacaccaaaatttcattttaattacaaaatttcaatttataaattttattgtacctcggggggctttgggccccaaaataaggtcccccgaaaatttttgattttttttcgtttttttaaatacggcgcctccgccccgcttttttccccactatttgaatatacgacatttgtacgtccaattaagaaatgctacacaaaaaaatgtaaagaaacaaacaaacaaaaacgtacgtcatgttgcaggcgagaaaatcttggggcctggccaacacggttgacagccggggcgaatggatgaaagtggcgatgcgttgcgcttcctccgcctccaccaaatcggcgggcagtgcccaccgcttctgctgcgttcggtcaatgaaaaacacaaatgtgctgaagaaaatgcgctcctcatttgatgcacggagtcctgaagggcaaatgcaatagccaaaaaaatttattttaaaaaaaattcatggaaattttgcttaatttttattgactcataattacggctgattgtgagtcaactgggccccaatccgatttttgtggtataactctgtttactgttgttccaattgaaccaacaatctttgtcattcgataggacctaagtgaatctatattagcctataaaatttcgataaatttgattcggaaaaagtaactcacaatcagactaacctgcgttcaatttatgggtttaaaaaatcaaagttgttgtagatttttgtgtaaaatggggtttctaagggtccaaaattggtccatttccaaaaactgtgatttcactcttttatttttttaatataaaatttaaaaaaaacaaattttttttctagcgttttccaaatttttatgatgaattactgtttttttcaaaatttttaaatcattccggaggagggaggaagctgttccagagcagacaagtgccggattttggcccctaattttgcgcacttttccaattggtaaccctcaaacaaattttaaaaaaggactgactaacaataaacgcactttcatggacagcccggtgagcataggctgacgtgtggatgaacccgttgaccacatggtgtcgtttgaactgcagtcgttggtccaacaaatccgcgggcattttcggaatccgttggcgcatgtaaaccgttaattgttcggtcgcaatttcgcgaaatttgtcaaaccgccgttcgcgcagattgagcgccgcgagcagtgccgcctaatttttttttatttgaaaataaattaaataataaactatttggctctaattgtggtttcgctatctccggaaaatccaaaaatgctaaatcagaattttgaaatcgccagaattttttaatgaaatgatctggggctacaagaaatgagtgaaatttggggtgtatttaaaattttggcttttttaggtttaaaattccatgtaggtaatttgatcagtgtcatagcagttcgtacaatggaaattcccgcacaaaattattattttttaaatttttccggtaagattttttttttctctaaaaaaacgaaactttctatagaaaaacctaataagattttaaaaagaaaaaaattgtattcactttttgaacaatttttcgttttttttctacctgaactgcaccgtccataaatttgttcatgtcgtaggccgagtcgtaccaactgtaccataaacggttgaacgggttgataagccttcgcatcaaatcaaacgatcgcatcacaaccattggtgatttaaaaatgtagaaaggcggaggtgacattttaaaacaaaaaaatctaagatttttatgaatcctaaaaattttcgagtaatttttccgctaattaggagaaatatcgaattatgactggccaaaatcactttaaaatcaaaaaaatggtcgatttgctagtgtaaatttttcgtttttttccggcacctgcgccaaagtgattagaaaaaagcgatcaagacccgaaaaatagacgaatagacaattaaaaatgaaaaaaaaaaaaaattaaaattaagaatgagcaatgaaattttaaattatcaatatataatatttattattattaataaaaccaaagaaaaattgaaaaaaaatgttttattacagtgacaacacatttttaaaaaatgagcagacaaaatttctagtgtcaatctaatcagttagttatcactcactaaatgctaatgatttacttatcacatccgcgctatttattagtatatatcactttattattttcggaaatggaatccatcatttcttcgcgtttcattttgtcgatttgacaggcaatgctgtcacgctgaatttggcaatttttggcccataatttccggcccaaaattggctgtcatggcccaaacattcgaccaccaaataacgcacgcccttcggataatcggtgaacacgtgctcaattttgtgccatccttcctctaaaaagcagtcaaataacgaatggaatgtcccaaatctcagacaatttaaaaaaatatatattacaaattggatgataatccaaaatggttataagccaaaaacttaatttgaatccaatcaaaacccgagaaatttttttttttgtatctgattgttaaactatttttaacaaaatggtcattaagaaaattagttccagaattctgttgaatttattagaatcatatacatgcataaggggtgttccggcgcaccaccctcggcaaagttttcaaaatttgaccaagatcattggactttcgtatggaaattctgtcatggcgaacccctttaaagaatgccatcaatagcagccttaccttcccactgatcaaatcgtttttcagtctctgcccgcagcaatttggcatcggtaatgatcatttgctgtaatccctttaaaaaatgtaagaaacaccaaatgcactgacaaaaatgagaggttataaattccgaatccaaatgaatgaatgaaccatgaaaatggtctctcaaaagggaacaggacaaaatcccgccgccgaaatcacgccgctagaaatttttgaaaatattttcaaaaatttctagcggcgtgattttggggtgctcccctctcaaaattctaaaatttcaaaattactttgtggatatttgttcgaattcggtacatcgatgcacagtctttacggtttgcaacaagttcagagacaacaattggaggcgtaaaattgtccagaatttcgtcctaaaaatgtagaaaatattgcttttaataacaaacaaaactaggacacaatttttgtaggaattttcaaaaaaatctcattatataaaagaaaaccaagacttaaatcgaatcacaaatgcccccgtcccatgcccataaatgtgccccaccgtaagtccttcgtccgccaattttatctcaattcgctttcggaatggcctgtaactgagtgccacacattcgttcaccgcctcctcagtgccgtcctccgttcgccatggtttttgctggccatataggcatgggggaatttcaatgcgaggtttatgtctaaaacaaagatatattttaggcatggatcaaaaatactagttaaatcactgttaaattagtcacaaaaatccatttggtgcacatttagtgtattccaacaaacaagcattgttcattttatatgttattttgttcaaactttttggtaaaaaaattatgtttttttttggataagaatcggagggtctgaaaaatatggcaccaaaacatcggcgccgaaacgatcccggtgggataaaacaaccatgtttgttaacaaattctttttgtcatacaatttttcactctcgcaatatagcaaacagctactccacccctgttttcatggtaaaatatataattttgcgttttcgaagtttaaaaatgcattgaccccaaacagccgtgttaataaccccgagttgtcgtccgtccacacaatgtccgagttgatctcccagcgtgggtctgcaacaaagcactgtgccgtaccaagtttgctcatgtcccatgcgtcgtgcacaaaatttcgtccaaatgggcgtcgaacagccacttgtcgaattgaatgaatgctgagtgtggagaagaattgacgccatgggggatgatagttgcgcagctcggcccaatccttccaaaacgatttggcagacaaaatgtgatgccattgatgggaaacctgaaaaacgaaaactggtaaaagggcggcacttttgacgttgggaacccccgaaaaaaattccttaatagaggacacttttgtgggaattggaattggttgaaataggtgt

SEQ ID NO: 4530 - DNA, 3375 bp, Heterodera glycines
tcgaagtttaaaaatgcattgaccccaaacagccgcgttttttacccctgagttgtcgtccgtccacacaatgtccgagttgatctcccaacgtgggtctgcaacaaaacactgtgccgtaccaagtttgctcatgtcccatgcgtcgtgcacaaaatttcgtccaaatgggcgtcgaacagccacttgtcaaattgaatgaatgctgagtgtggagaagaattgacgccatgggggatgataattgcgcagctcggcccaatccttccaaaacgatttggcagacaaaatgtgatgccattgatgggaaacctgaaaaacgaaaactggtaaaagggcggcacttttgacgttgggaacccccgaaaaaaattccttaatagaggacacttttgtgggaattggaattggatgaaataggtgtcaaattcgagattaacaaccccgaaaaccacgtgtaaacaagttttcactaactatgacagaaaaatttataaaacaaaagggacctctgccccctttgaaattttttcatggacccccatcaaaatgccggtaaaagcaacgcattgatgaaagataacacacaccaatgcgcaagaaatgaagaggtctttggccgacactcggagcaaaatggcttcaatgtcagtgtcggaagcacaggacaaatccataataatattattgcttttgttgtcgctggtatttgcaaatgccaaattgcccattcctttatttggtgtggaacaggtcaacacgttcaattcggccaaggaccgaagcaacaattgatcgtcccacaccaattaaaacagtgagtgttcccagtttaaaaaaccgtccctgttttcagggtcaggaaccagaagctttttaggtcataggtttcaaacaattccctatatactgaaagtcaaactggtaaatttttgtaaaaaggggccttggaatggaaaaaatttggttgaaaaatcggttttttttttaattttttcaacttttttttattctttttaaagacattttgccaaataaaaagttttttgattctttccttctgtaaccgtgggacggagcggcgaattacatattttctttcatctttccctaccaccgtcacgtcacgttgtccattgacaatttttcagctttttattgagttttcgttaaattttcatcttcgacatgcaccggcgttcccgatctcggtcgagatcaagagcccccgaaggtaaaacattttcctttaaaaatatacgtcttaactcactaaatttcaaagaaaattactcttccgttacatattttttgttcaatttacagaccattctctgattgaagcatttgagccggctccaccaatgcattcccgacagagtttacaggttaaattgtcgtcatacaaatatttttgtagggtcaaatggaaacatgcaaatttttgtgtccaattttccttatctctgttttgtgatctattgattttggagttgactctctgcatttttcttatctgttttttgcactccgattacaatatttaccatcacattgggtggtccattttgcatattaattatccccccccccctaatcattggtttttttgtggttggggccctagcgctgcgcctcccccacaattacaccattaactggtggagttcgacatttgaaaaaaaagcttttgcctgtatccaaggaaaaacctttggtctgaatccaggtacaatcgaactcaagtatgaatttcgcaaatatttggatctgcgcatgtaactaaaaccacaaaaaaaaaaattattttcttgcctcttgaaaatgttttgggttttgcaaattgatttttttgaaatttaaacatcgtattaaatacaatactgttaccatatatttttgttcagcaaaccagacaacgattgttggcaactcggttcaacccgcccttgaaccaacaaaatactccgatgcaggtttttaaaaaaaaattttttttttttttttttgcaaatttgcaattcgtgccaataatttcagcgccataatgggcctgctaatgtgatgcgaaattcattgggtcaatcggcacctgcccacaggagcgttcaacggcctaccgatccgagaactcaggcgtgggcaccccgtccaaatttgtcggccaaccgggcatctgaccaagcaatggccaaccaacggtgccctgacgactcggtaaatgcacgaactcaacaaattcaggtcggtgcggttagaaaattcgaactttgtcatatttttcaacatcggtttaggcaaataatccaatgatgccaaccaaccgaagcaatttgtcattgaatcagccaaatgttacgccggtacaggtttgcaataggaatgagcaattcctgaaattgcatggttgtaaatttttagcgtcagaatgggccatcaaatgtcgcacaaatgttggcggcccgtcgagctggagctgttacgccgaatcaggcacttttttttaatacaaaattcggttaattgtaagctaaaaatcatttccatttttttgaggttaatgttttagggcttttcggtgtcaaatgatacgatttgacatccattttgacccgaccctttcgaaccccgaaccttgacttgaacaaatttaaattttcaacaaaatcaaaaaacttgttgaaatggatgtcggaattgaattttccaaccttgaaatttttttgttttgttttgaatgggtggcccaccatcgacactattaccaatcctccgaaaccatttttttgatttgtctatataaattatagcgactggcaacaaattccaccagcagaatcgggggacaatcgtctcaattggggcccttccagcaaatgaaaatgcgaatgaactggagcatgcgaccgccctccgggcttgcagttagcacgccggtccaaccacgtccaattgggcaggcaaacaacagcagtacgtcgatgctgcgtcaattcccaatccgaggtggacgcggacaaccgcagcaacagcaaatgcgtcgcgcgccaccgccagggaattgtgatgtgccatcgccaccgcaggtggatattgttgaacaataaacaatcctaaattggacatcagggactatctcagggagggggaggggttcgcggtgtacataccccaagactactcctccatgaaaaaaataatatatttacgcgaaattttccaaaatgtcaattttttggatgaaaatttgttataaatcgagggaatagggaaaagcacaaaaaagcgggagaaagtcaaaagcaacagaaaaattcgtttattttggggcggaagcactgctttggcgaagcaccaatcggggcgggggggggg

SEQ ID NO: 4531 - DNA, 2367 bp, Heterodera glycines
gcccagattatagaagatgtttatgattagcaaaaaaaaaatgacaaaagaacaccaaattaatctccgaaaaacattttgccaaaaaattatttcataaattaaccctcccccccccccaaaaaaaaatttaatgcagtggaagcaatttttaatacaatttgagacgaaattaaaaaaaaaaaaaattttttttccatttaagatgcctttggcggatgaagaggacaatgtgttgccacatgttcgtttcaattatgacttttttatgctcaatttttgccatccaaaaattaatatttccagagtttgttgcccgattatgagaatagcagtgagaacaacaaccccgaaaacaacaacagcggcggcggaggaggtgcaacaacgacgccaaatgcaccgcagcgacggcacgtcattcattcggatgacagcgacgacgatgacgaggatgatgaagatgaggcagacgattatcggggcggcaattctggcacacatgcacaggtgtgttgtgaaatgagctggctctattctatacagggatcgaagtgggataagcagatcccgcgcgagattttgcgggatataccagtccgtaatcctgcatttttttggcaatgcataattaatctcacgggatcaccataccattccacaaaaattttgaatccttatctcgcaataaaagcaataaatctgaaatttgcgatctctaattcaatatttttaagaaaaaaaactataaatgcggaagggtggcatttttttttttttttgaaaaaacgtgtttccaatttttttttatttgtttttcagccgacagcaaaacggggacgcattgagacgacgtataacttcaacaccacaaccatcgtcaacaacagcaacaatgacatgcatttgttcgatatgccaagcacttcggcggccgccgccgctgctgttgctgctgacaatgaacaacaacaaatgctggcgatgatgcccagcagcagcagcagtagcagcaattgggtggacacacaaaatgcactggcaaatgacatgtaatataaatattaattagacaaataattaattaaatacctatttgatatttgatccgggtgtactacgtcccctcccaaaaaaaaaaaaattttttttcccccacacattttgcagccgtacaaattttgacgacgagatcaaacgcaaggatgagctgtgcagcaagtttatgagtacttttgctctcgtgattgggaccattgacgatgcattacaacagaagaagtccaaatgaccggtccgttttcgtgttttgtttgtgtcacactttttttttggttcacctggattatatatatacacacataataccgtattctctaatatacagtcgccttttaggaaatacggtattatcgtaattttcaaatcttcgccatcacttttttctttctttttttctacattatttgttgtttgtttgtcctcaattttaattaccgacctattcttgctgcaatatgtccctttttgatgtacttaaaatgttgcttatccctgaaattcatgcgcttagctttttctacattttaaatccccaacattttgcattccctgacaattattccatattttatttttataaaaatacttaacaaaaatgactgtccatacattatgttactctatgagaatatggcatccgttttctgtttcctactgtactacacacacttgttacggtacagcactttgccggccaccacagtgcatgcaatttcggcatttccagcaccgaacacaatggcatccgccaactgttgctgctgatcactttcactgacgacaacaaactgttccaactgatcggaacggcagtcgatcgccagacagtccttcgaaagtgccaatttttgccggtttttccctcgaaaaccgaaccatcgatttgccgacacgaaattcgccgaccgattcggccaggcccaatgcacttgcaccattttttgttgcaatttcgaccatttttgtcgcgtcaattgcggcccaattgcgacaattgtggaccatctcaaaaacaaacggctcttcatattataatggatggagtgtttcagtacaaacatattttttcattaattgaaattagagtgccacgggaccgggacctggtagcggactagtcccggttttcccagccaaaaattcccgggttttcaacccgaaaaggtcccggtccccggtttgcccaaaattcacggtccgtggcactctaattgaaatctttttagcaaattttgtttacattctgacaaaagacgagccatcttatttccctcaaaattgctgaaaattgaaaaacattttaaa

SEQ ID NO: 4532 - DNA, 550 bp, Heterodera glycines
ccatcccaaaagcaattcggtagagaattttgtgctctttctgatgggcctactcattttttccagaaaaatttttccaaccccctaggaatttttttgaaaattttcccgattttaagccattttggggtgtctagatcacaatgaaggagtgatctgatcaccttggtctaattaccttttttgatcagcatcaaaagttatgctaacagggattttttcagatttttaagtaaactttaaaatagtttttcaattttgagtaaagacttttttccgccctttttggtgtgcatacatttcgtcaacttgacatctcgccaactgacatctcccaactgacatctcgccaaatgacatttcgccaactaagccaaaaacattcatttcgccaactcagccaaaaacgcctcccctcgattcggcaactcaacgattcgtcaactcgacgattcgtcaacccagccaaaatgtgacgattcgtcaactcagtcaatattacttaaaaaatggaattaacaataattattgaatatttcatcggaagggt

SEQ ID NO: 4533 - DNA, 2740 bp, Heterodera glycines
  misc_feature (1966)..(1966): n is a, c, g, or t
  misc_feature (2005)..(2005): n is a, c, g, or t
aactcagccaaaaacattcatttcgccaactgacattctcttaactgatcaaaaaagaatgattaaggaatagtaaataagaggaaaacgaatctgttctgatatcaaatacattattctttctattttttatgctaaatttttagaatttgtttttttttctattcagattatattaagaaatgccaactgttcgcgaaattcttgagtgtttgcaaaagccaattaaacggcccacggcccagaaatccaacaaatgaagacagcgtactgaatgctgagataaagcgttaaagtattacgcggaagtccttcaacaactgaagcgtgccattaatcccatccggccaattaaaggcaagaaaaactacataatgactttaataattattagttaagggatgtgcgacttcgagacaggaatgctgaaggcaatgcggcatgtcttcccatcatgcgagcgctccggctgcaacttccacatggcgcaggcattgttcagaaaagcgaggagcttgggcatttttcatttatttgccgaaaacaatgccgaagcactgggtcaaagaaaatcggttcacaaaacattcaggtaggtattttcattagcaagtctttttttcaaaatcagatcagtcctctctttggcactcattcctccactttacattcgccaagcatttacaaccattatcaatgaagcccgcttggagttcaaggatggctggcgtattttggcaaaaactacattggtgccactcaattcgagattgaccatggagcggaggcatttgaaccaaatgcagatgtaggacgcttatttcttcgacgcactcgaagcacaactcgtaaattcaaatattttgtcatgaaatttatgaaaatttttatcaattttagcgttcagtgtgtcccgggcgtccataatgacaggcagtggaccaatacaattcggactgcattcgccataaccatcaactccgacgatcccattttccgaagagagcatcttgcagcttattcgacgttgggaacacgccattgtccgtcctccccgcttccccatatcgttttggaatgtgcacaccagggctcaaatggcacttgaacgaacaaataacggcatggaagccgcacacgtccaattcgcagtataaaaaatattttcagaaaacatttttattttttggtattttcagctagagctcaaccaccatccatcattgagtgacttcattgctgcgttcacaaaggacatcgacaaacaactggacatcggacgcgcagaacagctccagaaaagtagaaaacgaaacggtacaagtagtataaggccacaaatgtggtggtaaattttacccccacattctgcccttcgcagcgcgccggcggtcgccccctccctccccattgtgggagagtgttgtgcccttcgcagcgcgcgccggcggtcgccccctccctccccattgtgggagagtgttgtgcccttcgcagcgcgcgccggcggtcgccccctccctccccattgtgggagagtgttgtgcccttcgcagcgcgcaccggcggtcgccccctccctccccattgtgggagagtgttgtgcccttcgcagcgcgcaccggcggtcgccccctccctcaccattgtgggagagtgttgtgcccttcgcagcgcgcttaaccccttttttttgcacgagttgcgctcaaatattacacaaaactatgcgagctataatttaattagtcgcaattatttaattttgtaagattgaatttttattaaatatatttagatatagaataaaatatttctctatttctttctattctaaaaggactaaaaaatatttctttttcgggtttaaacaaatgctttactgctgttattctaattttattgtataacattctcatgttaaagcgataattttgcacttgtttttcgaattcatttatctttnaaaaacaaaggtccgatatattctctgcttcttgacatntaaatatatctgtttctttgatgccaatttttagtttctgcatagctaaggcctgttttctatattcactcataataagacctggtaatttttgaattttttcgagcattcctaagaatgaaaagtataaattttcgattccaggtgcactaaatgctgctatgtagaaagttttcacacctttaaaaagtttatttgcaaagatttcaagattatttgatcgtttaagtatattcccggctattttccaattttttgttacattattcttaataaaatcaatttcttgaattattgtagacatctgggattatagttacttctaacgttataacaccatccaaaggataaaaaagcgaatattgttcttcttttaataagacgtgttggaacaaagcctcggccgtgttttcgttagggtatcgaagagggcaataaaatgattcaaaaccaaaagaaagcttcaaaatgcttctgaatttcccttgctcatttttataattttcttcaattaacgatgtgaggatatctttaaaattttcctcagcattaattatgaaaggatttttaaaataaaatttagttttatattttgtaaaaccaaattttaagtcttcataacgaaatgactcaattaaagaacacccttccattttgagagttgcccttttagtttttatgttcttatatacccatatggggagaaacaattgtttggagcctattttcataatt

SEQ ID NO: 4534 - DNA, 3646 bp, Heterodera glycines
taaaaaattttttttttggggtttaaaaaaaagcttttcttctgtttttttatttttattttaaactttctcatgttaacccgataattttcatttttttttgaattcattttttttgaaaaacaaaactccgttatttttttggtttctgacatttaatatattggttttttgatacaatttcaagtttccgcatagttaagcctggtttttatattcacccatataaggccgggtaattttgaattttttcgagcatttctaagaatgaaaaatataagttttcgattccaggtgcactaaatgctgttatgtagaaagttttcacacctttaaaaagtttatttgcaaagatttcaagattatttgatcgtttaagtatattcccggctattttccaattttttgttaaattattcttaataaaatcaatttcttgaattactgtagacatctgggattatagttacttctagtgttataacaccatccaaaggataaaaaagtgaatattgttcttcttttaataatacgtgttggaacaaagcctcggccgtgttttcgctagggtatcgaagagggcaataaaatgattcaaaaccaaaagaaagcttcaaaatgcttctgaatttgccttgctcatttttatatttttcttcaattaacgatgtgaggatatctttaaaattttcctcagcattaattatgaaaggatttttaaaataaaatttagttttatattttgtaaagccaaattttaagtcttcatgacgaaatgactcaattaaagaacacccttccattttgagtgttgcccttttagtttttatgttcttatatacccatatgctcccaaacaattgtttggagcctattttcataatttaacatttggctttgcacccttcgggactcaaaatgtaatcttcgggcttctgttaaagaattttgagattgttcctcaagctttgttgcctggtcaaaagttttgcatctttcgaactcacgccacgcagattcagctttttctgactccaaattgatttgttccaggaatttgaaaatttcccaaattgaatcggacattttaagatacaattcccgaacaccattagcgtaaggagctttttctcttgattttattgcacgattaagagtttctcgagaagacttggcaaaatcgcttacatcatccgatagcacaacgacatctcgccatgctctctctgtctctcttttagcagcttccaacaaaatggaattagcttttctattttttattttttatttttctgtttttcttttatatatttttattatattttatatgcaatgaattcgtctctaaattctgctgagggtcttggcttttcaaattttatttgattttctcgcattatttcttttattttattggccatatctccaattcctaaatctggctgtgaataagagttacgataagtctgtccaatttcatgcctatattttttagctatttctattgattgtttggcatcttcggctaattcttggcacatcactgggtcctttctgtctagacatttttccatgccttttttaatatttttatattcttttcctcattttttattttatcaaattgtgaatgtatttttctaactccgtttaatagtttttcatgccaaaatatgatttcagattttcccgaattcctatccttaataatttgagcttcaaccatggtattatgagcagaaaatgaaaagtctttggcctcattagttaacctaattatatctttaattacttcttcaacaacccttcgggaggcatccacatttcatttatagacaaaacaaatcaaatttcataaatatcaatcaaagtataataaattcccttcttaccaccatattctttcacactcacattaaccttcaaagtacaaatggtcccaaccaagtttttaaccttttcctaaaaaaataaatttttgtgtttaaacatttttcataccattccgtcactcttttctacatttttcacaccgaaaaaagcaacacccccaaaaaacgtctgtatcatccaagagcgacaatctcaaaaatgaagactttaccttctccataccacagttacacttccccttacgacaagagatgcaagcctaaaaatcaagatatgttttctatttggttttatttacattgtattccgtagacccaacacttgcaattttagcacgaaccacaaaaattcgactaccacaaaccaattcaatattcttaatgtcgcggattgtgttcatttttcgagactaaaataaattttagaaaattaaaaaattaaaaataaatttcgactataactaaggcaaaaaaaaaataaattacacaattaatatttattataaaaagcaattcgaaagtgtgatggcagttttaaaaattcttccatcattttttctgcaacacttcgacgagaaatatcaaagagacttggagggacccgatagagcaatgaccaagagccaagccattctctgtaataataatgacatatagatttttaatcattaaagacctgtccatacgattaaagaaaacatttagtagtacttcaattggggaagtcaacagttcttttccccaagctaatgccaggacctttagcatttggacctttgccagaaaaagacgactcctaaaaaaaccgttgcggtttgtctggctccttccctcccagtaaaaccagaagaaaaaaatagggagtcccaatcccgaatcatttcccaaatagttcccctgtacgatgccgtgtagtaccaacgtgtatctacccataggagtacccgcccctgagtcataaaaaattcgcatatctcgctcaaccatggtaaaacaaaacgcagacgtgtgttcgtgcatttctatgtagccggaaaacgggctttcataatcccggtgtatggccactttatattgggatgattcaatcaacatcgcttcaacctcagctctgttcttaggccagaaaaagtcttccttctcaagagcagtttcaaaatattttttgaacgagtacatttaaaactaaaaataattagcgaaataatttttaaaatacaagcgtataaaacattaaataaaaacatcttttttcatcaaaaaaatttaattttggctgagtggcgaaatgaatgtttttggctgagttggcgaatgccaagttggcgaaatgtagtcgtgccccctttttcattgtgcataccagcatgactgacaaaaatttcgtggtaaataattagtgcataagccaatttgtagtgattctcgacaatggagggatttatcggacggatttgagaccataacgggggctgatcagttcgaaaaactgaaaatttccattagacagtaaattaaaaaaaatttatccttccataataggcagaagcaaggaatggttctcatcgcttataacattctatcaatctttcactgtatttaggcaaaccctttccaatataagcactaatggcatttttatttatcaaaaataatagtaaaaaaatatacaaaaatatttctttgaattaaagctgacaacattggcaaaatggggcggaaactgtattatgccaccagtgcaaaaacagaaa

SEQ ID NO: 4535 - DNA, 2777 bp, Heterodera glycines
ttgttaacagattttcacaaaaaaggttggtttttgcgattattaagctcaattggtaggattttcatttaaaaaatgataaaatatgtatcaatttaaaaaaaaaactatgaggaatcatattttctttataggaaacgcacgagtatacaaaaaaaaaattgaaaataatctaatttctgtagagggattgaaccaggggaaagaagaagggaaagtcaaggagactagccattaggccatttgcacacttgggcagtgttaatttttatttttccctttgactccaattttcttcactaatttttcactcatgctggtatgcacaatgctaaggatatttatctgtagctagcgatatgtggatagggtagctgcagataaaaaaatctgcagataaaatccctatgcacaatgctagcgctaactatctgcagctgaagatttttttatctgcagatacccatccgcagcaactctctcgtcacacatctttttatcttttctatccctcaagagaaattttctaactgggggttttcgaggtcgctgatcatgaatctgacatttatttcaaccaattcctaacccgaactcgaaaggtccaattttcggtttttgttcaatcatcatgaaatgtaaatcaaaaaattttagaggtattaaaagtcatttagtacaatttttcaatttttaaacttatttttgggattttaatcgacatttctatcgaaattatcctcatatcgatgaggatagtgattttaatctgcagataggtggtagctgctaccctatctttagcattgtgcatatgtagcctagctgcagctgacgctaaggattatttgtaaaagaaactgtcattgtgcatgcggattttaatccttagcattgtgcatacggatttatctgcggataacgatttatctgcagatagttagcattgtgcataccagcatgactgacaaaaatttcgtggtaaataattagtgcataagccaatttgtagtgattctcgacaatggagggatttatcggacggatttgagaccataacgggggctgatcagttcgaaaaactgaaaatttccattagacagtaaattaaaaaaaatttatccttccataataggcagaagcaaggaatggttctcatcgcttataacattctatcaatctttcactgtatttaggcaaaccctttccaatataagcactaatggcatttttatttatcaaaaataatagtaaaaaaatatgcaaaaatatttctttgaattaaagctgacaacattggcaaattggggcggaaactgtattatgccacagtgcaaaaacagaaagtttgtgttcgagaacatcaaagtgaccggtgtgacggcattttgtgtgggatcaatcaaaattatggcgacacggcgataattaaaaatgtgaagatcggtggcggctcaacaaatgtgtgcagcttgttcaaaggaaatgatcaacagaaacagccttcggtgattcacaactacaaagtcggagaagcgggcgacgggaagaattgtgtcgtttcgggcagctcaagcggctaatggaaaaagtgatcggagagagagagagagattggatttacaataaattgatattcgtgagtgatcatcataaacctaataataagcgcttgaagtatttgaaatattaagcttacaataaatttgctgaataaatttatgaagcaaatccatttttctcggataaggatggtcagctgatggaaccacgaatttaaaaagaaaaacttttttttttcaaaagaagacttggcatttcgtatgaatgcctgtttagcatttaaattgggtggatgtgcgtcgaatggaaaaaatatacaaatgtctacgtcaaatttataaatttgaaaaaaacaaaaggctgcttagcatagtttatggaaatcccagcgagaaaattgaaatgttttcgtgactcacattggcattggcataattatcatcattttggagttcgaagctcaaaaaacccaaagttttcgaagccgaagtttcgccagccttggtagcgatacttcttgagggcggattctttcatcacacattgatttgtttttggttaccaagatataacgtggcaaattgtaccgaccatcagcaaaccaattttcttttaatttgtttccctgacttttttatggtctagtaaattggtatcattcgatttcgcgtgagattttgtacataatttttgggtttgactgaatgaaacggggaaaattttcattattttcacatccattgccttccctttctttttcgtccctcgtctaaatggtgtgggactttgtccgtaaattgtgaataaaatctgtgctgaatgttcagtacacaagaaaatggattcaaaatggactacaaatgtgccaaaatggaaataaaaagtgccaattgcttacgtaaatcccccaataaaaaatccgtttgtctggcaatttcgtataaattcagtgtccccatcccaaagaaatcactctttaaaactttccaaatttcgaaatgcttttcctctcttttccgtccctcgtcctccgccaaattcgcccttctttctgtcgctgcttttcctttctgctgatgttagccatgctttttgatctgatcagcagcggtcgatcacttccactgggcccaaccaacgaaagggttttcttctccaacgcattacggtaggtattttacttgggttcggcatactgtaatagaatccttaca

SEQ ID NO: 4536 - DNA, 3101 bp, Heterodera glycines
  misc_feature (3095)..(3095): n is a, c, g, or t
cccaaatttatatgatcaatttgttggcaaattatggcaaaaccattcctcccaaacagagatcaatcctggcgagtctggctgtacacaggttggttttacaataatttgttattgaacttcacaatttaacaatttattttggacataaaggaaattatatattaccaaagagaacgaaaaactttatttttttttcatatcgaaatttttgaattttccaggctacaagagaaagtctagctccttcaaaagatatcaattttctaaaattgatggacaattaaaattttttttattgcatttggagccgaaataactcccgacccgccaaaacgttacctaaaatgatcaaaaaattagcattttattatctgaaacaactcaacttcctcttttgtttagaaccgtcagtgcgaagctgtaagcatatttgggaatcaattttgaatggataatttttcaaaatttcttactgtaaggtatggcctggttcatactgtcggtcgggcgaatgccgttgtgccaacaaccagccgccatttcgaacccgggatggccttgtctgtcttaactacggcttttgtcccctgaatggtaacaacccaaagtttcgaattgaaaatcaggtaaaatttgaacaattcttatgctaaaggaatttatgctttgaaattttcaggtccaacaatgttatggtaaatacaattaaattaaattttaatttaaaaaaaaatattttaagatttaattaacgcgtaggtaaaatatttaggtggcgcagatgctacttgtgaggccattggtgccttggcatatgactgcatatgcgacagtgaagattgcactgtaaaaatggaataaaaataaaaatcaaaatttttaaaaatactttaaaaaataatttatacaaaataatattaaatttaattgttgaataaatttcttcaggttaataacccaatcagtttctgttgtccgtcaaggggtaatgctaatattttttgctacttaagggttatgccacccctcaaaattggtcaaaaattttcaaaatttctttgggtttcaaggatgctgatcaagattttgagaattcagggctttggataatttaacccggatgaatccttttgccgttttcattgtttaaattttcagcttttgcttgtattcaaccacctaatgagggctttacacccccgggcggtggatcaagtttgaatcactggtaccatgatccgatcacaggtaagcttaaaaagcattgtgccgaaatcccaaagcccaaattttattttaaaataaaatagaattctacatcgattattttaattattttccatttatttatgtcaaatgacccctccaattattatattttaaatctaattcaatctatcaaaatagaatttaaggcgagtgccgcgaacttaagtaccagggatacggaggaaatgcgaacaattttgccaccaaagaccattgcgaagtagcttttatctcatttacggtatttacccaattttaaaattttttagagttattgtaaacaaagtgagtgctttttttgttgaagtaagaaaaattaaattttcagcttgcagccgaggccttcctctgtatagggaccgtaccatgggtgttaaacaagagccagtatactgtcagggtgctgacaatggttgtacaagtccaaactatgtgggatttgcaaatttgaaatacaaaatttaaaattattttaaaatttgaaggtttgcacggcaatgggcacccttcaacagtgctgtccaactttcagttacctaattaggtgtaataaaaaaaaacaaaaattattaagtgcatatttgttcacgaaatggtgcaattccaaccgaagtgtacaacactgccggtggccttcctacagaatatttcgatgttggagtgccggacggtagcgaaaagttaccgtatttcctataataagccccctggggttttattttttgaacccccttccccccaggaggggggctttatttcagggagggagcactaattgaggggggggggggctttatttgtcaacctctctaaagaggggtattcagggggctctaatttaggaaatacagtattgaaaataaaattaaaaatcatgaaatttcatatttttttaaacttttctaaggaagcggtcaaacatatccacgattttattatgatgccagagagggaagatgcattcaattttctgtgcgttttgctcattttttttgttattttttttcttgggatttatttcactgcttcagtttcttggccaaggcggtaacttcaacaatttcttgtcccaagatcattgtgaaaaattctgctcaagaagtacagaaaatttttagactaagattttacattaactaaaaaattttgaagtatttcagttatatgtgttaaaataagttgtaaaaaaggcattgagtatttttaaatcattcccattaaacaaaaatattccatgaaaatattttcggtataggttagcgctagagctgctcgagactctcactctctactctcgttgttgatcaattctcgttctcgggtctcagggtcatttatcagtctcggctcaagagtctcggaaaattttgaggctcaagcagccttagtgtagagcacgatgggtgtgcttgttgtaaagggaaagtgcgggacggatcaatttggcaaattcgctaattcaaaatttactactaattaaatttcgtctttttttgccctgatcatagtctaatgccaacgacaattaaattcagtcttatgcagtgccggcgagccgttgaaggacagtagcggtgagcgaaacatggaatgttcgccgaccggaagtggcaccaattcgtgcccgtcaacacacagttgcgagtcaaccaccggctcaacaacatttggtggaatttgctgtccacggactcaatatgtttgcaagtcagttttatttatttatattttaaatcaaataaaatttaaatgattatttggcctcctttctcacaaaattgcacatttttgactttttggcaaaaatttaataaaaattccanaattaa

SEQ ID NO: 4537 - DNA, 6521 bp, Heterodera glycines
tgcagaaaaagcatgaataaaattattttacttatggatttgcaaaatgcatcttatactatcactgtttcgagatttcgaataagtgtgtaaacttggggacccgtgcccggtttttttgaattgtcgggtttttattgggtttgcctgaattattattttcacttaatagacataagatttgatataaaaatgcataaaattgacaattgttggtgactcatcagaaataggaacaaaatttacaatttggttccggcatcgcctatcggcaccgccgatcctctcgtgtttttttttttgttgttaaaacatacagtaaaaaataaataattgtaaaaaagtaacgtatataaatgctgaattaaaattatttctcctagaaaaggcagaataggtaaaatcacacaaattcaatcatatgctataaacttttattccaatttttgagttttcgcgatagaaatcctgtcttctttacaaaaaagcaaatagtgtatttttatgtcaatcatttttcttttatttcttggccaatttgcggtccaaattcattgtttaatttcggccttaataattatttttcgtttaaaaaaaggataaaaacgtatgctttattaagcacttgccagacattttcattcaatgggtgtgacggcaattccaacaattttgctacacaacaggactgcaaggattactgtcgagttgagaggtagattttaccatcatttaagagaagaaaatttttatcccggcgaaaaaatgtttcactgtcgagcgggataattagttaacgaaaaacgaaatcaaaagtctgacttatggccaagacctcgaaaaaatccactttcggaccgcaaatgtcgggacacttaattttttgactttttttgcatttaaattaattagataatgtgttaaaaaattctttaaaaatattatttccttttcagctgtccggacggtggcgaagttggcaaaaaaaaaaaaattaaaaaatacattattaaaatttaaaaaaaaaccaggtttggaaagagcccaacggcgctgtgcgcccatgcacaacaaatcggcaatgcccttccacacactactgtacccctgttactgtattttcgggcaccgtataccaaacaaaatcactgtgttgtccatccaaaaattttgtttgctcacaaccaaaggttaaggaaaataactttttttactggaattcttacaaaaattttaggaccaaggtgttagatgtagcagtacccgaatcacacgacattttttcaatgctgacacaaaaacttgtcaaccatttgagtataacggatgcgagggtaaaaaccacacaattcaataattatttttaacgtgaaatttaatcgattaaaaaattaattaataattaaagaaaaattaaaggtaatcggaataattttgccacacaaaagtcgtgccaaaattactgcttgagtgaagcttgctctccgggtactgttgtggccagagactcagacaggtggattcgggaaccattttttttaaaccgaaatttttgttttataaatttcaacctaaatttttagttttataaatttcgtagagcttttagaaaacccataaaataaaatttaattaattattaggcttattcaatgcacaaatcctggtggaacaggacgggttagtggcggttgtcctgatggatactcatgcttcagcaggtccttcttcaaatccaactatccgatagttcagctacatttttcaaaaaatgcatcaaataaaagtttttaaaaaaatttatatgatgaaaaattattcccataaaaaaatttatttttaaaatgacattttttgcttttcaacccgaattttattatataaaagccgacaaaattgtttttttttaaatttatgatcagaattggactgaattaaagagtctgatcgaaatttattaacagtggcaagagaatttgtaaaaattaatatgaattttattttttaataactaaattcttatttaaaaataaataaattcttatttttttgtttaagccttatgcccagctggctcttcaccgttcatttccgcattgtcactacagcctatgcaatgcactccaagtgatatattttaattacaaaagaattttaaattcatttttttaataaaaaaagagtttaattacaaaattcaactttcaacttgtttttcatttttagttcaatcattaaaaagaatttttaattgttttttgtccaaaaatctcaaaatttttgttgctttttccaagtttttgaagaattttttaagaggtcggacataatcggtgcattttttaattgaattttggtaattaattcttcaaaaatgccggaataagggcgaaatgtccagaatttgaacataggtatgtgcacatcatatttatttgcctcttctgaagcattaaaaataattggcattaattaaaatgtcagagaatttaatttcgctcaaaacaataaaatcgcagtcttatgcgaaacaaaataaaatgtttttctgatagatgtggatggctcttgtcctggaaatttcttctgttggttttccactacaacgtcatcagtgaacgcgttttattgttgccgttcgccggaaagcagcatcgacacgggatgtatggaagaatgtggtgctaggtcgtttgataaatccgccaatttagtttttcgacaaaaaatggcataactttgcttaaaggtaatcaaattttacattcttggtataattcgatagccaagttttttctctattagcctgcataattcaaaaaaaattggtcaactttggaaaagttgcatgaaaaaaagtactatttctgccataactatgttaaatttggtaattttatttgaacttaagcaagctaatagagaaaaagatgggctatcgaaaggtaccaagaatgtaaaatttgattgcctttaatcaaagttatgccatgttttgtaagcatagacaaaaacagtaaataggtgacatataggaaaatgattatatcaatgttaattaagtgaatgaattttagaataattatcaatttcaaataccctaattcattttcctaatatattaaatagagattttttaaagaaatcgttatataacgttctttttaatatcataaattgaaaaaaaaacatttatagtgccatacattcattttcattatgaaattatttcattttcagtaaatattaggaaaaaattaacttagattgtcctccacaacttgtgccggtgcctggcgaaggcgctacaccctacagatattgctctccgtcggcaccaattaacgatggcattcaggtccgagacatattatatttataatagtattttttaatgtttaaattgtatttttaataaaataatcacatataataatacatatttgaaaaagggatgcggtataaacagacattgccaatactcaacaacactcgaacgctacatttgttgcggacttgagagcgatgtccgactaccaagtagccggggggatttatcggtggggggcaattcggtttccgcttttaggaaaccataacttttttcttttctttgatgacttataagactaaaaaaagttatgacatacggcgccaaaaagccaagtaaaagtcaattttttgagcttttttggccataacttttttgtaaagcgacccaattttttactaataaacagaaaattaagaaaaaaaatggaaaatgaatgattctctttaaaattctacttaaaatttttaaaatttaacagaaatctctagtgaaaggacatcttttttttctgaaacaagttgtcaccagaaattttaattttgtttttaaaaatatgctgtattcttggaaagcttaatattttcaaattacctgtaaattgtttggtacaaatgttgattatgcttggcaatgcaaatgtccgtgcctgcggcgcaaatagtgcgcgaaaaatttaaaaaaaaagctgtctcattaagtattttaaattgaatgcatagtgaattttcagatgtatgtccgcctcaaccagcaaatcttgttcccgttgaattggccggtaactaccgtacctgtaatccatacgccaggtccggcaccccacaggtcagtgattcctttcttcttatttattttcttcacattattttaacgcgtttttaaatcaagaatttttgaatttttaaggcctgcccagagaattctgcatgtctgtacacaggccaagacaatggctttatatgttgccgagtgcagctgcaaagttcgcccttttcctcacgtcgtgtgcatcgatttttacattagaaaattttgaaaacaaatttaaaatttcatcatacatacatgtatgatttcataaaattatgattattatcaatggaaatgaaaaaaactttttaaatcacacctgtcttttctgtaagcgattatatcacttccaaatgttcatcaaaaattaaatcattttaatgaccattatgatcaaaatgcttattatgacagcaatttgtccgtgaattatttgaccaattgggcatgaattttcttctgccccatccttggccaaatattttatcaaaaattatttgttgctttattttgctaacgtccgtttgattctttttaatagcaataatattttcattattttaaaattaaaatgaaaaataatttgtataatataaaatcttttacataattaatatagtaaaaggtaagccaaactatttatttcatcttatgaatgccacaatcaatactttatttattgttttttcatttttaatacaattttatcaaaagctgtcgttgattaattttgcgtgcaattgtacactagaaaatgtggaattacaataatatttcccttttgcgtgcaattgtacacaaaaaacgtggaataaaaattacaataatattttccttttacgtgcagttgtaaacgtgaaattacaattcatatttcccttttacgtgcaattgtacactagaaaacgtggaattacaataatatttcctggaattacaataatattttccttttgcgtgcagttgtaaacgtgaaattacaattcatatttcccttttacgtgcaattgtacactagaaaatgtggaattacaataatatttcccttttgcgtgcagttgtaatttcccttttgcgtgcaattgtacactagaaacgtgaaattacaattcattttattccataaaacgattcattcattttattcgtcaaacacaccgttttttagcaaattctctggcatactgtacagttttttgaccaagataatctcatccgacctaaatcgtggttatttttactttggctacaactgtaatttagattgtcatgggaattatgtatgccgaagggtaaagacaatcacataatataaaataaaattagacaatttttaattgtcacattagtaaaataattaatttttttgctcatttctcaataatcagaagtgatcagaacaacagcaacaattcgtcccaatcccaaattctaatcacacgtcgtattttcaagtcgttaataatttagtgtttttaaacagtttgtgaaaagcgtttgattgacatcaccgaataaatgaaatggtacggatcaaaatcgccaattttggcataaattttgtcctggacaagaatgtttgttatgagcaaccacgtcccgctggtggaccatatcggacgggtgcgcatgattccactgttccaagcaccccaccgaaagttgaacgaaataaccaaaatataaggaaacattttaaaaaatttttattcttcacccttattcataatataagcctaagagggccttgttaacatgtaaataaaattaggtgcgtttcagagcattttctgaaaaaatattcatgaattaattttgcaaaaaattggaaaagtacgcaaaattgcaatgtttaaaatttttaaagaaacattatgggacagttaaataattatatgaataagcattcttctcagctgttaccctgcaaaatctggtgcatttctgatcactactcgtaaaattatgagtgattgaattttcactaaaaagttaagcctaaactttttggcctgtttaaaaaggaattaaaaatttttaaaaattttaatcatcttcctttttgatagaaaaagcatcagagagccttattaacatgtaaataaaatttatcagattcagatcgccatgaaggagtaatctgatcatgttggtccaaaagatttatttgttcagcatcaaaagttagcttacaaattagaggaaatttttctgatttttttctctatataaatagatttttggttaaatttaagaaaaatttgaaaaattttcttaataaacttagttaaaaaataaaagttgtccttggagatttctacaaaaaggcctaatctgagagaaaaatttgctcaaaatcgtaaacttagtcattttt

SEQ ID NO: 4538 - DNA, 1421 bp, Heterodera glycines
  misc_feature (11)..(11): n is a, c, g, or t
  misc_feature (1364)..(1364): n is a, c, g, or t
  misc_feature (1373)..(1373): n is a, c, g, or t
ccccccccccnccccttctatatcgtgggaaaaacagtaactttctgactccgattcgaatttatcaagattcaattagtttggctgatgcctcgagagtcgaaattttccatcactcgagaaccaggatcgacctcgagaatcgagatcgagacccctataaaaaacccgagaaatttctctactcgagaaccgagaatctcgagcatccctttccatttcccattcaatttttggcatttccttgatccaattacattcacccagatcactttaacaaaaatttgcgtgtttagcttctgatcagaacgccgctcccgtgctaatcccgttgagcagtgaccaacaacagcagcaaatgtccagtcggatcagcaacttgttgacgacaggcattggtgcctgtgacacaaaattttgcgaaaaaacggatgccaattttcaagaaatttctcatgctcacaatcaacagcagcgaggcgtttccacagccaacagtgcctttcttgtggagcagcttcttcccaaatcggtgcccaattcaatggcatcgccaacttcgtcaccctcatcaacatcgtctccatgtcgacaaagtgggccattaccggtaggcgcggggttccatcaaagtggacaattcggcgactgggtttcccggacatttttaaccataagttttttgaatcacaacgaaatttttcgaaattagataggctattagagaacacatagactatcgaattaaataaattagttcaatttggacaaactaccaaaggagttatactctgtcgcccatttgcccctttttcgtcaatcaatcgcatctagaaagacggcaattcaattaaacaaaattttgctcggattatttggggagcaatttttggttcaattccacagtttcccacttctgccggcattgttgcggccgcaattgcttccgctgccaccaccacaggggccactggcgccagcacatcaatgccaagaccaggattaagcagcgccgtcgacggcggcggcatttctgcgcttagtttgcctcgagcgattgcgccatcgatcaaagtgggcacggccgcatcagccggcgccagcccatcatcattggctttggagtacgtgaacggcggctacggcatgaagaatccattgctgaacgcgcacaacgcgccgcccgacgtggacccgacgccggcgcccacctcagcgcccggcgcgctaagctgtcgcacttgtggaaaggtgcgggtccagacatgggattcatgtaggagagaaaaccctaacttcattcaggggttcccgaacgttttaagcggcaaagaattccaaaaatttccgaaaaaacaaccctnttaaattanaaagcaagtgaaaatttcattttagaaattccattttgcacggctgct

SEQ ID NO: 4539 - DNA, 4572 bp, Heterodera glycines
  misc_feature (2283)..(2283): n is a, c, g, or t
  misc_feature (4519)..(4519): n is a, c, g, or t
ctataaatgtttttaaagaatatctattccgataattaagctgctctcactaagaaatctttgatttttgaactaatccagtagcaaataatcaaaaaaattttaatataaaaattaatattttaacatttaaaagagaggaatatttttcatttaattttcaaaaaataattaaaaatttaagtttgaaaaatattttgttttaacaaaaaatttaaaaagaaaggaatattttttatttaattttcgatttttttattattttttaattttatttattttacttaattaatgcattaaatatatcgatgtctatgattttagtattctcagattttgtggttcttgcggagtaatagtcaaaaaattgtactacataatctattgtattctcaaatatttttaaatttaaaaaaaataaaataaaaatgaaggcgacaatgaattgagtgtttgtgtttatttttgctttgtttttcttgagttttcatcactcatattcttcttctctcgtcctgaacttgttggccaaccatgcaactttgttcactacttcttcctgaaaaaacattttaaaattaaaaaattgtttttttaattgtttttttttgcctgtgcgaggttgaagcacatggccagcaaagccattccggccaacaaataaatgctaaaaaatcaattaatatatatatatatattttttagagatcggagaaattttggctgcgttttccttacattaccgtatttcctattatacagccccccccccctctgaaatagtgtcccccctgaaataaagcccctttttgaggggtggttgaaaaataaaggcctcaggggctctatttcaggaaatacagtacttaagaaacggtggaacagttttttgttccagtaattcgttaaaagtccattgccaagccccttcaatccgagtttttttttctttcaaaattccagtcgtcgtctatatttggcacgaccttgtgatgaccagcttctcctgcgcttccttgtcactgccaaccgcttcgccaggaaatttgtcgccaaagccttaaaaacaaatatataattaaaaaataataaaatattaaaaaatataataattttaccaattgttgtcaatgatatgtaacaaaaataaaaactgtccagaaaggtccatctgaagaattttataaagttattattgaattatatatattatttattttaaaaatttaattaaatatatttaattaataaaaattatgtttgtttcaactcactcctcccacagacagaagagaatggcgccagtcaccagataggcaagcattgtcagcaaaaccaacgagaggggcaccttttgttgaaactttcaataattaatgatttttttcaatacatataaattagagtttaattagtttatagctttgtcctttttgggctattaaagcggttaaatatgtattaattaatatacatcactaaaactaagagtttgaaatgttgccaaaaattttctcataatccacgtcataaatgatcaccgatatccgctgaagttgggcttcgacgctttccttgacttcaagttggaccaaatgggctctggctgctaatagctaagaattgaacaataaaaaatattattaattttcaattttatcacctcattaacatcggctgctgcgccagtgacaaaaccgccattgaccggcagtgtattggcaccactggggccaattgactccaacgagcattcgtcctgttgctggaagcgcaatgtgctcaaatctgttgttaaaaaagcgcagatatttataaattttgaataattaatttttaataaataataaaatattttttatgatattgcgcagagatcaattttttgagacttattctatgtgaaaaaaatgaaaatatattttctctctttttaaataagatatctttaattaatttttaagttaaatttttgatcagaataattaatgaaatatatttggctacaactatttatttatttttatttatcgaatgccattttattaacttttttattattccaattttaagctatataatttaaatttaaagggaacaaaaatatttagaactggagcaattaattatcaatatcacttttccttacatggatgatttgaacgggtcagctggcaacccaagaattagcacgtcgaatttttgccgcttgacgacgcttgtgccacaaaatgatggtgtatttaagacgaattgagcgagcatatagaaacctaatttaanatatggaaacaaaattttttattccatttttaaaaatttatattttttaattttcacctaaaaatttttgccatcacatcgccaatgtttgtgaggaacagcagcatcaatgggatgccaatgattgcaaacagaatggtcagtgttttgccgaaataagtttttgcagatgtattgccatatccaattgttgtgatgatctttataaaaaatttttttattactatttttaataatgtaattgaatataaatgatgatgtcacctaaatatgccaactttacgtcattacgatcaggtaaattaattaattggcccaaaaaacgtttcactcattaataatgtgtcggaatcccgatttccgacctttttggattcgaaattagattccgaaattttttgaactgtcggaattccgattactaaaatttttcagccgttggaatttcggtttttgagattttgagtgcctcggcacacttccctggtgggtatcaatttttaggagaattcttgaagttaattagggtttgacctacgcattaagaaataaattgattgacttcaaaactttcgctttaatgttataattccatcttaagactcaaaaaatttcactggcatacttcatatttaataattaattatatttttattttctaccgatagagaatagagaaatgagccagtgaatgtccattgagctgcacggccaaactctttgccgtcatagcctcgatggatggcccaaaggcacctccgtttgaaaaattttgtctgaatttttttaaatttataaattgttggcatttttgtttttattttacctgctcgtacactatccgttcccattccgtcttgtctaatttgttcacacgaaatgtcgcattccatgccacgtcaacagcatgcctgtttatgaatttgaattaattgattgttaattcaacaaattgtaaaagcacctccgagctccagtaatctcactttggatgtaacgctgaaaacagtatgaaatggtattttaaatattaaattttattttttaaattattaagtggattaattatccacctcatgtgggccttcaacggcacggaaaacaacggcacctaacatggcatatcctatcacctaaaaacaataaaaattgttaaccccattagatagaggatagtcaaaaaagacgaaccaatgcacaaagtccaacatgtgagaagaaaaaggcgataatccttttcaccaaattcaccacatgtgtgaccttggaagagttagtttgttaatagacaaattattttgttaattaattaaattttcaagaatttttgaaattattttttattccaaaaacttttgatcgtcgatgatttcttcgggacattcgtggagggtgccttagtgagcgctattacacgcttatcagcagccttaaaaacctttctgttgattgaatgcacattgacagaaaaattgaatgctttaagaatacagtactaaaaaatgaaaatttttgaccgggatacggtatttgtgaaatttaagcacaataaaaatgaattgaattaataaattttgttcatcggctgatggtcattcaatatgtgtgagtatctgtggagaaagtgtaggcaaaaatccataaattgggggcctttcttttttggcatccaattgcatgtcggtcggttgtccgtctctttgccggcggcatgcctttcttccccccgattttgtgccctcgggggaatttacgccaccaatatatatccaaaggcaccaactgcacagctggcacgaagcgccaattgaaagacgaattgttggccaatgcttttaagttttttttgcatttggcaaaatgcgtcatcggatttccccttaaattatgaagaggattttcgtcaaaaatggatgttttgttttagcaatgactgacgaatgaatttcaaaaaatgtagaatttaatgatcctatatttaaatacaattgggacatttacgatatgtacccattgtattaaatgttgaagcaatcaaaaaaacagcaatatcttttgggtcggtattttgttggaaatttaaaaaactatcacttttttaatgataataaaaaaccccaaagccaaaaaacaattcattcgtatttttataatgtaaaattttttttgacacaaattttatcacaaaatatttacaacaaatcgaaaattagcactaaaataattcaggtataanaattaatttaattatttttaatattaatattaattttaaaaaatattacacta

SEQ ID NO: 4540 - DNA, 1627 bp, Heterodera glycines
gataatgagagtgaattgatcgatcgaaaatgtgagggatcgatcaccaggcaaataaatatatcttcgggatgtgaaattttccatttgctcttgaatgatccagtcgagactggttccaatcccttcatcagtttattttaatgggtaactacaagtcaaggcctcaactgtcatgcgcaggtaaagccaccaaaataaaaaatgaaatttttaaatgagtttttttaatgagttaattaatttaatggtttttaaaactttctaaatccaatcagatgagctgaagaaacggattagtgagggatatgccattgtgcggtcaaaattaaatgatgacatcaaaccgaaatttgatgctcgctctgctcttcacatcaattgcttgtacgcttcaatttttaaaatattttaaagaattttagaggcgtaattcaatggcaaattcaaaaaattttataaatttttagtcagggtaccctcgagggatttcgttccgaattggatcaattggacaagaattgtgatgacaaaatgagcaacggcggtcgtgagctttcacttctccatttgatctgcattggcatttgtgaacaggtcattagtgaattttctaattttttttggcacaaaaataatgtcaaatcaaaaaattttaccgctttagcaatccgagaaaatccgccttttgttggaccgttgggaccgttgcagtgtagccggcaccactaccaccaatgttgtgtcatcaaatggtggcactgaacaaccgagcaacggcaccaatattgccattaccgcaaatggagacggtggtgtctgtgttggtggcgacacgcacgacgctgctgctgacgcggcacagcatcaacagcgtgcacgcgcgttgttgcaacagcggacgcggaacgggttcaccgcactgcacattgctgtctataaaggagataaaagcgcgttgcagacgctgttggaggaaggcgcggacccgaacgcgacgccgaccgcgtcgggcgttccccctcctctccacttggcggccatgtacaattcatttattctctcactctcgagaaaattttcaaacaattttaatttaaaaattaaaaaaaactttaattgcaccaaaaacggcacataattgcaccaaaaacggcaccttctttaacaccaaaggtccggcaatgtggatgtgttgcgagtactggtcgcgcatggtgccaacctacagtcacaggactttgtccgctataccgcccttcattgtgccacctatttcgggcatgcccaggtagcagaatttcgccctggttgtctctctcaattgtaaatttgcgtgttctacaacagatcgtgcgggaactgctcgaggcgggcgccgacccaaatgcatgcggcggtgttcatgaccgaccggtgcagatcaatttgttatttgtcaaaaaaaagtgatcaatcgctttttcagattcatattgctgcgggcaaagcaaatccggcaatgttgaaggtgtggaaaattgaagcaacctgttgatccattttcgatctaaattatctaaaatttttaatctttcgaaatttcgcttcagggtgcacccctgttgaaggtttgctgaaattcaat

SEQ ID NO: 4541 - DNA, 2841 bp, Heterodera glycines
ttattgtggtcgaatggacgcggtcaagcagctgttgggtgccgcgggcagtgaagtgctgggaatggtaaattgaaattttcaaattaaaaacaaaatcatttttatttatttattttttataaataggaaaatttattttccgaaaccccattgatggccgcttgtacagcgggacgcttcgagttggtctgttttctgatgcgccaaccggaggttttttgagtaaaaaatttttacttttttattttttgccattttcaggttgacccaaattaccaggctcaggatgggcatacaggcgaattttatttttaaaattttatttagtttttattattttaatttttaaaattttctttttttcagcattacacagtgcgtgcttccacgggcacatccgtgtggtgcaatatttgctggacaacggagctgatcagtctttgactgcccgtgcagttgacagtcctctgatcaaccaattcggcaaaaattatttaaaattatttctaaaaaataattttgttttaaatttgcgtattcattaattacccaatcaaaatgcgattaaattttaaatatataacattaaacttttcctcaaggaaataataacatcagcacccaaaaccaacaacaacaccctttatcatcatacaacggaatttcgtcgttggcctcgcgaattgcgccatttgcacgagcggaaaattcagataaaaatttggtaaaaaaatgaaacgaatttttaaattttattttttatttttgcgcagtctgttgttgattttcctcgctatgcaaagtgtttggaggaccaacaatttcagccacaaacaccaattttatgggcatatgaaaagggccatgatcaggcgaataaatttttttaaaaataaataatattttaaaattaataattacataaaaatatatatttaaaaaataaaaatgttccacagattgttaacatgctgaaatattatgcaaatcggcggcccgattctgacgcctgctctgaatacaggtcacttacagaatatgaaaaagtagatgaaaagcgaaatgttaaagctccgggagcagttcatatacgccattaccttctccgcttggtcgtctgcgttccatgacaaaagttgatttttgaatatttgaaaaaagatatattttttcaaatagttacaaatttaattaatttcataaatacaattaaaaaataaatagatttttttaaattaaattttttaaatacaattttaaaaaaactattttcaaaataattataatatttattacatattccggtctatgaaagcgtttttgatcaaaattttatacatacatttaatagaaatataaatatgaaaattttaatgcaaaaattggaaaagaaattttctgatttttaaaacaatacgtaaccatatggatttattctttgacaattcatgattcaatgttaacaggaaaaagcagaaattttacaactgcgcggtgagctccgttccgcacaccatctttcactgctagacgttgagcttaaagaaccaattggttggtattgaactgtaaaaaaatttttaaaaaaaatcttcgaaatttttggcaatggttcgtttggcaaagtttaccgtggtgtttaccggggcaaaaccgttgcggtaaagcggtataaggtattaatgtaattttgccaaatttttatggtgaaatttcccataatttctaaggttgtcgcatttggtgcaaaaacagaggtgggcggaaaattaaaaaatttttttttcaaactttattaaaaatatttttttaaatatttttctaaggttgacatgttctgtcgggaagtgtccatagtgtcacatttgaagcacacaaacattgtagcatttatcggggcttgtatggatgatcctagtgtaagatttttttaattttctaattttcataaattttttagcaatttgcaattattactgagtttgcctcagctggctcacttttctcactgctccatgtacaaaagaggtgtgaatagaaaagcattcattctatttttatttaaaaaaaagatccaattagaaattattttaaaattcatactttattatctgttttttttttcaaaatttgtacaaaaaaaaatttaaaaaaaaaactaaaaaaccatccagggtcttcgagatgacactccgactttgtatcggtgtggacattgcgagaggaatgaaatatttgcacgaattggtggaacggccggtcattcacagggatttggtaggacaattacaacaaaaacgatacacataccgtatttcatgggggctaaaaatacggtgtttttgtcagaactcacacaacattctgttgcacaacaatggccgtgcagtggtggccgactttggcgagtcgcgcttcgctggttcgcatgacaagcgtgacgacaacatgaccaagcagcctggggttatagcctagcctaaataattgaagagacaattcattccgcggatacaatgtccaattttggacgaatgatccaattgtcctctagtccaataaattaattatactccgtttatctttaaaaaaaattttgaaatattttttccagaacctccgctggatggcgccggaagtgttcacgcaaagttgccgctacgatcataaggttttataataattattaaaaattattaaaattatttccaaaattaaaaaaaaaacaacatcaattcatgaaggtcgacgtgttcagctacgccttggtgttgtgggaaattcatgcagctgaataaacattctcacaactaaagccggcagcggcagctgccgaaa

SEQ ID NO: 4542 - DNA, 5749 bp, Heterodera glycines
  misc_feature (5521)..(5521): n is a, c, g, or t
  misc_feature (5617)..(5617): n is a, c, g, or t
gggttgatttaaatttaaattcgtcgtccgatcggtgcatagataattaggggaatttttaattttgcatatacatcaaaattttgtgggtattaagtaaagcaaaatttcaaatttaccgacaacactaaacaataaaaatgggtcaagaattgtgattaattagattttttggatataaaaggcagtacgaagtttttccgttcataaaccaaattcataattcccttcaaatattgtttttatgcaaaaataaaatatattttaaattgactcatttgcccccccccccaccctgctcttttcgtttcttaaaatttttcacatttactgtttacattttaccatattgcattattccaataaatttaaaaataaaattttgtttagcatttattcataaactacatttatttatttcaaattttaaaaatgtctacatcggaatcaaaaaatggtaaaaatctcaattcctcccttaacattaacaatctttcacctacagcaccggacgaaggcgactgcgaaatgcccgatgaacgtgttctacacctcgagtgctttgagagcggtgattatgatgtaaataattgttgaaaattccatttttttccctcaattttaatccatttcagatgatggaattgtacggaccggaccgtgctaaagaaatgctgatcgacttgcgcgactatgcagaggcgcacggaatgccatgtaaacatgtgaagatgctgttgtacaaactggacaaaggactgatcaaatggaagggaaccaagccatgaaatggatgatgagtgatcagatattttggtgacaggacgaaggggggatgattgaactcattggtgatggatgtgatttaaaaaaaataaataaaatttgagaagaaatatttggaaaggaaataattgttacttcccctgatcggtcacacggggttcatttatgagcgcccatctcgccaaaattattattataaaatgggcgtggcacctggcccgacttttttgcgtataaatacgggctcaccgggtggcatttttcatttggcgtcccttttcaaattcacaattcctatggcgatcaacatctccgacaaaaaatcgttgtgcaaccaaatcctcggccaaacggacctcaccgtgacctcgagtggtataaccatcagcggtccccgcctctcgacaccccgcttcattccttttgatgaagcgggccgttgtaggtgttgtaagggaacggagtccgaaattgacactgtgatcacgaaagaaggcatcacgctttggtgcacccgcatagagaaggcccaattcatcccgttcgatgttgtgtatgatttaccgggacattgttttttccgtctgaaaaataagtctcgtgtgttcaacataccctatggcgacataccctcttctgacacgcacaccactaaacgacggacacacaccaatgaccatcagcatgaactgaagcgcaaagcaaaggtagctcttgacttagtggaggccggactaatggcagatgccatgcaggacggcgcacgttggaagaaggcgaaaacagcaatcaatgtgctcggcaacctccttttggcggaatcgttagacaacacttccgctaatgacacttcgctgaaaaatgataccgtagacatcaaaaaagaagaagcaaatgtggaggaagaaaaggtgcaggaagagcccaaagaaaaagaggaaaacaaggaggaccttggagacattgacaaaaccctcgatgagttcttcaacagtattaaagcatccacttcaaacatgtagaccatcattgtgtgtaaaaatgttaaacacccaagcattcaacgataaagacattggctttaaattaccatttggtctaattatttcgggcccatcgtcgtcgggaaaaactcaatttctgctaaaattcattgccgaatcggaccatttaatcaccccaaggcctgtatcgatgctctattgttttggtgaaatgaatgcggcggtgcctgtacttcaaaaggcgggagtcgatgtgtacgcgggagtcccatccgaggaattaatcaaacgtatcccgaagccccttttgctcattcttgacgatctgatgttgtccatcgatgagagatacctatccgatttgttcactaaaaaggctcatcatcaccaatttgcagtggtgtttgtcacacaaaatttgtttgagcgcaagataaaagtggcccgtctttccgctcagtacttggtactgatgcgggccccaaattcgttgctgtccatccgcaacattggcgttcagctctttccgcgtcagcttgacttttttcttgacgcataccgcaaggcgaccgcccggccctatggctatttgttgattgacatgcatgcatcgtcagacccatcgctgcgccttcgcacaaatatatttaaggatgaacaggaggaagatgaaggcacagtcgtgttcattcccaaaaatggagcggcataaccaacaacaacaagtaagggttggacaactgataaaagagaattcaaattggctctgtgccttggcccgaacgaaatcctccaaaaaatgtaaaaagttgattcgaatggcaagcaccgatcagctgctttcacttgtggaaatttgtttgaatctcgtcgcttcgcgcttccgacttacaacccgacagaaaaaacgattaatgccctatgtgagcactgtacgccggatgagcagaacgagaagtgagcggggtgccaggcgcgtgcttgtccagaagggcgcaggatttggcggattgttcgctgctcttttaacacccgttttggttgaattggcaaagaatgtcgtgagcaaaaatgcataaatacccccacatcattattgttttttcatgcaccattcattcatttgacaaaatatggcgaataaatttttacttgtccctcaagaaatttaccgaggtctgacctcaatgtcggacacgggcgatattaatttggatgccgttaggcgtgacttagaccgcgccagggtcgaacgaacacatccttctcgcaaaaatgtcaactacaaccagcagcttaggcgatatttaaaaatgcggcaagagttaacagacaaaccggccaaagttgagctcaccaaagggataagcgtgctgttgaggcgaggcgctgaagatgaggagggtgaagttgtggacactccaccccggcctcccgctcctcctccaccacctccgccgcctgggcgacgtccatggcgtgggccaattcctccaccacatccaccaccgccgcctaagagaggtcatcggcgcccaccaagtcctccgggtcgcgctccatccccgccaggaagtcctccgcctcgcccacaacgtcctcccagaccgactagggcatcgcggagagatggtcgtttggagcagtgggagaaaaggcgaaatgatatacaacgacggcaaccagttgtgcgggaccttcttgcggaagcagctgctgcccccttaccggaaagtgatacagatgatgattatatgttggagagtgggttagcgctgccagcgccaacacaatactatggcgacttgcctatgctgccctacaatgctcaacgtgaaattgagcatatggacactgctcagcagaggattgccatcagaagaaaattaaaaaaggacgaagcatatgatgatgattcggaacacaaaaaatacagggttcattacccaccttcacctccccggcttccgctcccgcctcgtgcgaaagcaaaaattgaaccaccaccatcgcgtcctaccgcaaagagagagcctcagaagccaacaaagttggaactaaaaccatcaaaatttgactccgatttacgaccaaaagtcgcaccgccacctcggccgaaaaaagaacctgaattcccgcttgaccctcggccatccacatccaggcaggctgtacacttgcctccagcacccaaaattataccaaaacctgaaccgacaaagaggcctgtgccataccgtatcccgaaaagagagccaaaaatagttgaacaacagccacagccgctgcaacaaccccttcctgcttctgccgtcgaagaagaaatgcccaccgttcctccgcctaggcgggggaccaaacgccactaccccgtaaatggtgagaatgatggtgaggtgcgcattagaaaacgggtgaggcaaccgagaagggtgagagtacagtactcgcctgaaccgggcccatcaacttctgcacaaagtgatgaacaacagcaacaacaacaacgtgaactgtttgccatcccgtcaaatcagctgaccatgactcagcgggtggaacgactgtacatcaaatgcaaccattatgcggatcgtatgggcgttcggggaaatacaattaacacagcaaacggcaaaccgttggcgcatagcaatttgcgaatggccctcaagtatataatagaccggagagcgggccgccccaccattaaaccacctggagcgaacctattggaagagcggcttaggaaggacccaattttgtattcatggacggctccgccaaagagaccgtcacagagcaaaaccacccggacggaacggacaatcaagaaggaatttcgcccgaaaaaatggagctgatcaacaccactcttgacaaaatgtacaatgatccatcatccccagcggcattcgctggtgttaccgcactgtggaaagaggcgcgaaagaagattaaacatttacggaaaaaggacgtacagcattatttggagggacaccgcacgtacactctgatgcgcccccgcagggtgcgctttccaagagcccgaaccgttgcggcggggttcatgaccgatgttcaagtggatttggctgattttcaggcgctttcgcgccacaatcggggtcaccgatacctgctcgttgcggttgacgtgctctcaaaacgcttgtttgttgttccgctgaaaaacaagagagccgaggagatgttggaggcattcaagcaactcattgaccaaatgcccatggtcccgcatcgcatcttctccgacaaaggcactgaattcaagaaccgcttgctcagggaattcttcgaggagcaggaaattgagaaacatgagccagtgcattcgttcgtcaaggcatcggttgctgagcgggccatccgcaatgtgaagcagcgattgtaccgctattttgcggaaaaggagacgctgaattgggtggacacagtacagcaaattgtggacggaattaacagctcgccgtcacgcgttcacggaatgcgccccattgatgttaacttttcaaatgcgcaaagggtgtggaagcgattgtacggacacccagcccttcaaaggcggacgccacgctttcataacgaccaatttgtccgcatgagcagagagaaggggcaatttgagaagggatatctgccaaattacggggacgaaatcctgggaggatatgacggcagtgtgcttgaaaagcggtgtgcgcacncagatttcgggtaccagaactagcgcggaatgaaccagcggaggagaagattactacagcggctagctctctgatgagcccaggaagttggcgcgncgtaagaaaggatgcagagacaagctaccgcatcgagaaggtttacaggaagagaaaacggtcggacgggaccaccgagatgcttgtcaaatttataggatatcccaatcgggagtggattgctgagtctca

SEQ ID NO: 4543 - DNA, 2624 bp, Heterodera glycines
tgccatccagtcaaatcatctgaccatgaatcagcgggttgaacgactgtacatcaaatgcaaccgttatgcggatcgtatgggtgtccgtggcaatacaattaacaccgcaaacggcaagccgttggcgcatagcaatttgcgaatggccatcaggtatataattgacaggagagcggtccgccctaccattaagccacctggagcggccatatttgaagagaggcttaggcaagatccaattttgtattcatggacggctcctccaaagaaaacagcacagagcacaaccaccaggacggcaccgaaaatcaagaaggaatttcgcccgaaaaagtggagttgatcaactccacgcttgacaagctgtacaacgacccatcctccccagcggcgttcgcaggtgttacagcgctgtggaaagaggcgcgaaaaaagttgaaaaatttacggaaaaaggatgtgcagcattatttggaggggcaccgcacctacactctgatgcgcccccgaagggtgcgctttccaagagccaaaactgttgcggctgggttcatgaccgatgttcaagtggatttggccgattttcaggcgcttttgcgccacaatcggggtcaccgatacctgcttgttgcggttgatgtgctgtccaaacgcctgtttgttgtaccgctgaaaaacaagagagccgacgagatgttggaggcattcagacaactcatcgaccaaatgccaatggtcccacatcgcatcttctccgacaaaggcacagaattcaagaacagattgctgaaggaattcttcgatgagcaggaaattgagaaacatgagccagtgcattcatctgtcaaggcatccgttgctgagcgggccatccggaatgtgaagcagagattgtaccgctattttgcggaaaaggagacgctgaattgggtggatgcagtacagaaaattgtggatggaattaacaacgctccgtctcgtgttcacggaatgcgccccaacgatgtcaacttttcaaatgcgcaaaaggtgtggaagcgactgtacggacaccctactcttcaaaagcggacgccacgcttccgtaacgaccagtttgtacgcatgagcagagagaaggggcaatttgagaagggatatttgccaaattacggggacgaaatcctggagattgacgaggtgttgaaagcggtgcgcccgattcggtacaaactgagggatgaacacggggagaaattcaagggcagcttctatgagcaggagctggcgcgcgtcagaaaagatgcggagacgagctaccgcatcgagaaggtttacagaaagagaaaactgtcggatgggtccaccgagatgcttgtgaaatttataggatatcccaatcgggaatggattaatgagtctcagcttgtataaaagcatatgtattttttcattttgttgaaaaaataaataatcatgtcgaacagtttctttgtgtttttgcccagcaatgtgacggattatccggacaatcagcccaacaaatttcgtgttcggctcccaaagcctttgcattttaatggcacatgggtgtgcgggctgcacagtatcagttacccttactcatggtcaaccattggcacattggatgcgcagtggattgacattcacttcatcgaccgacacgctttcgatgaggaaaaacagcgggtgatccgagtatcggtacctaaggcatcgcatagcagggttgaacagctcagggactttttggcggtcacattacgaaaccgtagcggagcaaaactgttgccaacaccccgtgaggtggaagctaacaggaaccgaacaaagcttcttgattctccaccaccactgaaaagagagaaaagggatgcgtcatcaccgccagtgtttgacgcgggtggaaaacgcctccaggactctcctcctttgtataatataaatgaagacgaacaacttgaggagtcaccgccgccttttgaagaaacaaaagtttcgacacctccaccgcctgtcacaacccccgttaagccaacaacagcagtcaaaacgcccgctcctccagctgtagcaccttccgcaactgcaaaaccagcaactaagtctactaccgccgcccctgttaagtctacaacagcccctccgccaactgtaaaggcaacaacagcccctccgccaactgtaaaggcaacaacagcccctccgccaactgtaaaggcaacaacagctcctccgccagctgtaaagacaacaacagcccctccgccaactgtaaagacaacaaccgcccctccgccaattgtaaaggcaacaaccgcccctccgccgccaaagacaacaacacctgtaacacctgtggtaaagagcccatctgttaagccgacaatttcggcaccaccagctcagctaaaatcgacagccaatgcgccacctccagcttcggtttccgctgaattggctcctcgcgctcctctggcagactctccaccgcgttttgacgaaggagaagaagaaaataaaacagacaaattaaccgccgcaaaaccttcaactaagacgacaattacggcgcctccggagcaactaaaaagctcggcaacgcctcatcaacaaaaaca

SEQ ID NO: 4544 - DNA, 1817 bp, Heterodera glycines
cacaaattaataggttaattcttatttagaactcatttgtttttaattaaataataaatgaattgaagaacttctctgcattgaaaatttcttttattttttcctttttattaaaatttcatcccctctgactttcttggcatttattcggtattctttctgactataataaaacagtaattttcctgctctaatttaggatttaaaaaaactatagagttcgattaaagtttacaaaaagttacagatagataagcaagccaaattaaaaaatacttttctagaaaaaaactgggggttaaccgggcgatgtcaaatctgtgaaatggtgtcacagattatgtatggcacgcacctttctctgttaccgaaaccaatgaaaaaatatacaaaaatttattgagaacaaaaaactaagcattcatatgtcccgcgacagtaattggaaaacccggaccaggacaaggatttttgatcggactctttttactccgtacaaaaagtactgtcttaacaagactccggtcctgttgcattttcctaaaccttaaccggactacatatttggcatcctcaatcagttgtccatctccgtcagaaaaaagtaaatttaatttttaacatttgaaaaccaccctattataaaatcggtattaatcataaattgagcaatttgtttattagctgtattattttattttaagttttttcttctttccatcacttttcctccattgtttttttgtccatcttttttatccattaccttggaaaaaacttccagtcggtgaatcaatcatttcttccattccaattggccacttttggccaatccttcgtttttcattttcattgattcattttatcatccgcataaattgttgcataatattaaatgacatttttcagaaccaaagtcatcaaaaatgttcaatttcttttttctgctgatcttcgcttcttctgcccaaaattcgtttcaacaaaatgtaaaataaattcgacattattttgtttaatattttatttttttgtcaaggaacatttttgccattcactccatggtaccaatgtctgtgttgagtgtggcccatttgcgacggacaaacaaaaatgtaaatgaaatgaaacatagaaaaataatataataaataattggaggacgatctcggatcatttcaaatcgttgtcaaataattttaaagattgtgacaattgatcccatacattgacaagggaagtctcgagacagacccccccccccccccctcctccttcgtccattttacggggggggggagcaaaagaggggggggggggggggtgaagaactgataacatcaccaactgttatatcagccatctgatcaaaagctgtcatgtctaaaataaataaataaaattatttatttttatatttaaatttcgaacaaataaaacaagctgtcagaagggtgagacaagcttattctgacaagtgttcagaaattaaaaaaaaatgtcatagagtaagtgcccaaacaggaactaagtcgaagctaaaaaagtatcactgatgtaaagtgtcttaaattgagttgataaatagtaattaaatttaatattactttttttctctaatcttcttgatcaaaatgcttttgtatgaccagtactgaatttggtacttttgctgtttaccgggtacttttaacattacgaatccgagttcagattagcgctaccgttcacgacatgagctgtaaattgacaggatttctgtaccaataataccatcatgggcaagatgcacatgacgctatcatccatacaaattt

SEQ ID NO: 4545 - DNA, 1352 bp, Heterodera glycines
cattgtttgattcactaacatttaattgaattttaatcaccaggtgaccaattgcgcgtgcttttcccaccgtcaccaatgcctttgaaagtgccgcactctccgccactccaatcgctggtcattaacaattcttcgggagcggaagaagcgagaaaaggaatgccaattgctgtagtggtaagtcgttaatacattaccatcaattaaaaaaccaaaaaaatttaatttctattcactgaaaaatgagaactaaatttaattggttgtaactaatcacaataaaaagaattactgttggatgagctgttaaattttgttagtttttgaatatttaagaatgcatcgttgtcaaaaaaagtcgaattacacaaaaatgaacagcagcgaccggcgaagaaattgaaccatacgcaagccatgggacatcatgataaagtgcagcactttaattacataatttaaaaacgattggatatttttcagccaacaaatatcagcgtcgccaataattcaagcagtgattttatgattttaatttgcgtattttaattaaaaacaaattatttatcagaaaataatgggacatcgcccaccaatgttcttgtgaccagcaaaaatacaactgatggtgagtgttatacctatttacgttttatttttatcaatttgtgagcaattgttgaatccgataacttttcaaatgctttccaaataattttcaacattgtagtcattgtttgatccacaaaaacaaaaaaaattaattagactttttaatgaacaggtgattacttgcgcgtgcttttccctccgtcaccaatgcctttgaaagtgccgcactctccgccactccaatcgctggtcattaacaattcttcgggagcggaagaagcgaaaaaagtaatgccaattgctttagtggtatttacgaatatttcctcatctttgaaattgtaatatgtaattaattttcaacagcagcgaccggcgacgaaattgaacaatacgcaaccaatgagccaacatgatcaagtgcagcactttaattatatattttaaaatcaattgaatatttttcagccaaaaactgttcgcgtcgccaaaaaatcaagcagtaatttttatgattaaaaatttcgtatttaaaaaaattaatcatttattagtgaataatgggaccacattaatggctaatgccctgctgatcagtaagaattcaactggtgagtgctttattcagtgaaaaaaaatattatatttttgtttaaaagattattgtaaatgaattatcattgcagatgatttgatcaacgagatgttaaattttgcggacaaaaaatcaacgaaat

SEQ ID NO: 4546 - DNA, 5274 bp, Heterodera glycines
caattcaatgaattacgacagaacatcacgaaaatcgaacaactcattgtaagtattgctcaaacacatttttaacttttaatgattaaactgcataaaaaataaatgcaaatttttagggcccacaaatgaatattattgaccaaattggcaataacattgttaaaccgacgctcgattttttgagcaaaacaaaactttcattatcgcacctcagcggaggctttgatcttgatggaaaaatgccgcaaaaagaggtgctatcagattagggcaaattacacctttctatttaaatacaaatctcgggtgctaccttaaaaatcaatgatttttaattgtaagctcaaaaaatgtatacaaaccgccaggttaagtttttagaatgccttgaaatttgtagttaagattttgccataacgactatgaaaaagttgggagtttttctcaattacaaattattaaaaatacacaaaggtaacaccgacggaaaatatttttctgcgtttaattaattttgaaaatactggaaaacgagctaaaaatcaaacatgattgaaatgcttttttaggtttattcatattcatcttttttcatttctcctatattagtcatttaatttttgttttttagccaaatcgttggagtgtaagcaaatcgcaaatcggtttactgattttggagcctgactatcggaaagcagcagtcattggaaatattaacggttaataataaaatttagtaaaacatcaatattcataataagggatattttaatatactgaattgctgtggaaaatgttttataatgctttttaattacattttattaaaaatatgagattgcttatttacagaaatattttaaggttatcgaatgttatttgctgaatctgatcttttcccgcgttttggcattgtctattacgagacaaaaatcatccgtaggcaacttaccttcgggaatgggtatgacaaaaaaaactatttatttagattcagggacaagaattcccggctttaaaatttatattaattttgaactaatacttttatcttttgcttctcggtcttttctctgtctggctttactatgacttatttattccactaattatttgtcaatttgactttcaaattaaaggacgattggagttggtctttttacatctgatcacttttatttctattcgagcggtggtgttgtttttggtcacaacatcggtggcttcggaggatttcctccgtttggagagggcgacaccatcggttgtggagtcaacttaacttccaaggaaattatgtacacaaccaacggcaaacgattgagtgagtaaaaatattatgctattcgagaatctcggtctcgactgtggcattgtctcggcttaatttttgagataaatctgggacctttttatgatcattttatgttttaaaaagcatcactctagtcacattatgcgatcgggttttatattaaaaataatcactttgattaaaaggcaccaaatcattgaaaaaattatcataattattatataaaattttctaacttaatttatgggatttttttgtataaaaataaaaatttaagagagttcggaaactccataattaattttatcatgataatcatcttcagaataaaagaatgtttgttttgctatttcagacacatcaaatatgttcgtcgtcatcaaagacatgctgctgccggcagtttttatgcattcagttggagatacaattgaggcgaacttcgagccgaatttgcaattgcctaatccctgagcaaatcatacgaagatgggaattaaaattacacaattgtaatttttcaatacaatccaaacattggataaattcatttcggcaaatgccattcgtcttttctttttaaaaaaatattgaaatattaaatgttatatctgcgacagcgatttttaggtttgtgaatgactttttttttaattgaagagttttttgtgatccgattgtgccaatagatgaaatcccgatcttatgatacttaaatcaaagaatttatgtaagtgttaaatggctcctctaattgcgaaatatgcaacaaaaaaaaagtcacgtgtagattgcgaaatcgatggggaaattgcgaaataaaaaatttgattgacaggtgacctaatttggtccatattgcgaaatcgtaaagtcacgtgcagattgcgaaataatggaagaaaaataaaagaccatcaattatttcagaaaaattcaatttcattaatttaaatgaatttttatttattcaactattgtacaattaatattcctatatcttagaattaattgaatttcattaacaattttggtgcttatcgatttttttcacgactcggaatcgctgcacatcgacggagcggatgagagtggcggtgtcattatcgattaattttatcgattttttttttgcgcggcggcgacatcgatggggagggtagggcggtgtcattatcgattaatttgcgcggcgatgcatcggcggggagggatgggttgggcaaaaaaaaagcacccgtgcggttttgggaaatcggatttgggtgggcggcaacttcaaagtggtccaatagatttgggtttgtcacacgctcctcccataggcacgggtttgtgcggggcggcaacatcaaagggatgcacccctcccataggcatgggtccacgggcggcaacatcaaaggactgcacccctcccataggcatgggttcgtgcggcaacatcaaagggctgcacccctcccataggcacgggctcgtgcggcaacatcaaagggctgcacccctcccataggcacgggattgtgcggtaaacacccatgcgaaagtgcgcttttggggttctatactactaacctttccctaaatttctacttgacaaatggttgattgatgactgttggatatattttagaccactactctcatcatatttgaatggcaagtacgtacttgaaaatcggcccttgtgcgggaaagtttaaaaatttgcttatttccaaaattatactttaaaattagcatttcaagattgtacttgaaaatagcattactacttgaaaatgggcaaaaaaaacatttgaatttttacattttttgagattttataccagtatcataaaatccaaaaatttagccattttttgggcagaatctgttaacaaattgtttcaaattttcagatttttccccgccgaactcccccccccccgctccaaaaaataggaaaaacccattttggtgaaaaatataaaaattatatttttcttatcttttcgcgtttgaattttataacgttttcgttatgttcttgaaaatcagtctaactgaaccaatgagagccctgacttagatggtttgaaggttgatctcgaggtcgttacttcggaccatcgagactctcgaggatgaataattaccctccccttttcgcccattaattaccgatttgcatattcatttatcgcattcatccgattcgttgttaatcctcttattgtgcttttattcagttatttgttttgcatttttatttctcataatgaattatcatttctctcacagaaaaaattcacaaatgaaattttggcgtttgacatttatttttatattttcgttcatacaaaaatccacatcaaatgctacgactgaaattcaggcgaagtgtatgttttaaatttatcaatttcactaattaagatagagacaaacgttttggtaaattattaaaaatttgaaattcaccgctttgcatgccgacaggcgcctccaaagggaaaaattggcactgtttctttttagtaggattataaattgtacgcactaaaaatgccaactatgcgcatatccatcaaatgaaaaatgcccagaacaaaactgccaaaaatagctttgaaccatcaaaaaatgtttaaaaattcaaaattaattttaaaaacatcaaaacaatagataaaagcattttttatattgaatttttttaacgcttaaaaattactttttttatttaaacattttttccaaaattcttacaaaaactcaaaatttttcggttttgaggatgtgtttttttaaatcccaaaagtataataaggtggattttccgcttctttttttcaatttttttttgttaacatttacaaattggatgaaatatgatctaaaacgaaaaatggcaaaatataaaaaatcttgcaaaaccaactttttataattctacttattggattttgagtcaaaatctttttttttgaatttcgggatgaatattaaaaagaagtgaattttatggaccaactgcgtttaatttttaacaaataaaaaatcaatttactttagtaatgttctattttttaaaatttgatctctaatggcctaatcatcccattatttttcagactcaaattttggttcagtgataagtcaatttatggagaatcgtgagaaaattgatcaaatttttgcggatttggtaatttaaaatgttttttgttatatctttttcattggacagaaaaaagagaaagaaaaaagaaaggagcaaatgctttctgaagaagaaccgctgcaaattgtaagtcaatgaatacgacgtttaacttattgacaaatcgaaatttaaaaaaaattaatttctttttatcattttcatttttatttagattagagatacaataacaattgactaccaatggaacacttcggactgtcaaagtgatcgtatgattttgattccaacaattattaaagtcaaacattatggaaaaaagaaaggtaaatccggatggaaatatcggaaatatttttaaaatgttaaatctttttttaattaaaaatttaaaaacataaaatttattattttgaatctaaaactgtcaaccttttttccccaggtcttcgcattgttcgttttgcctttgtgtttccccctcaaaatattggagcagtttattttgaagtgaaaattgtaaaattacaaagggaaatgaggtaaaagtaaataaattacggtttgacgaaatccccggcaaaaaagatttgtctgagaatgcattcgaagtttaatgcttcataactaaagcacaggattttttacgggtttccatatggaactttcccaaacattatgagaccacaagccaaaatttgcgcgtcccttttgttttttttttaattttgacttgtcgtctcataatgtttgggaaagtacccctttcactgggactcccgac

SEQ ID NO: 4547 - DNA, 2309 bp, Heterodera glycines
atgtattttcccgaaaaattaatattttaattatatgtaattaattcttaacaggaccagttcgtcaaatctgtcaattggcgcctgataatgtgtatgatttaccaaaatatttattttatttttgtatatcagtggaattaaaatttcctattttgcctataaatccggagacacaacatttattacggctttttcagtttatttgccacacaaaaaaatttccaataaaataattattttgttattttttcacttatttttggaaaagtttgtatttattggactttgatcattttagaattttatttatttgtttagcaatgcgatggcatgcgccgcaattgcagcgcataatttgggctttgataacacacgggtcaaactgattgtcgatccaatgtattaccataattaagatttattgttttaaattttaataataaattgattaattaaggcttcacaattggcacattattgagtgtgaaattggtggcgagaatggcttccggacgagaacacgtcgagaatttgcggcccaacatggcggagtgagcagtggcgagaacacacttttggcatttttgtcaagcataaaaggcaattaattaaatatttaaatgtattattttattaattttattttttaaaaattatttcaattaattctgaaatcgatttgcagagactttgtacaagccgcccggtgtcaacatttgttagtccaatttttacaaccgatgtgttaagataatgtgatcatttacctttcattattattttttattttaattatttaattttaaaagttataaagcatcaatttttattaaaaaaaagatttttaaaaaaatttaaatagaaatgaattaaattcgccaaattttccatttaattcttttaactcgctcttttcgtctttgaaattttcttttgcatttttgcacatttcagtttttgaacaattttttccgtttttttttgtgcttcggctcattaaaaaaattatatttttttatatttttaatctcaaagcattatttataaagcatataaaatacctttttataaagcattttatgaaataaaatgagtgatttttattttcagtaaaatgataaagttttttatttgcgttttcggccacacactgagcacattccgccgccgtatccgtaaccgccgccattgccaactgacatggaagaggagctgccgtagttattccatgagctgcaaaaaatgattttttcaaatcataattaaatgaaaatgattgaaaaaattaatttaaaaaattgaaaaatatttttgcaaaattttaattttacgattttaaaataaatttttttatataaagcattgcttaatcaatttttaatgaatctttgtttaaattgccaatttttgataaaaaatgagaaaaaagaacgtttacctggacgcgctcccaccgttgttccagctgctactgtagcctgacaagccgccaccgtacccgccgtacccaccgccacatgttgcgcaagaggaatacgatggctgcatgggaggcggtggtggtggcacaggttggtacgaagaatagccatagccgccgccgccgctgccacagctgtagcatgatgacgtcaccggcacgggggcactaaaatgaaagatttactaattagccaatttattaggcataactgaccatgcgcagcctccgccatatccgtagctgttgtacccatagccgtagcgtttaatacgactaaaattgattttgtgaatttataaatttagcaaaatatgacttatgtataaataatttaggggcccgaatttgtacgggctaaaaagttgtggaatttattcggtcggatttttaaaaaaaatttaaaatcttattttaaagaaaaacgagaaatatttttttctcacaatgaatttttcatagatttcaaatgaccaaaaaaataaaataaataatcaaccattaaagtggtaataaaaaaagatcaaaatcaataaatttttaaattaaaactatattatttctgattgtgttaattatgttagagacttaaaaatgccacatttcacacctgatcaattcatggctgtggcgcactgcgcccgactcgtcgtcgccctccgatttgacagctccgattgaacagccaaagctgatcaatgccaaagtgatcatcacaaaaagcatagcagcagagctcatcatcatcattgttttatgttgttgattgcgcaaaaaatgatcaacagaatttggtgaacagtagtagtcacaattatgggtttat

SEQ ID NO: 4548 - DNA, 2985 bp, Heterodera glycines
  misc_feature (69)..(69): n is a, c, g, or t
  misc_feature (239)..(239): n is a, c, g, or t
aaaaatgatcaacaaaaatttggtgaacagtagtagtcacaattatgggttttattttgattttgtttnggttgggattataaaattggtaaattccctcggggctttttataccggcaaaattcaccacatttttttggaggcgttgttcattacgtaataaaaaaaaggtgccccaaaaccgcgtccccaattttggtaatcgggcgaattcggcggcgccgtcactgccccccccnccccaacaaaactgcaaaactggtcaagaattgtgctcaatttggtggaaaatttgttgtggcgatggttgacattggagaaccaccctcactcaacactcgcctcgtcgacgaatcaccaaacacaaaacaacaaattaaatttctttttgttcccatcacattggccaatttggagaacggcgatgatcatcgtcatcacctttttgctaaatttgtattaatgataatgatgatgaccgcattttggtgagaaaattgcaaattttgacgaattcctcgaattaattaaaaaaaaaaataataataataggaacattgtttgagtattttgtgcaaaataataagaaattttatgacaaaatcaaaattccaattccaactgaaatattctgcatttttttaaatcatttttttcaaattttgagaaatgtttacttggaaatgtcgtcaaattaaagcaaatgatgcgtcattaagcataattaagaaggcaaacttgaactaaaggaaaatgccaaatacaatataagaagcggttttaaaaaataataataaaattaaaaatactatgaaatttcttaaaataaaataggtctaaaaaataaatgggataaattttgatgatttaaatcaaaatcagctaggaagttgaatttaccgccagaatcaagaaaggattttcccgaaattttcaattttttgaaattctgaattcctgggttcaaaacatggattttgaaaaaataacgaaaaaacgcctataattgcagggggaagttaaagatttttagaaatttttaaacgtgtaaaaaagctacatgtctaatctaaaagcatagtaaatgttagtcaagttcgaaatgtagaattttaacgaattgtctagtcaaatataagcatggcttattttgctgggctttttacaattttttttttttgcatcaatgtcatactatacatatttgtattttttttttattatttactcaaaatttaaacgggtctcgatattttcgggtccatttgaataataaagttcttaaaaatacattattagtaaccaatattaatttgtgaataattttttccattttccaaagtttttcaaattcgaacaaaaaaaaacccaaagtaatattaatttaattttttttttttacaaaattcaacttcattaatctttttcgttagtaatgttctgtttttgctcccatttttcatttttccattcatttattcgtaatatttttttgtccatttttttcgttttgttttgttcggccggcgcgcacaaatcaaatttttattactattgtcacaaaatcgtaaaaccttctttaattaccaaattaacagcaaatgctgtaccttacctgtcccatccatttgatgatcgaaaaaaacgaaatgagcaaaaatatgagctgatcagaaacaatcagagggagttttagtgtaaactgaaaaaagatcaaatgaattaaacataaaatattcttctgatttcaaaaaaagaaattaatgtttaaaaaaataattttaaatacacaaaatttaaaaataagcatttatttggtaattttgaaagctaattattaaaatggaagccaatttttatattatttaaatgggagccaatatgaacaaatgaaactgaggctgagaaatcctagaagaattaaaaattcagaaattttgaaaaattatttttaaatttaatttatttaatcaaatgatcatttttggatttttaatattttctcggcatttgcacaaaattctaattttcatccatcggttccatcatagtgaacaaaattttgcgtgggcatcagcggcagagcattctcaattttcaatttgcacgaaaaatggaaaatgattattttacgccccctcccgccaatctttccggtgttaaatgattaaatgattgatgacactttttgcattttgtgcagcttcgccacattcttctcccatatctcatttctaaatttggaattcaccgaattcgctgatgctgaacgggtggggggggggaatggaaggccatggttctggttcttgcgcactgccgaacgaaagtgatggccgccgtcctcaagagtctcgaggtccatcgggtccaaaattgggcgacaaaggcgggcgcggtgattgtcgagagtcttgacaccaacggcaaaatgaagcaatttgtataagcatgtgatgtgtgagggggaataagaatgtggaacgcttttttgatgaaccccacagaagagcctactacaccgaccattttctcgtcaaggacaaactgtccaatccaattttggctccatcctttccccccgccaaattaagagaataatgggaggtgttccgccaatttggacaaaaaaagcggagagtttttcatcacaataaaaagtgacattgaaacttgctgccccggccattgaaggtcacacggcttgtggccacctaccagcagcagtagcaccagcagcagcataattttccactcattaagtaaatgagtggaggggggggggggggtttgcacgtcacgagcacacaaagtcgaaaatgccatataaaaggctgaacaaaatgaatgctggctatccattattccaaaatcagttgattaggaggaaccattaattaaccattaataggcacaattaataaagccctaattcaatatccataatttaaaaaaattaattagatagttatagacggaatttaa

SEQ ID NO: 4549 - DNA, 4552 bp, Heterodera glycines
cccggtgtgcccggtgacgacggtgctcagggcaacaacggtgcgcccggtattccggcaacgccccgacctcgtccgtcctacccgaccaccgggtatgtgccgctcttgtttagaatttagttttgcaaaagaatttcattttttcttagaatctaagtcatctcttataatcagagttcccaagttttttttttcaaattcatgacaaaaacactaaaattcagattcttttgcaaaataaattgtagcgctaagaaaacctattaaaaaacaatcgatatttttattagcataaaacatagggcttcccaactgaaaatctttttatgtttttatcggagccctcaaaattcaggacaatctgaaaattcaggacctttttgatttttcaaataggtacactccaattcaggaaaattcactttgtaactctgtttataatgaaaaaccgtttttccaaggtgccagatttgtgagcctgccacgaatggtaacccaggcgaacagggacctgctggttcgccaggggagccaggcaagcctggtgcacctggttatccgggccagaatgggccacgtggaccgcccggaccagccggaccaaatggcgagccaggaaaacctggccaaccaggacaaaacggagagcctggcgtactccggtgaattttcagcatttgcaattttcattattaattttttcattcattcagctatggaccggtcaaggttggccctccgggaccgcaaggaccgcccggctatccaggagggaacggagaaccaggacagcctggcccacaaggctatcctggggagcagggacagcccggagctggaggtccgtcaggatcgcctggaactccgggagaaccgggcggccaaggagagcccggagcgcacggcgaaaagggacactgcggtaggtttttttgtggatttggcagaaaatttttcaatattcaagggtctgatttttcggcattgatacgatcactgatcaattgatttttgattaattttttgtgtgttcagatcattgtcctcctcctcgcactgctcctggctattgagcagaagcgaaagagacggcgagaagctgatcagagtggaaaaccaaaaagaaatgcaatcaaaaattgttttgcccttggattattcatggaataaaaaattttgtttaaaaaattatttaatctgcaaaatttacaaaaaatgaaatttaaatcctcgcttattaatgcaatcgctgcatggcgagaaagtaacatttttctatttttttcctgaaaaatagtttctaaaattcttttgcttttgttagcttgtttactttgttttagagaatgagaagaagattagcaaagactgaaatcaaatatttaaaatgtttacgaacaaagaaaaactaaattttataaaaattcgaatcaaaaatttaaagtaaaataaaattggtcatttccatgcttcttcgagctttttgaaataaatttgcatctccgattccgtcagcaatttttgtccacgaatatccaccaaactttgcccattttgcaatgcaattggcactgaagaatcggccacagacgaaggcttcacaaaagaaaagaaattcttcagccaaacgacggctttacgtttaatcattgggtgatggctgaataatttttaaaaattaattggcctaaatgattgattcattagcgtggagaaaatcttgtgattagtgcgtccaaacgcactcgatatttttttaaattatttttttataaaaatttaaaattttacgtaataacagtgatttcaatgcatgagcagctaatggtattttgcaatgccattaacatataggcaaaactctgctgataatccttgtccaaaaaaccaaaataaattagaaaagtcactacatttaacgcattggccattcaaaaaatggtgtaaaattgttggcgccaattgttttgcagtgcgaatattttcagacaactaaaacattgtaaaaattgaattttcactaatatttttccaatataatagttaataataatttaataatataaataaaaattatggaattttaactaatcttttagtcgcatttactgacctgaaagcgttcattcagcgtaaagttaatctcactttgatattttcgcaaattgtacaaatgaagagcagtcatggacttaatttgttggcaaattatccaattaaaatttaaaaaaatatataattaaattttaattaccaaaatttcagcaaatcccaaagcgaagaaaatgcaactggtgacaaaagtggtcaaattgatgaagtaaaaatcacctcgctgaacatacatattccaaattgaaatgcccaactgcaatggacagagaattgaaatcaaaacaaattaatttcaaagatttttttttattttatcatttaaaacgctgtatgatttatatgtcaaatttaattcttaaaaaattatttttaatttaaaaaaaataaaaataagaattatattcactaaaatttctttatttagacaattaattttgttgttgtcagcgtaacttgaaatttcacaagaaaatacgaaggcataagcgctacccctgcaaaattttataattttttacagcttaattttttattttttcaaaatcagtatgtttctaaaaccaaaaaagcactacatttttgacttgatttttcaagtttttaaacagaaacggatttttgaaaaattgatacgtgattgaaaaacttcgaaattttgtacgctgataatccctactaaaaactgttttcctacaaaatttcaagtcattcattctgacaatcctctttttcattgtttagaagcatcaaatcagttaaattttgtttcaaaatcttattaatttcaattgtttttaggcaatatgcttttttttaaatttcagatttgatttaactgaatattcactccctaaaatttagtcaaataattatttttcaaaaataccaaaatgccaatccagcaaattgcgaactgtttggtggtgctgcgattctccgtatattttcgaaagttaattgtggcaaacacacgttcggccaccaaaacgtggcccattttattgcgaatcggaattaatgccatttggacaatttgcacggggactgctccatggtaaaacgcgtcggcaaagacaaatttggacaacacaaaaatgaaacgaaagcattcatactgaataaaaagaaaattttgtaaatacatattttttccctggcttctccatgctctaaatagtaggaaaaacactttcatttttgtgtttacgaacaaaaatcgtgtgactttttaaaatattttgagaatttttgaaaatttctagaaatttcttgtgaaaaaataacaaaaaaaatttttttgaaaatctacccctaaaaaataccaaaaattaattttaaatactaaaagatgatcataagcctaattaggttacattttgtggtgcctatcttaccctctacgaataattatttttccaaaaaaataacaatttttaaatatttatttacatatttgatacatattttgtttttttcttcatatttcgggctttttttaacatatttatgtacatattttgaccactttttgtacatatttttgacatccctactgatgacattatatttattattaagctttataaaattaaatccaaaataataatatttattatatttttatcagtagaatattcgtaccaatccaatgactgcgctttgaaccaaaagaatgcatttcaaatttggatgaagcaatgccgtgttggagagcaaaattaggttgaatgccgaaatcagaaaagacgcaaacaaaacacagagttcgatggaattcaaaaaaacgacccaatgtattaatgaatcatttagcaaagaagtcgaggaagaattgggagcaattgccattgggttgattaggctttgaataggcttaattgggtaattggtgcaattagagaatagaattctcgtttttcggccgactcgagaaaagaggaaatgacttcaactaccaaaataatatgcgccgtaaaattgaaaacaaacagcaaacgcattatcgctataattaaaaaattttcacaattcggttaaaattcagtaaaaaacatttggccgttaattaaataaaattgacgcctttgttattaagaagaaaatgtgatttaatatattatttaaccgttaattaaataaaattgacgcctttgttattgagaagaaaatatgatttaatatagaggtgcagacttattattaaaataattaattcacaaattacacgctttcttgttgttgaagaaaattgtgatgattaattaattatcccaaatgaagcataaaatataaaaattcaatttcattttttgaaaatgtttaaaaaatttttttacatttgaaatggggaaaaaaattttaaaataaaattgtattaagaattcccaacataaattttcacattgttttttattttcatgttaatggaaaagta

SEQ ID NO: 4550 - DNA, 1496 bp, Heterodera glycines
tgaattggatggcgacttgcaaattgcatgcatgtttaacttttagacaagttttagcgaaaaatttcgacatttttttttgtccagatgatcaactacggactgaaagtccgacaagccaagagaaggacaagttcccggcaaaagcgcatcttgcgctggcaaaacacaaagttttcgctgccgcagtgccctttgaatttggcggaatggtcagtgtttatcatttttttctatttggttcggataagacttggccctgggtccaggcatgtgttttttttcttgcatccaggcagactcggatcggttttcggtattcggtaacctggattttcttgtatgtttgtccaggatgacaaggtcaaacatggaaaaaaggctaggttacccatgaaaaacctgaattttcgggctgatattcgaattattattccaggaaatacaatgcatattttagatttataataattttgcggtataattttttcgtattatttaaattgaacgaatttgataactttcgatagccctaagtatgctctatttagcttgcgaaatttcattgttttttgaaaaaagatttggacaaaataatcggaaaactgctggccaaggcccaattacccccacccgaacttatccttcatgtataaaacattgaatacctaaatacctaattaatatatttcccccaaattttgcagaatttttgccaaaaggacatgctgcagctcagcgaatgtttgggtggtcaggacttgaatttgttgagcacgtatggcgcattttcattggccacttcactgatcatccaatacggcaccaccgaacagaaggagcactatttgccgggcattgcgtccggccaatggcgtccggcagtttgcattgatgacgaaacgtacaattttttcatgaaagtccaggctgttaaaaaaaattttcggaggcgtgaatccgaagactttagactcttagcgggactaaaaatctccaattgcagcgccgagcaaaaatggccattatgccaatttttgagttcaaattttcaaagaatatggcaaaatggggtccgtcattgccttaggcgccgtcgagaaattttttggaaatattttattaagaaaattttgaatttggaacttcaaaaaatttatttatttttggcccgaagagcaaaaaaaataaaaattcttcgaaataacatgtctttattttaataattgtagcactggcccacagtcgaatgagcatgttttttccgcaaaaggacaacaacaatttttgagcgcggttatgctttataaaatagcttctatcttaatgttttaaaatttatttatttgtttttagacaaaaatcaatgtgcagaatgcgcacaatgccaacctgtttattgtgtttgcgaatcgaacagttggagatgtggtaaaaaaacaaacaaatgcttttaccttgttttttcgacttttacacacaaatttttaaacact

SEQ ID NO: 4551 - DNA, 1038 bp, Heterodera glycines
gacacaatcgtggaccaagctgtttcgagcataaaaattcgggaacaaatgaaaactggcggactccaacgatgcaattgtacgaacttttttttaaattttaaaatgccattcatcatttgccagtttcaacggttgtgtttgagaatgtgccgttgcgtgagtggatgttgttgggatccaacgaaaatgccggatatttgactgatgaactgtcagtgtgcggacgaattgcctacggtgccggaattgttggccatctaaaaaaagtgctaggcaagttttcctttttgtgacgtcggcttattcggtgcactacattactcggagaaggtcgtcccctccccctggtcccccttagaaaattttcaaaaaaatttttagcgatttttcaaaatatttatgatttttatgctatcaaaaatattgccaacaaatcgttggtttcgaaattgtgaagggtcgaaccgatacgggggaactgattccggggagaggggaacgaaatgttcctcgcggctaatttctgctgattgggtttaattgtcggaattttgtttttcgtatcggccattttttgtgtgccaactctgtttttgccaaatacattcattcctattcaattaacaattcgtatttttatatcctcttcagccaatctgtgtcattttgcgaaccaacaagtcaaaggcaatttgcgcttgtccgattcccatccaattcaacgctcattaaccgaacttggcctcatcacttatgtgctcgaatctgttgtttattacatcggtaaaaggcgcaacaaaaaaaacattttgacacattttatgataaaaattgtttattaactcaatatttttatttatttagccggtatgattgatgaagaattgtttctgatgcaggacattgagaatgcaattgtacaagtacgttttgttttgttttgaaatttaatcattttaatatagtttcaccaaaaaattgccaattcagtgcatacgtgtacaaggggtgggtcacgaccaccccctccccccc

SEQ ID NO: 4552 - DNA, 3546 bp, Heterodera glycines
ctaattgaatgaattaaaattctttaaatagccctaaatgttctctatttgcctgccaaatttcgctaagtttcaaaaaagttaaagcaaaattctgtggaaaaccagtttttagaagtttgttgaccgtaacttttttgaaacttaacgaaatttttcgagatttggcaggcaaatagagaatatttattgctattagaagatttttaattcattcagttaggtcaattatgaaaggagttatatccaaaaaaccggcctggggcccattcgacccggtccgcaccccccccccccctgccgtttattttaaaaactttcgaggggtgggggaactttctgctcccggagaggggaattagtgcacacggataaacaacttttcccaaaaaaaaatttctgaaatcaaaaacagtcaaataagttatgaaatttgtgttacaggaacccgatttgcatttgatccggcgcatttccatcccaaccctggagacctatgtgaacaaatttgggggcatggcccaatttcggagtgcgtttgccacccaaaagatgttcaagctgaggatgaccgacatccgggagcaggacttcttggagccggccatcattcattacattgcggagcatgtccatccgagtttagaagtgagtacaagtactggctgacgttgtttttctgtccttttcctttcacccgaaatttaaaaaaatattttttaaaataaattaccattgcacaaaaatgaataaattaattaaaaaagaaataattgtaaatactatatttctaattcatcaaaaagcacgcctcctaattatgcgatttctaaaacaaaaatacaaccccctaaaaacgagtttttgaattcaacccccccccctccctcccgaagccaagggtctggctattcccttgataaataaataaattttttgtttattttcagccagccgctactggtctcgagaattccatgtcaagactgggtgggtttggggctggtggatagacagatatgctaaacacctctaattgtgttgcttttttctatcctaaagttaattgaaaattttcgaaactgaaaattattaatgtgtttttttttaatttctcattttattttatttttttaaataatgttttcgccccgtgcaggtcaactgtttgacaaagtgtgcactgaaaagggtgtgcatgtgaacacggattatatcatcttgggaaagtaagtgattaattacaaatactaattttatattttaattatttattttttgtccattaattgcttgtactaattgcaattactaatacaattagttaattaattgttttttaaacaatttagcgtttgtgaagtgatggaaaatttgttggcaatgaccgccaccattgcgcgttcgagtcggtcctatgcaattggacttcgtggtgcggataatgaggttgagtgagcatcgtacatattttcaaattttcaatttttatatatattttttccaaattggtaaaagatttattatcaaaaaaaaaagaaagaaagaattcaaaaattaaatttgctcaaacgttattctaatgtaaacttaactagtgcatttttggcattttgttttttattcacttttcttagaacttagataattagggacttacgtacatatttttaaatattttgattttttttttattacaatttttgcactttttcttatattacctataataattgcatctaaattattaatacaatattttatatttgtttacagcttcaatggaccatcatgttctgtttgaaggcgtcggaggaagcaaaaaacattatttccgacacacttaaaagtaaacaaataattaattgttttacggttttttgaataaaaatgtaacatatttcaatttttaatgaaattttaacaaatacctaaattaattttttgtgttttgactaattgctcccccatttatcccaacacagatgagtcattccttcggatgaacccgcggctcaccgacgttggtcagggcatgttgcagtgcaacggctatttcccggaaagtccgcttgagaagaattggtagcggtgcaattcagtacggctgaatgaatgaattttcgaccgatcattcattttagagttgcgcattctttgtttttttgttttatttgtatttttaagagcatttttcccaaatgtttgtttaatgatggaaaaatatttttcggtttgtttagaacatatttctttttacatcgaacagaagaaagcaaagcacgaatttatcggttgaaatttaaatgtaatgcctcaaaaatagcacataaaagtaacgctaatttaaatgtgtactcttttgaattttattaaaaaccaaaggggggagatccttttggtttgattggtggtttttggatccctctgatcacgaattgacaactattttaaccaattccgacttcctgtaacaaaaagtcgaaaaccaaaacataagggttttcgactttttgaaaggtccttcccctttggttttttaataaaattcaaaagtatacacttttttaaactaatgccgaaaaatttatataaacatttaggttctctctcagtgaatgccaaaaatgggtacttttatttttgcaaaattttgcccatcaaatcagacgagagaattatcatttctgctgctgatggcattcccccgcaaggcagaagagaagcggcgccatcttctcaataaaaatagagctttttggtccaaacccggggggggggggggcaccaactgaccccaccacatgtaaagccttttcctaggtacaatttaatttttttaatttgaaaaaacctcgaaaatcaaaattctatagaaaattggttttggtgaagattttaagaaaggcatccatccatcatttttagtggttaaagtcatcttttcaggtgccaattttacattttttttgcatcccgttaagaaatttaaaaaaccatttcggcacaaagtgccaaaaaagggaaaatggggacataagggtcacagtaatggatctaaataaagtgccacgggaccgcgaatttttgccaaaaccgggaccgggacttgccgggacctgagaaaccgggaccgtgaccgggactcgattttttttcgggaccgggaccgcaagaaaaaccgggaaccggcaccaaccgggaaattttagaaattcaaaaaaattttaaacatataaaaaaaaaattcaaattttaatttatatcaggtgaaaataatacaaaatgattctggttttcatccaataaataaaattaatgaaaattttcaaagaaattgtcttccattatttcaaacaattaatcatttttggaataaatcctccaatattaatagaaattcagatttgattttcccatcaactttttttcggagcgctttttcaaaaattggcaaaaaaaggttgttttttgcgattattaaagctcattgggaagattttacatttaaaaaaatgatataatatggtattaatttaaaaaaaa

SEQ ID NO: 4553 - DNA, 2266 bp, Heterodera glycines
agggtgatcaattctatttaagccgtcaatgggaaaactgactcattttttactaattttacattaaaaaaaacaaaaaattcgttagctaattggatttataaaaaatagatttgtaaaaaaaattgtggcaaattgaatgccggaagttacgctaactcgaagtcgaagcagcagccaaggcagtgacgcgcaacggaatgccataaaaatgccggtgccgccgcccgactcggcggcagtgggcgagccggaccggatgaccatcagcagtgaggagcaaaatgtaaaaattaacaaaaaaataaaaaataccaaattcattttcaacaaaaatttttagcaaaaaataaataaaggaaaaaattaacaaatatttatatttatttttaattaatattttaaatttttaaaactaaaaaattaatgaaaaaataaaataaaaatatttctatacaaaaattaattttaattttgttttatttgtaacggatgaaaattaacagcgttttttaagggtgtgaaaaatatgtcaaaaaagaggcgaccacatccggcacagctgaaaaagtcggtgctcctctcgatcgccaatggcacagaaaatgacggcggcacaaagtcgccccggcatggctcaatgcttcgccgtttctcccgcgcagcttcattcaaaaaagctcgtgcgttaacataatacagataaaatggattggcggaaaatcatcagaaatcgcaaaaaacgcaaaaattgggcacaaagcacgacaaaatgacaataaaataaatattatacaaatttattaattaatttattctccctcctctaaaatttggcacattggcctggtaaacgaaacgggccagttgcgtctgagccaagtttagagcatcataacttttttctttgttgaccaaatccaacaaaattggtatcattcgaaagctcttaacaagctctatcggcttcctaaaaatcacaaagatatactgacatataaaaaagttataaattaaaatatgcaaaaattctgactttttggtagtgttcatgtttcgacttttttataagttgttcaatcgcttagaaataacttatcaaaagcttctaaacatgtagagctttcgaatgataccaaatttataaaatttggccagcctgaaaaaagttatgatgtattaagcttggctcagacgcaactgacccctttcctgcattgcaaaatcattcttgtttcctaaaaaggtttggtaattttcctttataatacgaaaataatctgatttggtttttgatatttgttttgaatgaaaagcatgtttaagtatcccctaagtatattaaatgagagcaagccccgccccctcaattaaattggcatttggcgttttgacttaatatgaaaaaaagaagagaaaaagaaaagaaatagcatatacaaagaaaaaagggaagaccagacagttgcttacttatgtgtgatgaaagcgtaggagcgtgagggaataagaagtgagagataggaaaaataagagagagtgcgagggatgagaggaggagacaaagggaagaacgagaaaagaagggagagtgggggggtggatgagagagagagaatggggaaagagaacggagaagggagaaagagtgagagagagagagagaggagtgggtgagagggaagagaaaaggcgagataatgggagaaaagagagaatcaaaagagttgagatgataaaaaaaagcagagagagtcggtaggggtcaactccgtctcagcaatgttcaaaaagctataacttttttctttgttggccaaacttaacaatcatggtatcgttcgaaagccctagatgtttagaagatatttataagctatttctcagtgattaatcagctctcaaaaaagttgtcagtttaaaaccgcaaaaaaggcagaattttcaaagttttttatttctatctttttttatagttcgaaattttttgtaatttttagtaggctaatagagcctgtgaagagctttcgaatgatatcaagattgtttgattcggtcaaaaacttcaagagttatattgactcaaagttggctcagacggagttggcccgttccggagagagtgggggagagaagagagaatgtgtgaaagaagagtgaagtaagagcgagaggggagacagagcgagagagagagagaaagaatgagagagaaggagacagagagagagagagcgagagagagaggggaagggagagagtgaag

SEQ ID NO: 4554 - DNA, 2193 bp, Heterodera glycines
  misc_feature (22)..(22): n is a, c, g, or t
ttgtcttttcaaggtgatctancacggcgatcaaattccttcctatacccaaaaacggtggacttggatgtaagcattgattagtgattttataaatgccaaattttaaaattccaaaacattcatgcccattctaatttagctcaaatttgaaaacgctcccttcccatcggtgaccatatgcaatctgaacccatacaaagcatcggccattcgaaatgacattgcagcaaaagctacagtaggccaaattctacaaaaattcaatttttgccatttaaaaaaataaaaattaaatttgttaatctaattgccaatgccaaattctgcaataataaagcatttagtcatttttataattaatttggctaattgtcatttaatgactaccgtatgctaattctacaaaaaaatatattttaccattttttccaaaaaaaattttctaatttccaaatttcatgaaatttccacaattttcctattgtcttacatggagtaagccttgcttttcacagatggacgcattggaaaatgtgttgcaggagaccggaagaagtgagggcgttgcggcagcgattagcaccgataatggtccgtccgttagccatttattgggataaaatttgcaattttaaaataaaatttggcaaaatatctttgtttaattgttattttatagtgaagaaggcacgccgagaattgaaaaggcatcagctgaacagacgagaaaagaagggggaggaggagaagcagcaaaagaaaccgagcagcagttcaccaacagcagcgagcacagattggcgtgaaatggcattggccattcaccggcgatatttgcaggtgttttttaggctaattgtttttggagcaaattatccaagtttcaacaatttttaacataattagaaaaatataattgaatgttatgagactaatcccaaaattttgcaaaaattattatatgattatgatagaattgccatcatgaatttaccgtatactgtgcttttgaaaaggtgtacgccacttgctactgtgaggtcagccgactgtcatctgtgcgcaaacagggcagttgctacgccgcttacaaagtgtgtgccgaagttttgtcgtaaattttattatttttttgacatttttagggataaaattttggagtttcgtaaaaaaaaaatcttttttcgataattactatgccaaattcagaaccgtgtcactgtgcgctttctggacaataccaacagcaacaatggctctgatcagcagcagcagcatatgcattatttttatcctaccaaatgcttgtgccaattggactggatggccaaagcgatttggccatgttttccatgtaaaaaaattgaatttttacaaaattatgattgggttgattttttggatttattacagtacacgattttatgcaagtttgatttatgcaacccactctaaactctttagaatgaaatgtttttaaattaattacaaaaatcataaccttaattatcatcgtcataatttttttttgcaaagcgcagacaacacgtggaaggagcatatttgtgtggagtgtgttgatgaccatgggtctgtttgcacctttttccctaataaaataagtaattaataatatttaaacgattatttaattattcaaggcattgtccaatgcgtttcctcgactaccgtacaacaaatggcgagggcaacaacggtggtgggtaccgtaaatctcgacaatcggccgcctcctcctcacatcgaacgtacgctattgaaatgctggacgaaaacatggacatttgtgtgtgccatcgggagtacaaccattgtgtggctaacaatttggacggcgaaattcccgaaataatgccgggcgatgacctgaacctgttgaatatcagccatctgactgaagtcggttggcacattccattgttggcataattttatagcgcagaccataagccttagaagcagctcccccccctttcatatatttcctttggaaatttgtttaataagaagtttgaagacaaaaaatttaaaaaaatttattgaaaatttttgatgatttagaagttttttcaaaaattcttacaaaaattgctagaaatttttataaaatcgggtggcggggaacaacgatacagggagaactggtccgcgagggggggggggaacgta

SEQ ID NO: 4555 - DNA, 901 bp, Heterodera glycines
tagaggtttacaaatgccacttcaggtcaaaaagggcatttcgggtggtgaggcgcgtcgtttgctgttcgcctccgaattgttgaacaacccacaaatcatttttgccgatgaaccgaccacggtccgtttttttctcgaattttcaaaaaataatccaatttttagggcctcgactcgtcaatggcggaaagtgtgatcagcgtaatgcgtgccctgaccttgtccggccggactatcatttgcactatccatcagccatcgtcggaaatttaccagaaatttgatcgggtcgggtagaaattctggcattttttccataaatttgaccatttgcctcctgtggtgcaggtgatgttcctggcccagggacgtctcgcctattttggcgaaccgaccaaagcgacggaactgatcagtcgtgccggcaatccgtgcccgtccaattacaatcccgccgaccatatcattcaggtgggtacacttcatttgaaattaatatttttcccaatgggtcgccgaaaaaaataagaaaatttcaacgattttccgtggaatttttaattcttttcaaagttttgtggaaatgatcttttctcccgggtcgctggtctaaacagaaaaataggcacagaccatttcccctttccctagcctttctcttacccattttcacaaaattttttttttaatttttcgtaattctcccaaaagtgccctccttttcaacgttttgctttcccccattgttttgtcgtttcgcttcagtgccttagcattgagatgggccgtgaatcggagtgtcagcagcgcgtccgcaacatttgtgcggaatgggaacgctgtgcggagggcgccttctttcacgcggaagttgagaagcggcggcaatgcgttcgcg

SEQ ID NO: 4556 - DNA, 3655 bp, Heterodera glycines
  misc_feature (1387)..(1387): n is a, c, g, or t
gccgcgcaagacggccagctcatgggttcaggtcatttggacgaagcgtacgaacacgctgggggagcggggacggtggcatagccaaaggctggtttcggagaccccaaaaatttacggaacccggaatttcagccaaaaaatgtaccggaacccggtccccgccttgtttggctatcctccttaaaaagatataaaagggaagcggggtcgggacaaaatctcgccgccgattttctaatttaaaaaaattgataaatttttagcgattttttggtatttttttcaattaagcgtcattagtgagattagccgtttctaacccgagtttggcccagaatgttcagttatgaggaatttagttcatttttaataaatgatgaataaatagtaaaaatttggtcattttgtgcccttaaatttcgtgcagacgcagtcgttgctgaagcgttcgctgattgacaattggcgaaaccccggcctcacccgagccaaactcttccagaagctcatcatgggcgtgttcatcggactgttgtacatgaacacacagttgaacggtgtcggcgttggcaatttgaacggggccatgttttagtgagttttttttgtttgtctcttccacttgttacagtattttgtcaagagtacatttttgtaggttaagcgatgctatgaaaaacatatcatttttcaaagttttcgtccttttttccatttttttggaaattttttttgtatatctttcctgaaatcatttgttttcattactcattactagagtttttttgtaaccattacaaaaaaaactatttaaattgtaaaaaatgaatttaaagaatttttattagcaaaaaactctaagaattaagaaaatcattttcccacatttttttctttgtttattttttgggatttattccattttttctttttcaataaccccaatgtcacatcgttttcccctccttctgaagtatcatcgctgaactgacctactccacgctgttcggtgtgctcacctttttccccgccgactttccgctgctcgcccgggaataccacgacggattgtactgctcgggcgcctattttgtcgctcggtccgcctcctatttgccgctgttcaccatcgacggcattctgatggtgaccattgcctattggctgatcggactggtgcccaccgtgggccgctttctgatcactttaggtaagccgtgggggaggggaaggagtcaaggacgtattccaacagggtggggttgagttgggtgatataaacggagcaacagaggggcaaaaaggtcgtcgtcacgctgatatcccaaacgttggcattttcttagtctcctggtagtaagtctccgcgtgagaaatgggtganaacctattcctttacactgtccggacaatcggtcaatggacaaaccgtaaatggacagttcgtcaagttattttattttcttgatcaaaatcaaaaaatatgcgagtgtacgattttttaatgcttggttttttacaacatttctaattacttgacaattcaattaaatttatcattatatagaaaacatgtttaaatttacaaaaatcttgtgtttttattgctgacggattgtcggggagccttcaaaatccatgcgtttcgggaatgttcaaatataggctttatgtttttcatttgccattttgattatgtgctctcctccgccaggcatttccttcctcgtcgagcagtcggccgttgcgtttggcgttatgttgtccgccgtgtgcccttcttaccccgtcgccgtctccgtggccggcccaattctcaccattctgtcgctgaccggcggactgtacgccaacgttggctcgctgccgtacttcatcagttgggtccgtgccaaactcctaaaatctgagtccacgcccccattttgtcgctgtttcaggtccagtatttgtcctggttccgctacggcttcgaggcgttcgccatctctcaatggagcggtgcgtttggcgacgacgaagcgcacgttcgttcggtgctcgccgctttctccttccgcccggaggccttttacacggatttgggcgcgatggcactgttcatcggcatgttctatctcatcggctttttcggcctgcttttccgcgtccgaagggcgcgctaatttatgacacaaaattctctctgtgttttgacactttaaaatttttttaataaattgtttttccaatgtcgaaagtcaccctaatttaaggcaaattgaattaatttttgcggacgaagagaaggaaatttaaattttgccatttctaaaatttattctttttgtagagcgattcgaattccacaaaataaatatttatttaactattttttcgatttacaaaattggacaatttgctatcgttcacaattttatcagtgtttgacgaattgtccgcgccaaatgccttagcaatcgacagacggagtcgacgaacagccaaagctaaaaagtaaatttgttggcaattttcaaatttccatcatttttgactcactgtgccgaacacgacgaagtaaacgatgatggtgggcagaagaaacagcagaatgatcattgccagggtggcgatgaacagctgacgcacatccaaacggacgctgtccacacgccgtctcaacggattccattttttgctgcgaaaggcgcggccgaggcccacaaaggcggtgcaggagactttggccaacctgacaattgagaaaaaattgggaagagataattggaatggaaaatggggataccagattaaaaggatgaacatggattggaaaaaggggggtgggtcctaaattgtgacagtggcataaaacaaaaagttaagctgttgtttggctgagccctgccatttggggtggaaaaacgaacccaatcgatgccaagaaaaaatttggcgacaaaatttccagttttatgtccactaattgtaggccaaaacattggccaagaatttcccggcggaatgtgctcacagaaaaatttgacctgtgcgtgtaaatgtggaagcagaaaatgtgcacggtaagcacgcgaagaaagtcagacagaaaagcgacgagcaccgaaaagcctttcaaatgggagaaatttatgttcagcaaaatattaaaatcgttttacccaatgcgccgaaggcgacaattagcaacgaattagtcaatgagtgttcaaaaacggtgacataagctaaaaaacatttggaaaatgaaaaacaaaaggtcgatttttgggcaaaagcgacgcatttatacttttccacaaatggatatggtagaagaaaaagttggccagaaaggtgttcagcgcgtcgttcagtttcagccccgcggggttgttggtcagccaagtgatcagctgagggaaaggagaaaatatgaaaaacaaagattggcgaaatttaaaatggacgaatttcattggttttgggcagtttagaaagtgtccagtctcctttttctgaccgtttccaactgttcgatgtacaaatgaattgcggcccaaaaattggtggaaatgtttggccattgcgaagtggcaaaagtcaaaatgatcagcccaaacagcgaatcgacgaacaaataaaggagcctggacagaataaattcaaa

SEQ ID NO: 4557 - DNA, 3718 bp, Heterodera glycines
gcgcaaattttcaaatttgaacgttagctcggcagaaagtgcactccattccaacaaccggttaatggcactcattcatggcaaaaaaggagacaaagatgaaaacgaaagaaaatgccgaaattgaatcaaacacttattaaataaataattaaaaaaacaaattgcgcaatggaaaaagaaaaccaatttatgatgcactagaaatgacgaacaaacagaggacgaccggtcaaactaacaaatgagaacaaacaataggcagatcaatgattaattttttccatatatttataccccttctctctcctagaataaaaatcattgccaccaaatgcctttccccttttctgcctattgcgccttcagtttctccttcagcgaggcgggcatttcgggcggcggcgggcgcggtatgttcagtgacaccttgacaaagtcgtagatgaacctaaaagacggagggaaaataagaaaattcacattatttaattaattaatagtcaccattgaagagcggtgagagtgccgatcatgatgatacgaggcaaaagtccaccccagacacctgaaacggcaaatttgtaagattatttcgagttctgatgacaaaaaatgaatgaaattagggccaatgcggaattcggttttggccgaccaattagatatttacgaacatggtaacaggcataaaatgtttgtcgacaagtgaaatttaaattaccaagcgggccgagcttcttcagaatgcccattgcgtccgcactcgcgtccttgttaagctgggagacaagtgtatcggctggatgagaaacgatcgcacagaaaacgcctagaaatcatgagtttatgcaagttaaacgttcaatcaaattctttccactaattgtgttaataaatatgccccctctccacccacccgcaatgtatccggcgatgaatgtgaccaccaactgttcaggcttggtgcattcggctcttggcttgggcaccacatgtttgtagagcagttcaacggtgcgctcgaagcaggcaaatttcatcctaaataagggaaacaaatattaaaaaggttgtaaataaaaagtaaatcaaaaaatgagttgaggcacaaaaaaaagaagataaacaatacaaccaatgggtggtcgagatttttactcggaccatgtccggatattttgagggaaaagaccggaaagcggaagtctgtcaaaacagaaatttagacgcgggaatcccattccgtccctccttccgaccctaattcttgtttttttacaccctggactctttaaaataaagtaaaggcttacattgtgtacgggatttggcgcatccacaacggcggcagtcccttgtagaagcccatcagtccctcggtccggtaaatgaacggcgcacagccgcgcagcgttggcggcgctccgggcgatgtttggatgcgcactttggtggcctccatcggcgccagcatcatgtcggcgaagaactccgcgctggccgaggcggccaagtacaaataggtacggcagctgtaagccaattcctggaaaagaatggaccaaatttacaacggagcaaacggaatgctaagaaaaactaattcagggcacaaatggacaaaaatttaaatttcgatttatcggttgattgaaatgtttgagtcattgatgactaaaaaaacaaaaccatttaaaattctaatgcctagttagattcgatttttggatgtttggctcgttcggataagacgaaaaatttaattttggagatcgcattcaaaaaagtaagaggatgggatcgccatccctttaaaatgaatgatttggattgcacatctattagagcctataaatgcaaatttgaatttaaaaatatacacgcaaaagttttgttgctaaaagggtccaccattttgagcagttttgtcaacaactgactatgaccaaaacacacaaacaaacctcgccgatcatcccggcgtacacattcttgaacatttcgtacagtccgaatttgccaaggccctgcattgaatagccaatggcggtgggtgcccagcctttggccaagccgcggacgccctcctcttggagagtgactttgaagccgccgatgatccctttgtatttggcagggtcgacctaaacgcaatgcaaaaatccatgctcatcccgcaccaattaaactgtcggaaaatacctgaatccgacatttgaccaaatccaacgggacaatggcggtgtgagtgataccgcaagagagaattccgccaatgccgcataacccgtagaacttcatcgagccaaactccacttcattgccgctcttagctggaaaagttgtcgatttgtttttcaaataaatcgaagatgattctttggacctattcaaagtacccaataatgccggggcaattgtactggcgaccaactcagtgacgagccgagcggtgctaagccaaaggaaatcctttaacccatcgtaaagggtgggcacgacggagaagtacaaatacacccaggagaccaccaccaccacaactccgtaacgattttggtcgccacttttgcgacgcgaacgcacaacaacaattgggttcttcttctctgccgtttcggaggtcatgagaatttttaaaaatttgtgagaagggaatgggtaaatttctgaatttcaatcagaaaaataaatgaattcggtaattttttgtcaagtacactttcacgaggaaacaaccaaaaaaacgccgtgattttcacatttaaaactcatttctcattgtgtgcgcttttgccacgtggaaaatcagtggtggtggtgacgagatgagaatgtcaaacaaaacaaaaaacggagagaaggaaagaaaagggatggatgagaagcagaaatgttgattaacaaccaacagaactcataaaagtggaaaatgatggaataattggacaatcaatcggtcgtccgattaatgccatttccgacatctgccaaacgcaccattctctgctgtcgcacagttcgcagcgatcagtggcccggcgccaaacgcctttttggtcgcttcagccagctctgtgatgcccaccattattgtttttggtcagcagagagaaataacaaattatcaagggcaaattaaggcggaaactgaaagaaaaaaagagggaaaaatgaatagacaaaatgcaaaaaattaaaattaaaaaaaaataacaaaggaattaaaaatgatttttagttatttaaagaacgcttaaaaagagtgaaaattggaagaaagaaaggaattgaatcaattcgttttcaagcggcggaatttgtttagtctgtgacctgtacttgtggagaaaaaaagaagagaaaccatacagaaaatgaatttttctccgttcgcgtctggccgcctacgcttttttggccttttctctgttctcctatttccaattgaatgtttttctttctcttcccatccgaattatttggcgttttgtcttcaagtttgaatttcttacaattggtcttactccttgttggacagtatgcaatttatttgtatttgcttatcaattattaacacaaaaggaatttatttatattgaatgtgaatgaaaatgattattttttacttggtttattttatttctctgctcattttaattgtccgttttctctccgttatcattcattaattttaattacctttaattaatcg

SEQ ID NO: 4558 - DNA, 2433 bp, Heterodera glycines
tttaatttttttaacgcccaaaatgagtccaacatcagctgttgacccaacagcttcgaccccttccaaaagatgtgccattgtcggcgcgggtgcgtgtggcctcgcatgcgcccggtaaacaattcaaagaccctactgtaatcacagataccgtatttggtgtcaacgatttatcatggggcgtaggacggatttaaaaaatgatttatatcccgactatctcggtttacgttacggtttacgggttgactgtcctaataatggtaagccatttcatggttcccctgttagatgggcacttgcttacggcttccgtcccgtagtgatcgaacgacgacaaaatttgggcggcctctggcgttacactgacgatccgttacccgacgaatgtataaaaactaaaaaatgctatgtgtctctgccattttggcatttcgtttcctcccatttccccgcaaagtggccaccgtaatgcgctgtacagtaaccaactcgtccaaagagttgaccgcgttcagcgactttccaccggactctcagctgcccaattacatgcggcacgacaaaatgctcgcctatttggcggcatatgctcggcaccacaacttggagcagtacatccagtaatatttgggataaattacaattaaaacttctcgcccaaattttggcagatttggcaaaaaagtgaccaaaatttgtcggtcgccaaattatgccgaaacgggacaatggacagttcagtgggaaaatgaagggaacggagagcaaattgaagacactttccaatgcgtattggtcgcaattggacaccacgcgaagccgaattggccaaattgggaagggatggcccaatttgggggaaaagtaagcgaaaaggggggggatttaaaaagaaattacatcaaaaaaaaagattttccattcgcatgactttcgccgtgtttcgcctgacatggaacaaaaaagtgaatgtcgtcgtcggggccagcgattcggctgcggacatggcggtggagctgagcagagtgtccaaggaggtgaggggcaacagcagcagataatttaaaattaaattttcttgttgccgagatcggttcctcagattagggttactccccgacccctcggggggcaaaatgtagagctccgcggaccgtcgggggggggcacgtcaggggtcgggtcagggaatgggcccaaaatactgggtccgagaatgtctggtccgaggaccgttgggggggacacgccgggggtcgagttggagaataggcccagaaatgtcgggcgtcggggggactcaaggagatggacatgttgggagtcgggccggggataggcccattcggggtcggggagaaaccctaccttagatatatccatttttattggaaatggacccgaaaaaaaactccggttgagctaatttattttgtgggcactaattggcgattctgattagccaacaaataactgctgatcagagggcaccaaattgcggcatttgatttccaaaattgccaaaaaggtgcttttgtccacccgccgtggcttttgggtgctgcgcaaatgtgccgagaaaggccttcccgtggactccgtgctgaccacgcggttcagcgcgctgctctcgcgctacgcgccccgccgcttcgacgagtggcgccgcgtcagatttttgcaaaaggtgctgcacaatttagaggccaggacaaaaatttaagttctcggcattttgtccatttggccataatccgatatgactgactgaacttatttgaaaagcgtgccatgctttttgacattccgtttaatcgctttcatatttctgtctgtattggttacttatttatttaaatttatgtttggtgccttctcgtatagtcaaacggagaaagtgatcaaattgatcagcggtaggagggcaattgatgaccagcaaaagttccctaattaattcattaattaattgatgccaggggttggatcatgcaatgtacggcataatgccggacatttctccactggtcagccaattcttcacggtcaacgacgagttgccaggccgaatgttggccggcatggtcaccgttaagccggacattggccattttacggaaaacggtcactgatcattgactattacactgatcacttatagttgataaatgcttctttgcacaggcattgtatgggcggacggcacgcgcactgatcaagtggacaatgttttgttgggcaccggctatcgctttgacttcacactgatcgagcggggacagctgctgatcagcagcattgatcagtcgtcggacaacggcacgacatcgatggcacagctgtacaagcacatgttcccactgggcagctccgattggaacacattggcaatcgtcggaattgtgcaggcagtgcaaaatgccaaaa

SEQ ID NO: 4559 - DNA, 1763 bp, Heterodera glycines
acaaattaggtaccagtgtgaccacaggacatgacaaaatgcgtgtgacggtgtgccttacagctcgaaacaagggacaaaactcaagccgtacgtgctggtcaacagaaagcgatcgataccgcaaattgtcaaccaatttgctggaaattggtgatcaatttcgctggctcgatatggatgaatgatgacacaacggaggactacatgcacaaaatcatcggggcaaagctgttcgttggcgaacgcctcttggtttgggatgcgtttggcagccataagagcgagagaacgacgaaggtggtgaatggattggaagtggagacggtttttgtccctggtggctgcaccaaattcatccaggtaccaaatcatccttcacaatgaaattcatttttcttccctaggctcccgatgtctcgtggaataagccgtttaaggagcgaattcgacacttctacagcatttggatgtccaatgaggccgaaaagaagttcacgtcagcgggaaatccgaaggcacctgctcttcatgtggtacttgattggatccaccgatcatggcaggaaatctccaaagaagtgatcatcaaatcaattaagggtcagtttaaaaattaacacaggaaaaatgcctaaacttttaagtctgtggactgactacgccattggacggaactgaagacgaaaaaattgcttgcttcaagccggaaggagcaattggaccgatagggatcaaatttttgcgcgagtttagaggaaatcaaacaatgagagatggacgaaatgatcaggaggaagccgcctatctgatgatgatgtagagatggatggagtgggagatgacgatgaattgctcatttgttaaattttactattgttttttgaaaataaatggtgttgataaaaattccatttatccccccgggggataaatggagacggggggattatttttcaaagccctcagaaagggggggggggtaattggagccagctggtcaaagccctcagaaagggggggggggataattggagccagctggattaatggaaacggagggataaaaagagaaaacacggtaagtacctttttttctccgtactagtttcgatatattaagcataaataacacatttttcacttggtttgaggcttttacgtttacttttattatgcctttaatgccttttttgggattttcgtgcctttaatgccttttttggcttttttccgactaatagtgaattcttatggctatgcagcagaaaatgtgcaaatggttgaaaaattctttccttttatatgcattttctattgccactttttcagttggagatttgagtgtaaatataaaggcataaatttgagagaaacttcattcatcaaattcttcacaccacttcatggtatctgcactattacatctacctaatgtgtattttcaatcttttctaatcctaaaatttcatcgttttgaagcatatacattgtgcattcctgtacatacctgtacataatacctcctacattcctgtacataatacctccataatctctccctcctccaactcttcgatatttcattactccatcggacggacatgcgcgaactgttgttcaagaccgccaaccaggaacagcacactttcactcttgaggtcgaggagaacgaaacggtgaaaggcaatttccgacagtgcttaaccaattttcccttctggtagggcttcagatcgctcaaatcaagcaaaaaatgagga

SEQ ID NO: 4560 - DNA, 924 bp, Heterodera glycines
ttttcagaatgatttggctggtgctgatgatggtgagatgttggtgcagcctatgcacatgaacgatcatccggcggcggcgcaagcgggctatgtgaacgaccacgctgcacaccatcaccaccatcatcatcatcaacaccaccagcagcagaatgggatgctcatcgatcacaacgtgtggcagcagattcttgctcccgtacaacaacagattcagctgacggcgcaggattacccggccatccgtcgagtgggaacaacaaaaacatttaaattcaaatttatgatttcccctcatttcagctcatggcgctgggctttccgcgaaatttgtgcatcgaaggtgggggggggggggggtggacagatggaactacaattgataaattgtatcaactgacgtattgaatcgcgtacattgcctttggcagcgatgggatgaaggatagatcggagcttataaacggcttgagtctgatggtgaatccggacagggcctgtcgtgggataagaccccgagtcccctcgtcgccagttagcctttccgaattctgagaatcaaaacggacgaatggaagtgagccctggaccaatgctgatagccggtgaaatcgtttatcctcgtgggcggagctatttctagatcattaccgggacgaatgcaatgattttggcgacttttttgcgggatttatgaaagagaaggaagaaaaggcgcgtaatgcaattgggagtgagggcgagcgcggtgcaaatgatagcagcgtgctgataaaaacaaaggtaagcgggacgggaaaaaggattgaaactccgagccaaaattggggtttgattatactcaaaaaggagggcggttaaaaataaattatgaaagcaaaatgggttccaaaatgacgaaggaaaggctgtaattaaggt

SEQ ID NO: 4561 - DNA, 2755 bp, Heterodera glycines
aatttcaaaatcagcatttgaccgacaaaaaatcagcatttagggggagtgcattttgtaacagattaattctctcttccgtaataggtaagaaactgcattttaaattttccatcaattaacctcgcatccaattatccatagttttcccacttctcccttttatgtattattctcaaaaaatggaattcgaatttctgatctcaaattatgttttgcttcagatttaaaattcatttctcaactgattttattaagattcttattattgtttttcttatccaatggattggattcattgtaaggcgtttcgaatttaaagcctgctgctttggttttactgctggttcgctccctccccctgtaggtaacaaatgcgttgcagttggtaatcgtggtggttcatattggttcacatcctgtggccacattgtttgtatcaattgcatgaaacagggcatgtttgtgtaaattaaatgtccgcttattaatcagttacttaattcgttaattattcaggaggaccatcgcccgggcataaaggctcctgcattatctgtcaaaaaccggcatcaatgtaagtgtaagtaagcaacagcaaatgctttataactcgtgtcagcacaccgtcacagaatggaaatcaaccgctcaatgaagccagaaatcttgacactgttcaagccacaaaaggaagtgttggtggagaatacgcagcgaatcaaatcggcgatggatttgcagaacaaccatcggcaaatgctgattaggaaactgcacgaaaaggttgtgccgcttctgctggcaaagtgtcgcgttgagaacaataaaagtcactgtttttagtacgatagggcagccaaatttgcgagaggagcacaagcggatattgcgaaacgggacaaacgggagaaggcgttgctgacggagagggaccaactgaagatggagttggacacggccaacgaccaaatccaacgattggaacaaatgcaattccgaatttacgtataaaacatggggaaaacatgcatttttaggctgaaagaacgtgagaatgaaattctacgcctacggaagagtccgaatcgacgccacagcccacagcacaggaaaagtgagacgaacgggcaattttaagacctaatgagcgaccaatttcaactgctttttttagggaatatctacccgagtttgaacggcaacactcccatcacttcgttgtcatttctcgggtgcggtgcgatgagtacacccaacgatgaagtatcataaaaaaacattcacaaaagattaattataagcaaaaatggattaggagagcgccatgaaactttatgttggccatgttgagtatgaacgccaaaaacggcatatttttgatgagaaatttcaaaacccatgttttagtatacagaggaatttcgcatattagtattcgccagttattgtacaaattgatgattatgcgtttagcccggcggcatgaacttcaacatggccacagcaacgccggcgaattttggcattcgaaacgaaaacaatgacgcggagcagaacatcgaagcgctgttccggacgcaaaatgtgcaggaggagacgccacttgcggggcccgcgttctgtcctacgacgccttaccttttcgcaatggcggggagcaacagcgaaaagtgagagacaaacgaaaaaagcaattttcagacaaattaaccaaatttagacgcacgggagtaacgccgaaatacttctgaactgatctaatgtaataaatatattgtgcttcttttgttcgatatatgtgaaactcattcatatttaccggcgttgtatacatatacacatttggtatattaataaaatggcatatcggtcgtgcataaattgtttcatttgtcgatttgaaatggatgtgggacgcttacaatcaatcaagcaaaacaaaaccgtagtctttaagggcagcaattttcgtcaaaagacttattttttgcctatatttatcttttcaacataactatttttctaattaaaattttagtcgaaaatatctcatttaataaaaaaaagctgccaaaataggaacaaaaaaagagaaatccgaaatggtatttatgcagggctcgcaagtgtccttatttctaagatttttcttatttttaggcttccccaaactttttaaattttttgtgcttattgatttatttcgctgatttaaatgctacaaaaactcccaatttccaaaattttttcccagcggcgcctatcggcaccgccggcaactaagaaatttttgtttccttaaaaaataagctcaaaatcgtaaaaattagtcatttttggtgaaaatctgttaacaaattgcttctaatattcaaaaaaaattccccggtggcgcctatcggcaccaccagacctccctccccactttctctaagttttttgtaaaaaagcgccacaaaaaagtgcatatgttacgtttccttcgcgctaatatcagtttttcaaaaaatcttatttttggggtcaaaatcttagttttaatctcgtttgtccttattttgaaaaaaaaaacttgcgagccctgtatttatgtattacatatctgtactcagattttcaaaaaaatttatgtttttcgctataacttttttctttggcatccaaatctaagattgctggtatcacttcgaaagctcttcatatgctctattagccttacaaaaagcgaaatgattttctaggctgaaaaaat

SEQ ID NO: 4562 - DNA, 2903 bp, Heterodera glycines
  misc_feature (28)..(28): n is a, c, g, or t
  misc_feature (2795)..(2796): n is a, c, g, or t
  misc_feature (2881)..(2881): n is a, c, g, or t
agagaaattaggaccaaagtctcaaatntagagctgtaattatcaggaaattctcgaccttattaagtttttcaccaaaaatgaatattttctctaatttttgagtccaaaaattttaatttttttttgaaagtcaccttttaaaggttattttaaaaattttaggttatttatatttcttttttttctcgaaagtagccttaacaataaatagtaaataaaaaactgaggagacaagaaaaaaaggcaaacctaaaaaccagaacccttttcattctctttccctcattcgtacaaatatttatggatttttaaattgaaattggtgttttgtttttgccaaatttttggcattaattttttattttcttgaattcaccctccattctacttcatatgtatgtatatggcagagatgtgatatctgaggatttttcctcatttgtggtcttttgagggtcaaagaggatttttttgaaaaatgaggatttgcgggtttttgtggtcttttgagaaatttgaggatttttgtggtcttttgaaaaaaaagtgacaaaaacgcatatttttttgaaaattaggtatatttggcaaaatgttcgaattttttcttcaaatcttaaacatttttttgacaaaatttgttaacaaatcgcactcaaaattccaattttttcccggcagcgcctatcggcactgccggaccccctcccccaatgcttccaaaaattttttggaaaaccgcgccacaaaaagagcaatttaaaagcaaaaaaatttaagagatgtcaatttattaataaaacaatagaaatcgaattattttatattattttttggaggttttaaataagattagttttagatatttaccaaaaattaccaattttgcggcctaattttgcgattcttgaccaattttttaagaaaaaataggaattatttgggtccggcggcgttgataggcgccgtgattgttttcaaacggaaaaatgacagttgactgattttgtttgcaattttatgatgtttcaaaaaatgaggatttttccttccaaatgaggattttttgaggtattttaatggcaaatgaggattttttatggctgaaatgaggattttcaaaattttgagatcacatctctggtatatggtcaaaagaaatcgtctaactatgctaagaataaacaaaatactcatttaaaaaagttgaacacctaattagagcactttttaatgaagcaattgatgtaaaatcaaaattaaagaatattagccaaacaattatatatgtatattatggaaattgatatgctggggcaggaaaagcccattgaagcagaatgaccacgaacttttttacctacccaaagagcatttaagtttaatatttttcttatttctttttttgcgcagcgctttatttctgtgccactttttcgtcggtttttacaaaaaaatgaagaagcccgccgttgtcgaggtaaattcactcagggtatttgatgggcggggagttctgttgatttctttgccctttaactttgtgaatggcattcccatgacccattggcatgcattttctgaacaaagaggcaatcccttcccatacggcaaggcggtcattcattttcattccaaacactccaaaatgggaaaaaatctgagaaaaattcctgtcgaatcgctttttgaaactactaaaagtcttcgatttgacatccgctgggccactgttcgggtgtccgcctcatttgaccactatgttcttaagtgccaatcagattggctcttaaaggaaattgagcgtctagtgattttacatcgaaaagtattaacggctggagggaacatatccaattctaattaatgacaattacaggctttccaatttattaagattgagttcgtggcggatgaaaaagaacgtctgttccaagtcgtttctcagttgaacagcgaacgccgttcgattatccaccgcgccattgcgtcctattttggggttgacgaaaagtttggggcgaacttggtcaaagacggtgccactgaccacgaacaattctgtgggaagctaaacgctatggttgaccagttgatcgactacaccgacgcagcaaaagtcgcagtcgcaggagactgtaagatggcgagcacagaaaattttgaactttttatagcatagcaatcccccaagaaatcccaaaagtgacacttttatttctggttttcgagctcatcaattaaaatctacatccattttgtttgaggattggtttcatcaattttaacagtattaattactacatttatcactcagttttgcatcaacaaggccagtgtgcgtaccgatctcttgcggatatgaatcagatctcaaatctgaaggcgcacatttctgagcttagtgctcagaacttgacccaacaggcgcaaattggtgcacagcaggttcagattgatggctttcatgcccaagttggtaatcagcagaatcgccttcaggctcaagttattgctcaacagaatctgatcggtgaccagcacaatcagatcggtggccttcatgttcaagttgctgctcagcaacaactggatcggtggccttcaggcccaaattggtgaccagcagaatcatatcggtggccttcatgctcaagttggtgaccagcacaatcagatcggtgacctgcaggctcgaaatactgctcttctggctcaggtttctgatcgtatgtcacagctttctgatatcatatccctgctaagaagaccgttggaccttcggaatcggnncggtgatttgtcgcagacgggcggagaatgcctaaggattcagtgtcgacgatgcggctcgtcgtgatgaaagtgatctgacggntggaaacgaatcttatttttgc

SEQ ID NO: 4563 - DNA, 3939 bp, Heterodera glycines
  misc_feature (3891)..(3891): n is a, c, g, or t
ttccgtggagcgggatcgaacctgcacccattttccttctccattcctatcttaaaaaaaccacgggtcggatttattggtgtcgcattttctggctcccaaaaaaattgttggaaaagagttcgggtgatttttagaggccaaattttaaattacagaacaaaaagaaaacgaaaaaaggaagaaatttcggacaaaaaatttttgcttgatcattcccattcactttcttcttctcaatcactcccttccgtgttactttcttccgaatcactttcttcttttccgatgtacttttcagttcatccatcaattcagcgtcaaactttaaatgctcgaaaataataatattttttgatagaaatctttgagtttgacagaaccatattcacttttatactcataaattttcttaagattattttccttcgatgctttttcatcgattttgaatttttcaatgagataattaatactggaaaatattcttcaacaggaataccatgaaccatatcgttcatcaatttctcctgaattattggaaattattaaatctatttatattttttaccttcatgccaattattcagtaataatgtgccagcagaattttgtgaatgaatggctttttgcttttttcgaccaaaaaatgtgcacaacgattcacgacagaatccaactgaaaacgatcggccaacagaagaacattttccaccgaatcatcttaattataatttaaaattattagattcatttaattttaatcagatttaagagttttatttgcaaattaatagcgtaaaatatcatttcattcaattttcgatgggaattccatgcccattctgctccttgcaaaattaccgtccaactcggcactcggtgaattcactaaggaaattaatttttcaaaatttcccactgcatttttatcattgtcaattactagttttagggtttgttcgttaaattcaaaaaacaaaatcttgaacatttcttacatatttattcacattcaccacttggccattaaccattaatttgtcttctgcttgaaactcactaaaaatggattattttaaatggcattaattaatcgttaattaattacatgattggctttttcagttcggctttcacaatgatttccgctttgagtgttattgcatcctctttttcgtcgtatacgacgccatttgctgggtctaaaaattcattaagtttcactattgagaaaataaaaaaataagcataatatacctcataatatctacaaaatctatcccataaactgtttttactaaatgattccaaatttcctctccgcataagccattcatcgctttttgtggcagaaacagtgccaaattcgatagcagcttcaaaattccaatctgaaaaataaagtgaaataatcaagatttggagtttcaggaaattaaaatttcaatttatcaacaaaattaatgaattcatttcaccataaattccacgactggacacttgatagaataaatagtcaatagcattacggtgaatcgaaatttgccatggcattccgccgatggacacttcttcacttttcacttccttatttatttccaatgacctaaattcggtcactttaaaaagaatttgaccgcggcatcggttaatttcaacggcagacaaatcaaaatctttggctaattgaagaacattttgaacacaatcttctaaataattattggcatttaaatatttctttcaattttaccatgaacagcgaaattcggtgaatttatcacggaaattaattgttcaaaacatttctcggcattttcaatagaattaatttcaatcttgggagtttcatatgcattctctccaaaaaataaagttttaaaaaaatttgattgagccgccaaaatctaaaaattgttaggattcaagcacaacaaaaagaaaattgcaaattaataaactttttgtttatttgtgttattttaacactcaaatgaaacaagtaattaattaccgaattggaaaaggttttcccactttcactttcgctttgaatgtcattgtgtcctcctccacattataataacttttcctttgttcattagtttctaaaatttaatattaaaattataaaatctggatttattcaataataaaaattggaactttttcaattaatttttaataaaatacaaatcatttttattttccttaaatttccaaatgcataattgtcttgaggccagcaatccctaattcccccatcagtgaaatgatgaaaaaatgactttttaatttcttcatcgttttttgaggatgaaacaatggataattcgaattctgctttgcagctaatagcaaaatctaaaaaaactttaatttattatttttttaatgatttcttcatattcccaatttttaggtgtctgaatatgtaaatcaaaatttcgtttacatttttataaccatagatacataaagaaaatccaagagatccctttttggcgtgcttaatcgcaattttccatggcattccgttgatgaacactttgtcactgtaaaaataatgtggtcctcgtccttccgaaaatgctttgaatttggaaatcgtgaacacaatttcaccactggtttggtaatgattgtttgctaaaagagtttttgcaaatttctgatttttatatggcatttattaatttacctatggcaaagaaagggccatgcagccaaaaaatagaaaacagcagaatttcaattggcttcatctccaatttagctaaaattaatgataaataataatttagtatctatgtttttccgttgtttattcttaaattgtattttataaatttgttttttattaatccaactttaattttttacaaaacatgaaaagaacaacattccgaaataattaaaaatcaatgtaaagatgaattttggtcaaaaatatgtacaaaaaatggtcaagatatttacataaatttgtaaaaaaaaatccccaaatatgtaagaaatatgtacaaaataccctatgtaccaaatatgtaaaaaattgaaaaataattattttctttggaaaaaaattcttcggaaggggtgaagtaagcacaaaattccataaaatgagatttattgtaaataggtttagaaccacatttaagttttgaaaaattaattttcgtttaatttttattttttcacataaaattttataaattttcaaaaatttctgtaaaaaatcctcaaaattgtaaaaaatgtataaaaaagtccgaaaaagtccaaaatatgtagcaaatatgtataaaaatctcgaaatatgtaaataaaagtcccaacttttgttcgcaaacacaaaaaagaaagtgtttttaaataaattacatttactttattgaattaaaatttaattacttaaatttaacaagaaaaaattaatcaaatctttccttttttaaaatcatagcttaaaaagccgcaaattattctttttaggtgcaaatcgtttaactgtgagccaaaattccctaaatttcccagccggcaatttcggcaccgcggtacaaaagcgattccctaatttttttgagcaatttgagtttgggtgggacctttgattaatacttccatctcggaatattataaattttaaccgaaaatgccgcacttttctaaatttatcggtcgttctaatttttagtttctattaactgtcggcgggagttctttagctcccaaattggggcctttttaataaaatttaaattgtcattatttctgattgcaaatttcaggttttttaaaattaaatttgcattctttaaaatcgaattctctgctttcaatgcgccgctatttttccctaatttttttttacttttcaanaatttctattggcgttttcccgcgccacccaatttcatttcattccct

SEQ ID NO: 4564 - DNA, 2318 bp, Heterodera glycines
  misc_feature (53)..(53): n is a, c, g, or t
  misc_feature (75)..(75): n is a, c, g, or t
  misc_feature (122)..(122): n is a, c, g, or t
gggatttccatgagaaaaaaatggcacggcttaaaaaacactttgggtgtccngcgaaaggcaaaacaaagaganaatatttttcggaattaacaaatggatccataaattaccaaaaagtntaatcgcttctcacattcgtacagtgatccaatggaatgtctttaataaacgtgtgactgtttgatcattaaaagacttttgatcactcacaattaatgcctatacaaatttcttcaagatttttatgttgttttttgaaaaaattatattttttttgaattttgagcaaatcttggctaattcttgaaaaaataccaaaaaaatagtttttctacactggtttttatatgcttcttattttttatgtttggtaaaattggagttcgatacgacctctttaaaaatgagaagcataaaaaaattttgattttaattttggtcggattgaatttagcagatcaaatggaactgttcgtcttacgtcacgcggagtacgaaaggctttacaattgcacggggttggacatcgacgcaattccattggagaaaaggcaatttgtgcccgagtcaatcgccatctgcgttttgtgcgccatttattatgtaaaattgaaacaaaagtgaacatttcataattgacccacgggaatactgtaatggggacactaattcaatgatactgtgcaatcaactcaaattagttaatttacaatcaattagatgctttatttgccctgtatgtactccatttggaagcatttgcgcgagaattcctgctacaaattgctcttttataagggcatcactgactttggcattctgtggatcctcggcttcttcagcggatggctcaatttgcaaggggccgttttctgctctcatcccaagctgatttatttcatcggagtggcagtgtcatgttggaaattaatttttaaaaatgcaaattctttaaacatttatttagccctttggatagcggaaagcactgctgatttggtaattgtttcatcattaaatccaattcttaccatttgctttgggtacattttgttagttgggattatggatatttgcacatggataagatggcttttgataagctgggtagacccaaagtcatgtgccataccaggcttaaccttttttccccaaaaaattccggactgtgcttcgtctttatccgatccgacccttgatgaatcggtaaacatggagtttgttgttcgtcaggtgttggctttaaaccgctgtctcgagatcggctcgccctctctgtcccaccttttgttctccggccgtcgcgtgtccctttggctcttcggctgctctctctacgccctctattgggcacttttccttaaacccgctgtgtacagtagcctctatttcggctggttcttctaccctttttctggctaccgtagtgacaataggcgtgaggtggccgcttttcccttaccgtaaccgttccatttcgtttttttcaaattcagtttgaaaatcggctccaaattgtccaagacattgccgtggctttcttttgcccgttcatttatctgatcttggccatcaaacttttcgtcgatatccgaaagaatggcgccgtcatctccgaactcagcgcaatgcaaacgaaggcaaagcattgggaaaagggaaaacaatcagaacatacgaaggatgaattgccatggctttagacttttgtccaagtgtttctgatttcgctgactaacattttgaccggcactctctacgtgttaatgcaatggtacgaagttgaccaatgggcgattactcttgcggagttctcctggtaacactcataaatcacgatcaattttcccattttcaatttgaggttccatgcccatggtataatcccatcgttcgttttttgcctattcaattgtcccaagggctgccccccgtcatttatttggcgctgaacaaaaccatccgccacgactgtcgcctgctgtacctgaaagtgttcaagcgtaaccgtaccagcagctccggcggagttactgtagtccggccggcgttaacatgaggaggacaaaagcgaaagaaactgatgcggatgtatttaagcagccaaattgaggccaaaaaatcatcaaagattattcatttgtattttttaaaattcttattaaaaaataataaataaaaaagggaaataaaaaaatgaagcgacatgtttaaaaatattgaaaatttaatttcataatttcacctctctattttttgaatttttataataaagaggagatcgttttgatttatttataaaatgacttactatt

SEQ ID NO: 4565 - DNA, 4250 bp, Heterodera glycines
  misc_feature (841)..(841): n is a, c, g, or t
tacggtagccgacaaaaggataaaagaaccaattgaagtagaggctactgtaagtggcgggcgtaaggaaaagcgcccaatagagggcgtagagagagcagccgaagagccaaagggacacgcgacggccggagaacaaaaggtgggacagagagggcgagccgatctcgagacagcggttgaaagccaacacctgaccaacattttgccaaaagcattttcaaattgaatttaccaaatcggcagtgctttcagccatccaaagggctaaatttaaactattctaccaaaaaaatattaaatattgttcaccagtcactccaatgccaacaaaataattcaaagttggaaaggagcagaaaacggccccttgcaaattgagccatccgctgaaaaagccgaggatccacagaatggccaaatcggtggaagcgatgtaaaagagcactttgtagcaggaattatcgcgcatatgaatccaaatggagtatatgcagggcaaataaaggacctaatgatcacgaattaggacctaattactattttctctctcacttaattagtcccgggagattgaccctgcccagggaatacacaataaatacagttgtttattatttaaataaatacataataaatggcgcataatacgcaacgggcgattgactcgggcacaaattgccttttctccaacggaattgcgtcgatgtccaaccccgtgcaattgtaaagtctttcgtactccgcgtgacgtaagacgaacagttccattgatttttgatttaaagtctgccacccttcaccttaagtctcgaaaaatttggataaatttgaaatgatnttcttcggcaaatttctcggtataaaaattgaaaattgtaagacaaaagtgcgcttttggcttgtcggattattatattttgttctgcttaaatggcggattagccatcgctttcgccgctttcattgtttggcaaatggtggcttttgctttttttgaatttcattttacgttaaccattcaaaaaaacctgtctttaaataaataagcgtatgtaattttttttttcagcttcatttgacgtttgctgcttttttcgtaattacgccaataggcaaaaatataataataatttattaaaatgcccgagtattttgggtctataaaagtttgtacccggttcgggctcaaaaattaaaattttcaaaaaaaaatcaaattaaacatttttcatcaaaaacttatataagtatttacaattataatgattttaaataggctaaaaattgaataaattagttgaattttttgataaattttttgaattagaattttataagatttttctaaaataatgaattttaaaagagttttgatgcataagatttgaaccagggacccaaaaaatgatggtgccttaggcgcaacagaaagtttttttaacaaattttgacgctcgtcaaaaggtaatttcgccaaagtgatcagaagatcagaccgtttctcaatgtgatctcaaccgttttttgttttattttttgtggacgaaagtgcaactttttccctccatttttcttccatcgcttcacttatcgaaagtccatttgctcttttttgctcaccccactcaattaattgcctatttaaaatgtggcgaattctaaaccaataaatattcctcatccttcccaataatttctgatcaaattggacaatattttggttgcatttgcattttcggtattagcaatggcatttcagcaacatttggtcaacaaattctctccacttctgatttccggttattattccgatgggctgcattagcatggcattgtacccgcaggtggtacattggagcatgttctacgtgaaggacccttatcatgggcaccaactcggccgtgcgctcgctcgcagagcgttggaatttgcaggggacagacccgtatttggttatgcaggtcagaaaacatacggcagtttggacatgtttttgccgattgattggtctgtcgaccgatcgaatgatggccaatcgattgccttgtcaattgaatggtcgattaatggccaatcgattgcgtttatgttatttcctttcatgttcccgaaatgtggcacaaatacgaagaagagtacgcattccatcactatttggactggcgactgtggtcattcagtgcgaaatgtgccgacgtgcgacccgaacgattggaccacgactcgagagtggagctgaaggactggcgtgaagcttcgttcggcaaacttttgctttttgaccgccaggtgggcatcgacagatcggcatatttgcggaaggcacttcgccttccccaaagtgccgcaatggtcagcggcggttatttttggcatccagtgccattttaatgattttaggttgccgtgtgcagcgagacgggcgacgtggttggcttgtgccaggcacggcatttgctcggcgatcggctcggcatcagtctgttctatgccaacagttcggtcagtcggtctttgcacccgctttacgcaccatccgtttttgcttcagtccgtcgcctcggctcttctcgtgccgttctgcttcaatttgctttgcgggtccgccaagttcgactcgttcatctacaaaactccgtccgccaacatggagtccgtccgcctcttccgccaactcgtccaaaatgggccggtcgaacgtcggctttttttcccgcaattctcgcgttattcgctgccttttcccggccatcgcatttattcgatcggcgatgagcatgtgtcactgatctgaccaaagaagacgaagaaagagaaaggggagaaacgaaagaaatgaaaaaatacgaaacattgccgaaggttgcgaccatgtgccattgggaagaggacgcccaacataattgtccaaaagcctaaaaaattattctaaaattgaataaattttattatctgaccaatcaatgaggtcgaaaagccaccaaatttccaaattcagtgtaaagtgctgtcactgaattcctgatatcgcaaagtggaacgaatgcaactgatgtaagcatccgaacattcaaacaaagaccggaccggcacaataacgcttaaattttccgaaatttctaaaataaaaaagaaaaatacttgccataagtcttgctgtttcactttcttttgtaagttccgtacaaaatgaaaaaagcaaaaccggatctggcatccgggaaagattgtcgtaacggcatttggcatagccatttcaaaatccaagaaaaaagaagtgggagcaaaatttggccatgctgcacgcaaaagtgtaaacattctttcgttggatggttgtaatttgcaagtcattaaggcatggcacaccgggaaaatccatttttgaaattgtaacaaaatacttttgaaaataggtaaataatttattgtttttgatattttataaaaagtttttattttattttttggttttaccaaatatttgaattttcaaaatttttgcttggcgcccaaacgagcgcgcccaaacgagctggcgcccaaacgagcgcgcccaaacgtgagcgcccaaacgtgagcgcccaaacgtgagcgcccaaacgggtgggtccccgcgggcgtgcgtaaaccatcaaaataattaagagcagcagtagcatttattcaagggaagacaaaaattccttcattcccttcatcgatttgacaaagctttcaaattatgttgttctattaaatattatttatgcattatttaattatatttttacatctgaaatgataattttacaaataaaagttattctcagtcacaaaatgatgattaatgggcaaatgttacaaaaatttttgtataataatcgtcaaaaactaacatgaaataatattatattagagttaatgaaagaagatatgttaagattatataaaattattaaactaataatgaaaatgatatattaaaaaaaaaatttcgctacaaacttgggattagagagtccgaaaattcaaaataatggaaaaattgcaaatttattttttaattaaatcttaatctttagtttggcattatctttaaatagaacgcagttataactgatataattatttaaataggcttatgtattaaattaattattcatcataagatttctgtaatattattttattaataaattttttggacccaacatgaatgacattgatgaatggtgtaaatgattctcctttttttcacagctct

SEQ ID NO: 4566 - DNA, 1048 bp, Heterodera glycines
ttattatgtcctgtgaattgtatcttcccagcaaaatgatcactttcgtcactttgtcctggttttcttttattatgtcctgtgaattgtatcttcccagcaaaatgatcactttcgtcttgtccttgttttcttttattatgtcctttgaattgtattttcccagcaaaattatcactttcgtcactttgtcctggtcttcttttattatgtcctttgaattgtatcttcccagcaaaatgatcgtttcttaaaattgtccggaattttcttttattatttccctataaatgtatacaaccactacaaactgggcatataaataagttgatttatcgcttaaaattcattattttttcatattaaaatagattccattccgagattcatttcccccatttttttaattttacatggctggacccacttcacattttagggttgccgactgatagtgagatatcccggctggaatcccagcactaaaagactcccggatcgggaccatggcaatatcaggatttgaatccgagcaaacccgggtttttcatctggaatcatatcccggaatccgatcccgattttttcaaaattctcggctctaagaccaactgaacatttaatttttttaaatttctaatttaaggtgacagaatgaaatatgcattctattattctattatattttccgccttttccaatttgcatgtaaaagcattcccgccaaaagataaagaaggtaaatctgtaaatatattgaactttctctaagttcctgttgtattcctaaaatacgaaattccgctggctatgccccttagccaattccatgaaatgcttatatatattcctcctcttaataaatttcaaatttaaggcaccagtaatggaaaaattgtcaattctttggcagatcaaatgaaggaagtgttggacaaaggagaatattcggatgttcattttttggttgggaaggatgacaaaaaggaggcgagtcaaaaaaagcaaaaaccatagcttaatgcccaaggataaacaataacatttt

SEQ ID NO: 4567 - DNA, 7888 bp, Heterodera glycines
  misc_feature (11)..(11): n is a, c, g, or t
ttttatctttntcgttaataattaaaaagattgtctggaatttgtcttgcgccacaccgctgtgccattcatttatgtaatttgacaccagtctgataataatttcgccaaaatttatttattatttgtccatttattacgaattattttgcatctatcactccaaattttgttaaaaaaatttttttattgtcccaatttttaccatttcacaaggagtgggttttgttttgaattatttaaattttttaatttttccattttggcttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacaggttgacggtgtggtgaagcaagggaaatttgtgatgagcatcgagacgatgtatctcgataagcgaaacggagttgatcacttttgcacattcctgcgcacttttggcatttgtttcttgatgtgccattgaatgtgtttatttgttgcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaactgcccaagagtatgattgtgttctgccggttccacggcttgggtttgtcacggaaaattttcttaataattttttttaaaatagctcaaggcgcgatgagcacctggatgcctgtgttcttatggaatccgtgggctcaggccatcggctctacattttcgagtttgaggattgcatccaggtatttttaaaatatgaggtcaattaattaaataaataaataaaacacacccccacaggtgaaaggacacatcgaaaacgaagacggaacaagtacacgcgtgatgattgagcactatgataaatacaatgggttatgtggatttgaatcgtttttggcgtcatgtgcttttaccttttttggattttttgttcccgtttcctatgaagatgatgattgatttaattttaaaataatttttattgtatattgtgtttcacaaattcataaacaaattcatccgaattacttgtccttttcaaaaattgcataataaactcataatcaaatcctaaagacataaaataaataaaaactaaaacataatggccacaaacattagagaaaatcgattgaaattttcttcgattaaaataaattttccgaaaattatttgccaaatattttttgatcagatcgtttggcatctcgccataggagtcaaaaaagtaggccacccccggcgaacgcgcccatattgcgcaccaatgggttcccggcattcccgacgggtcctgaagtggcaaaatttatttaatgtattttttggcactcaccaaattgacaattagactgcagggaaatttcgtgcactttggcaatcggtcggccggaaatgtgccaacaaaatattttctcgtcgcccggttctcaaagagagctctgtcgatgaaccgattgtccattcctgcgacgaatccgcctctcctcaaaaacaggtaaaatcccgcagctgcagtacctgctgcaccaaacaggtagatgaggcagagaaaaaagttgattggcgacttctcgatcacatccggaaaacacagtacaatcccttcgtgtgcagcattggaggagggcatttgaacaaaatcggaggaataattctcaccattcatactgtaaggtcactagtgattgatctgttccggtcaatcagaatgagcccgtcagcctcggcataggctattaaagtgaccccctcgttcggaaccgctacggcaaaccgaatgttcaccgctgtacagccctccttgatcagctcaaagcccggcgagtcctcctgcgcattggtcatttggaagacatagaggcagtaggcagtcttgaacatgctgtagctgatcccgttgctctccgttgtacacgccatgccaaggtgctcctgggcatcatgatacgcccttgcgtacctgttgttctcgtagtccaggttgtacgggtactggggatatgtcctgtcagaggccgtaagctcaatgtcccgcacctgaataatctgattcacaagcagttgccatttgccactcacgttgtggtgattaaaatagaagggattcttctgattatggccaatgtaattctgattggacaccagtccaatgacaactcttcgtggcacctcctccgtgaataggttggcagagaagtcatagcgaccaccagtgacaaagagcgatttcatgaacgacttccggataccgtatctggcgggttcagtgtccaacttcctggcaatgtcaagactcagcccgttcatcaaatcgacagtcttcacgatcagcctacagtcgacaatttcaagcgtgtacttgtccttattcgcatcgtcctggtggaccataaagtcgtccgactgcagtgcgagctcaatgtcaatctcgacgttgctgatcatgtacaagtcctggttgaatatgtcggcactcagcttgcttatcgtttggaagctcttgctctcctccaccgcttttttccgtttttcgttcacttttgtcgaatcactgtctcgaaaatagcccgccacgccaaagtaggcatcctttgccgccgcagggtaactgagctcggtgtccaggtacaccttgtagctgtacagctgattggagtcgtacacctcacgctggtttatgtgcaccttcagattgcggatgaaagttgcaccgggcatttgtataaggccaacagccacgttggctgatacgtcaactaccactccgtcttctgcgattttcttgagcttgaattccgtgcacacaaacactttgctgaggtctatgtagctggtgatcggatgaatctgaacaaacactgataagagttatacattgcccaatatttgccttaaaatggaaaggccttgagctgatcgggttcagcgtggaaggtcggagctccctcaaagtacgaaatgcttccaccctgctgatgataattctccaaccgcaagttcgacccgttgaatataactcggaccattgtatcagaaagttacgacttttttaaactgaagagtcagcacaattggccaaattcaaaaggcacctctcttaaaccaaaaaaaaaaaaagtatggaaaatattttgaaaatcacaacactaccgtcctgtgagcgtacgaatctcaacgtccagtacgtccacctctctagccacaattttgtggaacaacggtgactgaaagtctttctcgaccacactgcccgacgtaccctcgaccgcaatcacttggaggagattggcgaaggagttgccaaaaatcatgctctcgattattccgctgtttaagtagatgcacaggtgactgacaccaccggccaagtcaacagcgtacttggcttggtcttcgttatgaatttcttgctgctgttcgtagcccaacacgtaggccagctgatccgtcaaagtgatgtgtgatattttgtcgctgaaaatccttagcgtaaaacgtccaagctcgtccgcgaaatagaatcgaaatcccttgaccagctctatcagctcattcttctcctctcttgtctttagctcataattttcgtcgaaaacttcgcgctcaaagatttcccagaattctgcgatgttttgttgaatgtttgctgatgggttaaactccggcgagtcccatggaagttccggatgtcgcacaatgtacttgtgcacagcattcacaaagtgataatcatccttctcgtgcagataatgaacgtcgggggtcgggtccttgccgtggaccagtcgcatgtagccaccacgccacggcttcagctcttttagcagctccaactctcgttgcttcaatttggccaaacgatcctcctctgcctccatggcgagttgttcgtcttctttttccttcttctctctagccaagcgttcatcttcctttttcacattggccaatcgttcctcctccgccttctccttggcgagtcgttctacttcctccgttgccaaccgctccttttctgtcttcttctctttggctaatcgttcagcctcagatttctttgccttctcttgctctttttcttgctgcttttgctgctgttctccctgctgctttctctgctgctcttctcgttgttttctctgctgttcttctcgttgctttctctgctgctctcgctgctttctctgctgctgctcttctcgctgctgtcgccttttatcttcctcctctctctcttttttgtctcgctcatgcttcaagcgaagttgatcaagttttgtgcgatttttcaacggatttaatggtgcttcttcaggctcttcctcctaaacgacttccatgtcaagaagttctccctcatccgggtactgtattgacctttttcgggtcacgagtcgttccatttccgcgatcatgccatggtgcattccccgttcgagctgctgaggcgtaaggaagctaccccttggcactctgaaccggaacttgcgaccatcgcgcaggtgaatcactgcgtattgtctctctagagtccctacagtcgcccaactaaactgtacattggcaataagaactgcgcaagacaacacacctgttgggatatattatgccagacatgcccaccatccatcctggcccatcgaacaccaatttcttttgcaagtgcactttgaatttattcgttttattgccgacaaagcccggcgtattgcttggcaaaattacaaagaaagagttgctcatttcaacgaaaaatcaatgaatgaatgatcagagatcacttttccatctaaaataggtgttccgtcctccgttcttctgtccagatggtccgtcatctttcttttggtgtttcatgatcaggtaggtgcagtcaaagttcaacttggcacagtcttggcagaatgtttgggtgaactccagcttctcttggccactgccagtgttgaggatgaagcgcttgtcgcctcgcttgaagttttcgttacggcattcgttgcacataaaggtgaacaccccatactgcaacggaagaagaacattgtagtgctgccaccagagcaaacattacctttggacgtgcgagcttccagaaaattgttgggtagtcgaagaccttggctgctttgcgttcgtcgacatctgcgacttcaacctctgcggggttggacttctttgcgttgttcacgtcctccagcagtttttcccagcgagactttcggcccctcttcttgagcacagggcgttcctctgcgtgagatgactgagagtcaaccaacttgacgtcatcatcactatctgaaacatgaaaaaaatgagaaaaaatccaaaatttttgtaaaatttgtgaaaaattttacccattttatgttttctttggttgttttgtgcttcttccacgtggttcgcttctataaaatgcttatattttgtgttttattttaaaatttactctggatttcgtccaaaaactgctcattctgcttacgaggagccattttcgaggaatattttttgtgtgttaagatgaaaatgagaaggaaaagtgtgggggtactgtatgtgacgtgacggagagggcggggggtgtcacgtgggaataggccactcccactcaactgagagcacgcagggacctccagacgggaggatttcgaaatccatccacagtatgccctcctatgccacgccccttatcattcacttccctgtcagtcatttagatgcacccactgacaacagccttatccaagctgctgaactgtaaagctgagaatttggccgagtacctgaataacccagaagctgttaacaaggcgagtgcatacctgcgaggaaagaagctcaagacaacctactcgaacaagggcggcactacaaaggaggtcgagtttggcaacttctcgctaaagtctgcttcggagacgtacgccgtcgagggattccttggcaagtgtcctttctgcaaacattccctcactttggaaagttcagaggtcaaagtacaccagtacttctacataaagcaccggatccttctgctgtacccccagctgaagtgcatcgttgagtaccacagcaaaggtcattgcaagtactatccgttgggtaagccttcgctgcgatgatgcccataatctcgcacggtttcagagttgttggccatagaggacagtgcagagataacaggcgaaaagccaacagacaccaactacttggactacctgggcttccgaagtgtttggcagccaacccccgtctattgaagcgagatgaagcgttcgagaccgtcgcaggagttccccgagattgagttcaacgtaaacacgatgggtgttacggtgtacagccctagacatctgaagacccctcggtttgtgccatgggatcagccgggtcggtgtacacgctgcaagagtgggaacgtggagctggactacatcatccagccagagggagtgaccatcttctcttcacggctcaaggatgacggagagaactttctgccatttgatgagatcggtaagggtttggactattgcgaaaaagtaatcagcagcttaagtggactttggcgacaatgccaagtttcgcgtccggtcacggaacaaaatgttcaccctgccactgaaacacccggaagtttaccaagctgcacaagtcgcagcggaagcgaatgaactgctggcagaagttccaccaatggctgacaacaatgatgatgatgataatgttgacccaaagtgataactcagtgtgttgataagccattttgttatcattcgtgatggattacccgagaataaatgagcatgaactcaaatttcccattccctccgggattgttgtcagcgggccctcctcttcgggtaagacgcagttggtccttcgcctgttggcacacgccaacgagatgtttgatccctcgccgaaggtgataggtaagccctctttgccatggtgtaatgggcgtcccattgggttaagtttgggcttacggtgagtactcctcgcagatccccgagctcgagaggcagggcgttgtcccgcacgctggtcctccctccgaagaaatgctgaaaaagttgccaaaacccttccttattgtctacgatgacctcatgggcgacattgatgcgaagaagttggccgatctgtacaccaagaagtcccaccacaacaacttttcggtgatattcctcacccaaaacctgttcgacaaggcgatgagagtgccaaggtccaatgcgcagtacatctttctgatgcgtgcgcccagcgatatgttgagcattcgtaatttggccagccaaatgtttcctcgcgagcaagggtttctgatggacgcgtataagcaggcgtgtgccgatccgtacgggtatctgttggtgaccctacacgcaaacacagacaacctcttacgactgaggacaaacattttcccagacgacaaagaaaagattgtctttgtacccaaaaatggttaagaagcaaatggtcggacagcgggtgttggacaactacgagtatctgaagtcccttgggaggacgacatctcacaagaagaggcgtcatttgttgagcagtgcaggttgtgaagagctgctgaccctggtggtgatttgcttaaacctacttaacg

SEQ ID NO: 4568 - DNA, 748 bp, Heterodera glycines
ttacacttttttattagtttgttttaaaccaatgatgaatatttagtttttgcatttattattacgttttttttaaatttaaaatgatcagaaagcacccgaattttgaagcttagaatttttggccttgaggaaaattgaatttccggtcttaacactcaattttcaaggttgttcgaaagtcaaatctatgctgctattcattcaatttttttgtcagagtcaaattaataatttaattttttgttttttttaattttatatatatcaacatgatcattttatacatttttatcaaatatatccattttcgctttcgttttttattaaattgttaatgattttttttttaaataatttttgcccatttccgaccaaataaatttttctggaaagttattataaaagctatatttgattttagggtaaaatcaacagagaaaagtggacaaatcattacattttttaatactatgaaaaaaagcagaaaattccgagcaaaataaaaaatgaatgggatgattcaccatttttatggcatttggaaaaaagagagaccattgaattaattaaaaagcatcattttgtgcgctgtgttagtgtttttgcttttcccccactgtttattatacaacgaaaaatcattttggatttttagaagcttttggatatttttccgcaaaaaatttaattgtcaattaacggattttaggattatgtgccagacttggaacctcggcgggggggg

SEQ ID NO: 4569 - DNA, 1845 bp, Heterodera glycines
tgttaaaaaaactttctattcgtaacttgattaaatttactatgcttttaaattagatggttgcaatttatagacaattaaaaataattttattttttaaatccttaatttagtgcccaaacttcccggtgcccaaatttctggtgcccaaacttcctggtgcccaaacttcctggtgcccaaacttcccggtgcccaaacttccgccccccattttgactaccctttaacatgtttttgacagccctagtttaatgcctttatttggactttaaaaaaattaattttttaatcaattaaaaaacaatgttttaaccaattgatttcattaataaaaagtaaaaagttatgttgttttttaatgttttcaaattaaaatgcattaaattactgcttttcagttacctacatcaggtcgttgtgagcccagcatggaatgagccgcaatatttcatggcaggatgtctaatggacaattgcacaacaatttaccaaaagaagggtgtcaacgtggtgatcactcgcttcagttggaatgatcacgattacctcggattccgtttgccacatctgcatgaagccattaaacggaaccgtgatcaaatttttgcagaaatgaggtgaatttttgtttcttctttttcagttaaaattatgggaacaaaaaattctgaacttttaaaaatattatttgaacattttcgaaagcattttcaacaaaagcatgtggaaaaagaggttaggtaggcgtttggttcatgaaaatgatcaccgattttgtgtcaaattttgaagaaacgtgaattttaaattggtcggtgacaaaagcctgggggaaattttaaaatttgagtccaacttatttctaagtcttcaaagttaagtaaaatgcactcaaaaattatttttagaccaaaataaaatttcactcgagctcattacttttatttaaaattgtttacagtaaaaaattcaaattgaatgggggcactgccgatttacgttcaattatggcacttaatttgcgaagcacatttaccgaaacagtttatagcaaagatatgtggcaaaattttgttttggttcacaacaggaagtttttcaacttggtaagtaaaattggagaaaaataaataattttttttaaatataacttaattttcttatttaccgcattttctaaaacattaaattaataatttttgatacaaattgtcaataaaaaaaagcttaaaatccaacatttaaaaataataattttcccattcctaaggcgtgtacgattccgcttggcattgctggcgttgagctgcaaggactgcatgcatacgacaatcaaacggaattgttcaattcgcaatttttcaccgttgcgaaccgttacaagttgattttgatgctttaaaatgattaaatgtttttggcatgcaaaatgtaacattgcttctgtcctacaaaaatccaatgttgaagtgataaataaattgccttactgtctaaaagtcaaatttaggctgctaattcattcaagtttaggtattttattttttacttttcaaataatgataatgttttaaaaaatactccaaagaatcaaaaagcggtcaactttaagttttgctcaattttgttttgtttccaatgtttgctgtgtttttcaagtgactttatctttaatcctatgttttcttttgaagtaccaccgaactcagtcacttaaaaatgtaatttttatttattttctcttagaaaaatacaaattttgtggttatctttatacaataaatttagaataaattcacaaaataaaaataattaaaattcaattatttaatttaaaaaaaa

SEQ ID NO: 4570 - DNA, 3004 bp, Heterodera glycines
aatgacgacgacaggtggcacattcgtcatttttatatgcattcattcgatcattagtcatgatcagcagaaaacacagtgattggaatagtttaattgatttagttacaaattaggtaaaacaacaaaattggttattttttacccggaaaagtgaatattggaaattcagggcttgtctcagagcacgctctttttttttgcaaaagattgccatgtgcaattaatctgtgactgatgtttaaatggcatttatctttaacctaccaatacattatgtaagactgatttctttacaattgtctcatcttaatataagcactggcttaagaaactgagaatagtcattgattggacacgtaaaaatcgattagatgcttcaattgcagtagagccatctttgtactacttaatatatccccatcccatccataggagttcttgctaattcctgaaaattccccaaaaccaaaagtttgctgtgccctgatggtccccctacacacggcctttagttttgtccttgaaaaccatttttttaaactttttcccattcattttttacgatttataaattttcctgccctaaaatggtagttgaaatgtcttccggtgctgcaacaactgcttctgccgctgctgttgctggaactgctccgtccgctggccctgtgccctcatgcatttgctcgtccacctcgcagctgttgacagcggccggcatggacggcattccgccggccaaaacgcccgcaaattcgggcccggacgcaaattttcttgccgattcgttgggcgtctcaccgctataccgccaagaagatactaaagtattaacaggggatggttgactaaaatccataaaaatggatgcattttttgcttgattacccaccaaataaagaattttaaatgttgaaaaacggaaaaaaaattttagcgatggcaaaccgccgccaaagtgtaccagtcaagccgtagtcaaatgcacagtccaacctccggcacttgtgcaccgcagcactttcattttggcgaatcgctgacggcggagggccatttgacgcaaaaaattcgccaatgccgaagcagcgggcaagtagtttcatccaattttttatggcatttttatgttcagtttttatgacattttgtgccttttatctcacaaaatttgggattttttttataaaattacaaaaataatccttcatattataagcaatcaattccatactttgtttatttattttgaaaatcacctttcaatcgaaatttttctgttttattgcactttgagtccaaaaaacgcatttataataatccagcaaagtccctgttcaaaaaaaaaagttcatgccgaacttactaataatcatgcaaacttagaacccgtccctttatctgaattttacaatacatctttataacaaaaacagggtttttctcctcttccagttcccccatttcgttggaggacattgccgcggtgaaccgccaattccatcggcaaatggacagcggacagcgccggcgggtgaacggcccggcgctgaacggctcgctggagttggaggcaattgcggcggtgcatgaactcgcctcacaggttttaattagtttagagagcatagttccatgttggatttgatgtcatggcaattcatacaaaagaatttcgtgcaatttttttaatttttcagttaaaacagtcaaaaaatcagaataagaaaaagttgaataaacttgaaaacgttagaaaaaatttttttttttttttttttgtatttctgttgaaaaaattcatttgggttttttgagaaaaaaaactgggtttcacttgataatttaaaaaaaaacttctttattttgatgtacggcggtcaaatattttaccatgttcacccatccactaattttgaatgttaaatgaaaaatggtgtatttatttcttgatgttagcctcgcagttgggtgattcatttaattgatgatgcccgagttggtaaaacgattgttcatttcttccaatttttgcatgggttcaattcccattggcgccgcgaggcattttctcccattcctcagtgggcaagagattgtgaatgacgcgatttaattgatcgttggctcgcaaactctaatcagacacagagggcaaagtgatcagtggttcatgttgatctcccattgtacccgcttcaccatcgggcattgggttttgcaatggactaacaatttagtttaatttcattttataaaaaatgctttttatttattttagtgtgtgtgtgtgtgtgggattttaggcgctaatttgacatattatgctgaaaatttattgaatgcaaatacgtttttatgcgaaaaattatttttgaaaaaaaaacatttctcattccgtcttccagaaataagaatttatttggtacttatccttttttaccccctcttgaaaaaaaatttacttctaaatgggaaaattttattcgctttggtcagatttttgcaaatttgactccaagttaatgcgcattagtcaatctttcgtcatgattttttttttatatatataattttttccgcacactttttaaaggtcaaacaaatttctgtctctgaaattctgccccgcacttccgacctgatcttcctgaacatcaaaacgtacgaaggtatggggtaggcaggcgtaaaaaaagttacaaatttttttttgagaaagttattttgcttatgttagaccatccttacactttggaattgaccatgaaaggatggcgcgtttgttccacgcacaccgattgtatgaatggtaagttttgcaatttattattggcaaaaaaaaatttaaattttcaaagttttcaggcgattatcacaacgtggcactgcacacgcgctattttcagaacgcaaaggaattgcttaaggtgaaaacaaaaatttctcacttttttagtgtgggttttttaggtttttagtagagcccggacgggaccgg

SEQ ID NO: 4571 - DNA, 3162 bp, Heterodera glycines
ggtccattttccaagtcccgatcccggtcccggccatttcaaaattacgggctctagtttttagattttaaaaattttgaaatttttttagcataaaatttgggttcagcatttccctctctccgtattttctttaaatttctgacatagaaatttttcacaaaaaaaccctaagaaaattttttaaccggttttatggtttgaaaaattatactgtaattttttggaaaatttctttaaaaatagaaaaattgctaaaaaatttctttatttccttaaaaaatattaatttttcatttgcatctatattgttaatactatataatccaaaaaattttcaataacagatggtttcgcctgaccacgacaagcacttcaccgactgtttggcgcaacgtttgagccaattgcagcggacggcgtcgcctccggcgcatgccaacaaagcaagaaatgttggcacaatttttttaattactcgttttttgtaatttttaaatatgaaatatgagctttgaaaattgttttgcatctcaataaaatttcacaagttccattcatccgttttttttttggataattccattttttattgtttttgtttaatgcggaatatgaatacggaacggagaaaagaattatgtgcaaaaaaaatgccgcaacccagtggaaaaataaaaaatttacacgatgaaaaaacggaattttcttacccccccccccccctcactccctcaaccaatgaatttgttttatcctgtgaaattttcataattcaaaataaaatttcttgattaaaaatgtaccgaaaaatttgctgacttttccctaatttcagttgatccatgcaactggttgctgatctgatcagtgaatgtgttgatcaaaagaatcgttcttggcaatgtgaacaaaatcacacaccccacccacgtccattctcacaacaattaatttttacccaattttgggtgttggcttatattacctaattacacaagtcaaattatggcaattttggggagaaagggaaatttgttttcccatttttaaatagtcataataatgcttaattgacacctgtgcaacccaattgttcaatttattgctaattttggatgtgagcagccccatttccatcatgacaaacaacaaaaaatactggcaaatttttcaaattttattttcggcaaaaaaatttcaaatgaatcgtcaggaggcgggcgcttcaattttttttcgaaaaaattattagaaaaatttttcttggtaggcctgcacatatcacaagctaacatagtaaaaagtaaaatactgtttttttttaaattactgattcgacctcctcattttgatctacctgaaattttgatcaagaccgggccaaaaaatggattcaataaaaaattcagcatttttgtgattctctaattttttcttgaaatttataaaaaatgtttcccatgtggttgatgggtcagctattttacgctcacaatttgctggtcttgatcaatgaaagcacaacacacaatggccttaatcgacttctatttggtgctaggcatgtacatacattattattattatattactctatagtgatggtcgagaccgaaatcctttttttcgagactcaaaaaaaaatcccgacaatttacttgaaaactgagattcgactcttgagcagcattactacatataccatgtgccaagacatttgcgcctcggattatgtgcgccacagacttttgcgcctatggtttaaaatcggtttcaaaaattaattttgtccattttaaatataaaattaataaatttaaaccgcgttatatgtacatagacacaaaaatacaggacgcaaaaatgtcatatataaatctactataagaacccaatttgtcactctctcgtccccctttttatccactttgtgaattcgaattttgcatagtttcaggaattctattcattatttgtgtggcattcgtgcatttatcgataaagctttttcttcagtttaattttgtaaaaaatcattttgggtttcgcaaatcgctttttaattattttttaaaattaattatcctttcattcaatttttaaatttgcccatttaattagcgccaaatgtttgttgcacgttcccagtgttgtgcgcctgttacaaacagtctaaagattagtcgctcttttgcggtcccttggaggcaatttttcgacaaattaaaagcggacagaatcaatgcgcaagtggtgagaaattagggggtggcggatggataaaatttcaacaatttatttgggaagtcgataatgcactttttaattttgcgggccaataatttatagggtctcaaaaattgtccgattgtgtcacattttcaaaatctttcgacatggttgtggtggtggtgggaccctaaaaatctccaaaaaaatggggggtccgtttcgttacattaaaaaaatcccaaaaaatgagtaattccattttgaatttttgcagaagcataagccgttggacgatgaccacaagcggtacgcggatgacgaatggcattggatgccgacgggcgaaagcgacattcaaaaccaagcaaccgtcacatttctctcgcgcacattgaagaaagagaaattggtgcgttaagaaaaatttaaaaaatttttgttaggtagcttatgagggaggaaataataggtgatcgtcgttccaccctggtggattaaaacaggactccaccgacccggtttttgggatatttgaataaattccttaaatttaactcaaaatttcattatatcatttaatagtcagacctaaaagtttaagtgtcttcactgttcacatgctaaacttcaaaaaaaaattttgtttaatttcaataagtacgacaaaaaacgatcgaaaaggcaaaatttttaagcataaatttttagaaacttgtgaaaacgggaatttttgaaggtaaatagagaacaattttggctatcgattgttaccaaagaaaattacgaaagaaattttgcattttaaaaccgggccggtaaaaaaaatttttttttttttagaatttgagacaatcaaaattattataaatgcaatgtatctatataagtatgtaattatatgagacatatcttttattccatttccca

SEQ ID NO: 4572 - DNA, 1546 bp, Heterodera glycines
ttaatacaaaaaactaccaatatttagcgaaaattccctttttgtgatcagtgggaaacgaattctggacagtgccggaccaagcacggcacgacgattttcagcggaacattcaatgagcatttgagcacagcgatcgtcggcccaacgaatggcctgaaaaaacaaatgaaattagttatttttaatcgaataattaattaattagtacagcattccaaatgatgagttcgtcggcgattttcaattggtcacgttcgataatttcgcacaacaaattttgatcaatttgcaaaaattcctcagattcaaataaagttttggcattttggtcaatgtaatccaagcagcgacgagagaaatccttaaaataaaacaattaaaaatattttgtataaatttcgatttgtacattttcgttgagaagacgagcttcgtcaaaggcaaggaaaacatttgacaattcattaattggaaacgccaataaggctttgaccagcagagaaacgttatatttattggctaaaaatgtttaaatataattatttatttattttttaaatttttcacctgcgtaaagcactgccatggcattttgtccgttcaattcgcttaaatcttccgcgtaaatgaagctcaacatcactttgaacgcttctgcttcaacatcggtcacttcaattacgtgaggacagtcggcagaggctaaaaaatgatgaaaaaaaaacatttttaaaaaatatttcgattttttttactttttgtctttgcgtttttatcatcaaaacggaacatcgacccaaacacatcagaagcgaacatcatcacgcatttgtgtgctttcaaaagctaaaaaaactcggaatagaaatggaacttgttcaaaaattaaaaaaaatgaggataaagattcaattaaattataaacatttccctggcggcgaagcaccgtctgaccctcattttactaaaatttgaccagaaaatggcaaaaaatttggttttttttttggaaaaaaacgaatacaaatccctgcttttcctccgtgcgctgaaaattttagaacggaaccttggattaatcaacttttgtgggttcaactcacctccttttctttcccaaccaaaaagtgaacgtccgccccatcgcccgtgctcaacatcagcttaaatcggcccagcaaattgctcgacattgtaatttttaagaaaaaatggcaataaagattgctgaatatggaaattataataataaaagaggtaataatctcttttcttccaaaaaagaaaggaattggtaatggaaaaactaaaatttaacattttaacttcgatttacagaggtcgatttggattttaatgacgtaaaatgtgaattaaaagggcttaatgatctgattacacttttgctcctaaacacaacaaatcacggctcttcacaccacaatgacggcaagcaggactgggcgagcagttggcgtgcccgtgcctcgggcactccgggcgccgccgtcgccgagtttgcagcggccatcggtgccgtgcc

SEQ ID NO: 4573 - DNA, 2676 bp, Heterodera glycines
tatggaaaatattgatatagaaatccttcctagaagctttaaaccaagctaaaaacatgtttttcgtgcgtttcaggcctccaatagtccaggaaaaaaatatggatttccatataattaccagccctactcattttactaaaatttgaccagaaaatggcaaaaaatttggtatttttttggcaaaaacgaatacaaatccctgcttttcctccgtgcgctgaaaattttagaacggaaccttggattaatcaacttttgtgggttcaactcacctccttttctttcccaaccaaaaagtgaacgtccgccccatcgcccgtgctcaacatcagcttaaaccgacccagcaaattgctcgacattgaaatttttaagaaaaaatggcaataaagattgctgaatatggaaattataataataaaagaggtaataatctcttttcttccaaaaagaaaggaattggtaatggaaaaactaaaatttaacattttaacttcgatttacagaggtcgatttggattttaatgacgtaaaatgtgaattaaaagggcttaatgatctgattacacttttgctcctaaacacaacaaatcacggctcttcacaccacaatgacggcaagcaggactgggcgagcagttggcgtgcccgtgcctcgggcactcccggcgccgccgtcgccgagtttgcagcggccatcggtgccgtgccgtacaataggccggcgccaggtgtgagcgcccgttggtgctgatggtgcagaaacaaaggcgtggtggcgccaccgacggaagaggaggaggacaaatgttgctggtggtggtgttggagttgcgcaaaagttctactatatataaattgtatatcgttgatacacctacatcgtgttattgcggtttcatggcaaaacttataaaaaaaaaactccgatcagaatgtcataattctcgatttaaagcttcggcaacaattctgaccacgttaatgccattatttttgtactatgccaaatttgtttaaaaaatcaataagcagccccacctgctgttggtgttattagtaaggttgttgttgtcgttgctgaatttgttgttggaccaacaatagctggtgttgttgttcatcaaaatgccaccaccaccaccaccaccgattgccggcacattcgaatgcggcatttgttgttgatgaactacaacagtagcagcagcaaccgatgaagaggaggcggaaggcactgaagaagaaataacagcggtggaggaggagggcacttgttgatgagtggccaacaaaaccatgccgggctgtgatttttttgtaatgattagagctgggatgccgttaatttacgaaaatgggatttgccactatttggagggcgttagcctgcaactgattctgttccaatttcgggcacgtttaaatccacacctgccgctgttgctgccgaacagatgctgcttgatgttgttgttgcaccagcgacgattgttgctgcacgtgtcgatgttgatggttgtgctgttgcggtgtttgttgttgcttgacgaagttgctgaacgctgactgttccgaccgggttatgatactgacagccgatgcaccgccggcagttgtggtgccggcacagctcgccgttgttcgccgatgcaactgtgccaatgcgacaaacgcaattttggcatcgcgttcaatgtgccattgttgttggggaagtgcgtccgtttctcgctcctcctcactttcgtctaccgaatgttgttgaccggagttctgatggtcgttccgatgatgtgtgagcattaatttcttggttctaaaataaatgctgatcggtaatttagcgtttcaagtcgagaaattcgtttgggactcgataattcagtcgcgatcacgttcataaatatcagaaccatatcacatggtcggttgatcatcgccagtttttttcttccacttaatattcccgatcaagagttgtcagaagagcaaatttcaatttaactgctgatcggaagtgatccgataaatctgatcacttatgccaatcacccgcttttgacacctgaacgtcagtgaacaagacgcgtccgcgcacggaaacggcgcctcgccagtatgcgcacgcatgtgcagctttaacgcagagcgggacaaaaagcatttgttgcacgcgctgcactgaaattgggacgcgtccacctcctggtgcgtacgccggtggtccgccagcgtcgtgcgcagacggaagcggcgtccgcacgtgtcgcaggcgaacggacgctcatctgctgggcgcaacacgcaaatttatattaaaaaaaaaactgaaaaggttccaacttttttggccacaaatttgttcaaaattgacgaattttttggaattttgcaggctattagagtatctgaagagctctcgaatgataccaagattgttagatttggttgacaatgaaaaaagttatagtccaaaaacatgctggggcccaaacctgcctgggcccaactgaggtagaccgaagaacccacggcccttaaaagcgtggaagggctcacctactgagatacggggattccttaatttttccaagccctttgaccagaacggagtggccgttgccaaatttgggcgatttttatccaattccgagactaccgacccgtatg

SEQ ID NO: 4574 - DNA, 4381 bp, Heterodera glycines
  misc_feature (4373)..(4373): n is a, c, g, or t
cacaaatttgttcaaattgacgaattttttggaattctgtaggctattagagtatctgaagagctctcgaatgataccaagattgttagatttggttgacaatgaaaaaagttatagtccaaaaacatgctggggcccaaacctgcctgggcccaactgaggtagaccgacacaaagtgctgaaaaaagcaacccgtcctttgggactcgaacccacggcccttaaaagcgtggaagggctcaccgactgagatacggggattccttaatttttccatgccctttgaccagaacggagtggccgttgccaaatttgggcgatttttatccaattccgagactaccgacccgtatgggtgcgcatgtgccgtctcaagtcccatgcccgcttaaacggacgcgtgcaatgcacgcaatgggacaatgtctcagtcctccgtttggcgtgccgcaccgttgcagaaacagcagcagaagtggacgccgccatcgcatcagcattagataaagcagcaagcagttgtccatcgcttaatctgggcatttattacgtattttgatgatgtcattaaaaaaaattaattatgtcataatttctgtggagttgttttatagccgtgaaaaaaattggggtgggaaatggagtagtgagtcgtttcgtccaaatgcccgggcctctttgtgagattgtccaaggctcttaaccgatgcatcaatccaccatttagcgggtgcttggaccaaatcatttagtttttatgaaaatttactccacagaagagagggtgttgcaccccgagaatttttataatttcctctccgatcgccgacttaggacgcaaaaaaaaaatcatttttaagcactccaaaaataggtttaaactttgaaccaaggacaaatgccatcaattatttgggaatgaattccctttggacaaggagaaaattttattttctcattttgtgcctttgtgaagagatgacgtcatcctccgcgtgtgccatgtcaatgtgttcggcaaatgcttgcgcaccggcggcaccaaatgaaccagcaaattgttgttgttgttgttgcggtggagcggacgagcgcgacgggggcggcacgctgcacaacggacagacgaacgcatgcgtggcatgggacgacgacgaggcggacactgtcacaacaatttacatggtagccaggattcggaactacattttatgcattgggagcagaattccattttcaaaatttgggcgtcggaattaggctcccggacaatccgtcagtaaatttatataaaaaaatgatcccgcttgggggaaaatatacaaggcttttttagactcccgtaattatgaggttacggatttccgtaaccaataaacactccgtaattatgagccacgaagttgcgtaattaaaatccaattacgtccaatcccaatcggaattcgtcaagacttttggggatcacaacacaaacgcattacaaaatgcttgctcacccatgttgcgcaaatgatcacggagaagcccaatgcagtcaaaggtgaacaagcagcagtcacaacggaatgccatcgccacaaaatttttgaatgttttttgagtgatcactgatcagaagacaatgacttaattggcaattaattaatgactcatttttgatcataaatcaattcgcaagaaaatatgccggggagagaaggcattctgagaacaaagaacagacagtttaaatattatttattaaaataaaatacataaaataattagtttaaattaatacaccgaaactcatttaaacaattcggaaattggcagtgccgtcgaattggctagcaaattttgtaggttaccgaaaaagggatctttgatactgtgagctttcattatagagacatcacgttacagtaccccattttgattacaaacgatacagtatcaaatagaacaaatttcttttgagccaacttaggcttaaagtttaaaacttgagcgccaacaatcggtaaaaataaaatttaaaaaaccaacaaattcaacaacagaaaaaacaacattgacaaagcataaaaataggaaaaagggtcatttttggcaagtgtttggtgagatcaccgggcgcagatgtttttcttctcctccgcctccttctccaccagggacaaattgcctaatttcagataagcgacgggacaaatggcgtcatttggtgcgctattgaaatggacctattggaaatttttttaaatttaattttctgacccaaaaaatgaaatgttccaatcggtaccatttccccccccccacgccgatttttttttaaactcccaaataaattttaaaaactggcaccacacactcacctccgtcgtcgcctcgtccatggcaatgcgtcgccgcttgaacatcggacagtcgagcacaaatgtttcatactcaccgccctcgccgcatacgtgcagcccgtacttggcatgcatggccaccaaatgggcacgcatctgatcaatgcgaggaaaaacaaaaaatatatattagaaaattaaagaaatttttagaattaatgcatcacgagagtctcgactcgtgctctgccaagattatttagttttattaagcattaattaattttgatgttggatttgaatttgggacctccaaaacatcaagtttgctcattacacagtcaaagttccaattttcgaagccctcagaaataacaaattcacactaaataaatgtaaaatttgtaaaaaaaaacggttaaaaatttcgcgaatcttcaaagaaaaatcgtcgtattcaaccggccgctgctgtcattgtcattttctcacctgttcaagcgaatggcccaagtgtttgggggtcagcccaagtgcggcaactttgatcagcacggccttcacaccagcggaaatctgcgaggacggcacaaaattttttagcaattatttgaaatttaagaaaaaaaaattttttttttttaatttttgaataaactattactagtaaaacatgtaagaattcaaatttttcaggtgggagagggcaaactgttccccctcttcaattgccattgaattcttctcaaacaataagaaaaagagaagctacgaagaatggacgaacatttgcggattttggtattcaaacagggaaagtaaaaagggctactattttttttttttttttgaaaagcgtggattttttcttaatctcacagaaaactgtaagaaaaaacaattagaaaaaggaaaacacgaaaaattttaaactaaaaaattttctgtggcattttttcacatcgcatcaaaaagagcagcatttttcaatgctttttggatcaacattctcgagtttgaaaaatgtttttgtgtaatttttcataaatcccaaagaacagtaaaaccggaaaaactcaaaattttcatttgtcattttgtgcagcaccattcactgaccatggcgtccaacagttggagttggtccaattcccacaggaagcacagcgggacgagtccaagccgttcgcacacatgttcaacacgcaatttttgataagtgctgtttatcgcgcccgcggaaacgcctaaaaacaaaaaattaaatttaaaatccaaaaaataattcatttccaataaatattttaaatttttttagtttttttccgaatgaaattgtaggtttttttaaattttcattttgctatcgttcgtcaaaaaatgccattttttgtaaatttaattatgaaattttatttaagaaaattgagcaaaaattttttgtttgcaaaaagatgtaaaaaatgcacaattaaattaaaaaatcaccccgaatttccgggtcccattctttgaccgtcttcaaaaggtggtacaaatcctccacttcgtcctcctcgtcctgcacataagtgttgctctctacacattttggacgccccgaaattttgcgttggaacagcggcaggccaagggcatccgcgtaaaactgaaaattgcaggaaaacaggcctaggagttttttccaaacaaaggagacctcggaaatgcaaaaaaatgaaatttaaggaaaattaaaaatttgaagccgaaaatttaaaaaaattatggcacctttgttctaatttttggattgcaaatgcattaaaaaaaatttaaattgcattcaatttctttattttaaagcatacatatttagtctcactaaccttgattccctcactgcccacactttggtacatgtaactgtccaactcggcaatctgaaaatttgctaattttggttgtgaaaatattttttagagatttttgtggttgatggatgatccgaatccagcatccatttcgtacatttaaatagattttgngcaaaaaa

SEQ ID NO: 4575 - DNA, 1645 bp, Heterodera glycines
ttctttcaacaagggccgcgtgcaagagatgcgcgcactccaattggacttgaaaagcggtgaaatagcgcagtggcgccccaaatatggcaattacaaattcgaaaaagaaagtggcaatttgttgctttggcaaccaaccgatttgagcacaatgattaacatggacaaccgaacgcatcaataacttattaaattttttctattaaattgttggctgaattattggcattctgttttttcctgatctaactttttttcgaagaaatatgacaaaccgaaattcagcttgtttacccacaaaaactgcaataaataatcaaccaatttaattttgctgttaattttaatttcatttaaatttgtcaccaattttttaaaatctttaattgagcaattttgttaccgatggtgccgtggctctaatttgaatgtgttcatccaccaaagtataggaaaaatctttgcctcaagtgatttggcattttgatcaagcacctatttattattacataatttttactaaatagaagagtataattagcatgagagttgaaaaacttcgaaatcaggattttggacaaaaaatcagattttttgggtaacacttttgcaaaactgtgttatattacaatttatgcaatcaaaaatataccaaatatatttttttcaacctaccattttccttacgaaattttttttttttgctgcgcctttttcagaaaaatttttgggaataggggagtaggctccggcggtgcgataggcgacatcggcaaatatctagtaaatttattcatgatttgttaacagaatttatccgaaaactcaccaaattttgtgatcttgaaccaattgtccaaaaaagtccaaatttcgcaattagtcggcacgggaacttttggctcaaaaatatgtgtaaaaaatggaaaaatcgcgaacgtgccgcgatagcaaataatgaattaattagatgacaattttttgatattgacgaaaacaggaaaataatgagatatttggctaaattggtcgtagaaatgaaagtgaaaatgcgacaattagtttaatgggtggcatgtgaccagtagtgctgttcgagaccaaaaatttcccgagactcgagactcgagaccgagaccgagactcgaccccgagaccgagactcgaccccgagaccgagactcgaccccgagaccgagaccgaaaaccccgagaccgagacccaaaaaacccgagactcgagacttttttcaaaaattttcctattcgcttaaaaatcgttaagaacattttttgactctattcttaactaatttttggtttttttttaaaattttgattcaatttggtacaatatttatcatttcaaaaacgcacaaaacaaaaattcattaaaatttatgtgcaatttgttaattgatttagtccaaaaaatgaaaatattttacgaatttaattgttaaaattatgattgaattcccaccgaaaaatgaataattttgaaaaattagaagaaaaaacatttacttggaggggaactgatcccacgctaaaatgaagaacaataccaagagaacacccacccggacacacctacgagtaaacaaaatgaagcaaaaaattaccaaaaatatattaattt

SEQ ID NO: 4576 - DNA, 5863 bp, Heterodera glycines
gaaatcggtatttttaatttcggattttttaagaccaagaaatttaagactgagcggagaaatggcataaaaaattttacttatcaaagcaaatatggaccagttgtttttggcactgtctactgagcccgttgcagaggaagaagaattagattttgcttatttggaacttaatgaagatcaattttgaatttttcatataatctatgaattttaatgaaaattttggaaattttataaaaattttaaaaaatttctcttggaaaaatttccggttggtcccggtcccggtcgaaaacttggtcccggtccctgattaaaaaataaatatttaaataatgtttcaaaatttattaaaccaaatttattctgataaaattctgtcttgaatttttttacataaaaaagcaaatccgttggcaatttcagtaagcaaaaatattttataaaaaaattaataagttttagatgcattcggttgtccatattcatcaattgtgcccaaatcggtcggttgccaaaacaatgaattgctaattctttctttgaattcgtagtcaccattttggtaccactgcgttctttcaccgcttttcaagtccaagtggagtccgcgcatctcttgcacacggccctttttcaaagaaattcaaaatttaataaaatttttagaaatttgggcctggaaggcacttggagtcctatcaataaaaaacattatgaaggcacaaaattaatggttcgacaatttctgctatttgtgtttcgagttttgatttcggctttatgattcgctgtccattggaataaattataataataaatatgttatatatatatatatatatatatatatatatataatttttttcttctctctaataagaaccaacctgatcagcgtcaagccgctctaactcatattttgctgtgccgcatctataaaaaaaacccatcaaaatctagataaaaatctcatataaaatttattaaatagagaaaagtctccgctgccgatctatataaagctttacaattaattctatcgttcaaatatttttaaatgataaaaataaataaatttacccataatttttatattttgagtgattttcgaatttttagattatgtaattatatcaaaaacaatgtattaattcaaattagggttaagccccgagcctagcaaaatgtcggggaacggggaggaaattccccgaaagaatttgtcggggatgcctggagaaatttaaaaaatgtcggggagcaacacactcgtcggggagtaaattttcataaaaagtctagaaaaacacaaaaagaaaaagttcagaacaaaaaagtcttaaaaattcatttaaagatacttccatcttatttcaagtgcaatttacgactttcgtaattccacgaaacatgtcggggcttaaccctaattcaaatcataaaaaaaccaatgtaagcctttaatcgaatagcttctaaatgcagaaatatcttaaatagaaataaaaaaatttttacaaaaaagttaatccataaataataattatttttatttattctaccaattttctagatatataaaaggtcaaataaacatggttaaataatgacctggtcaaataacatcttttattaccgccctgaccggattttgtctagactttttttgagaatgcacttggaccagcaagataaatccaaaaattttttagtgggttcgtttccttaatccatatatccacataataagatcagaagagactctgctgatccgtcttgatcagatttcaaaaagtgtgtgcattttccaagtccaaacttcggttctttaaaatttcattatttttcaattttattgactcactcgccactcaatgtgattgttatgttctcgaaatcttgtgaagtgtagtaattaattgggtcccagcagtgtcggtttttgaacaccacgggaaaagtgaacggtgaagcgccactcataccgtaaccatcaacggatgctttgatttggatactgtaaaaaataaaaacactattttaacaacaaacagcaacaaatatttttttatacatatttatggtatgccctcccaattttctggttgttcgaaactaaaatccagtaaaattcatctctggcacctaaggaatcttttgatttcttaaaaactttcaaatttatccaacaattcctatttataaaagtcatttaatattcatctatttttggatttttgcaccttactaattcatcctaattatttaaagttttgaatttttccggtttacgtgccttcaaaaaatgattttgattgaacacaatccgtaattaacgacctaaaatcatgaaaatcgttaatcaaaacacaaaacttatggatattaattaaatttctacgatatttgcgtgccatcaatcataattatggattgtcctcaatcaaaatcaattatgcccatccattctgggctggcaactcaacaaatatcataattatgtaaaattaattaaaattcaagatttcccgacttacgtgcccttaaaagctgttcggcgcctttctccccaaaaacatttggacaattgaaaaatctcatcgtaatcaattttcacatttgccgtacagtttttgcttgccccggtgatgcatccgtcaaaaagtgcgagagtgccgaaaatgggaacaaaaatttggcacaaaaataaatattcattaattacggcgttttttcggaggatcttctttagggtttttgtccgggtcatttttatagaaatggacctaaaaattccaaaaataagaaatattttaattagaaatgcgtggggatgaaattttcaatgaaaaatccaaccaaagaatttcaaaaaattagccccccccccccccctaagactgaaagatcctcaattattcatccattaaaatttgagttttagaaacagcgcaaatttcattaccaattttaattaaaaattttctcattatttgtcatttgtaatcgccttctttgtcggtcataaaaaattattttttgatgaaattttaattaaaattcccttttgaaatttttttaaaattttacatattttcgcttatttgggggtaattagtgccaattttgcaatttttctacctaaaaatctcatccctaccaattacagaccatggcacaatgtttcacatggtcataatatttgttaccgcagcttggcatctgtaaaagaaatcaaattaatataaataaaataattttttattatttttacaaatgcaattttttgcaaatccctcagacaaatccgccgacttccattgaatgtgccaaaaacgacgccgaatttctcgttcggcacttgacctttgtactaaaagatggcacagcttaacagttttaccgtatgaaatgcctaccgtacacgcacagtactcttcccccggtgccatgccattgctcgcttttgtccccttataacatgcgtagcacgtgttttctccgctgctcagttcattgtcgtcaaaaagcggcgaattaagccatggcgggcgcaaatggcgcggcacgaaacccttctgtttgaccaccgccgagtgccggcactgctcgtggaacggagtgccatcgatgggacggcacaattcgtcggcgccatcaaagcattaaattatgagaaataatttagaattgaaatttaaatgcttttttaattttattgaccatttgttgggttgtttttggaggtgatggcaaaatgaacgacaattccaatggcaatggcgaatatggcaaaattcggatagaacattttgatgagcaaattttttttactaaattaattatttaaaaaatatgtcattttattttaattttttttttgtttttgcaatggacggacaatccaaaaacatttattttatgttaatgcatttttttgatggttaagcaaatcgaatgtttagcagttaaattatgattcactcttctgctgctgctctctttgtcggtggaccaaattttcgaacatttttaatcataacattttgaaatttaaataatttttttgaaatttggcaggataatagaaaaacattgaggatctatcgaatcatatcgtgaattaaaaatatgtttgctttttagcaaagttataagtaaaatttatttttattaaaatggtttttgaataacgcccatttttggtcagtttttagacaaagtctgtcttataaaaaatgtgaaaattggatgaatggacattgattggcatattcagtaagcaaataaaatcctaaggcccaagatacagcttaaaggaagaaaaattgaattggacactgaaaacggtacaaattccgttccaactaaaataaaacttcctcctatttatgtaagattataaattgattgtttaataattaaaaacttttcaaatgatgataataaatattctagtaaggaaagttataaagatggaaaaatatcaaaataattatattgaacttttgcaattgtgaatcatcaacgacgaagtaaaatagaagattaatgatgattagtacgtttggattaaccatttgctcaggcagtgaaaaggttgtgaaaacggtgaaaaatcattgctaagagtgctctaaaatgagtagatgtctacggatgcttgtaagtgttgtttatgaaatgatcaagtaagtgtatgagtgatcgtgtgactagggacgagtgagtgattaggaacgagtgtgtgatcaaagagagacacagagagatcggtgtgagtgagtgataacagagagtaagtgatcagaaaattaatcagtgtgtgtgtgttaacatgtgagagagagtgatcgggatgagtgtgatcataaagacaatgattagaaggtgatcagagtgagtcaatgtagattagagtatgattaggagtgagaatgcttgatcagagaatgattagagtgatagcgaatgatcagagacgtagagtgattgatcacagagaaagagtgatagcaaatgtgattaagtgagtgctgatcagaaaattaatcagtgtgtgtgttaacatgtgagagagagtgatcgggatgagtgtgatcataaagaaaatgattagaaggtgatcagagtgagtcaatgtagattagagtatgattaggagtgagaatgcttgatcagagaatgattagagtgatagcgaatgatcagagacgtagagtgattgatcacagagataagagtgatagcaaatgtgattaagtgagtgctgatcagaaaattaatcagtgtgtgtgtgtgtgttaacatgtgagagagagtgacgggatgagtgtgatcataaagactgaatgattagaaaatgatcagagtgagtgaatgtagattagagtatgattaggagtgagaatgagtcattataaagtgaaagagtgattacaagtgagagtatgatcaaagagagatagaagagttatcagagtgcgagtgagagtgtgattgaagtagtgaggaattacaaataaatgattgcagagagagagagagagagtaatcggggtgatcagagtaagaagtgtgggatattgagtgatcagaagatgcagagtgggagtgagtgatcagaagatgataactaggattgagtgatcataatatatcagacaaggacaaagtgaccaaaagtgatcgggatcaaaaaattatcaaaatgctcagataaacatgtgcgaatgcgtgtaaatcatcggaaagagaaaatatactcagaaaatgatcagagtgagaatgagcgatcagaaggtgatcagagtgcgaatgaatgatcaaagcatctaaagccccctatatcttaatg

SEQ ID NO: 4577 - DNA, 5667 bp, Heterodera glycines
ttctcgcccatccctactgggactaacccttctttagcatttggaacgcaaatattatacccaaaatgtgagttctaaatcgtaaccgatttttgaaacagacccaaatgtccgagagcctcaaaacttttcacacgcttttatgtaccttttttgtagcagcttgtcgcaaaacaatggcgggcttcctttcggcaaaatcctctgatgactctgccacgtctgttttcagcgatacccaccttacagagcagaacttaaattcaataattttggttttaattagtcaattagcgaatagttttgtcaaactctgccataacattttttatttaaattgttgtaattagtgccgggaattttgagtgatttaattaatttttggtgccttgccgattaaaagaaatgaattagtgtagggttcatttttctgatttactgattcttttatgagactgatttttgaaaaattcctcaaaaatggccattttatgtaaaactgtaccaaaagtcccaagttttcaagaaaattccaaaatttttcagaaaccattaattaattaattatattttttaaacactaatgctaattttaaaaattttcagttgcgtgccctgctggtcgtctaaagcgcttttttccaaaggcatcgaaagatatcgcagttgtgtgatttgctttttacactaggattcttcagttttttgcaatagattttaatcccgagaattttcttgtgccgagactcgataatcaactctcgattatccatactgatcagatacctttctcgttctgatcaattgggatcggcggcggaagcgtaaactgttcgttgccgtgatcttgcccttcctcaccaaaatggcatttgcacgacaagccatactttttgcttctttcctcacattgttcgacatttttgatttggtgacaaaaccacataattgctccgaaactgggaatctcagcttaattgcttatgtttttttaaaatactcagcactgaattaaaattcttgtatatttttaaatttttcgtatattgtaaactctaaaaaactaaattttaattaaattaatgagttctgtccataaaatcgtgataaaaattctctattctccaacgcacctgctgtgatggaaaataccaccatctccaattaaaattttattgttttaactccatgttatgaacgtttaaaaaaaaaatgttttttttgacggaaggggcgaaaaataaagcaccgatgacccaattgaagggatacggtagccatcctttttagatggcaattgcaaaatacagtatcattttgtcctctcagaccaattgtgcaggttgccgctacacaatatttcgcctctttgtcaggacatgaggagttggccatgatgaagtttctgctgattggctggctttcttgtccctgtttgcacttgagacctgttgaatttgatttataaattaatttcttaaaagaaaagcactgggtaaagactgaatttttgagaaatttggaaaaaaataaataatttaaataaaaaagttttttttaaacactggaaaaataaaaggcaattcccattataaatttgtgagatttttgacaaaaatcttttaacaaatcaaacacaaaattcccaccagcaggactctaaatgacattaaaatttattaaaaaggcacattttgtcttttattgaacattaatctatgctttttcttcagcgattcatctgccggcattttaaaacaattattattttttcacccatattctgtcaaaatggtgctatgacgttagtcaaaaaaccatcaaatgaaaagattttttgatataactttgctcagaggcaaccaaattttaaaatcttgatatcattcgatagccctaagtatttctattagcctacaaaatttcaaaaaaattcattaagtctcaaaaaagttatggccaaaaatgttgaaaaaaaacttggttttctgagcttctcaagtcataacttttttcaaacttaattaatttttctaaaattttgcatgataattgaaaacacttagagctatctaaaaatatcaagattttaaaaattcgtacatactaggctaagttataaataaatttctgacaaaaatttttcatttgatggttttttgactaacgtcccagcaccgtcaaaatttgactgcctaccgaagccaccgttggccaaataagcgacgaagacgaaaaggtgcagaaagaatgcaagtgtctgacgcatttgagatggtttttttctaatgatgtttttttttctaaaattaatattttttacaattttattttaatttttttaattaatcgtaaaatgaatccatttggttttgcagcagatcgaataagtggtgaatagaaattgtgacagaatgatggagatgattcattgggaatgaatgcattttgtttttggtggattttccgtaaatattttacgaaataaatgcgaaaggcacaaaaaagattgaaacacataaaaaaagtaatgaaaaggataaaaaagcataaatttgaaaaaagctagcaaaaaattcatattttttgataaaaaatcaaataaaaaatccaagttttctaaaaaaaattgtcaccatactataaaaattcctatcagaatagttttcaacatttcttatatgtgttataaaaccatttcaattttttgcatttaaattcaatctcaatgattctcattaggattttagtaatttagtaagtccattatatttaatcaaaaaatggttttgactgatatgtatgtaacaactgatttgtcaccaaatgatgggaaaccatcaaaaccatcagcaaaaattataaatgattaatgaatgaatgaatgaataattacacttttctccatttgtgatagcccataagagaaaaagcagaaaaatgcaaattaatagccactggaaattattttattttatttattgaaaaatcttttataaaacaaacaattaaattattaccgataaaacattgcgaatagttttcttcttcaaatattaatcttagcatttgattccttagcatttgagcttttccttttttttattaaactatcgccattcatttgaactccactcaaaaaagccaagtaaatcaaataaatgctttgaaaataattatttatttgattatataaacttttttgataacagcataatcaacacatggcaatggtcggagttttgaaacgaattcttttttgcgttatgttttgccttgtgggccagtgctacggtaagacaattaatttgtagggcgggaattttgtaaatacatattttttcctggcctatgctctgaatagtaggaaaacactttcttttttgtatttgccaacaaaataagaaatcggataatcgggtttttccaaaaattagatatcaaaaattaattttaagattactaaatgtgattataagcctattgaggccattcttatggcatttttttgttgttgcctatttcaccctttaaaaatgttatttacatactttggtacatgtttcgggtttttgtacatattttggtgtttttttttacattttaatttacatattttgcaaaattttgttacataaaattctcagccctattaatttaccgtaaaaaacaaaaagaaaattaaaatgaaaattattctccatttaatttaattacaaaggattgatgtgtaaggacgggcgtgctgtcgtcataacaggctatccggatgccgaaaatgtcacaaccacaacgtgcttcattgaagagaaatattgcgtttttgtcacctgtgccgttggtgaatgcttttaccccactcataaaaatagtgtattttttctggaattttcggttgatttgccaggatttggagttttgtcctggaatcactaaaattagttttcgagttattagcagtttttagcaactataaatcgtagccctagtaataaagtcacagttattttaattttttgctaaatcatccgcagatgatagtccggggtatgcgctcagtgcgtggtattgcggtgggcacaacgatgaaacattttgtgccgaaacgatgtcagaagaaatgaggcagcgattcaaaaatgtcctctgcaaatgccaaattggcgaaccgtacaaagacatgaccaatgatatgccaaaaatgacgcttccaccgcctaagccaacatcgccaccgacgccaacaacgacggagccaccgagtgagccgttagaattgggttcccggatgctcgggccaacgtccggacaaatcatcacagtagacaatccgtcataaaatttttgggcaataatgatcaaaagtcttgtgaaaattattgtaaaatttaataaataatatttacatagattcttaacatttctagttacttcatacttctattaattgaccatcttgagagaaatttcatttaagttttaaaaaatgattatttcatatatatatatatatttaaaaaaaaaataaatctagttgacggattgttcactgacagattgtctactgacggattgtccggggagcctgctgggccggggatgtcggtgctatgtcgttatataaaaaccatcaaatgacaatttctagagaatgatagcaagatcactttattttgttcgttttaagaatgttttgatcagaatttttgatgatcaaaatcattgtatttttaattaaaaaacttctgttagaaattattcttgttttttattttcttgctattcgtcgatagacctatgtgtcctctaaaaacttaaggctaataatttataattaaattcttatttcaaaaaatttaattaagtttcaaaaagttatggccaagaatgtttgaagacctgattccctgtgtacttttggcattaactttgtggaaacttgacgaaattttttgaaatttttactttctaattgttgaaattttcttttgatggttttaaaaaaaaataaaagatttgatttgcatgcgtggtacttttgacgaggatggatacggctcgcttgaggacaaagaatgcgacaaaggccaacagttttgctacttggcaaactgtaaaaacggtaataacattggaatgcattatttacctcgcttaaaaaaatccaaatttggtactaaatacaaatgattgtcaataatttttaaaatatttttataaattttgctcaaaaaactaaactcaaaatttaagttaatgaaagattttctagaaatgactttttattcttttcaaaaaaaatttttaattaaaataattaatttattaaaatattatttaaaaaattcattaaaattaatgcattttcttgttcaaataacttgtagacatggtcagctatttgtcttggggttgtgcgaaagacacggattgtgccaaaatttcggctgattggaccatgaacagaggcggcggcaattactcgtgcgagtgcacatttggcgcccctggattaaacttgggcaacgaaaagctgcacattccgatggcacgtacgattgtgttcaccgaaatggaaatccccaacagcggaatttcttcatgtaatatgcaaattggtggtgccattctttgggtgctgggtgattaatgatgcatgagagtgtc

SEQ ID NO: 4578 - DNA, 979 bp, Heterodera glycines
tcacatgaatttgaatggatatgctggcaaaaaacaatataatttctataatatttttgtttatatatttgttatattatcagcaatgcgagggggcgcgtcatatgaaattcatacaaatgagaggggtaaagttgtgcatggacttcatcaataaagtcaagaaaagtgagcatttcattctgctgtcgactctcgctgtcgacaaggtacatggaaagctaagcgggaagaagttcgagcagttagtcacatcagcaaatcactctaaaattgattatttggggcacatgagattgtagatcgtggagctatcatatgcatattatatttattagagtgcagcgggaccgggaattttgggcttaaccgggaccgggaccttttctggttgaaaaaccgggactttttggctgggaaaaccgggaaaaaaccgggactagtcccggtcccggtcaaaaccgggaccttggtactcagttgtactcagttgtccgtgtccaggtcccggtcccgctgcactctagtatttataatatgctaccggttttatttcctaatataaaatcttgaataaaaaataaattggaaaagtggtgccaggccaagtcgtctggccaagcatcttaaaccaatttgtgccattaaattcttttatttgaccgaatccaaataaaagagctttcacaaaatgaagaataaattccttacattaaatacatatcatttacagttgcattcggcaccattggacgacttactgcagtgccaatcagtttctgttttacgatgctgattggttagggaaaggaatacgaataatacgattttaaaaataataacttaaatattataataaataattttactttaaatatttatggtttaaaatttcaaagggcaggaattatcgaaactttcgatgctatttttcttcaacaggtcatcggcgactttgactaaaaaaggtgataaagga

SEQ ID NO: 4579 - DNA, 615 bp, Heterodera glycines
atttgcgtcttgttcgtcaaaacggacaacaaagtctcgaattgctcggtcatttttaagatattttttagatcgagatacttcagatataggcctagttggatcaagttcatggggtatcatccgatttcgttggttctcatcttcatctttgattcgactaataaatctttaattgtttttctgttttggtatttttatctaaattacgttgccataggtggattaggagccgaaaatcgcttgttaaagcttgagtgaaagccttccaggccattattttttggaaaaatcttacaacattatggtcgaaaaaccaatgaaatttgcattaatagtataataaagcaaaaacaatggcgacacggaaagtgaaaaattcaaaggcggatcttggccttttgatgctttatgcggtaaaaggagaaggaaaacaagagttgcttggatgtgtgtgcatgatgattttttaataaaattactctcgttagcccctggaaaggcaatttcatgaataaattttttattcacaatcgggacgcaaatgttcggggcgcaaatgtaggggcacaaatgttcgaggcgcaaatgtaggggcgcaaatgttccgtcacc

SEQ ID NO: 4580 - DNA, 1764 bp, Heterodera glycines
ttttgcgactgaaaacgagcaaaacgaacaattgtttatggacgaaaacgaaaatatcatttcaaagcttgacttaacagaacctgatgcttcatttttgcgttattaccaattcaataagggtgatcaaaatgcaaagtgccgtatttgttgaagtcaaatatcacgcaaaggaggaaacaccacaggaattaagcatttgaagcaacataaaaagtctttaatttatttttcatttctaactacttgttaagttatcactagagaccggcggatcgggactcccgcgggattttacgggagtcccgctcccgactgtaaaaatgcactagtaagaattgaatttttttggaaaaatgaataatttttgatcgaaaacttaaatatctagcaaaaatctcaaaaaaaaattacggcggcgcctatcggcaccgccgggccttaaaaatccttaattttcttaaaaaattggctcaaatttggcaaaaatttgtcatttttgaataatttattaacacattgaactcaatgcggataaaatttcgttgaaattaattcaattttccatagtaaatcatgaaaatgaatatattttaaaatatttttgcaaaataccgaagaaaacaaaaattatacgaaaatcattaggtcattttttagacaaaatatgttaacaaaagaaaacgttttttaaaaacaaaaaaagtcgtcgagttgctaaaaaatctgtaaaatttgccacagggcttgaaccctagaataaattataaaaaatttatttgaagcaatttcaaaacatttgcttctgtattcgataaggaattttcgtccaagctgccgcaaaacaaatgaatattgagcatttccatccgaaagaaaaatggcacaattcacactcgaaatacaaaaaaattgactcactaattttgcttttcatttgcctttcgtgtgagccattccgggaaaaaacggaatgactgagctttttgaagaagcgtgtccaaggtaatttttttctctgtcttattaactaataaacaattattagttacccgttgaaacctcgtgaatttatgacagaattattgaaagaagaataccgaaaaaactcaatattgtaaaagaagaaattggaacgagaaaatttttgtccttcactacagacttttggcaaaatctgcgcaaaaataaaagatttttggggtaaaagaatacatcaatacatctatatattattttaacagaatttaggtttgaccgttcatttcattgactcgcattttaaacgaaaatggcgtatttaataactcagccgatgccagagtcccacactaagccatatcataagtttacgactcaatcacattcttacagattttggaattgaaccaaggaaattcatatttttcttcgcgatgcagcttcgtgtatgatttgtgccgttgaagaacttggttacgaacattttgactgtttttgtcacaaaattcaattggtaacaaaagagaaaaataaatatatttatatttaaatttcaaggcacttacggacctcttgaacatcggactaaaagcattggcgaagtcaaaaaacagctgcacctttgcaggcctttggtggcatttttcatggaacagcagtctttcatgattaatcgaattatggaacaacaacgcccacttaatttagttcatattgattttcggatgtgaaaatgccagatttagaaatgctaaagaatctttcaaatgtaagaaatgatcg

SEQ ID NO: 4581 - DNA, 1937 bp, Heterodera glycines
  misc_feature (1858)..(1858): n is a, c, g, or t
attttccactaaaaagtactttttcttttttaaatccatttattgatctcatcatccacttccatcatcctttgttttttcttcgttttccgtccgttcatttcgcttttttccgttacacaattataacataactaattcatttggcacctttaaaagtgcattgcaaatagaccttattagtcattcattcgacaagtttttgcaacttttcgccaaatcctttggcaattattttagtcaacaaaaataaatagattaataagaaaacaaaattaactttattcgttttcccctaaattgtggccaatttcgcattggccaacactttcttttcggctttcattgcaaattcaatcctttctttcactttgccccaaatgttctcccctcccccctcattttggcttcaaaattggccaatccgaatttcgtcttctttcgaacggaattaattcattgggcgaatgggcaaatgaatgaatggattttttggcatttgcttaacgccttcgcaaaaagacaattaaaaaaagaaggaatttgaggagggatacaaataaatgcacacaccaaatttgaaatcaaataaatattttttcttaaatttgatgttaacgacgaatttccgacttttgacccctcagggaaaatttatttttggccaccaaaggaaacagccgcagaattctcttcgtcaaaatgacatttgtttgcataacaaataaaaacattgctgctacaccaattgggctttcgttgctgcgcttttgcgatttaaaaataaaaataattttattttttaataattttattttcatattttaattaatcattcgttcgtcgattttcagtttcaattttcagcattccccccccccaccctttcctagctgtgattctctctttcctttcactttttccgtttcatttggccaagcaaatttaatcgttctttttttctgtccttttcctctgttgctttttcgtcatttcattttgcttttgccatttaattacttcgatttgatctccgttcctttttcccccggagatccgttgccttttttccctcttttctcaggcatttgccaaatgttcggcgtttcttttttcctttgcttttcccccggtaattaattaactgtcttttgatgttttgctatggcttcttcatcatcatcccttccattccctttttaatccttccgacttttcttcaatcccttcaattccgccctttccccaattttcatcccttccgccgccgccggcgatgtttgaccatccctataacattttgttgccatttaaactttcaattgggcaatttaatagttattggaatggaattgtgcaatttgccatccatttaattttttcaagtgctccacgaagaaggggaggagactgagctcatttaaacaggaaactttcatttgtcgggccaccactcacaatcaacaacgagactcactctcgatgccaattagcgcttcagccactaaataagccatgccatcatttcatttcgtccactcattttgccttttttccattatctccattatctcctcctccgttttctttgccacattcccatcaaaacaaaccaaccgttcatttcccctgaagggatggcacagaatccaaatgcaaataaaccctttgccccccccgccccctcaaaactctcaacttgcgcacaataaatattatttccgcgtcatcccccgaggcgtccaaaagggcaaatgcctcaaaacattcaattcgatgtgcagcaaaaaacattatgaaaagcaacgaataaaataatattttaaaatcattgaagggaacaaattgcaataattanaattaattggagtgcattaattatgacggacaacacaaaattagcagccaatgggacaacggacgaagaattaatgagc

SEQ ID NO: 4582 - DNA, 8553 bp, Heterodera glycines
  misc_feature (63)..(63): n is a, c, g, or t
  misc_feature (6673)..(6673): n is a, c, g, or t
  misc_feature (6682)..(6682): n is a, c, g, or t
  misc_feature (8122)..(8122): n is a, c, g, or t
  misc_feature (8181)..(8181): n is a, c, g, or t
  misc_feature (8517)..(8517): n is a, c, g, or t
ccgcgcgcgtccgacgcaaatgccacggtcactctgctgaccagcttgaccagctcggacatntggtttgtgtgtttaaagcgaatggcataaagcaaaagtgatgctatttccacaacaggtcctgcattgtgatggcactgtcactgctttacaacagttatttgcccattgtgctccaaacgcgggtggagccatgtttggcactcagtttggaggtgggccatggcacggggcattttggggaaatcactttaaaacttccttattaattgcaaataaatccttctgaaacgaagccaaaaagggcggatttatttttaaaccctatttatttgttcataatccattggattggcattgaaattatattatataatccattggattggcacagaattaattttctttcagatgcttcgcaccggcgggcttctcaccggtttgcattatttctttatttttttggcattttgtccattttctattttgaattttgctaatttcagctgcccttcatcttttgctcatcgctctccaccactgtgtgggcattattcgtccccattacaacaaggaacaattgcgccgttccattttggcattttgtgccttcgcttgggtggtgcccacggccattttgtggctgttagcactaagccgaccaaatcagggcttttggaactgcgagcggcccgacttttactacacgagggcattccgttggacagtgtccacactgctcggctcaatcttttgtgccattacgctttgctatgccaaattggtcggcttttgattttggcactttcccttccctttaccttttcattgccaatttgtttttctttagctgtgcattctgcgcacccaacacgagaaatggccaaaacaacaacaatcgcaacaacgacaattgcattgtcatcgcccgtcgttgttccgcagcagcagccgtcgccccaccacggactctgccgcgccgtgcgcggaagtgttgtcctgcggctccaagcggcgacgccgcgagcggcgtacgctgtggacgacactgctgatctgcgccagctttctgcttggctgggcgcccgcctcgctgctgttcgcgctgacctgctccgactgccgggtgttggccagcccggccaattaccgcgtgctgttcgctctcagctgtactcagttggcatttctgctggccaaatcgttgctcaacccgttgatctattcgctccgtatccctgaagtcaatgcgcacattcacaagtgcatggcgacaaagtgcggcgcagtgttcggctgttgctggtgagtacagtaagggaagcgtttggctgtgcatggttaataccgtaagacagggattgaaaagactaagccgatggctattacgctccggtattgtgatagaaaggccgcgggttcgaacccaccgggcgcgtgtcctaggaatggcactttgagtagccgcactgctcgaggccacgagactgaaacgcagtcggggctaacttttttaacaatatgccaaatcctttactgtacacggcaatttgaagtttcaattgggcagtcaaaaaatgacctaattttatttatcgctttttaatgctttttcctttacttagggactccaaaaacggtcgtttccgtcctcggattagcatcagcggagacgcccaacgccgcaaagcgcgcaaaagccgcagccatttgttcgccgtctcttcgaattcgtcctcggcacacgaagacaattgtcagcacaacacaaaccattggggtaaaacggcggccgaaatggtcaaacggagccgacgaaagacgcgcgttgggctgccgcttttgagcgaagcggcgatggaaaacggaggggcgccgatgggggcggaagaggacgccgcgggggaggaaaagggggaaacaaagccggaggggacagtggcggagatggagccgaacagaaacaattccggaggcgaaaagcgagggaaaagcgagtgccaaaacagaggcagaagcaaaagcaacattttcgaggagggcaggacgacggcgacggcactgcaagtgtcgcaatgaaaaggcgggaagtgacgaaggaagtgggaaaacgaaagtgccatccaacggaggaagaaggcttttgaaaatgcgcagctaaatgatttgccgacattcacatagcacaacccaagtgctgctcgagagtgtcgcctcgggaaattctcggggttttcatggtttttctgtctccgattttgagttttgagaaatttagtctcgaacagcacaaaacatatacaaacgttgtttaatttatgtattcattttgtaaaagaaatgtaaattttttgtgttttttattttcttttttggccattaaaaattaaaatttgtcgccgtttgatttattgcaccaaataagcatcttaaaaagcattttaaagaaaataaatatgaaattggtaaaatgttttaaaaatcatttgtttgctgagtcatccacccttctgattaatttattatcactcaatcattatcatatcatttcatatcatattatcagctgatgattgccctttctcaaatgattttcccctccataaatgcttcgatgacatgcaaaagttcgaagcctttcttttggggcaccttaaaacgacattttttttaatttacattttttaaatataattttcaccatatgaccggctccacgaactaaaaattttaaaatttaaatttttttaaaattatgttttcttttgaattcgacctgtcaaaaaagtcagtccgcctttgtacattgtcttaaagccgcccacttggcctcggaaaagccatggcctggccgatttttccagctaaatttcgtgtaataataatttaggggggctttctcgtatttttacttccatgccgagactggcacaaaatttagagcccaaaatcaaattgcaacgcatgtctgtgtcgccgtagaacagcagaactggcacacccgccttcagcacttttttcacgtggaattcaacgccctctaaaaaaaattgttttttgtctttttaaaatttgattggcctacccaaaaaaggtaattgggcaataaatttaactcacttatcaattagggcaatttcttttgggtcaatttctcaatttcatcattagcatttctttttttcctctcccaagtgatttgcatatgatcatgatctgctgatcagttgtctcctctgtattgcatttctaatcccaattttggctttgtgtttatttaaatttgtcacttcccatggaatgcattgcatttgttaccgtatcccataaacccacctaccgtattgtgtcttgtaattgtggatgccccttaaatggatgaattaattaataaattattattttctttttttaagtgttttttgtttttttttttcttacccgcattcggcccactgatgagcattcggtgagacgtgcaaagcttcgcggactaaaaatgggaaaataattcgaaatttcaaattattcgccttttaccttccgccttgttcagatagcttctcatgtcgtagactaaaaagcattaacaaattaaagtatttactaatgagtttgcgtgggactgaccattttcgcactttaattccgacaattgaacgtcgctttcctccgacagaaactcaaatttcggcggcggggcttgtggccattttgcggccctttgcttggcaattaattggtccaattgtcggccttcctcgtccgggccaccgtctgaattgcgttttttaaatagttattaaaaaaaatattttcatttaccgcatttttggtaaatgtcataaacattcagtccataattgaacccggaaggcaaatccttcaaattgtggtgttaatatcgttttattaattaattatcgtcccattccgactgaccacgtccgccaaattgcaactgtctaaactttgttagtctctgattaattagtcccattttcccatttcttttaatcaccaatgtttcccgagcattgatctgttttgatccgctgccagtccaactcgtccaccattccgtgtgcgtaattgtagcgaattcgcgtgtcttgctccagcgaaatgttgtggtatccgttgccaattgccattccctaatgacatgattaaattttgattttttgcatttttttgttagccgcttttcccttttccaccttaaatttgatcgggtattccttttgtccgtcgacaattcgttcggctaatgtcggcagataaatgccggcgtacgactcgcccgaaatgaacatgttgtggtcacggaattcggggaatttgatgaagaactgcttgatcgcctcgtaattctcgagggatgtctgttgagaatggttcactaattaattaattgagttaattgatttaattgttttctttctttctgtttttaactcacactgtcatcgctccacgctttgtctttcccggccaatgaaaagccttaaggtaaatttgaccataaacttcaaagttactgctgctttaccccctccccaattaatcataaaatttccattacaaagagacggaataatcaaagaaattttttcataattacaccgccaaattcgaaaattgactcttcatctgtgttccaaaatagttcaacaagttcaacgaatgaccgatcacttaccaactccggccggcccttccatgtaaacgaccgatgcctttctgttccatgcactcggatttttggtgatcgtttgtccgtccgagctgacctaaaacgaaggggaatccgtattttattagcttatttaaatataattggcattaattgaattgcacttgccaagtacggcccatgttccgacaaaaggccgagcagtgacgaacagccggggccgccgttgtaccaaaagatcaaagggtcgtccgacgcatttcgctgcgaggtgaccagccaataaaagagctgatgctcctcagaaaccttcaaatagcctaaaaacccaattaatataatttgtttaatcatttccataattacccgaataatgctcaaagtttggcttaaagtccaacccgggaagatccaaaattttgtccttattgttgaggaattccgtggcgacagcaaacgaagcaaagaaaaggccgaaaactgtggaagaagcagcgaaatgccgcatattaaaagcttaacgaaaataataatttaaattgaaaataaaatccacaaattttgcttatttttagtttttatacttttgccgccccggcgtatttaaaaaatgtgcacttttatgcgttgtaacatttgtaaagcagtcaaaaaagaaggcaaactttgcgaatttcgtcaaagaaattggccataaatttgtacttttattatatttttcgccgcttttttctgccaaatctccgataagtgcgcgaaaaaggcaataaatgcacaaaaaaatattattgagcattgataaatgaatgataaaataaatgcttattttggaaagctaaataaatgcaaatttaatttattcgttgaatttagggctttagctcactgaaaagaagctattttaataggagaagatcagctcataattattttttgaaaaagaaagaaagagaaagaagatagatgctgagagaggtgagataatgggagagagtgcgagagaatgagagataggaagactccgatcacctttgctgattatcctaataatgttctccgatcacttgaaagtgccttgcgaagcctttgattggatcacttccattccctcccccgtgggcaaaagggcaaatcgacggcaattcgcaattcgaacattgcgttttatacgcgcagcagacgtgtgaaatggaagtgcaaagtgcgcaccgattaatcattactatccattcgggaacagaacgggagcagttaatggacggacgacaaagtaccgatcggaagaacgacacaaaggcggcgtatcaatggtcagcaaatgcgatcggagggggggggggcgaagcgatcaatcactgatcactactaacaccaacaaatcactcccattttacgcccttcccttttcaggtcagtccgtctgccgcgccattcgccgccgctccgctcgaacggtgcctatttatgattgcataattagaataatattaataccaacaataataacagtaatagtattcattaatctttacgaatgcgaaatcaatgcctaatttttagtaattataagcgtttaacaatttaaattgaggaaaaagcgatgaatgaataaaaatgaatgaataatgaatgaataataatgaatgatgaatgaattgatggtaagcttttattgttgaatttatttttcttttcaaactgtctgaaactgaaatacaaaaacaaattaaaatatttcacctttatatatatatatttacaaattagatggcttccgagtttggttccgtatcaaaccgaagagccaattacgagaaaccaaatcagagaaatgaaccgaattgaaagtgcaaaaggctaccggagaacacgagagactatcattcttttgattttcacattgaaatgcattctgtttgataatgtttttgcaaatgtttaaaccttttcaacaatctacaatgtttctacaanattatttgncaatgtttaacattttaaattgttcagttttgcaacacaaaaacgtgaaagaaaattcaaaatccacgtaggaatacaaaagtaaactctaaataccattccgtaaaaatttacgtgcaattggattttttccttcatgtttaattgcaaaaccaatttacccatatgaataacgaaattccaaggaaatcctaaaacccttataaaagttaaaccgtacccgtttaaaaaaaccgccaaaaacctttaaaaaaaaacctaaccccccgttaaattcccaacctccggaaaaaaccaaaaaatccccatttatacccaaaaaaaaaatttaaaaaatcccctttttccactttttttttggaaaaccccctttcccctttttttttaaaaaaaaaatttttttaaaaaaaaccccaaaattttttttttttaaaaaaaaaaaagtttctttttttttattaaaaaaaatttggtttgttgttcgcaaaaccccccccccctcccccccccctttcccccccctttttttttttttaaaaaccaccccccccttttttataaaaaccccccccccccccctttttttttttttccccccccccccccccccccccctttttttttttaataaaaaaaaaaacacaaaaaaaaaaaaattttttttcccccccccccccccccccccccccctcttttttctcttttgtgctgggaggggggagttttttttttttaaagaaaaaaaaaataaaatttatattaccaaaaaaaaaaaaaaaaaaacccccccccccccccccttttttttttttttttttttttttttttttttcccccgggcgggtgtttttttttttttgttctttttgtaataaaaaaaaaaaaaaaaaaaaaaaaaaaaaaaatactttttttttccccccccccaccaaaatatttttttttttctctcggggggggaaaaaaaaaaaaaaaaaatttttttttttttttttttaaaaaaaaccccgttgtttttttttattttacaaaaattttaacacacaattttcctttttttttaacaaatttttttttcctttttttttttttttcccccaaaaaaatcctttttttttaaaacaaattttaaaagggcggaaaccaaaattttttttttaaaagtttttttaaaaaaatttttttccccaaaaaattttttttttcccttcccgaaacccttcccccggggaaaaaatgggaatcccaacccccctgattttttatttcccgtactttcggatttccccatttttgggccacttttttttccaaaacaagggctgccccccgaaaaaatccttttgattcgcttttaaattagtcaacataattccctattaatgatgcaccttttagtgacgaaaatcttgaaaatagttacttaaaatagtgagtaanaatgccaaaatagtgaccaattagtggcaaaaagtccgaaatagtgacaaatagtgacntattttcagccaaaattaagcaaaaatatttttattcactggttgcagttgcaaatgagctacatttcctttataaaattctcttagcaaataatgatattttttaaatcaaaaattttgtcaagaaaaaaaattttgggggagaatttttgaaaaaattttccaattcttagtggtgtatttaaaaaaaaatttttttggtcgattcttaggagtgtattttttgaaatttttttagatcgattcttaggggtgtattttttgattttattgcattttgctaataaaatctctgaaaaatgtcgaaatagttaaaaaatagtgataaaacgccanaaatagtgaattttcactattttagtgacgaagcgt

SEQ ID NO: 4583 - DNA, 1831 bp, Heterodera glycines
  misc_feature (20)..(21): n is a, c, g, or t
agatcacgtcccgcacccgnnttctattccttagtcagagtttgacattttaaaaacaaataaaaataaattgttgcttttgctaggaatattaatatttaagtatctaattaacaataatatattaaaattcttttaatctttttgataaaaatacccagatacgcagccctaatcatctcattaagtgcttttcatttgttttattattttgttacaaatcttcagaaataacaacagtgaaatgggtgaaaaaaaataaacaataacaaaaagtttcggcaccacgtcgcctcgttgtctgtcctcagtctgtccgttcacttcacatcctttcgatgggctcaatgccgagcaaacgcatgccttcgcctagcacttttttggcagcagataaaagcatcagacgcggcagtgccaccgcaattgtttcatcctgcacccgaagggcggccatcgctgtgccaatttcgttgcacagtttaagcttaaagtgtggcacgacgcgtgtttttattggaaaagcattggcagaggttggactcgagtccgtcatcaccgaccaagtaaatggccaccggattcgggtccatcttcttcatcgcggtcagcaacaccgtgtcgaactcctgaatgcgccgagccaacttctgtcccggctcccgcatttccatgttcagtttccattctccgtccgcgttcaatgcgcggatgcgttccatgtgctcgtggtgggcgtgctccagcgaacagagccgactgaacttctcctgaaacggcaccatgagagtgtgcatagcactttcggagatagccccgaaatgattcgagtagagactctcgaggagaccctggggggacgtacatggagcagcaaagcgttggtgccacccggacgaaaagagttgcgaaaagagaaagtgaagtgactgtttcgatgacggaagacaatctaacgaacggagggactcaaacgcattgtccagccaaaagtcacggacggattgggccaattaacccaatcaagcaaattcactaacatttggggaccattcacacaacttttagcatcgatcgaagggccaaccgttaacatatcaataaaagtctcccacatattccaacggtgctaacaccagaaagagcagcgtcgactcggccaaccgtcggcaaattgtgcccaattcggccggctccgcgcgcatcgtcggcgacgcgtgcacatacgcatccgcctcgcgcgcgccctggtcaatcagaaagtccaccgagtcgtttttgccattgcgcgtggacagaccgatgatgcgaccggaaagaaatacaaatttaaatattgatcaataaaaggcgccgtttaaatgttacaattagacgaatattgaattttgtaaagttgacggaaaacaaaaaagatttattgtttttttaaataaaaaccgaaagagacgtgttccattcggtccgccaagtcgtcgtcgccacggacgcgcagcaaaagtcgcaattggttgaagtgattggtctacgaaaaggaataataaaacacatttattagaagccaatgaatgaatgacctggccatagtccaccaaatagaaatatttgtccgcgttgtaaagacgatgtcgcgcataaatggaagccaaatctctgaaaaggggaaacaaacgccgataaaacaattaataacttggattgtgaaaacacaaagaaaaaaagccggtggtgcaaccatcgaaaattttgtgaatttttttccgatggcccttaagataccattgcttcgcgggaatctaaggaaaaatgcagaatttcgggggatttgaag

SEQ ID NO: 4584 - DNA, 1905 bp, Heterodera glycines
cccccccccccctcccttttctcttcccaaatggcccatgtgaaatgtcttggcaatgttcggagaggaaaagtcgatgacaattcgctgcttcgtaatgctgtatttggacaacagttccgcgaccaagtcctggctgaacattatgcgacggaaggcggccaaaagcatttcggcaaaatgccaaagaaatttattatgaaaaccgaaaaaaataaatacaaaagccaaaaaatcacaaacaaataaatgaaaaagggattggataaatagccaaacaagcaaataaaaaaaatattaattggtctgtccggcattttcattaatttgtaaataaatctcagggattctagcccggcacacagaaaaccccttgaactcgtaacaaatgatggaccggtcaatgacggatcacagcggaaagggcaattctcaatttcctcatttctgttgcccggacacaaagtcaatggccacactgttgatacagtatctctgcccaccgtcggccggcggtccgtcatcttattgttaggttttgatgaatttgcaaatgtttaacggatagtttacaatttcgtagtaataaaactcaccgaatacatggcccaaatgtgcgtcgcatttggcactaaattatgggaaatttaaacgaaaaggaaatttagtaatttttagacatttaccatcgaacttcgattcgttgacggccgtacgaattgtcgggcagtcggacaatgttttgatcgtccccaatggacttggagaaggcgggccatctgcgaaagcacaaattttggaaattcaattcaatttttgacctcttacccgcaccccgagttgaacttctgctccgacacgaacagagcggcaccacagcacacgcaagtgtatttacccccggctacgaaatgtttgtcgaattttccggtgaatggtgcctgttttttatacatttcggctaatttaattaaatgcgatgatttttcacggtgcactcggctttgcttttaagttctggcaatggcatttctccccaccccccccccttttgttggcccacctccgtgccggactgccgcgtcacttcaaacgcctccggcgacaacactttgcgccattcgtcctccgtcactgcctttgggtcttttttagcaccttcaagccgatcaatggccggcgtttgtccatcccccgccttttggtggcactgcccaccggcggattgttcagaggacgaagccataaaacagggaaaagcaactgtagaaaaatgggaaagcaaataaaacaagagataacaaaggatggaatggaaactttaggaaacccgcaacagattaacaccaaaaacgccactcgtggattctgccgttttagataaatgatataacggtaaacctgagagtttgaaacgaatgaccccccccccccccgcccacgtccgacacataatttaatccaatagaaaagaattgacctgccggcggaacacgaaacgcacggccaaccaaatgggaaaacaccggacgaaaaatggtgaaaaagtcgctagaacggctcaaagatatacaggaaaacgtgactcaagcgacaaaagtacaagcaaaataaacaatgtaaaaagtccatatattaaaatctttttggtgtccatttttatacagagaaaattaattttctgggaataaatatagaaaaatagtgacaagaaatttatgtcaatcaaaattatgcactcaaaaaacgaaagaagaaatgggacaggcagagttggtcatcatcataatcaatcagtacgggcagtccttggttgcgaattcggttggccagcctcaagaaacaaaaataaaccaaatcatggcgtttggacttaccacgaagtttgcgggtcgccgatgttcc

SEQ ID NO: 4585 - DNA, 1319 bp, Heterodera glycines
agcggaaccatccgaagttgaggcagcaaaggtggaggacgtggaggaagacggacactgaatttcgccgttgtcattcagccgcttttgactggacggacacggcatgtcgccgttgccgtcccgaatcattgtcagttgctgttcctgaaattcaaatggaaatcaagcaattggaaacaaaacaaatttttgtgctttaaccataatttatgacacccagcagtggaaaaatcccgaaaacctcagaaaaataaaaaaaaccttcagttcctgaattttgttctcgagcgcttctattttgcgcagcatttttgcgtaggaaagttgagcccttgcccatttaaccattggtccacaagcgacagatgcccgattgaccttgaattgttggatttgttattttattaataatatattgtaataacggaccttctcaaattcccattcagggttgccttcatactgctccattttctccataatttccggtgttattgaatccgtgttgaattgaagaatgcgcgagatgaagtcgcctttaaacatcattgcgcggatggacttccattccgtttgcgtttcgcccaacaacaaacagatggcttccatggcaattttcaccgcatttggaggcgatgccattgagcgcacttctaccaattgagcttttctgattcccgcaatcgcgctcttcgctttctcaacttcaggtttaacctgaaaagaaattctaactaaattgccagatttttgcaatttttagccaggcgacgacttttttcttctttaaaaacgctttttttgcgacgcgcttttttaaaagaacttttttttggggggggggggggtccggcggtggcgataggcgccgccgggaaaaattttgtatttttagtgccatttgctaccagattttgactaaaaaacaaaccatggccaattcccgttccacttcgtccttttttcgatcaatgcattgtttttcctctcggatttgcttcagcaacgtttcggaggtgcgtttctcggtttccgcctcgagcattagttgcagcttcgcattcagatggatttgttcatccgcaagttcctaaacattgttgtttttatacaaatttgaacgaaaatgcataatcacatcacgcttctccttgctcagcacgaatgaattgaccaccgcgtcgcgataggcaatttcagtgggcaaacgatcgcaacaatgctccagcgcggtaggcgaagtgtagtcggactagtcgatctcgcacatgctggtcagttcatgtccgacctgaaatagtgccgagttggaccag

SEQ ID NO: 4586 - DNA, 2757 bp, Heterodera glycines
ttactttttctgattaatacagggtttctttatgttcttgttcctaagaaatgttctgatttgggggtaatgccttattttcatctaaaagaagaaaatttctgaaaaatttggctaagttctaacaaaattcatataaattcttaaaattttccccggtggcgcctatcggcaccgccggcccccaaaattcctatattttttcttaaaaattatcccaagctcgcgaattttgctcattttttgtacaaaatttgttaacaaattgcattcaaattttcaaaattttcccggcggtgcctatcgcaccgccggaactctcccctcgcacattcatcaagtttttttttgaaaaatgtgccgcaagaaaaaaaaatttaaaaaatctgagttccaattttgagtaaatcacgataatttaatatagttaaaaaacgaaaatttatcgaaaaagtcttcattttttggtgaatatctgttagaaataaatttaaaattcgcccctatcggcacgcccccccaaaaaaaaatttttttttcttaaaaaaaattacccaaaaatccctaaattttggttactttttagtcgaaatctgtgcaatttatgtcaaaagaaatagtatcgaggcgatcaacaaataaaggaatgtggagccaaagaaatcattcttaaaaaatatttttttgtgagatttttggacctaattcaaagcaaacccccgcccccgtccccgcgggggcggaattatcgtgcccccgccaccgcccccgtgactctgacccccgcatcccccgcccccgtgaaaagccacccccgccccacggggctcgaaccctagtcagaagcatttgggattttgaatgtgtcgatgattaaatttatttctccattttcaacaattatttattttttttttagtacatttatactaataattgatttttccgcaatttttctattttcttttttttaatttatgagtgtcaatggctcgtttggacgccttaagcacttccaaccgcttcaattatcctacaaaaatggggactgaatttggacttttcaaaattaaagtttaaaaatttgatgtaatttttaggggcgccaaaaatcctatcttctctttcttaaaattatttgataaatttaaaaatttataattaaaaaaattttttaattagagttttctatttttaaaaatataatttaaaaaacttttattatggattccataaatagaatttaatataaataacatattaattgaatttcttttattttccaatttttggatattcaaggtcgatcaatttagaattgattattttttcttcgtgtaattcaactgcgttttcattgaaaacggtaagtgtgagcactccggctgtgaatttagacgatgtttattaaattattttaaaataatttttcattttttgataaattaccttcattcacatccacatttgccattttaacagttaattcttgtccgattttgaatttgatgttgtttggaaaaatgaattgagctttgttttcattgtcaatggtcattgttccgtcctgttgttttgccaaattgataagacactgtttccttgaaacactgagacgaatgttacctaattcgaaaattatgactttcaaaactttttaaaattacattcacaaagtccttcagttaattctgccaatttcaatggaattttctctggtcgctgtttttcagcaaatccaattcgagaagtgttggtaaaaacaaaagaaatattctgaaccggaaagcctttcttcgtgagtaagccttggagttttaaaacatatcccttaattttaaaaaatattttaaaaaatatatattttaatacacctttttgtcttgtaaaatatattcaagaaaatccgcaagaatattccaagcagttaattgagttttgttatttccttcattaatcattgcatcaatgacacgtgcttcgtttccttttgccattacagttctcacgggctttaattcgaataattcgcattcaatttcacttaaattttatttttttgttttagctaaaatccctatttattaacttacacaaactgttcgcctgcgcgcatttttttgattggcgttggaaaaaaaccatcattatcgagtgcaaatttctcacgcaaaaatgtgaaataattggttgtttttatcgataaaatttgatattgttccgcggtgatcagggtaattgtcgatccttcctttgcaattaattcataatcaacattaccataattgaaattcggaataactttttgtactccccaagtattaaatacatatgttttttgcttaacaataaatataatttttaattaaattataaatttaactttaaattcttgtccgaattctcgtgccattttttcgtaattgctgccccacattgtgatgttgataaaatcgtaaccatcgctaccaaccaatgtccaaactgattttccattgacatttctaaccgcatcagcaattacaattgtcaatttgatatcactaaatattaaatttatttcaacaattattaaacatttattttaaatatattgttaaaataattataaaatataattaaatgaattatttttaaattaaacttacatcattgtttcgccgatttttagacgcttaattggtgttaatttgttaattgttttttgcagacgattattctccattaaaaaaaatccaaattggtttgaaatcttaa

SEQ ID NO: 4587 - DNA, 3016 bp, Heterodera glycines
  misc_feature (47)..(47): n is a, c, g, or t
  misc_feature (65)..(65): n is a, c, g, or t
  misc_feature (67)..(67): n is a, c, g, or t
tggtcacgcaattcttgtacatctgcaacgcactctacacatgcttnctgctcatgtaaatgtgngncagatttacctatacgtccggaaagtcggcggtcgcctcgcgcacttgcgagaaaatgtcccgggcgtccatcatattccctttgtgggccaagacacagcctttacaacagaaagtgttcatgctatttggccattctttgtgaaatgtggcattttaccaattccatttgctgcccaaatgttatgcggacgcaatttcaatgctttggcataatacgcaatggcacgctccctgtacgaagcatccttaagtgttaaaaaacaaattagcaaaattgtcatcattagcctgacaagcatatccaaccagcaaaacaaccttttcgtgtgtctttgacgagaaaagcatttccagccaaatgtttcctaatgccacgaagctgtacgcgtcggtgttgttggtcagtttgagaatgtgctcgaacttcttctgtgccggcccccactcctccttggccatgtgcatgttgccgatcagagtccacgggtcgggattgctcgggttgaccgacatggactctttgaagagcagcgaagcgttgtgcaagtcgcctttgttgcgcaccaaacagcccaagcggagaatgccttggagggaaaaagcgggcgcattggcaaaatgccattcaaaatcaaaatccaactcacaatccatgtaattgggcctttgtcggatgagtgtccggtacaacttctccgcctcgtcgtacagacacaactgttcgttgacacgtcccaagttgtagctgaccgtcacaagcagtgcggcggcctcgtcgttcaaattttcggcaccctccgccaaaatacaacttcttgcctcttggaaatatttcttaaaagggtcaaaaattgttaatttcatgtcaatttgattgccttcgcctcatccaattgattgagcataaagtgcaaagatccgatgttattcagaatttctgctggaatgtcgacaccaatgtcatctttgagcaaatttgcgactcgagtgtacaaattcaaagaaacctgaaattaaatgataaaataatttaatttgatttcttaaaatgaactgtcatcaggaagtacccgagatccgaacagaattagtctctgtttattttttgaaattctcttacttgtgggtcttgttgctcgagcagttgtgccaattcgataagtgcttccaccggtgccctttccgtttggctgtccacgagtttggtcagatattcgcgtgccttttctcttctttccacaacaattttcgggtctttatgcggcacatttgtgtacagtgaaccgagcacggccaaagtgtcaatgtcattgggcaccattttgagcactttttcaaaggcgacaatcgcctaataaagtaaagtaaaaggaaataaattaaaaaagacaatatttcatttacattttcatattcttcacgataaatgtaaatttggccaagtccaaaataggggaggacaaatttcggatgcgaaagagttgtggcctggtaatagaactgaaaagaaaggacagattgtgatcgaaagaaagacgaggaaaaggaacacctgaaatgcgtggtgatagtcctgcttcttatggtaacaacgagccttaaaaaagaagtttagaaatcgtaacgattttaatatgaaattgttttagtgttatttaattcgtaggatttcccctctattgttttttctcttaaattttcgaaaatttatgaaattgcctctggaccgctgccccttaaatattagacatttcctcccctaatcatccccttcaaaattatttttttaaaaactgaaaatatctttggtttccctgttgatggttttctataaaacctaaaattttacaattatttgttgaaatgtaaaaataataacgaaaaaaattgttgaaaatttttttcagaagggggaatgttgagggaacgagttattccttgacctagtcattagttgcccatttaccaaatggtacatgctctccgctcgcattgcgtcgttgtccgccaattgatgtgctgcagaagcgagattgtgcgtcttttcaatgtcctgaggaaaatcagtgtttatacaaatgacttctaatgtagaatggtttcacctgtttgtagaagaaatgattcgccaaatggttcaaaaccattggattttccggctcgcgatggtacgcctgccccaacgcttggattccgtttcgaatgccctcgggaatgccagaattcagttccaaaacggcgagagcgatgatcgacgggacattgttcgggtcaatttggagggctcgttcgaaggccaatctgtaaaataaacaaataataacaactttgtacacccacccattattgtttgcaatggaccaacttcgccttgtccatgtgccccaaccgcgcaaaacaatggcccatcccaacgcgaacgtcggccggactgtttggattttgcttgagacaccgtttgtactgatggagtgccgccttgtaatccttgcggttgaacgcgatgcacgctttgcccatcattgccggaatcacacggccttcgttgccttgggacttaaaaaggacagagaatgaacagcaaaaaatgactggcaactcttacctgattaattacaaaattgaactgggcatcggcctgttccactttgttgccctccaacagacagaagtacgctcgtcccagcagatggttctggtcgtacatgagtattttgtctgctgccgtgtacagcaaagtggcacgagtaaaccaatccttgcgcttctctcggttccgctccttgttgccctttttgtaggaaaaggataaaacacattcattatcagaagaaaaaacaattgggcaaggggaacctgcagcacgtaataagctgccaacatgtccaacgcgcgcatttggtccttctcatattccgagtagtcgagcccagcttcgtcgccact

SEQ ID NO: 4588 - DNA, 1685 bp, Heterodera glycines
gcatgccgtgcagtgtcgagcaaaagcaaaacgaaggcaccgctaaatcaagccaccccgcacgccgctttctcgcccttcagaatttgcaggacttcctccccatcgggcaattctgtgaagtcaatctcgatgatttcctaaatggtcatcattgcgcccttttccctttgtttccgtctcccttcgttttacctcttctgcgctgttcttcagcggaattacaatggatgtttttggcacataacgataagacattgcaacaaaataaaacaaaactgagtgattttaaattatagtgaaacatttggatattcaaaaaggtatttttcaatgcccaaacaaataaataaataaatacacattaaaaaatctgagtttttaaaaatcaaaaacagacaatcaattcaaaaaggataaagcaacgaaacaattgcaggctcaatataaatgccatgtttccatgccgaaataatcgccgtgaaaagatccttatcatcgaaaactgccaaatcaaccactgagtcccgcttaaatgacagttcctgttcgtacatctccagaacaatgggaaaaaggtcgagcagttccttggctctgaattgtagcaattgatgagggtcatccggtgatgtagaagtgtcgttagatgaagtggatgagatgagatcactcagagcggctaattttggtccaaatttacgtagacgaagcaaaaatgaatcgaattttgcaattgatgtgcagagaagctcagaattacgaagaatgacatcagtgatgaacatttgccgatgtaaatccgcttcattgtcagcctttggttgggataacttcgtacaaataattgcaattccaatattttttatacctttccgttcgctttcatacggtccatcatttgaattcggcattggcatatgctttccaaaagttcacaacaattctggttctctttgtcccattgctgcaacaaattgaagatggaaacgtggagatcgttcagtcgacgaccaacacccttaacgaaacgaacaatcaaatttatagcaaatataaaacaccaaccgatgaatttttcagaacagaaaactcatccatcctttaaaaaagcattttgtgataatcaaagagaacaaataatctacaaaagcaatataaaatggtagtgatttacctatattagtcggtaccaataattgaatttaagcactgataaaaaaacccaattttattcgggaagtaggagatcaatgatgaattaacaaaaagggtaagatcacttctcaaagttccatgtcttcctgcacgccagaaaatttatcaaaagccaatttacgcgcttcgaaaaaagccgaaataagtgccaaactctgcaatttttcagaacatccgactgccaagcgttgttcaatttgagccaattggttgcacaacaaacaaaacacatcgtcaggaaggtccaatggcctcaacagctcaactaactcttcgagaaggtccgtaagtgctaagccatgtgcaagtcgaagttcggtcaattctgaaatgataataggtagtttatattatgtctatattaaaggatttgactttgcatacaaaaaatctaaacaatttagggtaaccttcgaattgatgtcccgacggaaaaaaaagattaaaattttctttacatttttcta

SEQ ID NO: 4589 - DNA, 3735 bp, Heterodera glycines
  misc_feature (71)..(71): n is a, c, g, or t
  misc_feature (119)..(119): n is a, c, g, or t
ttcgcgcagtgcaaaatgatcagaaggcattttggaccgaatcggtgatttgagaacaaatgaaagatcgncgcacaacagaaaagaggaacggagccaatggcaaagaagggtaggtnttcagagagcgcggtgcgccacgtaatccgcgggtgggattgggactttgagggacttccaaaattgcgggaataatcccgcgggaatcagtcccgcaaaaattaagagttctaatctcgcaatggaattcgaaaagttacaatttctgggtttagtgattaataaacaaaaaaaaacattaattggttcggctcgcgccgtaaaacggtttttttgttaatcaatctttggctttttgtgaattctttgattgtttaagcattggtcgacgaacaattcgcgcagttgcaaaatggtcagaaggcaattttggagcggatcggtgaattagagaaaaggggacagccggacaattacggtaggtttacgataagtgcattttgaattttgaagaaacaaagtttacgcaatttcaatttctttcattttttcagcttcaacttccaaggcaaatgaccaccaattcgcacaatttcaaaatgatcagattttcttcaattgctgggatgacaactttcgtcaaaaacaactgcaaatcgacaacttaaaagtcgtccatatgggaactagtaatttttccgaaaaattactgtcaaatttaaattgctagaaaattttctataatgaatatacaaattgaacagttatgaccatttaataatgtttaaatctcaatctttcttcaaaggtggtgaccgcactgtctttgccaaacattccatattggcggccgttccttcttcatctgtccttttttattttgagatttccatcataaaaatgaaccggcaggcgtatttattcattatatttttatatattcgaatacaattcggatattttttactgtattgattatttatttccatcattttgctctttttcagtaccgcctgctttggatttgccataaaaaatacgagaaatcttgctgggtcatttttttctgaagcgactgcttacgcgtatggaagcaagggcaaattttatgtcgacggtaccaagaccttcgcaaatcccacaaatgccttcgcaactggtcacacggtcggatgtggtgtcctggcaaacagggaattgtttttcacgaggaatggactttgtttgggttggtaaacaaaaaaaaatggttatttgtaatcactgctttaaaatacattgaaacacagccgggaataactaaaaattctcaaacttagaaattttgtgcttaaataatacaattattttaattcttcatttgttaagattcaactgcattttcgatttctctatctgctgattgtgcgttcctctttccattcgttactttgcttgaatctggtgacgaaattgaggcgaactttggacccgaattcgtgttcgatttggcaactctgatgaaataacgtttggagcgtgaggagcagcgaaagatattcaatggaatctgtttatgagtggctgaaacagaacataaactaaaattgttattttctaattgcacgaaaaaaagttgtgaaattttcagttagggtggtcaaaaatcgaaatttcttttggtggttttgcctgtgtacacgttgcatggcacatgtacacataatgggttacatattgtacaaatatgtaacttatgaatgtgtacatgtctcatgcaacgtgtatatgggtaggttgctaaaaacatttttaaatctttttttgaccactttaactgaaaaatgcctttttgtttcactgcctgtttattttttgtttgaagtaaatctttctaaatctactttaaggaaggaattttttgaaaatgtttcaaaaataggtaaaagataaatctgcttgatttttggaaagaaaattcaaaaaaacttcactttttgtcttctttggctatggagttttgtcaattcccgcatcatccacatcttgtgaacgaatttttagccgtttttcaccgctggtttatgattatcgtcgtaatcgcttaaacgactttttcgtcgtttgaatttataacgacgttttttcgttaaaaaagtcgttttgtcgttcactaacctggatccaggcctggatttttcctgggtccaggtcatttttcggcaacctggatttttcctggacctggatttttgtccaggaaatccaggtccaggtcagtttggaaatccaggtccaggcatgaaaaacctggatttcctggataaatttttttcgtctttttatggcgaaatgtattaaaaatgggtgtaaatcaaaatttatatttttttaaattttcacatgtaattaaaatggcgctatgtaatttcgacactgggtaaattcgacactgagtattttcgacactaagtaatttcgacactacattttcgacatagagaaatttcgacactgaactatttcaaaaactttcactgttttcctgcattttcggcactggaccatttcgacattgagtaaattcgacactatagagaattttttagaaagtaatatggaaaatttgaaaatgttagtacatatttatgataaattttcctgttattttctaattcgtaatcttaaaaaggtagatggtataactattggttaaatcaatgttagacaaatcaaatccagtgttagaaaaaatgattcataatgccaaatagcataatttaggccctaattcaaaaaaaaatactgatcagtgatcactgccctttttgcattggttgttttgatcatccataactcgcagcatctccaactaaatctgagaatctagtgatgaatagtggcactaaaaacgaaaattttttgaaaaagaatgtgttttttgtgcatttctcatcaaaataaagccgcagaaaaaattgttaaaaaactagaaatcctcgccctatttatcataaatatgtactaacattttcaaattttccatattactttctaaaaaattctctatagtgtcgaatttactcaatgtcgatatggttcagtgtcgaaaatgcaggaaaacagtgaaagtttttgaaatagttcagtgtcgaaatttctctatgtcgaaaacgtagtgtcgaaattacttagtgtcgaaaatactcagtgtcgaatttacccaatgtcgaaattaccagccacgatctggcggtgccgatagcgccgccggaaaaaattggattttttgtgtgatttagtaatagtttttacatcaaattccaattcataaaaatattggaataaatctcagaaaattttagattattgaatgttttttaaaatgcttattttcaagtacaacttgaaaataagcaaatttcaatttaaaaaaagccaatcgcttaaacaaattttctttataaaaattttaaattttgtagattaaatttttatgaaaatttttcattttttatgtatctattttgaaaattttagggtcgaatcattttcgagctcaaaatgtgttttttttttgaaattttttctttaaattttttacaggcttgaaaatctttttgctttttgtaatgctaattgagcatgttaagagctttcgaatgattccaagattgttggatttggatgccaaagaaaaaagctttagtggaaaaacttgctggggccgaaacgccagcgccgaaacgcgtgggt

SEQ ID NO: 4590 - DNA, 517 bp, Heterodera glycines
tgcaattatttaaaatgatgattgattggtggtgaggaaggagcctgtggaatggaagcttgaaatggtcagccttcattaggcggtgatttgccataaacactgtgcatactagagaccggcgcggaaagttgtgtcatagagtgaaaattcgttcacagaggttttagaagcactgatcacgattttgacatcatttcaaccaattctgaaatccatttcacaggtttaaagattgggcccagaaaacccagagggaaacctttctttttcaaaattttagtccataattacaggggtttttgagtcggggcacctaaactgagggtgtaaaaaattcttttgggtcaataaattgcagacaatgattcgtcagtgacaggatcattcgaatttggtttggtccatatatccgtttttcgaacttttattcacatacaatatatcgacaatttacacatcacaatggtatcagcacgcatataaatatatcgaatatttggcatcgtagatatgt

SEQ ID NO: 4591 - DNA, 2675 bp, Heterodera glycines
cccgcattttttggaaaatgcgggatttgcgggattactttcgcgggatcccgtcccgcaaagaattttgagttccagtcccgcagcgggatccgcaaatttgaaatttccggtctctagtgcataccctctattctctctatctctctctatcactttatatctttctctctctccccgtccccttctctatccttctctctctctctatttccgtctctgttgtcccctaccggctccaaaaacgaaatgacacaaagaagtgcatacaaaatgccaaaaatggcgcaaaaaccgagtacaaaagaaaacatttaaattgtccaaggtgttgctggacgcgataggaggccaaccagaaagtccaaatggtcggttgttgttagccgttgttggtggcaccgttgccggagcattggtggtcgattgggtgtttgccaacggggaagaaaaggtgattattattttttattttttttttgaaattatatttcgttttagaaatgtgattttatattaattaattaactaattattatttttttatgagttgagaatttcttaatttaagaaatctattgtattactagagcccgtatttttcagcaccaaaaaatgataattaagcaattaggtaattttcaaatcaaaaaatgctaaatcaagcacgaattaagcatgaaaattgcaaaataagcaccaaaaagcgaaaaaggcataaaagtttggtgcttttttggcaaaattttttatcaaatattataaattctcatttttcattttcgcactgacaattctcattttttagaaaaaattgaatttttgaatcaaaaattttgtcaagaaaaaaaaattctggcgatgaatttttcagaaaactttccatttctttgggggtattttttgaactttttaggtccattattaggggtgtaattttcgtttttatttcggggagaaggtattttagtcaaaatttaaaaaaaaatgtcaattaagcacaaaaataagcactaaaatgctaaattaaccacaaaaattacatgctcacaatcagcattaagcaccaaaatatctatttaagcaaaaatcagaatgaaagaatctctggttttcaaaattggtattaaaaagcaaaaattttcgctgctatcggattagtccctaaatgagacctttgccagaaaaatgattaaaaaaattttagtttggatcaggcccttagccagcagaggaggaagtaacgaagaatcccccccccccccccgccccccgccctcccggaaatgaaaaattaaaaattttcatgaaaaagatgggcaaattttaaaaattcttactaattctaacaataaaaaattttctatatcccattataccatttttttttgaaaatttgaccccaaaaatcgccaaaatttttgcgccgaaatgcataaaaaaaatcttcggcttccccgccccctccttatttttttttctggcacaggcgttagtggaaattgcagttatattactgttattcaatctgtcgtataattaattttataaattcgatatattttatggccagactcttcattgggcccacaacacaacagcgggtgccggcaacattgccgacggcaattggcacgcggcaaaagtgcgtcgccgggggcgaactgtcagcctttccattgacggcaattggagtcactgtagggctgcttaattacgtaattaggaaggcttttaccctgtttatgatatttcgcggattttatcaatttgtcaattgaaatttttcaacaacgtacaattttctgtttaaaattgaaaaaaaaagttcataattttggctgacaagaaatttaagtttttaaagagaggcagatttttctaaaaaaaatttttgaggtaacaaaatgctttgaaattttattcgctgattgataatctttattccaatgtattttcctggaaaatttcaaatcattctgacaacaatagaaaaattttactaaacaaattgtttaaactctgtaaaatatttatgcccaaaaatccaggccctatttaattattatgcctagatcaactgaacaacatccaaaacactgttctgtccatcgacgatttggtgatcggtgtgccgttgggtccgcctcgtttaaaaagtagtttttttcaccgaggatttcttaaaaaattgtaaaattctcatttttttagaccaaatggagcattttttcaatttccatggcgatttgcgtcattttactatgaacggctttgacttgttgaagctgtttgggccaactgcaacagctgtcgattttggaagcactaaaaagggtgggccaaaatttgttaaaagccattccaaaaaatcttttttttcttttttggcattctgtttttaatttttccacccaaattggcccattacccgtcgctgaatggaaaatgccattttacctccttgtgccaaatcctggggccagagcagctactcatttaaatgcatatgaatggaaaaccgggggacgcccaatttatattttatggcttaaacaaaaagactttttggcatacttttgcctaagagcttatgtattatttttatttttaaaattatttatttttataaggggaggtttatatattttaatatgctgaatttaaaacggaaa

SEQ ID NO: 4592 - DNA, 4011 bp, Heterodera glycines
gatgcccaaagggcctcagcattctttcttcatacaaatctattaggagggccaacaaattgcattgcacaagttgttttttcttgttttttaaaatatttttgtgttcaatacaataataatattattacacaatatttatatatttaaatttctgaaatatttttttaagttaaattacaataataaaaacctttgtttttatttatttttttatttttattcttgggttaacttttggacagtcaaccatcggatatatagttaagatggggaataaatcaaatttcttttatcctcttgagacaaatgaatcaatggataaagctgggttaacggaattatttttttaggatctgattttatagaaattttcaatctaattgatttaaaatcagaatttcttcattttttctagctaaatatttttcgtttattttttattatttattaaattattctgctttaaataaaccaggatctggtgtccagcagcaaaattcagatcaactacattccgcaaaaaaaattctggattggaaccctgatttttatgagcctgatccggataaattttccagaaaatatccggggctctggatctgggaaaaaagattaatccaggcatgactccgcttgtccatattctaattattaaaatttattttacctaaacattcatctccatgattttgtctcgtccaaaattttctcaattttagtcccccgcccaattttccgaaatcattgccaccaaattttcacagcggccaataaatatttggcatccgtcaatatgaaacaaattttcgagtggacactgtgacgccaaaagtggccaaaactggcctctggccatccttctctacctcattattattcacctccccccccccccgccccccgctgacccccgaggcgaaatattttcctcaaaagtgccgggggcgctctgctgccgaaggcaacgaattttgccatatgtcgtccacccacttcaattcaaaattctctcaccacagggcatcaaaatgatgacgaagctgtcgatgatgatgatgatgttgttgtcggtcgaaactttggcacttattgagcaaagtgccatggaattgggacaaaattggaattaatattttgctataaaaccacatataccatgttcttatacaaaatcaaagtctctgctattatttaaattttttttttattattttagttcgacatttatttatttttttttaaattatatgcggtagaaatttgctacttgaaatttttcaccatgaattcctaaaacccactgccctgaaattttccaaacctatcccatttcgatgtacaaaatttttttaagcattggaattctgtttttcgatttgcctattttctgccaaagattttgtaagacacctggggttttcggccactccttacttataaatttttttcgcacagaatttgaaagctttaaatttaaactcgaaatttttaaatttattatgcccttttcgggtggtgccattttgctttggcattagctggcattattagttaataatgccaaaaataaaatgccgatctgctgtgcatcgttagctagaccatccatcttttttggcattttgcgagtgctgctttctcacaatggcacctttccaccaccgcagacaaaagaaatgtgtgtgcccgggggcataacatcaaaaagtcattgctcatcatcctcatcatcccctgaggggagctttatctgtgcttgctcatctctctgacaaacggcggaagggcatatgaagaaatgccaggggggaattttgtgtttgataatccctcctgtgccgtgctggccccggcactttttttaaaaccgttatttgtgctgccattttaaaaattttcatatgccattttcctggtgaatattttgtttatttacttctctgtttatcctgtctgaattttttttttattttattctttcttcattagaataataaaataattttaatcactttataattatcaattccaatttttgtgtaaaaattttagaaatttttaattaaattttaatttggcgtttttttaaattttagtttaataaataatttaaatttttctttaatctttttattttattttttaaatttcattaaaaacggcatattgcaaaaaccttaaaatttcataaattaattgcattttttaaaattaaattataatgtcttttggtgtttttctaaatttttagtttaataaataattatgattttttttataatctctttcttttttaaaaataatttcattaaaaattgtaattgcaaaaactaaaattgcataaattagttgttgcactttttttccgcccatcaaaagtcgatcaattcctaaatgggcttttagctgctcaacctttgtttttctcgtcttctccaatttcttttcaacatttggcacgcaaaattgtgccattgaggggattatccattatatgtgggtggggtgtgccaatgccgtcgggcgcccccggacgctcattgtgagaaaatgtcgcgcgcatttttaacggggtgtgcggccccggagggtgggaatgatggatgggcaatttcaggactaaaaaatacatattcccccgcctaaaaaaattagttaaattttatttatttatcaatttgaaatttatttttttttaaagatacacaacgccaaaacggcgttcagagcactgaaattattcacgacagcaccaccaccacacaaaagatgatcatgaccaccaagcagcatcgaattgctgacaaatatgaggtgggttaattaaattctattttgttaatcatattaattcctaaattaatccttacaaaattaaaaaaaaaattttttttaattcacagtaattaatgtcacttgttgcaatttaaattcattaacaacttaccaattcccgagaaacaattaacgaataacaaagaatggacattttcacatctttttaaattgttcattattcaaaagaagggattttggtatccaaaataatggaacataaatttttggaacttaacgaaattttatgacttaagcctattgaatgattacaagaattaaaaatatggttgcggttgttttttttttgcaaagatttataagcatagattttttattttaatttttttttgagcaacgcccattttgatggttttagagtgacgtcataacatcaagaatattaataagccgcctcctttccatatttggcacttttacgagaagtgccaatgccaatttgctttcctatcaatttcaaattcatcaacatgcttgcttcttctctgctttgctgggtcacacctcttcatttaggagggggcggggaggcgggtggcacccaaccgaaaaattgggtcccctctcaagacaaagtggtgacggcactgtttatgttttttttgccaacccatttttgttggcacaataaatgctcctcctccgcgggagggcgctgtgtgccgtcgccgtcgccacactggcaaaagtaattaggacaattcgtttcccgctcctccccgcacttgacaatgagggacgggacaccaccgcgtcacacgccgtgccgttgggggttggaaattgtggcacctgataattgtacatttgtcataaagttttaaatcacgctggagaggctttttttggggtgctagatcattccgtaaaatccgccattttagctatttttgcaacaaaatatggcataattttgtttaaaagtaacaaaatttttatacttggtattgttcgatagcccagtttttatctattataaaatttcaaataaaattatcaaatttaatataagttatggcagaaatagtacatgcttatacaattttttcgaaagttgaccaaatttttttgaaattttgcaggtaaatgaagggaaaaaaaaatctcgactatcgaagggtacaaagaatgttaaattttattacttttaag

SEQ ID NO: 4593 - DNA, 3194 bp, Heterodera glycines
aattgagaatttatttaaaaaattattagattttagctcgggagggggcctcccttggatttttatgagttcgtaattttcaaaataagcctcaattttgcttctttcttacccatagaatcttggggataaaccttcttttttttggttaaatcgcgattatttagatttatagttagaaatacgctttaataagcactgaaaatgagttagaacttccttaattttttgtgccgttttttctcattttttgccaaatgctggagttgatatacatttccaaaaaatgaacataagcaataaaatacaaaataaataaaaaactagtagttcaaaaaatatggccacatttttttgacaagaattttgatttaaaacatgtatcttaatacgatttgtcctaattttgttgctttttgaataaagttttgttaattagtccctaaatttataaattaatgtacatagtaatattctcttcttattctggtaggtgccttggccgtggcgcatttggccaagtgtttgtgtgtttgaatgttgacacgggcgagcagttggtggtcaaaaaagtgccattgggccacacaaattcccggcatcgccagcgtgtgctggccacattagagaatgaattgaacgcgctgggctcgttgcgtcacgcgcacattgtcaattatttgggcgttgtgcaacgcaaggattgtgtgcacattttcatggaattgatggcgggcggctcgttgaaggaccaggtggacaaaacattctattgccaaggggggaagcatccctcgtttttcgacaactttttatggcattttctacttagcgcttattcattaaaatgacatataatttgctattttttcattgggattttatactgcaaaattgatggcaataatacacacacatgcagttaattgttcattcaagcgattaatcctttatcaataatcctcaatcagatcagcgagtatggcgcgcttggagagccggttaccattcggtttaccgctcaaattcttgacggtctcgcgtatttgcacgcgcgtgacattgtgcaccgggacatcaagccggcaaacatcctacggcacacgcatgcgcacgtcaaaattgccgattttggcgctgcaaaatttttgcaggccatttgcagtgaccagggcatcgatattcaggcacaaaatgcgcaattaaataatttattaatttctttattttataacacaaaaaataacttttttttcctctttgactgaattccattaaaaacatggtgtcattcgatagctaataacagactctattagccctcggatttaatggagcctcccgttggcaactctctgctgaaaatttaatggacctaattaactcaatgtgtctactacaattttgtcgtacgttttcagggcaccccacactatacggcgcccgaaattttgcgtgccgacaattgtcgacaatttgaaccacggtcagacatctggagtgttggaataactgtaagcaaatgcaaaaaatgagcccatgagctatttctaaaaatattaaattttcggtggtggaaatgatgacaacaatgacaccatgggcaggcattgatccagcagcggtaaaaaaatacattaggaagggaaatgggaggggatattgtgtcgggacaattggtcaatggacaatccatcaatactggacaatctgatagaaaattatatttttaagaggctgaaataagggcaaaaaacagtaaaacagagataccaaaattaaaagaaaattcttttactaacaaattgattttcgagcagtttcttcatttgtctttcgaacgaaaaattttattttttgggatttttttattgaatttttagggtgcatttttcaaaatttttgatagttcgatagagggttcatatttttaaattttttgcattttgttcaaattaaaaaaagcggaaatgaggcacgtgctttcgcttgaaggaaaatcgtgtcattgaccgagagtctcgacaagcaataaacctttattataatcttatttgtgatttatgatcaggttcaccttcgcattgtctttgctcgacctgatctcagctcattgcccgatggtttatcaacggcactgcgtgcgtcaattgaggcaatgcttaatagtgagcctgatcaacgaccacaggctgtgaagctactgaaaatgccacctttctgcgattgagagaaatgccataatatgggacaaggaatctgaaattcacaagtcaaaatagttgttaaaaagtttcataagcagaaatagttgctaaaaagtcgatccaaatcgaaaagtgatcgaaaaaaatatgttttttgcgcttatctcagcttatgctacctgcaaaaaaaatagatgaaaacctaaaatccgttccctgtcaataaactattcacatgttaaatcaatggccaatttcactttgtcctcgtcgttgttgtaaaagaaaatgccacctttctgcgattgagagaactcaatcgcaatgccataatatgggacaaggaatgtgatttgatgcctttgtttttcgggttcaaaacaacagcagccggtgattcattcattgtctttttcatttggtttttaatgttaattcacttaaaattaaattatttgctatgtgtacaatttatacaaattcatttactcaagtgagggagacgtgttcggggatcctccagacgacttaccgtatttgctctttttatatgccatggtatattatttttcaacctcctcagaaaggggtagataattggagactggtagactaaaggagactgggagattatttttcggctgatttatttagtggaaaatttttgaacatgtcgccaaaaatgtcatcgcgtcaaaaaaaaataatttttattacatttttgttaaagaacttctgtaaattgaccccaaaatggcaaaaatgggtcattttcttgcttccggtatgcataaaaattagaaaaacgaatgagactcgacggagcaggtcgcccagttcaccgtccggacatcaacactaaacttgtggaaacggtttttatccctggcggctgcaccaaattaggtaatcctgcagaattgcggtcccgacgaaaaataaatttaaaaattttgttcttatctttcctggggtaaaagggggtac

SEQ ID NO: 4594 - DNA, 1212 bp, Heterodera glycines
attctctcttaaaatcctccacaccgctcttttgagagacaattcgaagtgttgccgaacatttgcggctccaatttccatcttaaagcaaattaaatgctaattaaatttatatatattttagcttatttcataacataaagaaccatgctcgcctaaatttatgggagtcgacgttcaaaagctttaataaaaaaatattagtgtttgttatcaattatcatgttaatctctccaagcgcatgtattgaaacattttaaaattctaaagcaaacctttttcagaagcgtcgcacaaaagaaaaaagctcaaccatttcgcagtgctttcattttaatttctgcccatattttccatggcattctctttatgtacacagttgatttcttgtgcaaatttcgataatttttcaatttccatcgaaagtgtgccgttggatttggatcggaattctccgtttttgcctcgtccacaatgacataaatgaccaatttcactttgtcctcgtctttgttgtaaaatcctttgctcggatccaacaattccttaatttttatgatttaatttggaaatgcaaagaagtaagaatttaattgtgaaaaataaatttgattgaattgtcactcactgcaaaactaatgaaatcatgaaatccaaaactgtttagttctttattataaatgcgatctcaaacaacgagtctaaaagccgaaaattttcgaatttctattttgtctaaaacttgtctatgaataaatgaatgtttaaaaaatgtatgtgaaaagtaccaggtaaacttaataaggaccttaaatattcattattaattatgagcagtggacaaaatttcaatattttttcaattaattcaatcaaatttaatttcgtaaataaataagaaaagatgctaaaaaattaaaaaaagaatttagtaaatgtaattcaacttaaaacaaaaaaagtaagtttttaatgaaattaattattttttatcatttaccatagtagttaacctacagctatcttcgtcatgattaattgcttttgaagtgacagctggcctttgaggcgtgccgccgcgcgcgggtttaccgcacgaaggcgtgcctgtggcacgggttcgtgcgggagggaggggtgcgtgcgagagtgaggggggaggcggcgcgcggttttaccgcgcgtgtggcacatgggtccgaaagtggggg

SEQ ID NO: 4595 - DNA, 3401 bp, Heterodera glycines
aaaagtttttgccaatggaattctgtgggggagggggtgggtgattaatgatttgttgtatgggaggggggggggcttggtggttcgcagcgcagcagcgaggaacggcgcgtgcacatgtgtgtctgtgtggtgtgtgtagggagggttagagaaatcattagagagtgaaggtaaaagtgagagagtgagacagcgagagtgaaatgaaaagtgcaagagggagagagtgaaagagagagtgagagaaacaaagagagggtagagtgatagagacaaactaaacgatgaccaacaagtgaacgcatagtggacattattagcgtcatttttcggaaaacggggggggggatgactgcaaatattttaattatttttctcgtttttttcaggtcaaaaaatttttactcaaaatgtccggcaatttggttgtggctgaaagtgacaccagttttgacgcaacaaatttgaacccgaggtgtggggggggaggaggtttaaattgtacaagtaataaaaaatttttttttcaaattaaagacgcaaattgccagtggcagtggtggtggtgtcacaacggagcgtgacaccgggtgtgacagtgtgttgcggagtgcaaccaagccagcattgattaaagtgcaggtacactttttgaaggagcttaaaaaaaagaaagccctaggattacctttgtcaactatcatttttttccaagcaggcacaacaatgtcgtcagatgggcaaaaggacgggtggcgcaccccgtggaccaaaaattgtgccaaatgcatgcacgtcacccgagcggaaaaaacgccaaaccaaacactacaataaactaaatcgacccaaagtaagaaaaaaaaggaaaaaattttcattttttttgaaattttgagatcactgtatccagcagcgccccgaatgtgccgccgatcattcgctctcttgaaggggagcgcagctaccgcgtgaaggctgttttggcgacctacacccatagcaacaatagaatcggatattacgtagactggcttcgtaagtggttgggatgaaaattaaaattttttttcatttcttctcatatttttgtctctatttgtttggttattgatgagttgtcactgaatagctcctccataatcaaacagtccggggtttgaatgtttgttgccgagttgtctttgaatagctccgcgcaagcgttttaagttccgttcctccttttcatctctctctcttctcgctgtctctctcaattttaaatttatcacagtcctaaacactgtttattattaattaggtgcgaggggccaagagagttgggtgcagagcgagtcgtgtgattgtatggaactcgctattgacttcacaaggaaggcgaatgtccacgatgtgttgcgtggactacttggcgagccaattcccgagagtattgccaaggaagtgatggcgagtccaaaattcgtagaaggtcatttttttttgaattttcaaaattattctttaagtttgtaatttgttgggccgggaccccgcaacagtgctgaaaattgacgacctgaacatttcatttgctccatcactcaatgtccaggacattccgtacaaaaaagtattttggaagcgccggcacccgaggaaagcgacagtgaagacgaatgaaaggaaaaggctaacacataacaaattcactcatttttaacatttctcacaaatttcctcttacaaaacatttctcaccaatgtgctcttacaaacatttttcaccaattttacaattttaaacagaaataaatttattcttacatatttataaaattagtcgaaaataatgacacaattaatgttccatgtaataattagttagagctttacaatatggacattttttggggtgttcagaaagggtcaaatgataaattaaacaatttcggcataggcctacatgtccacactgcccactgggcagtgtggacagtgcagaggcagagtcccccctcagatgggtaaaaaagttttggggggtaatggacggctcccaatgggtccccccatcgaaaaagagaccgcgtttctcgcccttcttgttgcgccgcctccaatggggttcgtgccgttgttgcttgacacatttgtaggcgcgtcatcggcccaaattccatgctgatgcgcccatggggtagtcccatacgcattctttctctgttcctctcccgtagactttcgcacggcctgcaccgaaccaaatggcactcgctgcatccttcaacagaacaatttggttcaaaaaattttttttcttttaaatctgcattacttgcaactccaaaccgtgatggagcaattgaagatttgcgacgggacatttatatttttagagggcttgtgtaataagacaataaatgacccttccactcgccttctccctctccaatcccatgtccccctccccccactcagtgtctttgccagattcaaattcggcaagccaattaatcatcaccccagatttcatctgaagcaaacacaaaagaatttgaggactgtctcaaaaaaaatgtttattatgcagaattaatattaattcaaattatggattgtatcatcaaaatccattattgtcttttggtcaaagttcactttttcttcaatggcgccaaaaggtcggttgcgcggcagttggcccacacgcattcctcacacatctcaaagccgaaggcaaaacggtccccctccagacgctttaccttctgctgattgttgtacagacgattccaatcatctcaaaatttttaatcaaaattaaaatttgcagaaattattagtaattattaccatgacacaaatatgtcgtcagcaaaaatttgcccttggccaatttccacaactctcggtcctccactttgcgtttcttcgttgccgactcgtcctttggctcaaaatttttgggggtctcttcatgtggcttgggcgccttgggaccgattatttgatgttgctcagtagaagcagcagtacccaggtgtccgtgggatttccgaatgaaactttgtgggtgaatagatcacctacgggttcttaagaaaaatggtgtcaatgtatcgcacataattcggtgtcaggagcaacgacattacttttggcatcgcggaccatgtatgacgcaatcagctggagtgattagctgccgtccaacagcagagacaaatgccctcgcgcctcgaccccctttccgtgtgggaagccgtgttcgtattgaaaagctacaagcacgtgttcaaaaagggctaccttcctcgcttcactgacgatctgttcacggtggcagaagtacgcacctcacgaactgccgatcacctacaagctacgggatgtcgtcggtgatgtgctcaccg

SEQ ID NO: 4596 - DNA, 4616 bp, Heterodera glycines
  misc_feature (3053)..(3053): n is a, c, g, or t
cgtgccaactgactatttggccgagtcgttcagttggaattcgctgcgattgtcgtaagcctttttgacgcctttgtcgccccacagagcgatcagtgcgtttgccaccgcatcagtgaacggctgattctcctcgccattctcaatgacacggaaaatcacagctttatgattctaaaggaattgatcaaaggacgaacgaaaatgggggagaaaagcgatcggtagttcaatcagtcaataagccatcgataggtcaatcaatcaatcggatcacctctttgctggcgtcttccaacggaatgtgcagcaccgagtccatggccttgagaatggctgccattgaagtcactgaaacagaagtaaagcaaaaagaaaaacagagaaatgcaccggtgttggaatagacgacggaccttaattagcatcattataactgattaattaatttgtcatccatttgtcttctcaccttcgctcattaatttcctcctcagtgaatccattgctgtgcaaaatttgcatctgtttgagcactgtcgacttgccacattctccggcccctgaacaatgctaagattatccgtcaatcattgactgatcactttagtgttctgccatcactaagcgattactctgataacctttctatttaaatacactcagataatcaatcggtcgaaatgttcgatcatttttataaaatcatcctttttttatcacttattttgacaatagcccttttctgatcactatgatagtcaaactaatggtcctattcttgtcactctgctgatcgttcttcttctgatcattcccatcactttgtcgccccttttccttacccaacaacaacaatttgatgatattcgatgccatccttctgtcactgctcagttgcttctcaatggctttgcttttggagatctgatcgcgcacttcttcgctttgacaactcgccaacattccgcccattggaggaaaaaaaatgccaaaatgaaaaggaaacccgaagggggagaagaagcagaggagaaaagtgaatttgaaattaaaaagtcagtctgaggaaactgaaaaataaaggggaaaaaacttgaaattcaaattcaaatttgcatttctttggggaaaatggacgaggaaaaaacaaaagcactctgtgaggaaagccaaaggaaaagggccaattcggatgtaaagccgagaaaaagtgaatgagcaaaatgaaaatgagaagcggcggcgggggggggggaattaatgaaaaattggcgaaattggcaatcggagaacgattaacaaaacaacggacaatgggaggagtttaatttgggattagaatcaattgcagcgggggcggagaaactttaaaagaaaaatgccaaatttgttaccaaaaaaggggggggggaaagtgacagacggacgccctttgtcggtgtgacggtcagctgattggaaaccgaatgtctatattcttccagtgtgaaacgatcttagattagacaaaaaacccaaatggttttgaataatttcgagaccagggggatacttcgggattgaatttcggttattaaaaacctgagatcattgagagtttaagggccaaaagattggccaaaagatatgccgtaaaaatacaaaaagtgaaggaacatttaacacggagaacaaaagccaaagaaggaaaaggaaaagccaaatttgtagacggaaatcaaacttattaattaattagtaaaatgaaagcgaagtgcgcaattcgaaaaaggaaagaacacgcgaagaaaggcaaatggacgaaagtggcgaaaatggccaaaagtgacggagaaaagtcaaacgaatggccaaaaacgaatgggggggggtaatattggaggattgaaaataattacggaaataagcggaggaggggggggcgacggattaccgaagagagcgacggcagcggaagcgcacagcgaaagaaagagccaacggcaaaacaagcgaagaaaaagcactccggcactttattgttgggccaaatcgaagtaaatccttcccaattggcatcggcgtaccatttcatttttcattcagaggagcgccggtgtcagcggatggattccgccgccatcgatgacaccgcaagtaattaaagcccggagggaataaacggacaaatgggagggatcggatggaccaatgcagctcattagcatcccttttgtgagcaataaaagacggctaagaagcaagggcttttgggtgggaagagaaaaggggggaaagtaagggaattaatgggagaaaaaaggggaaacaaagtggcaaaaggagggacaaatgccgaaatcgactggtggggacggcaaaggatgggttcaacgaaaagcgattgatggaacaataagaccgaaagtataggcagggccaatgcggcaaaaggagtgatccgctaacattggaagatccgtcgcagttcggcacattccgtcggtctaatcgacacgcaatgagactgaaagcgattcccttcggcaccccgccccatcagtgccccccagggctttcacaccgcacaattacctcccccccctttctcccatcaattcttcccacattcgtcccaccccaacattttttatgtaataatcactcggcgtattgccagggcaacgtcagcagagaaaaggtaataaaatttaaataaaactgccgaaattcgaacaacaaaagataagtgggcaaatgcaattgacgcaatagaaaattaagtgaaattaaaaagaaatacgacgaaaagcgacgacagacaaagggaaaatgggccaaaaaagtgataagtgaatggcatttccatgctcacattttcatttctcagatatttttctttacttttttgcacattggtccgatttggtcggcttgatccaattgctgctgcaatttcgccaattttatcaacgatttgcagaatttgttatataaatataaaatttctgtccattcgtccaattgtgtctgatctgtctgcttcttttccgttctgatcactctctccncctttcttctttttcctctgcttctctgtgccctctctctccgcccttttccctccgtttcacttcctctccctcccttttgagttcctccgtctttgccttccttttctccctctctttctctgccctttcttcgtatttcctcttcagccgttcgaattgcgcctcataagaattttccccgttcaaatggcgatcgaccgcaaactcaaaaagtgaaagcaaaattaaatcgcaatagaaattggttttaatttaaaatgtatccgttgtaatgatttgtgtctttttcagtttagcccccctttctttgatctatttattgtccctaatttgtgcagcacatttttattcaaattcgctatgatcaaacccacttttaatcttttgtaggcaatttggatattttcatgcaaatttctcgactcgtggacctaaatttttgaaagtaaaataataaataataattttgtttaataattagttaaaaattgtatgcatttaaaatgacaaaatatgtgcataaaatatgcactaatatatttgaaaattaccaaaagtcgaccttcagggtgcatttttcggttttttgcctttttcctttcaaatttaccaaaaaataccaaaataagctctaaaattcaacttaatttaaatgcataaaaaattaaataataaaaattaattattaattcttataaaattaaaatgccattaaatgagtgcccactttgactacgcaattcgtccgcttgtgcttcaaaatcactgcgttccccgccgaatttacgtttgaccctccggggccccaccccctcacgtgtttttcttcgcattcttccggaattatctcgggcaatttgtaccctttgagacgtttttttgcgacagaagtgctggagaatctcacaaaaatgcgaattgaaaacatttaaaacaaaaaaaggaaataaattaaaattgaaaaaaggaaaaataaataaaaataaatagacggataattaacaattttaattttgattcaataaaatatcattggcattgcgttgattaattaattcaaaagttaaacaaacacccaaataaattgggagtagtggtgacttggcgattattctttgatacattttgtacaataatttttccgttggcatttgcccatttcgctttcatttctcatttattttgccattctttctccatttctttttccgattcgcttagtctcttttttcttcttcttctggcgttttgtccgttgtgccataaatttgaattcgccgtcctttccgacctcctttcaatggctctcttttcccttctgtttcttccaatttcgttatcatttcgctgtccgtcgttgtgtaattgttgtactcgtagtaaaatatggccaaaagtgccaagatggcactgaccaccaccattacgacggcatagaaaaggaattcgaccgcggcgtttggaaagcgatcaagagatcagcaaaatgatagtgtcgccaattgcggggttcatcaggctaaaaggtaacaaagaattgaaattgcaaatgaaaataaa

SEQ ID NO: 4597 - DNA, 945 bp, Heterodera glycines
accgcgtggaacacgcgcttttcagtccgtggagaatttggccgatcgccgccagtggacaaattccccgtcacagcgagctaaaaaatgattgatcggatgatataaatcatttgatcagtttggtttttgttggtcagttcttccaatcaccatgtaaactccgccttgcgtgcccacttccaattcaatgcccgtctcagtcaaactcattgtcagttgctcttctctgcccttcgtttcgtgcccaattacttttggccttttctccgttaaaaacagcttccatcgaaaatattattttttaattgccattaatttactgattatagtcaattaaattaattaattacctccccgatcgaacagatttgtaggcataaatgcttgcattgtgagtatttgttcgtccatcgtttggccatataaatggacttttgctcttcaaatcacctttatccacttcccatccgacaaaatccgccactctgcgcgggtcgcaaatgaccgcactttcgttgctctcacgcggattccaacggcacaatgccaaatttccgccgtactcgacgtcctccagtgccaaagttatcctgtcatttacatttattacacaaattctgctagcctgtccttcgaatttgggcatgaattggcacttccctcccgtcggcttttccctgtccatcccccctcgcaacgggcgacggaaggtaaattctaagggacgggcagaagacaaacgctaaattagcagcttaatgaacccaaacaaagcaattaactgagaatagcagatcaatgactttttaataaaaatggaaaaaacaaaaacaaagaaacgaaacgacggccgatgacccccgccccgccggtgagtacgagatacgccgcaacccccagttcaataccccctaattattggattggcttttcgtgtttttt

SEQ ID NO: 4598 - DNA, 2798 bp, Heterodera glycines
cacttccctcccgtcggcttttccctgtccatccccccttggggggcccccccccctccaatttcggcacttaccccactttgaattcgcccttccctcccgtcggctttagcgtgtccgtctcccaaacagaacgcccattcgactggccatcatccaataagtgcgtccggcactcaactcccggcccacctctcccccgaattgcttccccccgcagtctcccccctccccttcaaagtgccactttcgctgtcccccgtccaattcgaacatttccggcctttctctgttcgtatttgtcagtgtctaaatgggttttgtgaatgttgtcatcctttgtccgcttttgacttgatttggctccattattcgacacttttctggcccttttccattctctgcgcacactttcaaaatgcaattgtcaaatgcgttaattgcggaaacaaaggcacgcccatccattggaatgtccggcaaagtggtctaaatggacacaaatgtgaatttaaacggacggccatttaatcacattaatttggaattgaacgatggccgaaaggacaaaggcgagggcggcgaacagtccgccggccaccattttgcggaggggactaattaaaattaatgggccaattaggaagtgcaaaacaaaacaaaaaacaacgcacgtgattttggcaagaagagaaaccattgggtagacaatgacttggaacattggaatgaacagcagaatgagcactgagtttaaggtgagcatctgatcgggcaacagaagggtgtcgccccacaggcgacagtccatcatcacctaattagcaaattacaaacaatcattaaggagcaattagcatcatttgaaagagcaagcagccccaggcgatgaccgaccgattgaatgagccaacgcgacccctgctgatcgtacaatgcccagaaaacgggggcaggcaaataaacgacgagcacacggagaaggccccgcacgtcggagacgaggcgccgctaaaacaaaacaatcgaatggccaaaggaaaagcaaagaaaagaaatggccaaaaaacaatcggaagatttgctattcgccgctcactttgtgacattcgttcggattgtccttcaaagtgcgcaactcttcacattttgggtcggagtcgcacaaatgcgagtcaaagtaaaagtcaagccaatgcgaaccacgctttttgttgcctttgcttcgccatttattcacaagcgctttctgtaacactttgtttattttttagaaaataaatgaaacaaaatgccaatttacaaaagatttccccccgagggaatgccaaaaagaaatgactaaaaaatggcactcactcactttgccaacttggtacacctcgcggaaaatgttctccttcggaggcctcttaatgtaccaaaaagaggcggacatgaacagaactgaaagagagcacaaattgcttttgtaatgaaattttgattttggcatttcggccattaattaattaattgccccactgactcgtcgccaaaaccattaacgcggcgggaacaccaaaggacaatgggtagcacgagtcctggcccagacagggcattgctgcgaataggaggaatacggtaatttcactctcagaaaggggtacggtaacgaccacgaaacattggcgaaatgaaagtggagatcattgccccggcattgattgcgaagtaaaaggcggagaagaacacggacagcatcttctgctggtgcggctcaaactgatcgccgccaaaggaacaaacgcacggcttaatgccaccggtgccgacgccgattatgaccaagccgagaatgtcgagaaaagggtggagggaagaagtgccattcaaagtggaggcgaagcacagcacacattggccaacggcgtacagaagggacaggaaaaagatggtcctgagggaggggagggcagagcagacaaatgcgaaatgccaattcaaaaatgacaaatgccaatgcccacctgaattttccaagatatccgtccgcaagaattgatctgaatttggaaatgaaatgttgacatatagttatttacgttaagcttcgaaaattagaaaagatagcaattcctagttttgtgttttttcgtttttaagtgaataattaacgaaactgtattttgttactttatccacttggttcgttacaagaatattaataaaagttagtttatactacttgtatctgttgagctgtaataacgcttgaatcttgcccattcctttaataatttcccttctaagcacactcatttctatataagagtgtttggttttgaataactatataaatatcagttagtttttattatttgccgtaaatctctgtaactgattaacaatttttttaaatttaagtagtgagagggaattataaacattatattcgtaaggaatagttatttacgttaagcttcgaaaattagaaaagatagcaattcccctccataaatttgtaggtgttgttttgtgttttttcgtttttaagtgaataattaacgaaactgtattttgttactttatccacttggttcgttacaagaatattaataaaagttagtttatactacttgtatctgttgagctgtaataacgcttgaatcttgcccattcctttaataatttcccttctaagcacactcatttctatataagagtgtttggttttgagtaactatataaatatcagttagtttttattatttgccaaaagtctctgtaactgattaacaatttttttaaattta

SEQ ID NO: 4599 - DNA, 1840 bp, Heterodera glycines
tcggtggttgtagccgaacggtctcgaatgttgtcatccccgtgctttcgtccctcccgtacttccgatcatgttctccctcgtctcgagcatgccgtcgaatcgggtatgtctgacgctcccgatagtcgtcgttcacgtgagcctgctgcttttcgatttttggttgcatcagtgccggccgatgggctgttgctggggggaacgcccccatctcgtctcgatttcgattgatccattctcgcgctgtgttcgtcactctcatgctggcgacggacggcactttggcacgccgctgaaaaatcccgtccaaattcgacatgacgggtgtcgcgactcgtcccattggtcttcggttgtgttgctgtacaccttgtccgccgttttgccatcgtttggccgccacttggaaggatctctcacattcttctatgttccgattttcgagtggaggtgggtcgtcccccaccggatggctgttgttggtcccgaatgacccgctcaatcgagaccgcgcgattgcttcttcttcatcctcgagtgctcgtcgcatcgttcttaagtctccgatgtgctcgtccgcaatttgaagcagttcagctggtgttggatggtttcgcaactgcaactctttcgttgctgccggcagtggcgctgtcagtaggtcgtagaagaagtcctggtgacctgcgggttctgctcccgctgctgccattccaatctcgaaatgtccttggaagatttgagttgcctccttgagtcctctctccatggccaacagtcgcgccgcttggtagcctgcctccccttcggtaaggtcttggtcgatcacttctcgagcctccgcaattcgagcggcgagagtcccggatgctctctcgattctgtcccgcgctgtccgtaccgggatggatacactccgcaaattgcgtgatgggaagggtagcatcccttgctgatttgtcgccacgcctgtcgccatgttgcttcctctcgttgcttcgtttactctggcaattttttgttgctcttcgttcgttgaagcgacgggaccatccccgtcctgcacattttcgtcgtgctgtgcgccgttgcgatggccctcattcgctgggtccatgttgctttcgctcccgtcctcaaattcgagtcgttgcattttttcgtttccgcctgttctgttcgtcgaccgaaatgtttcgctggagaccccctgctaacggcaccagtttgtcgccaatctttttatttccgccgcgcgcttggggttggggtgggccaagctgaggcgggattggttcccgctcctcttcaccgctctcgtccctttctctctctgctcactccgttcgcttgtcgtaaagggaagcgcacccttttttgccgttcgttctgatgggtctgatgctgctgaccgatccgatcagcgccaaagggggacgagaatgggaggggggaggggtgacaaatttggattggtgcttgagagaattgtgcagcaaatcgctgcttgcttaacggcaccaccgactaggattggggaagggcttgtcggacccctttgactcgacgatcacgggttacgactcccgatccctgcgacagactatccggatgatgtgagaccgcttcaatcgatgcgcgcttctccggcttgtggtgagttgtgctgactaacggtcctgtccttttgccggataatttggcaccgctcgggtcttcctacctgcactgtgctgctcggaattgacgactacggtagtacaccccgtctcttcagttgctcctactggtgggaaactgaactgctcaaattttgccgctacttcgggtcactccc

SEQ ID NO: 4600 - DNA, 3093 bp, Heterodera glycines
acgggtttcgattcccgtctcctcctgtggatgctccggctggcgggagactgactccggcgatgcgcgcttctccggctggtgggattagcggcgacgaacgggcctgcccttcggtggacggtttggcaccgctcggctcttccttccttctctgccctgcttggtttcgtcgacgacgggaattcgccccgtccctacggctgctccggctggcgggagactgacaccgatccgcgagactccggctgcgggagtctgaactgcttgaaattcgctgacgctccgggccaactcccggattctccaatgccaaagggaaaggaactgggatcgggaggattgggggagaacgacgagggctgccaggaaaggaagggggtcaagaggtgaatgggcgcctccgtttggccccgcacgagaatttgccgaatgtgatggagtgtggagggtgcttttccctcctttccgagtcctccaagccgtttcagcacgaatttattaaagcaaaacgaataatgaataaaagcgacgaattgatcgaattgggcgatgggacgggggaattggaggaattggtcacaggcagaccgaatatgaagcggaggggagtggaaggaagagaagagaagagaagagaagagagcgaccccttggccgggggcgcttaaatagacaattttcgaagggggcgggcaaaaggccatgcacgtggacaaattgtgagagagacaaaaaatggacagaaaattctagaagcgaattgcgaacaaaggaaatgggcgcacaaaaattgaatgtgaattggcagatgtaaaaagtgagaaattgtgaaaggaaatctgagcacaaagttggccgaagatgagccaaccgatgagaaagatttgaattgtgaagggatgcgatggggcaaaaatgggacaaaggaacgggcaaaatgtgaatggtacgaaatggagaaatgcatatgagaaattagatggaaaaggggcaaaaattaggaatgatcaattttgaatgaattgatgaatcgggactcgccccgatcttctccaagaacatccctcattctttttgcttcgattgagtcccgtcccgttcatttgtgcaataggcggggattgacccgccttctcgtcgccaatgaaaaaattggcgacacacattctgtaaaaaataaaaattaaattaaattaacagctaaaatctaaacattgtcagaagatgccgtaaaagctaattcctatttctttagccaaaattaaataattgaaagaatttttagatattttaattttgttttgtataattacattttattaaatatgaattatttaatgtacttaagttttatatttaaacaatcttttaaaaatctttaattactttaattacaattttttttttgcctttttacatttatttgtaaataatttatgtgttttaaattaatattattaattcattctctttacttttatattttattgagtaatataaaatatgtacgtatatttgaatttaaaaattttagaaattatcattaaaaatttatgtgaaattttttatgaaataattatgattttaatacataattgaaattttttttaaagttggacaaatcaattaaatttgtttcatttctcgtattgcatcataattagaacatttatcatctgtaatattccttattaattttatttaatttttagtttatcaccaaaccaaaatttttatataagtcttaagtacaaaaattaaatgaatattttgtaaattttcaaaaactttgataaggcgaaatttaatataaaacgaaaaagtgcaagccttaaaacataaaataatactaaaattagccgcacaaaagaatatttaatctaccgtatttcctcgattataagccccggggcttctattgttcaacccccctccaaagggggcttatattcgagggggggcttccattcgagggggggcttttattgttcaacccttcatttctacaaattaatgcaattttttcagaaccttcttttattcaactttttacgaaaaactacgttgctttttaactttcaagtgccaaatacaaatcattttataattaattatggatgcaacaaaaaccttacctgaatcatcgactaaaaaagtacctacctattaaaaaattcttttcaaaattacctatcttaaggtttgctgctactgcagcaatccttgttctggtgcccaccaatgctggaagtgcaaaaaaccttgccatgcgatagcgccatgctcattttcacatgacggcgaagagggattcggctcaaaagtcacctgctgtctgtgctggctcgacgatgacgttgaccaaagtgcgagtgccgtcgtttcaacagaaccaagcagcaaacaaaacgacgaagaaagtcgagattctagacttcggcatgaagtcttcgattcatgccgctagccgccacttcggagtcgaccgaaaaatggtccgtgaatggaaaaaaacaagaggcgaatttgaggaaagtgtaagatgcctgtaatgtcacaatgttttaattcgtttaatttagggccgaatcgtcaaaacgaaaacgtttggaagggggcggaaggaaagttccaaacaggaacttcgaagaagctgtgttccagtgggtgtctgaattgcgagaaaagaaagtgcgggtgacacgaagtatgattgctgcacaagcaatcaaaatgagcgccgcctacgaagacatggaaaattttgcggtaaaatttcgaaaaatttttgaacatttttctcttaggctagtaagggatggctggaaaaattcatgcaccgtcataaattttccttacgtcgaccgacaacagtagcgcaaaaagaacccgatacatacaaaaacatcatcatcaacttcatattatatattcaacaactcatacacaaaaataagtaggtaaatgagaaatattttttcaaacgactaattttcagctacacacgtctacgcggcagacgaaacggcggtttggcttgacccgggtggcgggacatgtgttgctgagaagggctcaaagaccgttact

SEQ ID NO: 4601 - DNA, 2444 bp, Heterodera glycines
acttttattattttaattaaagaaaaacatagtgtttttaattttatgaacatttttactcattttttactggacctttttttacccagtaagtttaattttatttacatttctgaacataatcaaataaatgtaaatatttggtaaatagattcctatcattatatatttttataaatagtgaaaatttttaattttatttcaagattcaggagttggcacgccgttcggcctttactacatatgcatgtttgtattaaaataagtactgacaagattaatcaattttatgtttttaactatcgtaattaaatatttttaaattttaattggcgctaaaatttaaatttttaatatgtttttttgtttaatagcttccagcgttttacattaataaatttttaatattattttaaaatatttttgtcaatattttcaaatcagctggcacaacttgagtttaaataataaaaattcattaaatttattcaatacaattataagtttatttttaatgccttctagatttacatcgttaaatatgcctaggaataaaaattgaatccaatatttaatttaaattaagagatgccaattttttaaagttcttatttagtttcttaatatgttatattatttaattaataatttcaatattatttttcacatttattattcgaaataaattttcatttgttttattattacaaataagaaatttacatttcaatttcttgatcttgttgatctgttaaaaaaaacaactatcaaaattatttaaagcattttgtaatgttatttcattagctgtatattaaaaagtttaatcacattattaaagaattttactaatttgtttgatgttcatgatgattttcgtggtgtttatgttgttatttatattttattctaaaattttaattaaatattctattatattattatttttaaatgtatattcattttgtttacatcttaattgatcatattctgttttatattttcacatgtaaacttaggcgatatcttgccaaagtgtctcatccatctaaataataattttctcgttttatattctaatcgatagtttcaacttcttttctgcatttattgttattttttctattgtatattcgacaattcttatattttatttttctacttattttctatttttagaatttaataccattaatatttgaagcactttgatttctaatgatataataaattctgatgaattgttcatataatctatagtttataattttactttttctcgtcaaaatttgtttcctaattattataagaaaaatatatttatttttaatatttacatatttttcctggattttgtattatatcataaataacttattcagttagtgatattaaaatattacagaatattaattcgtttaattgaatttgttaatttaagttggcatatttatctctttgtttatcgcttgttgctagagttgaccgggaccgggtcgcgaattcccggttttttcaggtctcggtcccgatcccggtttttgaaaaaagaaatccgggtcactgttttgccagtcccggtcacggcgggactaaacaagcactggtgtcgctgacagaattgttaatttccatctttgatcatcataaatttttctgaaaattcttcttaccctctctaggcttaaattcaaaaattttatcccttttccttcttaggcccttttcccaacttttccaattcaaattttttccacaaggccaatttcccattccctaacccccccccccttaatcccgcacatatcccattttgccacctcatcggagccgccccctgcaccgcccacatggactgaagagcctataaaagaaaggacggtcttcgatgctcacctttaccggcctcttcgctttttctctcttctactgccttcgatcaattttcaaacgatcaactgatctttttgtgatcatttcacctgatcattttccttgttttttcacatttatttgtgctttggttttttaataaagttggtatttctaaccaacgcggttcgatcaactctttggcctccaaagccaattttctcagacccctcttccctgtccctaagggaattttgacccagggtctagtcaccggggatgggccgaggtttcgcttttcgcatttcgcctttcgcattattcgcattttttggcgtttcgcatttcacttttcgcatttcgctttttggcgcgaaaagcgacttttacacccctaagaattggattaaattcccataaaatttttcaaaattttacctataaattggctaattttcagtgaaaaactgtttataagtgatcaaaatttccaatttttttccccggcggcgcctatcggcaccgccgcgcaccgaaaactactattttttcttagaaaatggccccaaaat

SEQ ID NO: 4602 - DNA, 1126 bp, Heterodera glycines
aaatgaaagaaaaaaagttggaatattttttttaattacaatttcaattaaaataatggtaaagaaaatatgaagaatattctatcccagtggggaattgaacccaagcgagaaataataaaatcagaaggtttagccacttgaccacttatgcatatgaacaaatgctttaaatgaaaataaataatttaatttttttttctcaaaaaatttctccttcttcaccattccctactgttttctcacccagaccccctttcttaccagtgcaaatttttaccggcggtaccggtactagacaaaccggtaccgatactttgatttttgaaaaaaccggtaccggtaccggtaccaaaaaaaccggtaattaccggtcggtaccggtaccggtaccgctcaacccaaagtaaataacataagatatcttttcattattttccacctcaaagtatgatccgatgcccgccaatttgacaaattttgtcgcttttgccacttgggccggtgcgtcgatgtcacggaattgttgcgggttgctcagagtccaaccacggcctcaatttattaaaaataaataataaaaataaagtttttgtaattcgatttaaatttttgttaccatatgttgggattccgataataatctttaataataaaattaaattaaacatacaaaaaaataataaaatgggacctttgatttcggcatgcccttcttagcccaataattcgcagcaccagcctaaaactcgagcaaaattcaagttaaatttgtttttattcattggggaaaaccaaagaatattttgctaatcaattaaactctcaatcgcatttacatagaaaagaaaaacatatagcattttcaatatcgaaattctatggcaaatttcaaattttaatatctaaatcctaaaaacaaaatatttgataactgtaattaattgtaataaatcatttatcaattcgatatgacatttatgattttaaatttgactgaccacattccacaagcgcttctccggcacatctttggaccgtccgtacaatggcgcgttcatccccgtctgctgctccacgaggcatggaagtcgtagcccatcagaagcacaaagtcgagaagcct

SEQ ID NO: 4603 - DNA, 2645 bp, Heterodera glycines
  misc_feature (2557)..(2557): n is a, c, g, or t
  misc_feature (2564)..(2564): n is a, c, g, or t
ttattttattatattttgctcgactttccgactgtcggaatgtcgtatccgttgtcaatgttttccgtccccgccgcaaccgcagcagtgatcagcagacgcggccttccgcttgaagacgcttctttccgaacggcgtctttcagttcctagtgaaatcaacttatgtttttttttaaatactttcttaaattaaaatatttttaataaaaaatatttttgattaattcataaaaatttgccttaaaaaatctgctgaagtttcgcttctgctctccgccctttgggtattctcttacgatgtcaatgccatcaaagccgtgctttcgcacaaatgcaattgccgaatcgatgaaactttttctgcttgcttttctgaaaattaaatatcaaaaaatttatttcatttgagaaactagggatgtaacctaaagcaaaaaggaaaaaaaataaagaatttaatcaaattaattgtccataaaataatcaaatatttcagataaaatttccattaaaagtttaaataaattgcgaaggaaaattgcacaattgaacacatttgaagcgcagcgggtgccccggtcagccaacacttcgagaacggttaattgatcaaaaatgtttgacccgaaatccgagaatatctttgggaaaagtcgcgcgcgcaacgaaactaacctaagtttgattgtgaaaattttcttataaaaatgctagagggttggaagaccgagaacaaaaaaaaaaatttcttcctgttccttggtgcattttgtaggacttcgaaattgaagcaatggtatactgtatttattcggatgcttagagattatctttgcccaaaactgaaaacatctgtttaactcatgctaaaagaaaacaaccgcaatttttggtcttactttgaagtcatttctcgaaaaagtcgggtgccaaatgaccaaccgccaaatgaaagaagcgttttcagcaccggatcaaaagccttaaaattaattaattaattaattttcgaaaaaggtttattactttaataaataaaagaattatgactattttgtaaagaatttccattttattataacctttagtccgttcactcgagcatacatcccatttggttgcttatcacttggcaaatcggccggattaatggccctaaaattccatttattccctatttaaatgatgaaatgccaaaaaaaaaacaataattttaataattccgcgatttgtcccacttggccgtgtagtcctcgttcatccacccaaatgcgtacagaatgtgcgtgcacagtcccgggatgtaatcctccggcatgaacttggcccggccctctctgtactgtgcccaattggtgaagtagcagggccgaaggtaagtgccactggcaccagaaaccgcggaggatgaagcattgtcaccggcttaaaaaggagccgatcgtttaaaatgaagcaaaaaatgctacattcgcaataatctcttaattgggcttttgttctctcccccattaccaatagttttagcactaattaaattaatcattaggcttcatttaaaaaatctcaccgacaaaacaaatgatgaataaaaccgtagataagctgagcaaatgtttggagagttgcaaagacattagggcgaattaattcgttttatttttaatataaatgccaaaaatcttttctcagttttataaaagaatttcttaaatttttaataaaaattacaattaatttagcccatccctacagtataaggactgcttaaaggattataaagcgactcgtgcagtcctccaaatgatcattaaattggcaatgttagctgagaatcaattcgctttttatatcggaaattctttttacaaatttatgcagttcaagcacaaaaatttacagaataaaaaagatgaaaatgaggaaaacatttgtaaattattcacagtttgcttcgttcggccgatcgcacattgacaactttttgctgaagtggagcccattgggacagtcgaaactgaacatttggaacagatatttgaaaagaatataaagtggatggaatgaaataaattatgaaatcattaaaaatattttaaaattattttaaatatttaaatattatcaatgtaataatagagaaaacggaccgataagccattggaccaacgcaacggtaaaagtgctgacagctggacgggtccgcgaagaagccatcagtcatacagacaaatgctgcaatttttaaactaataattcaaatggtcactataaaattgagtcgaagcaattgttagtaaaataggattgacaaaaaattataaaatttttccaaaataaaaataatattttgttgaaaaagtgtccaacgtttgttgctgccgttgttgctgttgttattcgatatttccagctcgtttttggcgatgggtgaagcttggctgctggtgtaggcattgttcagcgaaaaaacggcggcaaaataatggtgggacggagttttgcgctgaatccgaaagaaattgtgtttaaattttaagaataataaattaanattttanataattattttattttattttaaaatatttaaacggaaaacaatgtgtattctcaggcatgtagtcagacaaaatttctta

SEQ ID NO: 4604 - DNA, 1358 bp, Heterodera glycines
  misc_feature (28)..(28): n is a, c, g, or t
  misc_feature (1102)..(1102): n is a, c, g, or t
  misc_feature (1153)..(1153): n is a, c, g, or t
  misc_feature (1183)..(1183): n is a, c, g, or t
tttctttctcttccgccccccccccttntggcccacatcatttaaatggccaagggcactgctaaattggaggcccgcgctgcattgcatacggaaagacttcccttaagaaaggaaattaaaattttattgaaatttgaaaaaatgtaaaaaaaaattttgctttacccgagagacagagcacaaatgcctctctgaacgatggggcggccatcgctttgaacccgtctttttgcccgtagcaaagcatcgattcggacacacttaatgggctgactcataaatttgaaaattcaattttttttatttaaaatataatttaaatgaaattcaatttttgacccatcctctcgccttatgccccccgccgtctgtccaaatggcggtgttttcgtcatcgactgaataactaacggaggtggcctagtgacagccggcaaaagtgcacccgtaaacggcgaaggcgactgtcaacaaaaatatatataatatttatttttaattaaataaaattctacattcgaaagtgccgagacgggtgtctgtgagagttggatgccgcccaattcttgggcaattgtgcggatcagcgggtaacggcctggacaaaacataatttaaattcaatttgaaccaaatattccgaattattgttgcaaataaaggtacggtaccgagttggctgccggggcattgtccgttgaaatcgtcaaagtccaaagtccacacgaaagcgccgccgaaagagttttggcgaatccaactgagctgaatgaggcaaaagcatttcaaattgaaattcgaaatgggctttcattcactttgtttctgatgctctccacgtcgtcgtagctgaaccactggtcgttgtccgccaccaaaaagggcaccagcgtttcccggtccacgtaacgctgcgcaccgtttgccagcatttcgcagaacttaaaacagacaaaaaaacaaattttaatttcaaataaaaataaaacaaattgaaaaaaataattttaaaaacactaattaatttttggattttttttattatcgtaagtcagcacataaatatttatttattaatacatatttcttgatgggatgngatttgaccggatttagaaattctggacatttgggcatcttttttcttgtncatctatggcttattttagaaaagccatanattctttaaaatttcctttaaagtgagtgacccatcaaatctgacctaaaatatgccaataaataataatatcaaagaagacgcggcataaatatatagttgaaatttgaacgggcgcttttttagaaatttttttttaattaaaattccaattggaatggaaattgaattaaaa

SEQ ID NO: 4605 - DNA, 3391 bp, Heterodera glycines
  misc_feature (3371)..(3371): n is a, c, g, or t
acttaaaacagacaaaaaaacaaattttaatttcaaataaacataaaacaaattgaaaaaaataattttaaaaaccctaattaatttttggattatttttttttttattatcgtaagtctgcacaataaatatttattaattaatacatatttcttgatgggatgggatttgatcggatttagaaattttggacatttgggcatcttttttcttgtcaatctatggcttattttagaaaagccataaattctttaaaatttcctttaagtgagtgacccatcaaatctgacctaaaatatgccaataaataataatatcaaagtagacgcggcataaaatatatagttgaaatttgaacggacgctttttaagaatttttttaaaattaaaattcaatttgtaatgtaattgaattaaaatatttttaatacaataatagattaataatttccctcttcatcacctcaaaatacgctccagtgcccgccaattggacaaattttgtggcttttgccgcttggcccggtgcgtcgaggccacgaaattgttgagggttgctcagagtccaaccacggcctcaatttattaaaaataaataataaaaataatattttggtaattcgatttaaatttttgttaccatatgttgggattccgataataatctttaataataaaattatattaaacatacaaaaaaagaaaagaaatgggacctttgattttggcatgcccttttcagcccaataatttgcagcaccagcctaaaaagcagaaattagtagggaaggcagatgaaaattttcaaaaatttcatatggcttggctaaaacgacaactgtaaaaaatgagtaaaaaaaagttaaattattttttgatgagggaaaatttagttactgaaattttaatgaaatttgatttaaaaaattaacatattttactcaattattattgtaaaatgattacaataaaatataaaaataaattaatttaattaaaaaataattattaattaataattaaaatgtataggaatacactgactgaccacattccacaagcgcttctccggcacatctttggaccgtccgtacaatggcgcgttcatccccgtctgctgctcccacgagccatggaagtcgtagctcatcagaagcacaaagtcgagaagccttaagcataaaattaaataaaaacgaaaactaaattaaatcgaagaaataaaaactaagagacgaaaaattataaatattttttaagtaaatttggtaaattataaagtaataaatctgttcagatattttccaaatttttatgttataaaattgggggtgtacttaaccgtaagggggcccacatcaaaatttttaaaaaatgttaacaaagagcgcgctgaacatccaaaaaactgcgcttgcaaattagctaaaataatttgggccaaaatatcagagtaatttgcacagataagaacccaacatttctttgttaatattttttaaaatttgaatgtggggcctccaaacggaaaagcacctaaattggtatttagaatcctttcaaatttaatttataattaaaaaaaattattattttattatattttgctcgactttccgactgtcggaatgtcgtatccgttgtcaatgttttccgtccccgccgcaaccgcagcagtgatcagcagacgcggctttccgcttgaagacgcttctgccccaacggcgtctttcagttcctgcagaaaagcaattatataaattaattttttgtcattttatttagactgttttatagagtctgttaataaaaacaaaaatatttagatgaaaaaattcaagcattttttcgaaggaccaaaaaacattttaaaattaaagtgaaaagtggaaatgctttaatttttgcattaaatttcccttaattcgacattttattaaagatgttcaaataaaaatttatttctctacaaaaattaaattaaattaaaaatgttgtgccgatgtaaaagcgcaatttacacgagaataatttcatattttaaattaattgactaaaacaatttaatattttttgcatgttttaaattaataaaaatttgcactgtaaaattgaattaaaattttgtcacgacagtgacacttttaggctcggctgacaatgagcatgaaaattaacggtatgccaatccaaaaaaaaaaattaacggtatgccaatccaaaaaaaaaattaacggtatgccaatccaaaaaaaaattaacggtatgccaatccaaaaaaaaaattaacggtatgccaatccaaaaaaaaattaacggtatgccaatccaaaaaaaaattaacggtatgccaatccaaaaaaaaattaacggtatgccaatccaaaaaaaaaattaacggtatgccaatccaaaaaaaaattaacggtatgccaacccaaaaaaaaattaacggtatgccaatccaaaaaaaaaaaattaacggtatgccaatccaaaaaaaaattaaaggtatgccaatccaaaaaaaaaaaattaacggtatgccaatccaaaaaaaaattaacggtatgccaatccaaaaaaaaattaacggtatgccaatccaaaaaaaaaaaactttatttaaaaatcaaattcctttacctaatttcggctaaattttcaatttaattttgctattaattaatttgccttcaaaaatttgttgaagttttgcctctccgcttctccgtttgggtattcccagtcgatgtcaatgccatcgaagccgtactttcgcacaaataaaattgacgaatcgatgaaaacttttctgttcgcttcactgtgaatttaaaattaaaaatttaagaaaaaattcctttgtggcctcactttgaggacattccctgaaaaagtcgcgtgccaaatgaccaaccgccaaatgaaagcagcgttttcagcaccggatcaaaagcctaaaattaattaattaattaattttcaaaaaatatttatacttttaataataaaaagtatatataatttggtattgcatattaaaatatattttattcttttctctttctattataacctttagtgcgttcactcgagaatacattccttttggctgccaatcgctaggcaaatcggccgggtcataggccctgaaattttaatgcctttttatttgcttaaataaaaatttagaattctctttaataatttataaaattcgcccttttctgctagaacgtcaactcggtgtcaatttcaaaaatgggtggaaattcttttctggtaattatattcttagttattataatgcttatcacttggcaaatcggccggattaatggccaataaaattcccatttattccctnatttaaatgatgaaatgcca

SEQ ID NO: 4606 - DNA, 4392 bp, Heterodera glycines
  misc_feature (24)..(24): n is a, c, g, or t
tctccgtcgtgggaaaacgcttgnaagacgatggcgacgtgccgccggaggaagtcattttcttgcgttacagtttttgttttctcgcataaattaactgctctgcttaatgagtggtcgcaatttcactccatggagttgggcccggggctctcaaaacactacaaacaaaagccttgtttttatcggcagcttaaaaatgtattctggcggtgggagacgttcgtcaatggtgcacaaagacggaaataatggcgacgacttcggcggtgggagacgtttttccatggcgaataaagacggaagttgtggcgaagacgacgcgcgactgtgcgctatcgtcggtcggtcgcatgtgctcggcacggaacccaacgcaaaagcagcggcagtgacggaggtcagcagaaatgggagggaaatgccgaaaattgctcaaaaataaaacattcgatttttttaaacagaataatgcctttgacctcgcgatgacgaaaactccgcgcaaatttccgaatgtggaggcggatgagtcgagcgtgttcccagcggacttcccttgcgaatttaagctggacgtaggggcattggccaaacttttggtaagcattcttacatttgacttttaataattattctaatgtataattcacggaaaatttttgcagttttgagcggaacaaaataaatttagagcgacttgccgcagtcgtattccgcgacattgccatcgccccaattggacgccgactttttcttcaccgcatacagcgacaacgacgtgttgcctccgtttgacgcgcttccgcccgcggtgcaatgtcgaaaattttttgccgaccttcgcccgttggaccgaattttggcacgggttgtgcgtccgggtgttgccgtccttcacgtggagttggtgtgcatgttgagccgctttcggcgcactttgctcacctttatgaagggccgattggtgcgtcctttttaaagggaaatgagttgacagaaaggagagagagagacgtcaaattaaataagagtccattttgcctaaagaaggagggagggacatgagagaaggaggaaaaggaagaagcaaaagggtgaatgaaccaataagggggaagaggcggaacggaggggttgacaaaggtggaggaagggggggagaaatgagagacgcgtggagagggagagaaagtgaggatgaagttgtccaaaaaacggaagggaaagagagggggggggataatctctgactgctgattgtgagtgattgttccaaaatgaacgaatttgcgaatctagagctcattattttgaaaattagagttgatcactttgggattgttttgtgttttcttatgaaacatacaaatttagaagatgcaagcacacgacagtgacgacagcggcattgaggaacctgacaacgtgcaaggagtcgtgcaagaagggcaagaagggcaaggagtcgtgcaagaagggcaaggagaggaattggtagaagtaagttttgcgaatttcctcattcttttggtgccccgacatttgcggcccccagccgaaaaccacttgcgtctccgacttttgcggccaatttcttaagggtcattttccgattcatttcacaaattgtgcttgctcaagaccccatcagagcctaagtttttttatttctaccaatcctggattcctatatcgatcagtcgatactgtagagctccgaggtgtcccaataatgtttcgttcctattttcacattgtcgtaatgcaaaatcaactttttgatccctcttcattttccacattttttttctttcttgtttcagttaggggaaaataatttgataaaaggtgaaaggaatatgtttgattattttttatcgagtaattgacttgaacttagtaaaatgtgctgaatttacacctgagtaagtctaattttggtttgggctgaaatttcggaatgacccttaagaaatggccgcaaaagtcggaggcgcaaatgtcgagacatgattcgtttttgggagcagcttcccccccccccatatcagtccccgttttgtttctcctcgaaaattgatttctcaaacccaaaaattatattgaaaagttgaagttttacaaaatttcaacaaaaaactgaaaatcttttgctacaaagtatgatgaattacaggtttttccaaaaatttgcctaaaactcatgtctttttgaaacttataaaattttcacgaatataaggatgggtaataaaatttctaatttattaatttctaaattttttgagactatcttttttacgtcacggtcaatgtttgcggcttgctttctttttcaaaatgaacgaaaaattaaattagccgtattatttatcctttttgggtcacttcagtcccgggtccgttcattccaaagtattctccgccaaaaattattctaatcgacaaattgcttcaattaaatctattgactgatttcccatttttatagcattaacttattttttatttcttgtattaagataataacaaatttgtttcctctaatgaaaaaagggcacaaacgttttttcaaaaaggttattttcggtttcattttttgatgaaatttatttcaggtcggacaaattgattttgatattggggagctagcggctcaagtcgacaatgtccaagatgatcatgccctgctccagaatcaagtcgtaaacttgaacaaccaagttgtcaacttgaacaaccaagtcgtcaacttgaacaaccatgttggagcactcttgaatctggctacacaacagcagggtcagattagccagttgcaggttttagttgcaagatataaattaaaaaagtagctgggggatttttcatgtttagtaaaaagattaaaaagcgtttcaattttcaggaggcgcttcagcagttggtcggaccggtatttgtttcaaaatattgtcaataaaaaggcatataatgattttaatgttttttgaaaaaaaaatttaaaaaagtcctgaattctaggcgattggacaagccgcagcgggcagccaacaacaagaggagaagagcggcaaggaaaagcccaaggaaggcgaggacgaagaggaggcggggggcataactgtggccgaggacaaagaggaggcggagggcgagaaaaatgtgcccgagggcgaggacgaagaggaggcggagggcgaaaaaactgtggccgagggcgaaggcgaggacgaagaggaggcggggggcgaaaaaactgtggctgagggcgaagatgagggaaccagcgatggagagccgaaaacgaagcacccccgtttgcaattttaagacgatctgtttcttgccatttcaaatgttttttgaacgcaagaaaataattgttgaattgcgaaactaacttaaaatttgttgattcagttacattgaaattcaaaatttaattttcaaaacttgtttacattggcagtctaaaaatgtattctggcgatgggagacgtttttccatggcgaataaagacggaaattgtggtaaagatgacttgcgactgtgcgctatcgtcggtcggtcgcatgtgctcggcacgaagcccactgcgaaaacagcggcagtgacagaggtcagcagaaatgggagggaaaatgccacggggaactgaaaaatttaaaaaaaaaaagaaaatttaattggtaaattaaaaaaataaaaagccttttcgagattttgaaaaagaaagcaagccgcaaacattgaccgtgacgtaaaaaagatagtctcaaaaaatttagaaattgataaattagaaattttattacccatccttatattcgtgaaaattttataagtttcaaaaagacatgagttttaggcaaatttttggaaaaacctgtaattcatcatactttgtagcaaaagattttcagttttttgttgaaattttgtaaaacttcaacttttcaatataatttttgggtttgagaaatcaattttcgaggagaaacaaaacggggactgatatgggggggggggggggggaagctgctcccaaaaacgaatcatgtctcgacatttgcgcctccgacttttgcggccatttcttaagggtcattccgaaatttcagcccaaaccaaaattagacttactcaggtgtaaattcagcacattttactaagttcaagtcaattactcgataaaaaataatcaaacatattcctttcaccttttatcaaattattttcccctaactgaaacaagaaagaaaaaaaatgtggaaaatgaagagggatcaaaaagttgattttgcattacgacaatgtgaaaataggaacgaaacattattgggacacctcggagctctacagtatcgactgatcgatataggaat

SEQ ID NO: 4607 - DNA, 3096 bp, Heterodera glycines
aaacggttgtgaagagccctcccaagcttaacaaaatttaaaaaacgggcgcgaagcttccatttgagctaaaaaaattttaaaaacgggcgcgaagcgcccgttcgagctcaacaaaatttgaaaaactggcgcgaagcgcccgttcaagcccaactaaacttaaaaacgggcgcgaagcgcccgtttgagctcaacaaaattttaaaaaacgtgcgcgaagcgcccgttcgaggccgcgaagcggccgaaaatgccaaacaaaatttaaaaacgggcgcgaagcgcccgtctgagctcaacaaaatttgaaaaactggcgcgaagcgcccgttcaagcccaactaaacttaaaaacgggcgcgaagcgcccgtttgagctcaacaaaattttaaaaaacgtgcgcgaagcgcccgttcgaggccgcgaagcggcctaaaaatcactgaaattctttaaaaattcaaaatctcttcacaaccagatagctaatctaggtagcgaagctcaagaagcgcgaagcgctttccccagcgccaccctcgacggttcacgcacccgctagttactatatatgttatattgacaaagagtttcgttgctaaaaccattttctcccggccgaaggccgggagcgccctgaaagtagtggaagggtcttacaactttttgaggagcatccgggaaaactatatagaaaaattcagcgcggacgactgagtcccggagaccgatttctcactttttcttgcagtttttcttctacgaaattttttctttggaccgggatcgcttagctcttgctggtaggattttaagtcagactatccccgacaactttgccagcaaaacctaagccctacgttgggcgcccaaggctgtagccttggctaattttttttacccaaaagtgtacacttcagtaccaggcgaataactcgccaggggttgctttgaccgaaaaaattgtttctgagcaaaaatgtgtagtatttgaaaggctatccaaccaagttttaaaatttcgaaaattttcaaaatttttcaagttaggcctaaaaaacggttttcgggtttttgaattttatgattttttaacgaattttcccgggaaaacgaagaccacttccaaaacatagtttttcgagctctatcgaatggtattttttttgaaaaaatttcgatttttttccggaaatagaaaaaatttttggcctaagcgggacatttgagtcccgggcccataactcgtcaggggtcggttttagccaaaaaatgccttagagcaaaattgtagagctttttaagctctatcgaacggtgtactacatgatgtaaaattttcaaaaattttcgagctaggccccctagaaattttcggaaattttttttcggacgaaaatgggggtgaaaaatatttttctggggtaaaataaggtgctgagtacgaatatgatgtctattttaagtttcataatttttggaattttttaaaaattctttattttttggcaattttttggccctcgggattttgggcgaatattgaaaaattcatatctagcctaagggttgaccaattttgagcaaataaagctttaaaaatagagaaaaatcaggagaattttatgggatttatttaggttttctaacatcaatatgaaaaaagttattccagaaattctggaaattttagatttttcaaaaaaaaattcataactcccttctgaaaagtcattctgtaaaagtaaaatactacaaaaatctgcaatttttttctctattatataaattttatttggcatttctatcacatttttaaaaaaagatacaaaaataaaagtgattttgggattcgggaccaaaggggtgagtataggatttttgagttgaaaaattttttcaccaaaaatcttcaaaaaacatgtcattagggctattttatgacgctgatcacgaatacgtgatcagattttacttttgacatcgttaagacctcagaatccctgtgtgattggggattctgaggcatcattttgaaggggggggggcaggttcggatccggacggtgtaacattatttttctttgtatttttggcttattttacaatgtttttaattaatttttgaagatttcttttaaattatttaaatttattttttttaaattaaagaatttcattatttatttttgaatttgtaaaaaaaaattcatttaatttcaaattaaataaatattcaattaataatttccaaggttgtttttaattaataaaagagtattttattattaaaaaatttttaaattaaaatgcactcgatttttaacctttaataaaaacgtttccttatttatttaattttaaacaatattgtacctctcctaacaatgttgtaccacttctaatcacagttgtacctcttctcatcactgttctacctcttctgatcactgtttacctcttctaatcactgttgtaccacttctaatctctgttgtacctcttctaatcactgttgtacctcttctaatcactgttgtaccacttctaatcacagttgtacctcttctaatctctgttgtacctcttctaatcactgttgtacctcttctaatcactgttgtacctcttctaatcacttttgtacctcttctaatcactgttgtacctcttctaatcacagttgtacctcttctaatctctgttgtacctcttctaatcaatgttgtacctcttctaatcactgttgtacctcttctaatcactgttgtaccacttctaaaacaaatttaaaaaaacgggcgcgaagcgcccgttcgaggcggcgaagcgtcctaaaagtcccagataattttttaaaaattcaaaatctccacaaccagagctaatctaggtagcgaagctcccaaagcgcgaagcgctttttcccagctaaatagccgacggttcacgcacccgctagttactatatatgttatattgacaaggagtttcgtttgcaaaaacaaaatctcccggacgaaggccgggagcgccctgaaagtagtgtaagggtcttacaactttttgaggcgcatccgggaaaactatag

SEQ ID NO: 4608 - DNA, 6597 bp, Heterodera glycines
  misc_feature (2495)..(2495): n is a, c, g, or t
aaaaaaaaaaaaaattaagggatgattttttttcctttgaaatttttaaaccatgttaagggattcaaaaattcgcccatttgtctcaaccatttaaaacataattttttgaaattaaaaatggtgagtatcatggctatttgttggtgtaagctttaaataactaaagaagtttgttatcaaacaattctaaatttatggttcttggttgaaacagtcccaaaaaactttgctggtgcctaattttttttttattctgataggcgcgctcaaaccgagagtcaacattttttttcaggagtcgagaaatccgtgacttagaattaagaatggaaagagtttctcaagaaaaacaaatccaatttaatttttaaaggaattattttaattttttagagagctcaattcagtaataattatggtccgcaaatgtcggctaacctatggcatttcctgcgcacatccaattccaagattttgtctcttccattctctcgacccccgcaaattttctcgagtcataaaagcacgtccccctcccatttctcttgtcatgctccgatttggcaattccattctctccacaaacaattcccccccccccccaattcattcattcattcattggttttgtcctcctccatccgccgtcgtccaccccttccataataatgggggattattcgcccctccggggctttttcctaaaatgcacaaataatcccccccccccgagggcgctggtcactcattcactcccaatgcacaaaaaattcaacaaaattaatgtatctcaactgagactttgaaaaatttttttttgaggagtggaagggcagtaaatgcgaccatccatcaatatttgtttccattttttgaatttcactttaaaaattgtccatttctccacttcaaattggctagaataatagtggtctttttctttctctcaaaaatttaacattctgatattgttcgaaaacacttgagaaactctattaatctaaaaatttgaaattttttttcataaataaaatgcttaatttgattagcaacgaacaaagttatggtccaaaaagccttccggcgacattttggggtgcacccgttttgattctttcattcactcgatgccttaacctcaaccacattgtgtaatatgcctattttcttagtatgaaatgccaaaaatggccaccaacaacagatcaatcttcatcatcatcatttgcaacacttaacggcgcggcattgccctccggcaaagtgccggcggtgccatcctcctccgctgaacctctcccccgtccaccagcggcgatttgccccactaattccttgtgccaattttgaagtccaaaaacaacccgcggcacaccatccacaaacaatgcgacggcatagcgaaagagcacttcctcacagaggtacgattggatgccaaaaaatgcagttaaataaaaaactttcaatgtcgtacaaagagaaatgggcaaaatgaatttgatcaaatacattaataattacggcttacagtatacttctaattacagtatgctccataaggcccccattttccgggagccggtaaataccgtactgaataaaaaagatacggcttactgtatacttctactacagtagtcccattttccgaagccgtgcaattatcgtattgaatgaaaagtgtccgggctgtcttagaaatgctcacaaaggcattcattagttgcagaaagcggcatgtgccagtcgttcacctccgtgccacgcacatacattcggacagcggacgagttggagccgttgtcgttcagcgcacggcttgccagcttccccactctggtgccagccgcttgctcgcgtgccgagtcgcccatctgccagctgcagcgtcgtttcgcacaacaagacgatgcggccagccgacggatggccgaccatcggacgctgccgtcgcaaatgccaattctgccgccaaaagcgctgccagccggcctgcccaagtcgctgagaccgtccaaattaccacccagtgagcacagaagggcacacttttggggaatggaattgtaacattgtcaaagggagtggaaaattgagctaatgtcggacaaagtgtcaaaaaattaagcaatttgggcaaaaaaataaaatgccgaataattgatatgccaagaaacaaattaaattattttggcaattatagaaaaaatgtcagaatttttcttggaaatattaagtattatttgttatcatttgataccctaacatttttgttttaggctgcatatttcattcttaattcaaaaaatgttatacctagaaaaatgatttggaatttttgagactaaactttttcgaaaatttaatttaaaattttgcaaaataattgaattgagataaaaaatttggtgaaatataatattcaaataattctttctgaaaatttgctaacaaataaatgaaaatttaagccacttggaataaatgcncaaaaatagcagaagacaatttgtcaaaaatttcgcagaaaatttggacgagttggaccccctgcggcaaatggccaaagagccgggcaccggactgctcggcaaatgcgtgctgtgccttctgctcaacgccgtgttcgtgctcgccttgttcctcgcatttttaattggtcattttgcggccgacgctcatttcccccacagcaataaggtaagactcaacaacatcaaccaacaagcagagattggcatttgtttctcgaaattaacatttttgactatttttaaaaaattgtaagaaaaatttaggaaaatttctgtgcgtttccccctccacgtgaaacaacgcaaaattatgtttttaagtgaaaacctgttggcatcttattgaaaaattttcatggttttactaaaaattcaaattatggtgacctcccagtcgctcgaagaacgcggctctacaaaaggggtccattttttggctttccatcgggttttatataacccgaattatgatttatggaaattactatttcaaaaatcgaaaacttggccactttctgatgttatttttaacctgtaaaattttcaccgcccgcaaaaaatatctgcttattaattaacactaacaaaatgcgcaacagcttgtttaacattttttgcaagactaacaccagcaacactgctcatttattgcccggtgaggtgcctgtggctgacggcaccgatatccgcggcaaaacaacggcatttgacctacgcggaatggcaccaaagcactcggatggcactaacattggcactgatggcacgcaattatggagccagcgagaagaagagttccaaaaagttgggaatcagtgttttgctggtggaaagtgacttttgagagtcgaaattccctaaatttcgagggcctagacgaaaaaaactgagaattttgcgggaatttgagccgaaacactcgaacagccctgcctttaatggtgccgattattaatcctcacagccctttcttcaacccattccgtcaaatttcttatccaagcgaggatcacattaattgagttgatcactgagcctttcaccggtgatcacttttcgtttttcttaccatatgccaattgcgctaccgtattccaaaccatttacattacacgctcatcagagattgggcagcaattaaataattaagtatctctttttctgatctcagagcctggaacgacgacggcaacgtgtgccgtcgttgagcgaagtttacccgccgctgttggacggtggcgatccgatggcggacgaagcggacgacccgatgccgttgagtgccgcgacagccgcgcatcagttcggcaacgggccggtgatgcaccgatcggctggcattgccagtcaaaatgttccattgattccgttgcccaaaacggtgatgccaaggcattacaatgttgaggtgatcaggaaacaaaatatttgaaaaaatattccataaaatccattcatggattacataaattttaggagataaaaactgccgaaatatatctataaatgggaaaataggatctaaaatttgaaaagttaactgccgaaattagtttaaataaatgggcaaaaaagaaccaaaatttttaaataagataaaaagccaaatttaaatcgaattaaaatacgcatatgagaaaaaaaattgataaaaatatgtatacgaaaatgtacatcttcagaatgggatttaccatatgaagagacaattcaccagttaatgggtgctctttatcattctttttttatttttgttggaaattttggctttccgttagttaattcagcttttaactatgggcttctaaaatcacaatatctgcttgtgccaatcttcagttttcgcgggccttggcaaaacaaactatcgtttattaccggggcggatccgttatttaacaaccatcataaagggcggtagttatttaaaaaaccatcattatgaaatttttgtcgaaaaattatttataactttgctgaaagcaaccaaatttttaattcttgatttcatttgattgccctaagtgttctttatcagtcagcaaaatttcaaaaaatttcgttaaatttcaaaaaagttatagctcgaggaacgcaaaaaccttggtcttcgaacatttttagccataactttttttaaagttaataaaattttgaaattttaaaggctcataaagaacatttagttctatcgaatgatagcaaggtttaaaaatttggttgttttagagcaaagttataagaaatttttttttttttttgatggttttagaaataacgcgcataatgatggtttttaaataatgacaaagcacccaaaataccatcaaatgggaaatttttgacagaaataattcataaccttgctcgaggaacaaaattttgaatttttatattatttctaagaaaattttttgaactttggcatgaaatagagaacatttagggctatagaatgatattaagaaataaaaatatggttgctttttagaaaattataagcaaaaaaaattttaaaaaatttttgtacggtaattcaaaatttcaaaatttgtcgactgactgttaggccttatacaaatgtattttttctgaaaaattttacattattctgacaacagcattttaaaacttcgtgaattttaacctaaattcccagccctactaataatgtgataactgaaaaattaatatttgtacaagtaattcgaaccggtaaaagcttacaaaaattttggaaacaaatattttaatttttaaaaaaccgagcttatagcatattaaaaacccatttattcaataatcgtaataatataaaacattaaaaaaaaattattctgaatttgcactttatcatatggatatattatagtcaatgaaaataattcatacaaaaaattcatcatatgattcgggcatttctcagcaaatgtgtttctcttcaatcagaaaaaatccattcgaaatattttacaaaaagaaatgctttattttatttaaaaaattattattattattatatatctggcccaaattatatagaaaaatgaaaaaaaaaattaatatagaaaattttttggaaacctttaaacgctttttatctttttttaagttcttaatcattctaaacaattcacccattttttaaataatataacgattaaaccgttaaaggttaaaagcttttctttagaatgtgccgacccaaaaagcgtcaattattgcaattatttttgttattattttgttatttgattgatggacatcaattaggcccagtgcaagtaattgagaacaatttagaacaaactgaagaagtgaaagcgaaaaacattgaaatggcacaacaaattgttgaaatccgcgaaaaaaatgttaatgggaacattgaaaatgagctgttggaagtgtgcaatttgttgaaatgtcccagcgaaaatgttgacaaatttttgaaaaatcaacttaaaaaattacacccggacaaagtcggggctgaaaatgccaaattgggagcagaagcaacaataggtaaataaaatgtggcatttattttgcatattaattattttacaactttttttaaattttatttattttagtgattaataagttgcgacaatttgttatagagaacacgcgaaaaggtctttatcattacagacatagaattgttgagattttggcattttaaaaataataaaaaaaaattaaattttgtaattttacagttttaaattagtaatcaaataaaatatatcgtgataatttgattgtttcctttcttttagcaaatcaaattttgactaatgagcggcaactcatttcggagtcattaaaaagtaaatgtttgaaaataagaaaactttcaataaattttaaatgaggcttttatgatataagcacactttaatgccctcaaatgaaaatatgtttataatttttcatagggtagtacgtgaccgggaccgagccggcaattctcggtcctctcaggccaaaatattttttttaattgggagaaaataaaatttagaaaaatcaatgtttctttttt

SEQ ID NO: 4609 - DNA, 1449 bp, Heterodera glycines
  misc_feature (51)..(51): n is a, c, g, or t
aaacatggtggcatcattggaagccattcatcatcagatttagtgaatttngtggcacaaaaaatgaccaattttaaacattttacatgaaaaaaaattccgcagtccaaattggccaaattcaaccgagagcatgagcaaatagcgaaaaaaattgatcaaaattttgatcaggaaaatcttttgatcaaagcgccaaagaacaacccaagcgaagtgtacaaaatgtggaaaaaatgggaaagtttggaatttacaacgaatttttacaaacaaattgagcagaattattgctggaacaacaaactgttctatggatgagccgcattaaaatttatttatttttgttttttgatttatttatttttgtagacatttttattttgttgtcgagcgatgatttttttagactatttttgttgattttggctgattttgttgttgcatttttttagatgtgagtaaattgtatcggattcaggcgcaacacacaccaattaggcttagttttgtctagagttgtacgggaccgggactggtactgaaaaaaacgtacaactgagtacctaagtccctgttttgaccgggggaccgggactagccccggttttttcccagccaaaaagtcccggtttttctacccgaaatgccccggtcccggtttttctcataattcccggtttcggggtctatgggaatacaaaatatatggatactgaatctgatcttggatttccccaattacgaaccccagacccgaattcgaacaaaagagttgaaattttttttcaaaaatacgcgttaaaatcgaccaaattttcgcgcaaattgcgtattttttattcaagtaataattgaagcattgttttgcattaaaataaatagttgttaaatgaattcgaagcttttccccttaaaaatgcatcttttgaaaaaaaattcaacttttttgttcgaattcggatccggggttcagaatttttgtctatttttagggtattgcccctttttgagaactctcccccattcacagtgcaattaagccaaacctttttttttggtatcattcaaaagcgcattcattttattaattaccttaaaatcttattaattttcgaaaaaagttagtgtcagttcttctggctataactttttttttgaagcatcattaaattttttgaaattttgccacgctaatagagaaggctttagagctatcgaaaaaatttatttactcttgaggcagattaagcgttatttttttgtcaaaaattttccatttgatggttttttaattaacgccttttagaagctttttgtgtaacgacccagcagctccccgacctttttggactgtaatttatttaaaaattctaagcagatgcctgagatatgaagcgcccttaggcatgtaataatcatgcgataaaaatgcccttttctcagaat

SEQ ID NO: 4610 - DNA, 2005 bp, Heterodera glycines
  misc_feature (1969)..(1969): n is a, c, g, or t
  misc_feature (1988)..(1988): n is a, c, g, or t
tgattgatttattatgcaagatttcatgtttactaatttttattttcagaatattttcaaataagcgcaagtgttttttcaatccgattgggaaacttaaaaacgaaaatttggtcattttttggacaaaatatgttagcaaaaatttttcaaattttcaatttcttctcccggcggcgtctatcggcaaccattttttaatgtccttggatttcggaatttgcccgctatgttcttgtaaatcagtatacccgtccttgggaaaagagtttgtatgatacgagtccttgtcgcgtcccgaaaattaaaatcattttcgtccctcgagtggatcatccattcccccccccccttttctttgaatccccgcctatttttcctttgtattggccctaaggacaggtgcagacaaaacgaaccccttttctcacgacaattcccccctttcctctccttataatctcttctgccgcttcgcctttccacttcaccccttttccgccttttcacttcgccttttcatcgccccttttttccttttcgctgctaatcacaaataatcgcttgctttcaacttcgccttttggaaattaaacttttggtcttacatacttaattcgtggtcgaaacccaagctaatcctaagttcgggttccgcttcccatcccaaccacgacaccctgcttttatcccacttgagtcaatacttttgctaaaacttgaatttttgccaatatttatataatttatattttctgccattttcatctttattttgttactatatttacacccaaacgtaaatttcaattactttttgaaagatgatcaatttccttcgattccgtcaagcaaattaatgccaatcccatgagaacagctgctcaattaatgaatggtaaatgcattaattataaaagtccatatatgtaatatagataaatatttacttcaaagaaaacgttaatttttcatatgctgaatttcactaactagtgtaagtaaattaaaaattattttaattttacatttaataatagaatttaagtttccgcccttattgcgtgtcaaccactattttccttgttttaactaccaaatcagcttctccctttcataatcaatttcattcagcttcaaaaaaaacgagaaaatctgttacaaagaattttgtcggaaaaacttaggcgtttcgtttggattaattttgactaattaattaatgtcaagccaatttccaattcacagaacatttttgacaaggaatacgatcaaatgggaaattgacttattaactacaaaataataatatgagagaaggagacgggggaaagttataagcattttcccattcccacgataaaataaaacggctaactttttgaaacagagaaaagggcaaaaaaattaattgtcagttgccacttcgcaaagattaacttcaaattaaaagtttaaaaacaaaactcccaaagatataggaaaaaatttgtctaattcgtaattggaaatcggtttcccgattcgaaccggcaaatcggtagaaaaacgagaaatcccagtagaaattcggagccgggactaaccccgaaaaagccgggaatagtcccggttccgcgacctactaaaactttcatacatttgcttctctttttccgaccctcccatgggctttctcgagtggtccatctcagcgcgggactcttttctttacttggccatttgtctgagcattccttctgcgctgctttatcttgccgaaattgtcaccattctgcggcataaacaattccacaattcattctacacactgttcgtcatccgtgccgtgccggtgattaattgcactgattgtgcagtttcattcctttgactgtttcctctaggatttgctgtacttgctcgactctttctactgctaccgcttgccctctctgttcggctgcgtccttttttccattattctctngtccccatttggatgatcnggcggattgcccttttt

SEQ ID NO: 4611 - DNA, 2504 bp, Heterodera glycines
  misc_feature (10)..(10): n is a, c, g, or t
accggcaaantcggtagaaaaacgagaaatcccagtagaaattcggagccgggactaaccccgaaaaagccgggaatagtcccggttccgcgacgccggtgattaattgcactgattgtgcagtttcaattcctttgactgtttcctcttaggatttgctgtacttgctcgactctttctactgctaccgcttgccctctctgttcggctgcgtcctttttcccatttattctctgttccccaattggatgatcggcggattgccttttttcctcaccggttacactttccaggcaaacaatttggccaccgctttcatccttctcaaccgattgaccgcaattgcagtcccattgaaacatgacaaagtacagggcttgccaactgctgagaatggcattattctttttcagttgtggaaacgcattctcccgctggttgcgatggtcgttttcggcttgccaatttgcactaattggccaatgttcaaaatgacaggttagggaagtgcacgattcccgggtttttggggattctgtctcggcctcaattcctaagctcatttggccattgcctggtctcatttcctattcacgatgaaatcttttgccccacaaaaggcaagctgcttgttgaagctaatgacagcagcccatcagcggcttcttctgctgcttctggtgttcgcattagcagtttcttgctatacgaagaagataatgttcgttgcacttttaatttcaaatcattttttccattttttctttagtcggccccatttatcaattttttgaattatttggacgcggttgtctctgtccttttcatggccatctgcattttgatcaatgttttcgctgtttccgcttacaaacggcaaatgaacaagctcaagtttaaccagcagcagaacactcccaccaactttgaacggaaactgttcatttacgcgttggccaccttttgtggacatgcgctaatcgcctgtctgttggtaatatcaattaattaattagcgttaattgtaatagaaattcaaacgtcaatttgcagatctgcatttacattgcgtcaaatgcgcttaacgttcaaatggttttggcattatacacccattacccgtgggtactcgacacgggcagtgtgattctgtccagctggctcctcctgtgggcgggcgactcattccgtgaccaattattgcgcgactaccgtataccacgaattcgtttcgaaattcgcgctaacaatcgcgtggtatcggtgaagagaccaattgagcaaaccaatggaataaagggccacgaaaagctgcgaaaaatgccaaccgttgcatgaacaaacttttggatgcttcaccagatcatgttccgtttgaagatcttgcagtgttgttagcctaattgtgtcaaaatttcttactcatttgtattctcaattttaaacactaatttttcaaccccacacacagcagaggtattttcttaattttttaattctcttttttggtctattttttaaatcaaaaaaatcatttcatcctgttttccattttttaattttaaattgtaaaataaaatgaaaaagatcgaaaaaataagaattattcgactcatcagttgtgcatttctgttttaattaaacacactatcggaccgatcgaagcagacaaaacaattaccaagacaccattgaattccaactaaagcgttgaagtcgaagggatcgaacggaaaattttttaaatgttgcgcatcatttgttgttatatttttgttgtgaaacacagaaaaacacttcaagtgaaaaagtgagaagattggagtgttaaataataaataatttgtttgctatttgctttaaatcattgaatattaaaattccgttgaattcctcagacaaatttataactgaaaatattttgaaaaaaaaatattttcaacaaggactgtccatttcaataaaattttgatatattcctttcatctcattattttctcttcaattattgagtcgtcatcttcaaattccaactttttgtcaattatcgccaattctcgccgtttcttgatagaaaccgggagtgaggtcctcgtcctcaaaatcattttctcttatttcgataataaattgagaacatggcaacgtctttctttataaccaaagttgatttctgagggtccttcattcgtaatttagagcgtaacatttcgcttaattttttgcgagttggacaattgagtcccgggggcagttggtcacgttcagcccctagtctataactcggctcagatttgttgcctcggccgatatactcgttctctcatcaaatgcaacgaaaacataaattagcactaaacttcaatttttcaaattatttaatcattgttgatgaattatttttaaattgaaaagaataattagtaatgcaatttttccttcaaatagaagtttgatctaccaaatttattcaattcaaattaactaaatgttctgtcgatttt

SEQ ID NO: 4612 - DNA, 1743 bp, Heterodera glycines
atgccaataatgcgtggaatacatccaagcttttttaggaatacagtaatcaaatagttttaacagaaaaccaattacaacccatctcacaatcagcagaagaaggagaggaggaggaggaagaggtggtggtggaagaagaagggcaccaaaatagtgaagaacatcagcaggaggaggatgagcagcagaaccgagtgattgtcaaccgaaggccatccgtccaaattggcactatgccaaatcaacaaatggcggacggacaacgcgaggagaagccgaccgcggaaaaaaaacaaacgcagaaaaaggcaatgaagccgaagaatacaaaatacccattcagggcaaaattattttcaaaaatcttaaataagtaaaaggaacctttggcacattgtagtatattttatttttcgattttttactataatattttttgtacgtttgccaaaagatgaaattcagcagaaaaaactgacagtgcggccaagttattcgacactgcggacaaacatcattcgtctgacccctgaaagcatgaagtgcaaattatattgcaagtaaatcccggcttagaaaaacattaaaaaatgatttacaaattaatggaaaaaattcgaaccatttgaaatatattttaaattcagagggccaaaatgcatttattgtggaccggagaattggacagaaaatcaacaagcaattaaaggcttatattcacattggttgcatcattttgttttttatttattttttattttttaggataaacaatgaaattttggcgatggcacggccgacaattcgaacctttgaggagtttgacctgatcaaacaatttaaaaagcaagcttaattaaaaaatattttgagctaagacaaatgcacaaaaaacagtaaaaaataaatatattccgattaatgacataaattcttaatatttttttccggcttttatataaattttcattactgttctttttaagtcagaattttcatataaattccacgttaagacaacacattcgaactgtcttgaaccttcaatgtgtgaaggagcacgacttttgtggtccgccattaattgaccacaccggcttcacctacaatcctgaactgttaatgcgtgaaaaatgtatttttttatttattaaaattgaaataagttaatttgtttttcagtgtattattttaattttgcggtccccgatttcggcacagtgtcagcaaaatcaattttggacatttgcaaagtcatttggttctcattgaaacatggtgggtttaatgtctattatatttaaaaagaagaatagattttaaagtaaataaataaaggacgcattggcattcattgccatgccggccttggtcgaactgggacaatgatcgcctgcttcttggtttggtcaaagggcatttcaagtccgaatgccattgaagcagtccgatcagcaaggcataaaacaaaaatatataattgtcgtgaaatattttagttttacagaccaaactcaatacaaagcattgaccaaatcaacgtcatcgaaggtcgtatttataagatatttatgcaaattttggaaagttgatttaagccttgacataatcccttcccgtaaacctttaaatccctaaattcaattataattaaattaacgaggaaaaaaatttaagaatttgaactttatgttcaaaaacatggcacagcattgccaagcatattctttgctcaccagt

SEQ ID NO: 4613 - DNA, 1905 bp, Heterodera glycines
aatattctgttaagtattttctcgcatttcattgctttttttctgattaagcagtgattgttcattgtaattgatctgtagcgctacatgttcatcattgatcctttattttaatgataactcttcctgcgattcgtcctcgcactccgtctcttccttttcttccgtctctatcatttcttccgtctcttctgttttcttcgtctcttccatctctttcgctctccacttcctccccctccttcctattggctctcttcctcttcctcctcccctcagtgctgtcccttcactgctatgaatgcttcgatcgctctggtccctgcactcgcttcagcaattgttccggctccgcgtgtattctctgtcagtctttgcccattttcaccctttccttcccaactgttgtatgattttgctctgatcagatgagaacctgcctaaacgaacttcgatcgccttttgtctgctgatcagtccggtggcgcggaaggacggcgctgagttggcgcagggatgttggagggacgacggcacttcgggagtcgaatgtgtgtgcactggccaattctgcaacataccgagagacccgagggcatccggtacggccgaacaacattatgatctcatcccttatggggtgcgtgtgcaaccactcttttttgccaacttaaaattctgtgccgccattccctgtcacttttccatcgttttcagatccgaattcttcaccagtgattggcctgaaaatgttacagagaaacccttttgtggattatggtaagtgaagcaccgttcgaatgtcaaaaagaacgatgttttagaatatttggacgatgaaaaagcggcgattttgggagacggaggaaagaaaacggaaggacgaggggaggaaagcagtgtggaggagacgcaactgccggagcagtatttggacgaagaagaagaaggcactgcaattgtttgttgtcctttcagtgtcaaacctaaacaacagatttgatgccattggcacttgccgattatttcgaatgggagaaaagatcccgaggcgcgagcaaaatgaccgaacccccgcaaaagtcacaggccgattcagcaccttactcccataccacggcatttccaccgacagaaattggcatttctatcggttttgatcaaaatgacacagccgttgtgcgtcagccaccgccagtcgacggcacaattcggacgggggacgatgacaattcgtcctcggcccatttgggaagtgtgccatggaagaagtttctgctgttgacgatgttcatttgtcttcttcatcttctttatgtacattgataccaatgcatttttatttattgaaggaattttttcaaatattatgaattcttttgttaaaaatatggccaattcgaatattcccccgtttctttggcttttccctgccaattcaaatattgccaacctttgtcttccccaggggatgaatttcactgagtgctctttgcaatcgcttcttcccaccctttcccttcccccccccccgccttggcactttcgcttttgtttcccactttcctttcccgactgtctccatccgcttcttctctctttccccccccccaaatgcccctctttccctcccttaatccctcccctctgtcaattcattcgatttcccattccaaagaactccaaatcagatggttcggttggactcttttgaccatttggctgttaacagtaatctgcatgactcgagagttttggcgtatcacaaacagcggaagaagaggctgaggaaagcaatcggaagaggaacaaaatgatggaagaggaaggaaatcaggaaatgatgaagaggaagaacaggagaggaaggaagaggaagaacaggagaggagggagaggaaggga

SEQ ID NO: 4614 - DNA, 5356 bp, Heterodera glycines
gcgaaaatcggccgtcggttggaaaaaagtggcggtgcatttctgttcgctgtttgccgtggaaaaagttcgccgcccttttctctgctggtcctttgacctatatttcagctgagtgagggcattgacttctccgactcgcactgtcgtgccgttgtcatcgttgacattccctttccgcccctttacgagccacggatcattctgaagaaggcgtgtttgacggaacagcgcaggaaaggccgaaatgtatatagagtatttcattggaaaataataatcgggtttctgtttcgctttcagtcgcttaatgcggacgaatggtggcgaattgagggcatcagagcggtcaaccaggcactgggccgaaacgaggtggacccagtataagcgagtaagagaagcagtgattaatgggccaaatgaatggaattaaaattcaaaaacataaactaaccaaatgtgccgtttctcttttcatttgttggcactttattttctctttagtcataaaaataaataataaaaatattttttgtcattttacactattttatacaaaagtaaaactccaaaattgcgaaggccaaactcagcagagaaagcacaatcggcggatgggggagaagagagtcagtgcatggcaattatccaacgcaattggcgagttttggtaaacgggccgaaaagtgcgggagaagtgagtgaggcggggggggggggcaaaaacggcgaatgtatcgcacgaattcttttgagtgcccactttaaatgccctacaatcaatcggacaaacacttcgtaatttgaacagcaaaacattcatctttcggaaaaatcctaacgaaatgccaaccgatcgcccctttcaaatcgcttcctttgacccaatgaatggcttttttgttgcgcttttcctctcgccctttttctccccggcgtttgcggtcggtctccccattgtgcccttttatgctgacctccccctaacagtgcattgcgttcggcggttgtctgctcgaataccctggcggctgtgctcagccggtgccaggatattttgccaattgttacggcggatattgccgaagaaacaaagcgaagggattacggacaatggcactgaacggaacggacggaagagggggagggagatggggaggaggcgcgggtagaaagggccacgggcggacggacgaacagcaaaagttgaggatgggcaatggcacaccgacaatcccacacaatcccacagaaaagagccaagcagcggggatcagttcactccgatggaggcgagtgcccgcgcgaatgccgcggcatttctgttgtccatccgttatttttaggtctccccggacgtgcttttcttggaatgttgccaaagttgggctttgcctccgccgtgtcttctcaaatgctcctactccaattacactgctgagatggttccttccatcgcttcttcgctccctcccattttcctcttttgtcagcttcgttcgatgttcttccgttctgatgattgtcccatcgaatcggcttccgtaattcatttctgtgccacacaaaatttggaccacagtctgtgctgccgacagaatggcattttgacaacacgttcaggggataaatgtctggtcttctgtgaacaggtttaatttgttgggccaaaaatgccaatcaaatgaaaccaaacgaccgatcagttgccaacaaatgagacgcgacttgatctgagttatgtgccgtgctttgaacgattttctgaaatgaaaaagtgtttttatgaaagtgcactaaggacaattgactatttggaggccgaatttgatcaaatgaagaaagaagacgacaaaatgaaaggtgagagagaggaggaggggaaagggaaaaagaaagagaatgagagagagaaagagaaagaggagacaaagaaagaagaggaagaagaggaagaggaggaggaggacggaggaagcactttcgcaatcgcaaagccaccaatcattttcgtgaatgatcttacaaagaaacacccgaacatcaacgacgaattcactccgacggacggagaacggaagagatggaagaaaaacggagggggagaaaaaggagtgcaaagaggaaaaaggagggagggcaaaaaagaatagagaaatcggaggagggcaaaaaggagttcagaggaggaagaaaagaaggaatggaggaagacagaagagtggggggagtgcgcattataaagaaaatgacgagcagcaaatgaacgtagttttacccaaattaccacttattccaattaaattttaaaattgaaatttgtatgtgtaaatccctttttttcttcgacgcctttctcccgtcctccgcgctcttttctctccctaagcgcccgcttcggtcagatacgcgtgaggatggaccggtttctcggctcgtagcagcagccagttttggttgtcgtcgtcgatgaattgcaatttgtccatccatccctccagcaatttgtcgtacaatgtcttcccgaatctcttaatcgtttcggcatttgtctctcccttcccaattcgttcttccccccccccaccttcacaaattcgtctccattagcaatcgctcggcttcgctccatctccaaaatctcccttagacgtggtgtcatgttctaaggtcgcagagcaaagaatacgaaaagagtgtcccttttccaaacctccgtgaaaatgttggtgaaaccggcgccgtgggcagtctgaggagaaacgtaaataaaaagcaaaggatggcataatatgaaggggtctttcataatcagcagatggccggcgacaactcttttctttgtttttccttttcttttattattcttttctcttttttcccttttcttttgcttttctttgctttgcttcacctctctgtactcatccaaagtcttcaacatgtactgcctttttcgcacatattcatggaacttcggttgcaaaactccatggccctttccatacattgtgagaagcaattgccctcccggctttagccaagtctaaaagcgaacgaatgtcaagccaattccggcaaaacagacgtaaatgtgacggaagagggcctttgtgtcctaaaataatcaaaaatttattgttgcaataaaataggaagtgaagcgaatgagcgaagagcggcgcctaaggcactgccgaacaatcgcggcattgatcgcggagaaaaggaattgcatcgattgggaggggtgatggcatttatcgcggagaaaaggaattgcatcgattgggaggggtgatggcattgatcgcggagaaaaggaattgcatcgattgggaggggtgatggcatttatcgcggagaaaaggaattgcatcgattgggaggggtgatggcatttatcgcggagaaaaggaattgcatcgattgggaggggtgatggcatttatcgcggagaaaaggaattgcatcgattgggaggggggcgggaatggaattgatcgtggagaaaaggaattgaccgattgggaggggggatggcattgatcgcggagaaaaggaattgcatcgattgggaggggggcgggaatggaattgatcgtggagaaaaggaattgaccgattgggaggggggatggcattgatcgcggagaaaaggaattgcatcgattgggagggtgatggcattgatcgcggagaaaaggaattgaccgattgggaggggggacggcatgatttcggggaaagcatcgatcgtggggaagggaatggcatagatcgcggggaaagtcggcatcgctccgtcacctgaatgtgctggatacaatcgcgactgaatacaatgtcgtaagagttcggctcatagcggtagaccattgcgtctgcgatttgatactccactcgatggtcctaaaagtgtgcttatcgccttttctcatctgtttgggttgccttgtcgcgctgattccgttcgaatgcatgttggatcatattggacgacagatcacagccgagcacttgcaagccgaactcctgtcaatcggtgggtcattcggcgaaggaatgcgactgttggcccacccgtgccgcctgtcgtgcccctcctccgatgcccaccccaatgtccaacattttttggcccggccgaaggcgacggaaacggcgcagcacgcgtcggttttcctcaatgccacctcaaccgatcaaagattggttccattatgcttctgttcgtccgtctcccacctgggcttatgaaatccttgccgaaaatccattcgtagcttgccacattgtcctcagtgtactgagttttgtcgagaaattcccggaaagtggccaatttgtcatcgtacaaacgattttcttcggattttgtcaacgtccaatggacgtcgaggaaatttgaatgcgaaaaaatcgaattctgcacttggcacatcccatagagacggaagccaaaagtgtgattttgccatttggcggcgaacacatcgacgaatttggtgaggtcggcgattaatttggcagaaaaatcttctaaagaaactgccaaattagggagagattgcggaaaatttgaccaagattctcgcgaaggattagaacggcgccttcgccccgaagcattcgcaggaaaacgcccaaaacggccgccatttttcgtcggttttccaccatatgaaagagacaaatttatttatttttattatttttgaaattcgcttttcccccgagggaatgccaactttttgcccagtgaaaacatttgagcaaataattccatcaaattgctgctgacaatttgccgctttagcctccttttccgcttcctcaattaactcttccgctcccatttcttcaattttcaaatttccatcaaaaaaatcgtccaaattcgctctgacaaatgagagaacattcaaaaataaattatgaatgtcggaaaaagaactgacttcaaatcctttttggttacatcactctcagaaaggcacaacaaaattcgaccgcccggcggcggagcgttcggattattgtgaagggcattggccaattcgcgggaaatggcactcattaggagcgtgaatatgaggaggaataattaagcaaaagtcagttcagtaaaattaataataaaacgaggacaaattaattgaacggggagaatgataagataaaatgataacgaacagagagagagagagagagcgaaagccaaacacaaaatggccgacccatgggacggtttgatcacgattttccaattggggaaatttaattgcaaataaataaataaaaacgatattgtttgttgtttaagcaattggaaagggagacaaggagagga

SEQ ID NO: 4615 - DNA, 1259 bp, Heterodera glycines
gagagagagagagggatagacagacacaggaaggagagagcgtgaggagggagaatctgtcagagtggaagagaggggtagagagatacatgaatgagtgagggagatgaaggagaaagtgtcagagtggaagagaggggtagagagatgcaggaaagagagagggagaggaaggagaaagtgccagagtggaagagaggggtagagagatacaggaaagagagagggagaggaaggagaaagtgacagagtggaagagaggggtagagagatacaggaaagagagagggagaggaaggagaaagtgacagagtggaagagaggggtagagagatacaggaaagagagagggagaggaaggagaaagtgacagagtggaagagaggggtagagagatacaggaaagagagagggagaggaaggagaaagtgacagagtggaagagaggggtagagagatacaggaaagagagagggagaggaaggagaaagtgacagagtggaagagaggggtagagagtgggtggacaagaagggaaaggaagggaagagaaggtgaaggggaggttgggacagtgatttgttaacagaaaaacaatcatgcattcgaagtgatcagaataataaagagtgtcgtgggctgaataagttttgcgcctctttggatgatgtaaatgagcccaaaattagataataagcattcattggctgttgtgctccttgatcgatccttaaaacgtgtttttcccctttgaatcgtcattttcttcccgcgatcaattaaccaattaataattactaaaacacttcattaaccaatcaatcaatcaatcaatcaatcaatcaatctgtcggtgcgccttttccctccattcgctttggtttgccaatttattggccaatttgcgccttccccttccaaatgccattcgaacatttgcttgtctccacccaaattcgctgtgagacggggcccactgttgttggtgacgcgaactccgaccaaaaactgatggcactgcttgaagctcaacaggtgcaccgtttcggcaacactttccccgtttgttcgcagttcttcgacttcgttttcttacctctcttccataggaattcctcacagaatggccgcctcgtaaagttttggaccgtctctcggatttgggcttttcaatttgcggtaattgccgagagaacttttggctaattagtgagtgattggcagagagtgctggggcaggacaaacggtgattggacga

SEQ ID NO: 4616 - DNA, 1958 bp, Heterodera glycines
tttcaactttagctaccgcgcgaggacgtgacggagttgctgccgaacgacggggacttcctggtgcgcacgacagaagaaacttcgggcacagagcgcgtctttgcattgtctgtgaacgtcggaggcctggtcaaccacgtcatcttccgccgacacaacgggatgtacaccgtggacaacaactccgacaagggcttccgaacaatcgaacgattcgtcgaccactaccttcgcaccggaacatcagtcacaagcgtaagtcaaaaatttaaattataaatttagtgattttcctttgtttgcaggagcgattcgtcactctcaggaatgccgtgcaccgggcgaattgggagctgtcgcactcatccatcaccatcagcgcagagttggggagaggggcattcggcactgtttacagagcaaagctcaccgaacgcaatgggaacaactcgcaggtcgccgtcaaggaggtgtctcagacgagcaccaaggagcaggtaaaggcggagtttgaagcattgagatcgcaaattacacatttttccttttcagatcaaagagttcatgaacgaggcgcgcatcatgcggcagctggaccatcccaacgtcatccgcttccatggcgtcgccgtcggacaggagcccctgatgatcgtcatcgaactcgcatctgacggcagcctcatcgactacttgaagactcaacggagaagtgcgcgcaccagactcttcatgtgcgtcggagcagctgccggactggcccacatccactccaagggcatcatccattgcgacatcgccgccagaaattgtctctactcgaacggcgtggtgagtcaaaacttttgttgttttagtaactaatttcgctctgttcccacaggtaaaaatctcggacttcggcatggcgcacagaggaccagtgaagaaaatggagcccaacgcgcgcgtccccgtcaaatggctgtcaccggaagcactcgccgagcgctgcttcaccgcgaagagcgacacgtgggcctacggagtgatgtgctgggagatcttcaccaacggagaagtgccgtactcacaaatggcgggatcagacgtggcggtatcggtgggtgaacacacttttgtttgcttttttcaacttttccttccttttcagctgatcaacggacagaggctcaacttcccgagagatgcgccgtcaaaattggtcgagttcatcttgcagcacatttgggatgcggagacgagcggcagatactcaatggcagcggtctacgactggctgaagcgacacacgtaaggaacctagcggtgaacggattcaatgccatcagaagatatatgtgataaccctatgcttgttgtatttttacatattgctgactcattgttgtataactactattatgatatgtataaatgactgatgtccgatgtttgctgattggcactttgcctgaaagaaaaactgaattttatgactaaaatagaaatcaaaaatgaccaattttcgattaagcttattttgctcaagaaaataaaatttggtccggcggtgccgccgggattttggaatttttaatgaatttgttaagaaaattgctgcaaatttttcctcttttctcccctcgccggtgattctttttctctccttaatttcttgaccgcgcttgattacgctttttggtacttatgtatatggtttgtacgccacaaatttaaaatacggtatgttagttgcagtattatatgaatgcgaaaattgattccccattattgttgtttctttgcatttggttatattgttgaaaaaaatttttgagtgattttctaagcaacctaagatgatttaaaaaattttaaatttgtggcgtacgaaccatatacagtaataatttccttatttttcttgtttttcttcgttctctctttctcttcccctcgtcgaccctcactga

SEQ ID NO: 4617 - DNA, 4609 bp, Heterodera glycines
ccgggcccgaattcgaacaaaaggagaaagttaattttcaccaaaattcacatttgttttcccaaatatattcaaatgaacggaatataatagaaaagaaaattcacggccatttagtgcatttgaatcgattttggccaatacatatggattttggtgtaaaattaattttctccttttgtgcgaattcgggttcgggattctaaataagttgaaatggatgtcatattcgtgatcagcgctcccgaaaacccccgagtgccactcagaatcgcaaaaaaccctctatttttttttctttttttagggaccaataaagtaaaggattaccgtgtttttttcttttcttccgctattttaaatttaattccagctttccaatgcgtatttgcccgttcaaaaacctgagtttattaatgtttctcttccggtggacacaatgatgccgaaggtgggcaattcccaggacagcggagaaacggagagcaaaaacatcgaaatggactcaaattatcaggtggcttatattgtaatttctaataccaaacagtcgaatataaaaatgcgtaacttttttaattgctccaattcccttttaagccaataacacaacgtgaggaggccgattttcgacgacttcttagcaaatcaaacctccaaattggacaagcaaaacaatttgcaactgttctcagcgaacagttggcccaattggacactgcaaatttatcgaccatcatggagaacaagcaaaatgtgggcggactaatcgaattggttgacaccgcaattgaattggcggaatgcattgaacgacaattggacgaatacgacactttgctttccgtaatatttgttttgtttatctcccaaaacacggagcaaaacgtcgccaagaaaaaagaagaaaaaatataaattttctgcaaaaaatttaaatctttacaaactgttacaaaattcaaaaatttattttcttgaattttaagaagaatattaaagaattaggcttgtatgtgaagctttttcttttttcggcgccgttatgtctcgtgacgttttgtcctgctttgccattaacatttcccttttcagtttgtacgtgacagtgttgaactgatagaggaaaaaggtaaacattcctttcgctattttttcccaattttagccctttttaagacagtctgagacacattgagcaacagaacaacaagcgactcttcgacgagctcaaagacttcgtcttccttatggaaatggtccatgatcagcacatcgatgccctcaaaagtgccaatttgtccgatcccactgggtatttactttcattgttttcatgtgcaattacaatatctcagaatcaactcgtgttgtcaagctgctcgcgtggtagaccattttctgagcaaaaaaacgccactcaatgggatgagagcgtatcagacaaaagtggaattgctgaacaaattgacggtggatttcatcgacaagttttacgcacacatttgcgcaatattcgggaacatggtcggccatttatttattcattccatcgccgacagaatgggatgggtttccatttttatgattagtttttcatgaaagggttcaatgttggagtgccagcacatcggcgacattatcatacaaaagcactcgcaaaggcatcgcgcccttttgcccttctccgatctgatcgcttggctgaaacaggcacggcccgcagtttatgccaaagcgatggagcggtacaaaaaggaagcacgcaaattatacaaaaatgaattcgaccgttttttctccgaactttcccgacgagccttgcaaactgttcaaaatgaaagtaaaacaatcgattggcactaaaactgaaattttaatcagggaaggaaatgaaatggcctcagcagaatttgggaataaaaaccattcattttaagatttaccgaatttaattgtaacttttaaggtggaagtcattctttgagtgcagacaatgcgatctcttcgttaaagccatacactgacgtgagatgagactgtctatttttggatgcattttcaatttttacagttaactgaaacggcggttgccgagtgtcgtacggtggtggaaagtgaacagaaattttctattcgttttttccacctaaacattgacattctatcgcaggttggagttgagatgaacaaaaaccgtatgtcatttttataaaaaaaatcaaaatgtttattaaaaaactttttttagaaaatgacggtagaaaaacagtagagaaacaattgaacgaccaaattaaatttgcaattggcgacattttcgactcattgcccacttacttttatgcccttgtctcaacattcaaagaccacaacctcgtgtaatcaatcattcattgtccctattttttttcgaatttctcattctgtccgaatcattcccttttccccctttatttgttagtgttgtgatgtctctttacgtcgccttaacaaaacgattggctgccttcactgattccacttcctttttctcttctctctacggctcttttctcatttcgcttaagcgccttttcgatgaacaaatggtctttgttttttaaatttgcttccttttgaaaattcccagagcttttaggctcaaattgaagactcctatgctaatgccaaattgttgaagaagtcgagagtgggcattctcgactcaatttcccatttcaaatcggtttctgtgatggcagtttcgatatttggcgaattcgaacgtcgcactgacttggacaaatggctggagaaattggctgatgccattctccgaggcattgacggggcggccgaagcgccgacttcgaagtatccgtcggccattgtcaaagtcgagaatttacacttcttttattgtattttgaccaaataaataattagatttatgctcttttcttaagccacattgtccgagatgaaaattccctgcttggacacgagacgaaagaatgttcgacttttgtatcaagaaaatctcggaatttatgtgagggaatcgatgggccgtccattggacaaaattcatgtgaatgaatgggcagggaaaaataaatcaaaaaatgaaattcagacatttttcgagaggatagaaaaacacttggaaaatggcgcaaagccggaagagttgagctacgagcagcaattctcccggatggaactgaaacgggccatttcgtcatacccggccaaagaagtgaagaagggacttgacaatctgtacaagaaagtggagaaacacctctgcccgggctcgcctcttctggtcgttgtgtggcgacaaatgcaggcaaaaaaaaccacggatttctttcacatttgacaaagttcaggaagaattcttgaaccaggtgaaacattaccaagagctgatctcgcggtgttacggcgcctcaaaaatcgaattggatttctccattggggatgtgcttcaattcttctctgaaatcgctcaacagcactaaccaactcatgtcaaccacatcagtcactcttgttttgttttcgttaatctctggcaaatccaatcatttaattatatggttaatgtaagtgattaaatcccctgtgtaccattgccatggccagcggttagggggagctaaagacccattgtccaaggaacgaaaataaaaacccgaaatttttttcagtatctggagattgttttttgccagttgttgaacatgttatccattcttcctctccaaatgcttgccaatttaatttttgaatgcgtatcccttacaagtttttgaatgtgatatgtccgtaacaaatcctcaaaaaactttcgagtttcttaacagaatggacattgtccttctcgaccaccaatcaaaacaaggcatttgtaaatgtgatttataataaagttatatttgatacaaggtggagaattcgaatccgattttcatttgtttggtgatcaattgaaatccctgtcggggaaaaggacgggcgccagcaaagtccaaaggtaaagcgcagcgcaaagccaagaagagatgacgcgcacccaaagagatgccatgttgtcgttcaaatagcgcaaatcatcgctcgggctgaaggcagcgatatgttttagcacggaaacgttcgcatttcgtcacttacgtgtaccacgaagtgagggtcatcatcacatagagagaagcaagcgcaaaaatgaagtggaagaacgagtaggaataggccacggaccccttttcgttgtcgtaaacattgcgccccgtcgtcccacggtcgccctcctcgacggacattgaagcttcgcctgaacaaatggaattgttcgctcaaatggaccataagtcttccgccccccccccttcggttgctaatgtcctttctcttcctcctcctttcccgccaccgttcactttcgccttactcagagggatgtcctgaccttcggcatttccttcactgatcgccccaccaattttgcccagtgccgtgtatgaagaagtgcgaatggaagcgtagagaaggcaacaaaaccaaatgaccaaagagacgagcgaattgacgggcagcgaagtggtgatcaccttggggg

SEQ ID NO: 4618 - DNA, 1869 bp, Heterodera glycines
  misc_feature (1845)..(1846): n is a, c, g, or t
  misc_feature (1857)..(1858): n is a, c, g, or t
ggggactgacttggaattccctcccgcgtcgccggtggaattgtgccgaggaataagcgacgggttgcactccttgtctgaacaattggaacagtttgtggatgatctcgattcgaacagataaccaacccgggttattggtgagcgcactccaagtcaggtaacaaacgtacagtgacatcatactggcctggatgagccccgaattgggcattcgttcctgcactttgggcagaagagaaacgacggaaatgacgaaacagaggacgaaattgaaggaaataacgaatttcggaagggcacaagaggcacccttaagcaaaaaaggaaattgccaaaaacaaaataggaatgaaagacaaaccgaagtgtaataaaggaacatgaaaacggtgctggcgatggacagggcgtaagtgagcagcgagaaaaagatcattccggcaaagcaccagcgcgactcattctcctcgtaagtgctcacccaattttcggccaatccatgcgcaaaatcgacgataataacctaaaaaatataacaaaaatatatgaatatgatgtaaaaactaatattaataagccatgtcgtacgcaattctcataatttaaaaaatgtttttgaaaaatctttcagattcgccgtttaggaatttcgcgggtcgaattagaaaagcaaaaattcactgaaataaattaccagttggatgagaatgaatatgaaagcgccaagcattccaatccacatctgaaaaaataaaaaattgtattcataaaaaggttttttgaaatgcaatttttaaatttaccatcggagtcgcccatccgccgtccctcagatagaaaaagccgaaaatgagcaatccgagaagcaaatatttgaaaaaccaaaagccattttgaatcggggcacggccgtcacgactcgacttgacaccgagcattagcaacatgaacaggaggaagaaggaggtcatgcccatgcaaatgctgaagaggaagaaggccaatcacaacaacaaaagggggtattaggaaataagaggggaattaaggctttaaacccccaaaaagtcattcctgctggaagggttagtcccatggcaaaacgcatttggcgtcaccgacccaccggtaaactgcttggtaccccgtgaccatgtcacacacgggaatgcccgcactgcccgtcgccgaacagaaccatccgccctgataaaatggtttacaaaggaggcaaagtaaatgttgaccaagaccttggccaacattttttggacccattcggagagcatcacgcaggaggtgagagtgccgaccaacaacatcaaagcgtacatcacacgagtggaggtcgaattcttagaagtgggacagaaggaacagcacagggaacaagcagtgctgccgaaacagcaggccaactggaaaacggaacagttattcgaatgccctttttgttttgaacatttaccgaagcggcacatgccggcgcagccaaaagagcgcccatttgaagtagcaataaaatcaaaaaaatgaactggaaataccaactaaaaaatacacgtaaaaataaaataaaataaatttgctaatcatcgataaaatcgctaaaaatcctcaaaataagaccgtaagaaattaaataggaaaatacccaaattaaataggatctttctaaattttttagttttagttttaaaaatgcattgaaaatagttcataaaattcgaataaaatttttatttttcgttcttttcttatcaaatgagtacatttaattaagcaaattttgaggagaaaccgttttttacttccaaaaatacgaatgaacaaaggcaaagnnaaagggaaggnnttaaattacaa

SEQ ID NO: 4619 - DNA, 1769 bp, Heterodera glycines
tttttttactgtttttctatgtttgccaaatgaatattaattaaaccatgttttggtctgaaaaaaggttaattgaaacaaaatatattttgacaaattagcaaatgtgtgccatcataacggaaaaagtgccaaaaaatttttgataatttccgacaatattaatttaattctttgtcattacactttttcctgctgatcatttattcaaaatttgtcttcatttttttttcttataatgttgcaatacataaacaaacatatttaaaattccagcaattgttacggaaaaatggagacattttttcttatattttcaaatgatgtgcttaatggggaaaataaaaaatcacagaaaatacaacacagaagagatgaagaaacggctctgctgctgctggtggcagaagagatttttatcatcccatccttaagaagaagggtgtggatgggagagaaaaagtggtggtggaaaaaggtgcgacaaattgttacgggaggggggggggggtgactcatcacggacagaagcaccgatcgacgtttggcatttagcggacagacaaatgatcatagttttgtatgtacattattccgccttcctccgctttcatccaaccgtcattttttaaattaaaacaatttacctcctgtttttatttaaaaaaaaaaattaattttttgagtttttacatttgtataatatgtatttgtagctaattttcgacacttattttttgttttgtatttttttaattgttaattttttcgttttattaaattatgaaaggggaacagaggaagagagacagttgtagaagaggaagagaaagtggaagacaaagagggacaggagtgacagaggaagaggagtggaagagaaaagggaaagagaaaggggaagagggacctgaggagaggaggaagagaaaagggaaaagaggaagagaaaggggaagagggacctgaggagaggaggaagagaaaagggaaaagaggaagagaaaggggaagaggggcatgagagaggaggaagagaaagagggatagttgagaaggggaagataaaagtagaagactaagagggataggagtgacagaggaagaagagtggaaggggaagagaaaagggaaaagaggaagagaaaggggaagagggacctgaggagaaaggagtgaccgtagggcactgattttacatgtgtatacctaatatgtatttttaaagctattttttatccttactgttttttttttgcctttcttattcatcttcaactactcatcacaatggctctcaatttgcaggaaatggtacgtccttttaacatttacaagggtttctgccatatttgatggatttgtcctggaaaaacagggcaaatggctgaaaatattttacaatttggtgcttaaaatattaaaaataattatttaaagaaataatttaggtcaaggagttcgacggccgattgaacacgcttttggcccaggcaaaccattattcagtgccgactctgcacggaatcatgtccagtaagttgcattacatttcgggacatttcacttttatagggttttgcggggatccggattctggccgggattggtctcggattcccggctttttcaggtcaaggccccggtttttaaagtgccaaaagccgatagggtccgggacaacccgggaataatacggactggtacaggcccgtaaccaggggggggggcaaggggggataagaactggatttgaaaaaagaacaaaa

SEQ ID NO: 4620 - DNA, 3564 bp, Heterodera glycines
accccttctttcccaaaagttttttgaaaaagcgctccgaaaaaaagtgatgtgaaaatcaaatctgaatttctattaatattcgatgatttagtccaaaaaatgatttttgaaataattgaagaaaatttgtttgaaaattttcattaatttaatttgctttattttgggttttattaaataaaaaaccaaataattttgtattattttcacttgaaataaattaaaatttgaattttttttaaaatttttaaaatttttttgaatttttaaaatttcccggttggtcccggttcccggtttttcttgcggtcccggtcccgaagaaaaatcgaggtcccggtcccggtcccggcttctcaggtcccggcaagtcccggtcccggttttggcaaaaattcccggtcccgtggcactctagtttcaagcgccatttgtacatttaatttgcttttcttacgtctgttactacaatttttgagaatattttatagtaatttttgttaattgttaattcttaattatgctaaattttgaatgaataaataattatgccgaattaactaacattgtcaaacaattaccaaaataatgtcacttttgcgcaaattattgccttttgacatttattaatgccgtttttacattaattagtgacattgagtgagttaattaattcgttttgtgccattggtaacatttttttttgccgcttttagagtccttattttaaggacgcccttatgcaaatcggatcagcaaaacaagggcttcggttttttgagtatttttatcaagagtggatttaacattagggcttggataaaaattttctttgtctttcttctaaaacttgaacatgacttttctttatataaggacgtccttgaaacaagaatttgtcatattgaacattgaatttaaaataattaattaattaaattatttttgactgcttcttgacaatgtgccgagttggacaattgcgacagctaatgaagggcctaaagtgccaaaagccgataggacccgggaataatacggactggtataaatggggtataaatattaaatgaaaataccggaccctttccttacaatgaaaaatgttttgaatttaagccaaaaaaaaaatttgtcaaattttcctcagaatgtgacacattttgacactttttaggattggcggcctattttcgcaatgatggcgtggtcttggtcttgcctgatgccaacaattatggcattgccaaatttaacacgcattttgccaatgttgtgcgatgttttgagttttttctaaatttgtcgattatttactcttctgtcaatatatttatttcgtattttgtctcaatgttttttcttcttcacttagaaattcgtacttgttaatgaacaaagctttccagtgccatacatttgatttacttttcttacgtctgttactacatgagaatatgggtaagaaattttcataaaatcgacaaagtgggaaaatttcaaagacaaaattttaagtcccagaagagggcgaccattggccattctgtttgtgttctccatcatgagaatggggttgctttagtgatgaatttttctttgaatcggttggaattttttatggtcagtgttctgaaatttgtggagctaatcgattatacactcctaaatttgaggcttatcagagatcggaattccgagggtcaaaaacttttcggaaatcggaaattcttgaaaaaaatataaaatataataaaaatttttaaatattttaaggctaaatttaaaattcttaaccagccaaaaggtgatttcaaaaatgtttttgatatatttctttatgtattttgctaaaaaaaataattcaatggattttcattcaaatttttttttcttttcattttacattttttttagaaaaatttttgggtaaggggactattacacattttttccggcacacttgtttcaaaaaatctttgagaacatggggagggggcgggggtccgtcggtgccgaaaggcgccgcggggaaatttttttgaaaattttagttcaatttattaacagaaattggtcaaaaatttctgaaaccggaaatcggaattccgaccccaaaaatgtcggaaatcggaattccgtgacatccctggtacacaccactgtcagacaaaatgcaccgtaacgccagaattgaaagaattttacgcaaaaggcactaaatttaaaaatcaaaagaccattcgttatttggaacggacgggacacttgagttccaccagccaaatttatatttaaaaattaatttttggtattttttagaagtacattttcaaaaaatttttttattttttcatttgaatttttataatttccaaaaattctcaaacttttaatttttggcactattatttaatttctgcatttgtctgtcctcatgttttgcaaaattgaataaagcggtacgtcctttgatcattatttatcactaaaaaagcttatcaatggacaaattgggcacttttatttatttggtgataaaaatgccctccttcctcacattaataaccaaatattacttttttttatttttaaaatgaaactaattaaacgaaaatatttgccacccgaattactttttgagttaattcattttttgcctttcaaatgccgttgggctaataaaagggtttctgccatattcgatggatttgtcctggaaaaacagggcaaatggctgaaaacgttaggcaatttggtgcttaaaatattaaaaaaaataattatttaatgaaattaatttaggtcgaagcgttggatgacaaattgggcactcttttggcgaaggtggcacatgaacgtagaaatactttgtactgtgccattatacgtaagtttccgacatttcgatcacatcataattttcttatcgtatattctctaattatcgctccgtctccattaatccccccgtctccaattatcccccccccctttctgaggaggttgaaaaataatccccccggggcgataattagagaatatacggtatatatattgtcttatctatgaatatttttcaaaaatattttagggttcgagcccgtgggcggggatggcttttttgcgtgggcggggctcgaaccctaaaatatttccacaataagtttttaattgttttgttgttcccagaaatgccattttttatgaaaatctgttaagaaatagagccaaaatttctcaaaaatttcccgacgttaactccctaaaacccttttttccccggcagcgcctatcggcaccgctggaccccgtcccccaccccagttctccaaaagttttatgaaaaatgcgccgtaaaaaagtgccatgaaaagtcaagtctaccgaaaaaccgaaaactggtgggtccaaaaacttcaaaactgaaaagcggaagtaccggttaataacaggtcgtgaacaaccctagtaaatacctaaaacgctattttcgcctaatttatatcctttttatggcatttcttttttggaatattcatgcttttctaagatttttgc

SEQ ID NO: 4621 - DNA, 2624 bp, Heterodera glycines
  misc_feature (2563)..(2563): n is a, c, g, or t
ttggtgacctttcataaatgcaattagcatattatcctccccccaaataattaaaatggattgctaaattaattacccctcttaattaactcaccgatggatttgcatttgtaaatggaaataaaaataaaaatggattggaaataataataaaaaaaggaataaagtaattaaacattattaagtttttcttcttgaataaaatataaattatcaataaaaatgaaaaagagtaagtcgtgaacttttataaaatggatgattgattccattaaaattacataaaatataaaaaaaaagattattctcagccatcctcaatttcataatccaaaaagaatggaacgcattattacatttttattacctattgttgcaatataaccagtttatgcaaaaaaatctttgtttaaatataaaaatgtgaatttttgaatgcataataaattaaaatttttaaagaaattgaattgcggtaaaaaatccttttagaaagtttttaacagctcctccaaaattaagggttttggtaaaagtttaacatttaaaggaaaattaaattcacaatttcatataagaaattttcggaactttgaaaattttcactcagacctaaaaatttttggacccataattacgacttccggaaatatttacctattaaaatgaaaaatggaaaatcacacagccttataaagacttgaattagtgacatccgtagaattataaaaaaaaaaattctcttatttatttatgtcatttattattttatctactgaatgacgcaattataaaaaaataaaaatattatgattcaatttataatggtgacgtagaattatccaaatcccttactcatttaatatctaaataataatgttattatttaaaatgttgattgatcataagtagaattaaccaaaacccttattttttgacacataaaaatattattttatatttaaaattcaagcaataatgaaggaattaaaataaaatttcaaaaataaatggaaaacaataatcagttggccaagaattttgaactctagtttaaattgaaattcaaattctcaataattcaaggctctaagaattgacaattgcttaaaattccaaagcgaaaaatttattcgccatttttaaaatttttctctttttcagtgtgtgactcttaaaaacctgacatttatttatcctactacctctgtgaaaggaaatatttggtttataatttaattaaaagaattttcaaattaaattattttattttttatatttttgtgcctagatgatttttcgtaccctatgagcttagtttttcgtaataaaatcaataataatttaaatttacatattaatatatgtaaataatgggaaattaaattaaattttatattataaaatttatttattttatttttagcaatttttatatttttatatattttttttaggatttgcccattgatcattttttgcgcttctacctagcaacatttaaatgcaattagtttcgcaaaatgttaaaaaaattgtaattcaactttattttgtgcgtcctttcttccacgccgcagcaccaaatttttttttttggcacattgacaaaatgaaaatttcgaaagagcatatataaactttgaaaatcaattttagtgcctgcaacttctaatcctgttgatcagtaagaagaattcaattttttgtgatgaaaaagtcaaaaattttgcatccaactttatttggtgcgtccttctgccaaaaagcagtacaaaaaccgttttggcatatagacaaaatgaaaatttggcattggggccggcaatggatggtgtggaatatgccttaaaaactaccaaaatgacttttaatgctcaaaaaaaaatgccaaaaattgtgtaaaaattcagaatgactttaaaaacaccaaagcaattgctaaggagcgttttttagacaattggaaaaaattttgattttcaaagtttatatatgctctttcgaattttttttatttttcactaaataaaacaaaagttaatgaaaatggaaaatttttaatctattgttgcttaattttctaaaagtctctcattaacaatttttgcaaattctttgatgctgctgaccaccgcccatttccggacacaatgccaaattttcattttgtcaatgtgccaaaaaaaaaaaatttggtgctgcggcgtggaagaaaggacgcacaaaataaagttgaattacaattttttttaacattttgcgaaactaattgcatttaaatgttgctaggtagaagcgcaaaaaatgatcaatgggcaaatcctaaaaaaattatataaaaaatataaaaattgctaaaaataaaataaataaattttataatataaaatttaatttaatttcccattatttacatatattaatatgtaaatttaaattattattgattttattacgaaaaactaagctcatagggtacgaaaaaatcatctaggcacaaaaatataaaaaataaaataatttaatttgaaaattcttttaattaaattataaaccaaantatttcctttcacagaggtagtaggataaataaatgtcaggtttttaagagtcacacactg

SEQ ID NO: 4622 - DNA, 959 bp, Heterodera glycines
aagggaaacgtaagttttcggcaataatttataaaataattcatttactgagcaaattcttccacgaatggaagaaagaccagaaacaatccaacaaattctgctggggttgtctcgtcggtagcaaaagttgtcaccagtgttttggttggtagtgagtgccatggaactaccgggtgccaactgtgcaccacgaccgtttgggcatggcacaccggcggagacggcggtgaattttaatgatgctgctgatcacccgttgggctaaacaaacatcagcaccaactcaaagcttttcatctggtcttttacggttccgtgtgccatataaaactacaaaaatggcaggatttcatgaaactaaaatcaatcttatataaattttttaagtttgatatttacgttaatggaataaaataccttggtaataaaaaatattaatttttgaaaatatttttctagcacttaaattgttaagcatcgatttaattaaatgttattcaataaaaaatactaataaatgttctacttttatgctatgaaatataattaaaaaccttcaatgctaaatattgtaaaaaaaaatgccaaaaatatcgtaaaaaacgactcgtcgccaaccccggtggtatggcatgggcttaattggagtttgaaaaatttatgcattaaacgaaaataaaaataaaaatatgactcaattaattgcttcatagttttctgaaaacttaaaaatgggaaaggaaggaaagaacaatttcattggaaataagaaagattccgaagaatagccgaattttgtggaaacaaaaaaatttatgaaagaggcgacgaattgaaagtgccaaatttgtcattatattcttcttcctaaagcgtctttttcttcatcattttctgtttctgatatcccggggacgtttttgccttttcttcaatgaccatttttatatatttgt

SEQ ID NO: 4623 - DNA, 3310 bp, Heterodera glycines
  misc_feature (109)..(109): n is a, c, g, or t
ccttgcgccatttgaattttcattttctcaaatcttttacggcacaagagatcatttgttcatcatacccataaatttttcttttttctataatccgacagaaataatntgaatattctttagccatcttaaaaaatttctttggatttgtcgctaaccctttgacaaattctgaaaatagcgcatcctcaatcttaatttgactaatttaataataaaaaatattttaattgaaggacttcacccattttgtttgctcttcaaatttcggaatggaaattatcaaatttcgctcattatcattcatttcatcatcatccgcatcatagccatcttcctcttgttttttcctttttccgcttttttaagcatttcctccaattttttgccaaaattttctcttaatattccgtctaaactttcatttgtttgccattcattcgctgtgtcaattgccaattgcaaaatcatttcattaattggcaattttggttcatttaccaatttcacttcataattcaatctctccacatccaacaattttagttcaaaattatcatcgaaaaattcgtttaatttatatccataattttgtcccacccattttttaaaataaaattgcgaaatagtggccaagcaattcgccgcataaatcagtggtccttcaatttcaatttctttcttaaatataaattttggcttcactgttggaattccggcatattctctgtacatacattcgtacaaaatgttaaaatatttgcgatatttttggcattctgtccgttcatattcttcaaatttctcctcaattttgtcacattgccaatttttccgcataaaatgcacaatgccaaggtgtgcctcatatttttgctttgaatattcactgatttgcattttctgatcgcttttcacaaacgaaattagcattttttcttctctctgataaaaaaaagattagacaaattaattgccaaatttatttaactcacgaatggaattgcatttgtaaatggaaataaaaattgatgaggaatgataataaaaaaaggaactaagtaattaaatagcattatgtctttctttattcaaatataaattaataaaacaatttgtcccttatttaataccatttttgtttacattaaataatgaagtaattatttataaaaagcaattagcaaagtttgcatattaaattttaaaaaattaattataaaaattggtagaatcgctatgccttatgaaccattaagaaatttttacaattgtccataatttttttttgattttaaaaagattgaaattcattattataattttatttcgcatttttggaatatttctattttctgaaaattgtttgtttaaatataaaacaatttaatttgatattttgaaatgaaaaaataaataaattttaaatatgaaactgaaagaccttttaaatcctgctttttagtaaacccaaaaaataaaattaatctgtataaaaaagatattaaatttttgaacattactaattctattggattataataaaatgcattaattaattcaatttgatttttttcaaagggtattgtaaaattgagaaaatttaattattaaaatgaaaaaatggaaataacactgccttttaaacggagtaaaaatggatttgaaaattgttaatgatcacagcaggataattcaattcaattttttacttatataatttatatattattattaaataataatgtaattattaaaatggtgattgaccataagtaggattaaccaaatctatgttttacttatataatttatatattattattaaataataatgcaattattaaaaaggtgattgagcataagtaggattaaccagaaggcaaggagaggggattcttctctctgcggtgccttttggcttggccaaaaacaacacaataagcgaacgagcagggtgaagagatgctgtaggatccaaaacatggtgacgtggcacatcagtggcagaatccagaaaaggaagaggaaagtgaagaagctcgctccgccaatgagtccgaatgtcacgtcaggtcgacaatcgggatttgccagtcgttcaaggcatatccaacaatcgatgagctcgcaagcatctcggcctggacattggatgcttccaatttcttgttgccccgtttcgtccagtacattgcttcgcaatcgtagtcgaaaagaagatgttccttgggcaaacgatgaaaggatttccgaacgcctgattgagtgatgcactgagtcccatcggcacaacacagcaagaatttggcaatcccatttgggatcaaaatgtccacgccggtttttgtgcaggtcagttcgcatccacgacaacgaattggaaggccattcccacgttttggcttagtcgtgctactggcgtttgtttgggaagcgccaaaaaataggcacatcagaatggacagaacggaggccagtgctttggtttttgagcgagtgaccatagaatgagtcgggccaggtgaattgcgccggtcacgcagctggcaaattggacttgagtccgctgtttgggttctgttgtgatgttcctcaagcggcgggtttgtcagctgctggtggctctcatcttgttcggcagaggaagtcacttccaagggataaagacgatttaggggccggcttagcacctttcctgtggccaatcgaattttggcgtttcgaatctccccgtgtgagcgttgtaactcgacaattcgtcccattggccaacagttgcgaggaagtttttcttccgagattagcacaacttctccttccgtgggctctcgcgcatgaagcaattagcttatttattttatcgatgtagccaaatatcatttttgtgttaattttgaaagtttttgagatttttatcagtttttccgaaacataaaaaatattttttataaatttcatttcctttaaaataattttttttccgttcaaaataggtgaacatagaaatataattgtactcctccaatagaaccacctgctgtcttgaatagagtataaaattcaattttccattttggtttttttctattttttctgcagctttatttcgacgagaaatgcatgaaaaacacatttttagctcggaaattcttcggtttaacgccactatttatccctaggaattcactattttggagctttgccactaaaaaaactattttggaagttggccactaaaatagttttttgccactattttggcgtttcgtcactattttggccacttggcattttttggaaaatttcc

SEQ ID NO: 4624 - DNA, 2013 bp, Heterodera glycines
  misc_feature (23)..(23): n is a, c, g, or t
ctaaactaacatgtaaataaaantctgggtaggcgtttcagacacttctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtgatcagcacgaataacacaggtaacggtagcccaagtacagaaaaccacagcgttcccatgttttgtacgtgccgcaaggacatcccaaatatttttcgctgttcaaaacggtgccacaactgctccaaaatgggctggaaatgggtgaaacattaataaccatatttggaactttttattttttacaagaaatccgtttagtcccagcaaaaatgccataaaaatgtaaggctatagctccccttcctgattggctctgactgactccgtcatagccttgttggaccaacacttaactatctaacacctaactctactatctcccaattgtaaattaattgcctctaattaatgaatgaacacttacggagccgctgcgcggtaggctgattctccgtataagcggtagtgacgacagaagcctggcccctcccaaattgagcaacgttttttgccagcagtggccctctaaaatttagttgttattttaaaattaatttattttaatttattaaaaaaattaatttacctccatacattcacaaaattggttgtcgcagctcttttgtcctatttgcttgttgtagcatctgtaattgaaagattatattttaaagtttatacaaaaattgatgaagattagggggaccagcaccatatttgccattgtgctcgtccgacttatcgtatttgccagaaatgccaatatgaacaaatgccaagcaaaaaattgccaaaattgtcagtaccatttttcaattttcttaaattatggacaatttattttaattgcccaattcaaaatgttccctatcatctgatgagtgaaagactttgaaattgaaaattatcattttatttaaattgagtataatttcaattaagaaatattttttatatataaaggttattttgagtttaaataaatgagtgaattcatttgaattgttcatttctttaaatgcatttcttttctgcaattagtttgtaaactcaataacgctaatcactcattagttaatcaaagcatcataacgctactaattaacgaccaattaatttcaatcaagttttgcggaggaagtcattttgcaattaggaaaaatttgaaaagtgtaaattgtgcgcagcagtgcaaatgtatagcgaatggactaaaaaacaaaattgttcaacccaaaaaataggaaaaaataattgaaaaaaacaagttaggtgagcaaatattctcgacgtaactctcccctatctcaaaatgagtaattaatgaattaataaactaataaaataattaggaaaaattaattaattttaaaagagatttaaaaaacgaattaatgaaattatttgatataaggtcaaaaaaacaataatgattacacatagcctagatgatgagctaacaaataaattaagaatttttataaatatgtcgaattaaattaaaggcgcaatgactaagtacgaaaagtgcaagattgggcgaaaaatacgaaaaggtgcaaaataggcgaagtgcgaaaaagtggaagtgatcaaattaaaagcaaaataataaattattttaaaaattaaaacaaaaattattttatattaattaaatttatcgtttttagtttttggaggtaaaaattattagcgaaaaatgtgaaaaa

SEQ ID NO: 4625 - DNA, 2348 bp, Heterodera glycines
aagattccatttttttttaaatgacaatttaaaaactcattttgaaagaaatgaacagaagtacattgggttcatccacattttccattgtacctccaagaaattgttgcatctctgtttccgtccggtcaaaaacaatttgtcaaaaagaatgtccgtagaacgggcaaaatttttttcatcaaaaaatgcgcgcgcaacacgaaaataggctttgtaatggggaaatcggagcagaataatgtcgaaagcagtgcgacacattcgcacaatttcatgttgcaattcggacgcacaacacaatgaatggacctgaaaaagaaaggcattttggaatataattattgtacaacaagggttatacaagcaattaaaatttagtcattttaccctatgcctaaaattaggctcaatccaagggagaaggtggaaaaatttcaagaaaaattagcaattttttttgtggatcccaaaaaaatggcggaaaatgggcattttttttgaaaattttaacctcttttattaaaattcccggcggcacttatcagcagcacctgaccccccccccttttaatcatatattttgaaaatttgtgaattgtttgaataattattttattttacttactttttattttaaaaaattcattatttttttggtaaaaattaatttattaaaaaattgtcttatagtacgatgtcatgacacaccgggagagagaggattggggttattttggttatgactgtgccctttaattgtatgtgatgagtgagtttcttactcaccacatcttcaatttctccattatccatttctgcagtcagctggcggccatcaatgctctttggttgttcactaatctgtcggttgttcttgtccaatgcacttttgtccagaatggattgcttatcataaaattccgagacggaccaatgactgtcctccaagcagcgacgctgtacaccatgataacggaacaatgtcaaataggcgtgaatgttggccaaatcggttgcacattgagcggatgtgcggggaggaaatgacgatgaattgagtgccttgagataacgcagggcataggcatgcactttgtaatgaatctccaacggttcaaagtacgtctgaaaaggggggattgggtgaaatgtcattaataaactaaatttaattagccgaaaaaattgggaaaggttagggggtgcaaaatgtcattaataaataaagttgagttaaacaacaaaaaatggtatagtttccagaaaatccatgatatcgggtacatcttggtttcgttttgcgcctttcggtagaaattcctcatttcgatatagaatttatggtttacaatgccatttcaaattcaatctaattttttttctttttatctaaaataaccaattttacaatattgtgccatcaagaaatgccgtcgatagacgtagttgggaaatgaaaaaattttggaagaaattcaaaaagaattacttacttcttgacaaatgactgtatcgaaataaccaaaatgtcgcaaaccgaaacggacagggctatcgtccatgattacctgtttgactcggttaattttggtcaaatattgaatgccttcctcctccaacgcgagagcacaatggtagtacaagtccaaaacctggaaaattgtcgtaaaatttttcatttaaaattttaaacaaccttttcgggctgttccccaagtttttcgccaatttttgcaagaaaataattggacagccaagcgacatcctttggcgaatcgttgaaacggagggccaggcaaaagtgcactttgcatttgagcaacattccctcaattttggtctgcgctttgcaccgcaattctttgctcacttccttctgaacggagttgaaaacagaattctttttaaactaaaatttatcaatgataggtttgattaaaagttttttttttgaaatttcccaaaccttttcgtcaaagaatcatttcgaactaataaaaaaataaaagaaatttcttaaacaaacctgcactttaaagcgcgcaaaacgtgtcctcagctggtaaatgattgtgccaacatccaggtgtgattcagcaaactcccagtgcaaaaacagtgccattttgaacgggaacacataggcctccacttggtcaagcaattccgtgtcacttttcttcaaaaaatcatatcattgtttaaaaaatggcattaaaacaaagaaaacaaagtgtatagagtgctatttaaaattccaaattgaagggtttgtcgtggaagaaaagaaagacgaaaagcattgaaaatttgaataaatttagaaatagtctaattttttcaaa

SEQ ID NO: 4626 - DNA, 2692 bp, Heterodera glycines
accgattgcccaacatttactccaccattctccctcagccgtcatgccagtccgataatggtagtgggcaagcaaataaatacatttggcacaaaattcggagtgtgcgtcttcttggttttgctcctgtttttgttggtcaccaatttcatttacagctcctgacattgggattgtcaataattgatcaaagccgagtctggccctcttcgcttatttgcaatcgctcttcatagccgcaacagagaccgtcggagtcaaatttctcctccaattccaatcggaacgggcaatggagcagttcatcgagggcatggagttgtgccggatcaaccgtcaacaacgggtcaaatgccttggtaagcagctcggccaaatcgcttggcacacgtcgatcggaacaaatgtccggcaatttttggggcaggatcagttcaagaactttggccgcaaacgcccaatccactgtccattgcagttttgagccatggtcaacaacacggttggaacggaaccgagactggccaaatttatcactgaaataaattaagtattattatttttataatgatagctgatggacaatcagaattttgtatttactgaaatattccggtaatttttttttaataattttcatcccatttattttaagggtgtccagcggtgccgcgcgtgataaaattttagaattcatttaaatgtaaatattaattaacatattttgtcaaaaaacaatcattttaaagaaagtaacaaatcttttgggtccgctaaattttttttgattcgatttggtatttattattacatatgaactttttttttggtatgaatgtccactaatattgctatttattgtttaaatgactgacctaagacagcaccgtaaacattgcataatttccaaggcgatgttgtcccgaatatctttgtacgcatctgaggcaataacactacggacggatggttctctgctcgcactcagaaattcctcaatcaacagacgaagaaacgctccctaaaggtataataaatacatattattgacaatgagtgttcgtaacatcaactatcgagtcaattccggatccctaacaaaaatctacattttttgtaccgtttcgaattttagcccgataaaatggacagatatgcacgacatatataaggatgtacttcgttgcctctcccaccaaagcgtttgctccatttttcagaaaaaaatcttataaaactttttctaagaaatttcaagaaaaaaaatttccagcgatttttttttgtaaaatttttcgaaaaactaataattcttcgaaaatttgttaaaaaataattaaacctcatttctggaacacttcttcgccttgcccaacacttcgtggcccttggccaaaagcatggtcgttttggtgggtaatcggcggtccaaaaatgtgttgccattggcacaacagttgtagaacttcctcagttccgcaacatccctctgttgttcaccctcctcacgaaacttggcaattttgtaacaccaacgccacaaatccgtgtgctgtttgagcttctcgtgtggtgctttcggttgcaacaatttgcccaaaaagtagccaacagtggcaaagaaatgttcagttgacgcatttcggtcctcaattcggtcggccgggaaaagctcatcaagcaaatgaagacaacggcgcaagaatcgcttggccacaaaggaagagagatcagtgccaccgagttcgttgagaatccttaattattgggataagaataggctttacatgacatttgtgccatggatttttgggactaggaaatgcttaaaatttcgatccaatgtttaaaatggattttaaataagttttttttgtttttcagttttaaattgagaaaacaactttaattgaaaagaaagaacatatcttttggcagattaagagaaaattaatttattaaaagttccaaattttgcgcaggcggcgcccatcggcaccgccgaagctaaaacccttaattttcttaaaaagatgtctcaatttgcaaaattcgctcatttataaatttaatctgttaataaactacactcaaattttcaaaaaatttttcggcggcgcctacctcataccccaaattttttttgtaaaaagcgccgcaaaaaggtgggttaaaaagcaaaaacaatatgctcttttaaatttactaggtcgtcggtgcataaaaaagggcgctaagaaaaaatcctttgtcccaaagacaagtgttttctccttggccttcgttttcagaaaattcgaataatcgccccataacacaattttggaaacttgtgcgattctgtattttttatattattttaggggcataaaagcctcaaaacccgatggaatattttggatttttgtttttgactttcgggttggccaatagatttggaaacttggcccaaaataaacatggccaaaaaattttgtttttttcctttttcgaaaaatttcttttcaggttttttcttgttaagctccttcaatttcctaaactgaccaagttttaaatccttttgacatttttaacctccaaaataagggcgcttgtgtaaaatggaaacccaattttggtccccttaacccaatttttttggggatgggactttaaaattaaaaggacaaaaccaaaatttttggtaaaa

SEQ ID NO: 4627 - DNA, 2964 bp, Heterodera glycines
ttgttaagctcatcaaatttcataatctgaccaagttttaagtcgttttgacaattttaactcaagttatggacgttggtgtaaaatggtagccaaattttgttgaccttacccaattttttggactgtaactttagatataaaaggacaaaatcaaaatttttggcaaaaacatgacgagaacattcagataaaagaattacacacaaaaaagacataacaaacgttaatcaagtcttaaaaaaagtcattttgaaaaagcgcccttttttatgcaacgacctattaattgcacaaaaaaaacgtacttggaaatccattcaccaatgtccaaaagagagttgtccgtctcacgaatgcattggatcatcaacaatttctgctttatgtgcgcatcctccgagtccgatgtccaatcgtactggtggaggaggacatttttcaactgaaatttgaccgatgacaaattatcgtagtacaacacttttaaaaaaaaaatttatgcatttttttattttcaaaaaagtttttgcggtaaatttttcttattttttcgggtttcgttttttagatcttcaaactctttttcttcattttatagttttatttttttttaatatgacctcctcatatcgtttggcttcaattaggtagtcaatttgttgcagttggaattgtcgcacccttttgcgcaacaattccttcaaatttcggacagtcaaacagctgaggtcgaactcggcatggctcagcagtgcccattccggctccatgagagccaaagcagaagtaagctgtgtgtaagtgtgaatgaagtggaaagcctccgaattgggcaggctaagctcgtcgggcaaaaggttggcaattaacctgaaaaaaagtaatatgacttcaggcccgtagcatgggggcacgaaaaaaattaaaaattctaagcaattttaaatattttttggcatttcaaaaatttttttttttcggatattagaaatagcattttagatgttaaatttaaattaccatttatagcgcacctccaactgtctgcgaatggtcgagagttctgagcagtcttttggttgtcccaagtgattatcatcatttttgttaatgctttcatttcttccaataactgaaaataagcatgtttacaaaagctgaaaatgacatttgaagacttttaggttagttggtcaaaaaatgtgtgaaaaattttttttggcgagggggggggaagggtcgcctcaaataacattgatgaattttttttaaaacaaaagcacacccgtaggggaccgactgttgttgttgttgttaccagccacagtctgtcgtgtctgccgctgctcagcttgaattcgatggaacacccagcggaacagtgcgtcgttgtcgctggtaagcaacaacttttgttgtgcatggccatcgtcgtccactgatgtttgtcggtgaaattgatattccgtaacatttccattttcttcagcattctctctaattggaatggttttgccatttgacgcgtgtgccgttgctttttgtttctgttgcagcaaaagtcggccataaaatgcctgcagaatggacagtgcccgatgtgagccgagttcagcagccaattggtgtattgccaaatctgactcggtgaatgaacaatttgacaaacagaacagactgctccaccgggcatagacgtcactaaaaaatagtttttgtcaatcccatcggcaccgccgtgtcccacccttcaaaaattgtttttgaaaaaatcgtggcgaaaaaaaacaaccaaaagcagtaccggtaggcttcgacctgctccaatgttaggacaacaaatggctgctgttcaaaagcaacccaagcaagaaaagtgtagagaacatccgggaattttgtcgtttcaaatgatgtttcatcaatcaatttgacgaaaagttcatcaacacttgacaactgttgcgggctgttgatggcatcgggcataaactgcatggattgccggtgattggacaccgaagcttgatgttcttccaactcttgttcatcaaatcccatcaaagtcaatgcctaaaaagaattaactttttttttatttattaataataaaatatattgaaaaaaccaaagaaaaatttttttgaatttttttttggaaaattttcgattagtaatttattataatttagaaaaaattataaaaaaggtgtaaacgaacatccatgcgtgaatcgttggcctgtgtttgcctctgtttgtttgagtttccaaaataatccaaatcgtcgaataaacgtgtagaacggcgtaaactgatttcgtcttgagtttccggcatggcggtggtgccggcggctgcctcactttcttgggacatagacactccttgccggtcccaaattgtagcctgaaatttttgcaattcgaacaattttcttaacagttcattaatagaaaattcaaaaaacaaaaattttttcctcgaatgggacccaattactaaaatgttctgttaacaaattgaactcaatttttcaaaatttttccgccgtacccttcccccttccgtaattattttttattgaaaacgccaaaattggtgtgcggaatcaaaattcgtggtttacagttttacacatggctgggtcccctttcaaaaattggcagtgatcccccctccctcggacccctttgattgattttggttgattccccccccccctgcctctctttcatctatgcatttcaccgaccacacctacctgctcattgtgagactcattgttttgtggttgttgttcatcggtgtcccccctctccatcgcgttttggttttccgaaatttccgtctccgtggtcgcaatttgctccaacaatgtcattgcattcggctcatcagacatcaaagactgccgcatatggtactcgacaactccccctcctacaagggaacattaa

SEQ ID NO: 4628 - DNA, 2188 bp, Heterodera glycines
tgttgaatcgtttttgcttgttttgatcggcatttttgcttttggccttttcccccaatttattccctttacaatgctcttctctctttcttccctttgatgttgaatttgttatcccaaactaatcccttcgcccatcccctcgggcatttcccaaaaaacattctctttgtcttttttttgatgtgccgactattcttcgtcttaaccctttttgtttcttgtgttttctctcctaaaacccttttcccgatctttggacaccatttggatttcttctcttctcagtttttcattcacattttgacataccacattaaccaatttaacttatttttgtctaaataaactttgtccaaaaaacccaatcccaatttgctctagttttggtataagtgttggtcagacacaacacaaatagtccatttttgttttaaaaaatataaatgaatttcacccaattttttttttcacaaaattgtaaattactaaggtaatcgttgttgaaataatggacgagcaaaagtgcttccaacgcacgaaattcgtcttcacattgcgtcatgcaaaaagcggcggaccgccaatcccttcgacgaatggcacattgtccacaattaaaccacagatctttgaaatccggtcttatacttaaagcctggcaacaacaaaaaaacagtgtaatgtgaaaaattagtaatttttgctattggaggcctccgaaaaattgcaaagggtggaccctttttggaggaatttagtaatttaaaaaaaaaaaattttggggctctatctcaacaggtaaagtgccaaaaacttgccaacctggacataaaattggaacgggtccttggccagtccactcatggccaaattgatgttgaaatacagttttgccatatttggcacaattcgttgcgatgaagtgccgtcgccggcagtcattgatttttgccaatcaaatgttgaccagtcagcgatgtgatatttggacatcaccgggtggacaagaagtgccgaaaatatggagacagccctttcaatgtttccctcttgcaaaaagttcaaagcacttcggtatttgtcctcaatctccgcttcctaaaaggtttttttttaatgacgaaaatgaaaaaaaaattccagacggcgcctagcgaaaattcagaagaaaaaatagtcagtttaaggcgaataactattaaaacagtgttatttttcgcccatagagactataattttggaaaaaaataacattgaaaattttttagaggaagaacaaagaaaaattcttcggattctccattcgattttttgggcggttaagagctgattaaacctaagctgggagctgatttttttttgttgaccgaaacagaaattatccttttctatcataaaaaaatttcacttttcattttgtggcacggatagaaggaactcgcacaaaaaggaggtccagcattttggcagtgagttcaatggctcaaattcgggccacaaaatataaaagtaccaaaaaaaaaaaattacaataaatatattattaggaaaacaaaaagtttatgagtgagttttacttgtgcttcacgagatgttcgtggattgtccccatcttcaatggatgaccaatcgtcgtccacataatctgaacactcagagcgcaccggggattgatcacgaggacagtcagggcaagtgtaaaacagtttaaattgtgtatttgacgcttcttttacggtggaagcagccaatgacgaatcggtgtgaacatttacagctacagattggcctgaaaaaacaaatatttaggtaattaatataaaaaaaaaaattagtttagaggacccgatagaattttgcaaagaactaaaaaaaattacaaattttaaggtccttatgggttttcatcggatccactaaattgcaaaagcgctgaaacttttgattacttatgggacttaatgagtgtgaatgttgttgaagtccatcatcgtcattaagtggcgttgaattggttgagttcagtgttctatttgttaaaattggaggaaacatgtcaacaaaaaaagctaaacaacaaaatataaatttttaaagctagacattttgaaaaaagtcgtggatagcgcctcaaaatcgccggaccgcaaaatttttgaaattaactcgtgtttttaaaattctg

SEQ ID NO: 4629 - DNA, 486 bp, Heterodera glycines
gttctatacaaatacaacctttgtgtatttgacgaatattttgaatttctaaaattacaaaaaaaagcatcaaaggatttatgagaacaaaggtaaggagaaatgcagggaattcacagggaaagtcatgaaaaataagcattgtcttctataagcacagaaaagttgcgaaaatcatcgaggacagcgcaaagagaagggaaaaggaagcgccggtgggcggcgaaagtgcggagttgcagggaaaggtcgcctgaagaatggggggagggtaaccgtagaatattattcagtccgtagtgcagatgattcattccgtacaaggtttcccccccccccccgaacccttgtgagtcccaacccctcccacattttggtcgttgatgcactggtcgatgagcactgtgacccctttgttgccggtccgtcgctttccgtccaactcctcgcccgtgtaagcgcattccctcacgatggtcgtctcgt

SEQ ID NO: 4630 - DNA, 6708 bp, Heterodera glycines
cttcaaaaaaatcaataaatttccaaaagaaaaagaattgaatttctcttaaacaaagttccggaccgaaagatgactgattttgagtgttaaaaattcatttaccatcaatcaaggaatctaattaattggtgcggtattttacacacccaagtcgtctgttcccctcctccatagtgatcgggatggacgggacagtaaaaagctatcgtagaatccacttacaaaaacaatcaacttttcatatttatctacccttgatgtgtatgtatgatttttgagcttgtgatcggtcaaatttggtcaaataccaataaaatatttatggagaaaaatcgatttaaaaaacaatcaaagggttttattagatgtcattaaacagtgcatattgagctctttcgaggggaggaacaaaatcgagccagtcggaagcatggtttgggagaagacccatcgtgtgaccttgaaatttgaaataattaacgttaaataaataaagttaacgaaaaagcatacatttgtacacggccaatgcaattgcgcataaattccccaaggcaaaaacaattttgtggatccaaagtgagccgacatgctcttgcttaaagggatgaattaaaaaagggactttcattgcttagacacctccagcggtttaaaagcagcattgactgacatcaaagttttcatcggtctccacgccatcattacgaccatctcaaatgggcaaagtccgtcatagcacccaccattccccgcccaaatgtcaattttgaccaatagtcatgaaaaccgaccataattgggaaaatggagattgtgttgcccgccatgtacatcataaacctaaagggcagcctagattcagtcaccggactttccctatattcacccacatattcatcggcaaggatttcaccggctgcagggccaaatcccacgcccttttgctcaacaaatgctgctgctgttgctcggctctgttggccgattcattcttaaatgaggcaatgttatggtcattagtcatcccgtgcccacttgttgtgtagtgctcagtccgggattataaccgggcgggttcagactctggtcagctgctgcacttctcagcatcaacgtccgcgacccggcggacccacaaaggtccaagcgccatttgttcatcggattggcaagcggaatggaagccatttgcaaaacaattatttagtgagcaaattagttagttatatcaatgaaaaaatattttaattcaatgaaaataatgttattaaaaatttaggtttaaaacagataaaattcagtgagaaaatggtaaaaaaaagtagtcgcaataattgaaagaaactcagagatagggcagaaaagcaaaaagaatcattaagtttatcaaaagcgcgcatcaataaaccaatctttcttcatttgacttggagttgggcaagactttctctcattttggtcgagtctttgaacgcataaaccaaacaataatgctccaacaattgcgttaacagctaaattaaccaattgtctaactttttcatttaaaaattcacttctttctcatccaagggttccaatgactcgattctgaaaaaacaaaacaattattatttcacgatagatgggaaaagttaggtaaacctggaaacttcctgtctttgaaagtgctgactgtaaagctcactgatagtccaggcttgtacatgtgaaaagccaacattcaaaaacctagaaaagaaatacgaattgaaaaggggcagagaagggtgaaagtgcctttgtttttgggtttggagagatttgcacgtcgacagaccgggaagatgaatgccacgactgctgagattggtcgacatcactttgctgaaggggaaggacagataacatataataattaattgctctttttgagtgcgttttttcctttttaacatttccgattacctgaatgtgtccgtcatgttaacctgaacaaagtcacacaagttgatgtatttttacggcttgtaaaatggttaattaacaataaatgcttcacctgctcgtagttaagcacagcgactgtctcaaaacgtttggcaacatcttcaatgagttcatgggaatgtgcttcatccatgtaaacaaaaacacactcagcgattacgagggtcggctgagaaaagtccaaatcggcagttgccaatttcccgtcaaattcgcggatttgccttaggtcagtgcctttaaaaatttaggatcagtttcagtggcaacgtgtcaagtgaccgatgaggtggtaatcgccggcatgcaaatcgctgtgctgtttctcttccactaaaaattaaaaccttaccattaacagtttatgcctcaaaaatcattttgcctgttttgctgaaaaattccgttaaattcacatttttgttgcgtttgatctgacaaatctttttggctgttacgctgctgaagtcgagttccacaaacttataaaaactaagcccagcatctttgagtcgccaataaagtgtgtcaaatcccgcgcccaaattcaaaatttgagttgacggaccggcaagctgagaaatgcatttcaatcggaaacaatggggacagaaagtgcctgaacaaattgaacgaccatcgaagtgattgcgtttgtccgggcccaatagccacgagtgatctccgggtctctgtggtggggcttctccgaattgcacgcgtggatgaaagccgggataaatctatcggagtagtaacccaacttaagaaagacagtgattaatcttgaaaattgaaaggaacacctgcgcagcaacgaatttgcctaaaaggggaaagcaaatactatcggaattgattgatgttataagattaaaattcaaataagtatgatcaaaatttgaaaattatgttttttgattataccaaaaattatccatttgagggtttttgagtaacgcccccaaatccccttccaaattaaagtggacattgtcggggtcgctgattcgaaacataaatccaaatttcgaaaagttgaactcgattctgttcgaattcgggcccgggtttagtaattggtcgaaatggatgtcatattcttgatcagcggccccgataacccccgagtggaccgaagaaccgcaaaaaaacagttttttttcttttttttatgggaccagtaaaagtcagtattactgcccttgaaccggttgaacaactcactcacattccgtggcgtcgtcgttcgttttttgcaccgaataatcctcagacactgaagcggatcgccgtcgatgactcacttccgtactgagcaatccggaatcgaaatccgcctcagcttccattaaaatcttcagtagaaattttaaggatattcttttgatactgtaaatataatatggtaaatatatggacaaaacaacaaaaagttaatgatgcgtattgtataatagtgacaaatagcagaacgcttatatacgtttgtgtaccaaagagagaagggagtctattccgtcttttcaatcgttcaacgtcgatctttacaatccctgctgaagcccaaagccgggccccggcggtgtctccgtcagcgtcgtttgtttggcgaggggctcggcggctaaacggccgctcctcggcccgggcaaaggtcgcttgcccgccttgaactcgtcgattatctcttcaatgtcccgaggggtcaggtcttcgtagtaatcgtcattgatctgtcaaattcacaccaaaattacaaagcagaacccatatggcaattagacctgcaccatcggagcgttaacacaagccccgagacattcgacctcctgcagcgaaaagagtccgtccgccgttgtccctccctttttgatgcctaaattcgctttgcataaaaagggttaaaagttcgcctttttgaccaacccaatttcttctcaattgcctcgatgattgcttctgcgccgcgtaacatgcacggcgtagtgccgcacacctggagaaagtatttgcccacggggtccctgttgaacattgtgtaaaaggtggccacttcgtagacgcgcattcgaggcatttctaagaaacaattgactaattgaagggtgaacgttggccgacccaaaacacgtgccacttcgtgcattgcggaaatgggcagccacccgtgctgccgctgggccaagtccaacacgggaatgagagcagctcctttatgtccctccgggaaattgttcaacagcaccgtaattttggccaaattggcttccgtaaattggaaaggcgtgttcggattgttccgctcgttgtccctgtgcacctgcagtccatgggcttaatgaaaggaatacgtatgaagaaacaattaatgaacgaaatgctccacctgagtatcgcctcaagggacgcgcagcaaaagaacagccaaaagggaaattgcgcaaatgcttagcaaacataataagccaaaaaaagggaaacacactttaacagtgaagggaagtgaagtaaaaatgaacaaaacataaattgggagaaacgcatttgaataatttacctttttttattcataattgctttttaacgataacaattgagttggacaattaacgcgggagaattcacatggagatcaaagggtaaacaattaaaagcacaaaattatggacccttattaatggtaaaagaaacgcacgaacaaagaaaaataaataaataaattctaaaataaataggccagttttgaatgagttgccatgcacaaacagtcagtgtaaattgttgccaaagttttcgcactctcttcaaattttcgccgactgctgctgactttgagcggctttttgacaactttctaaatcatacaaaaagcattaaaattagttttttaaaaaggcacgaccattccacaactgctcttcagcagggtcggggttgtcagagcaaaaatcgtttgagtcggcggtgtcgtgatcggaaaccgggtaatccgagccttaatgatgggggggggggaagcggttaatgtgccaataagtagtcaattaggttaatgtgcaaatagtagtcgtaaaagccatccaaccttcgctggttgtctcctcctcttcctccttcactttttccgtcccttcctccattccgttggtgccgctattcccctccggcccattaatttcgttctcctttcccattgcaaattcggtccttcctcccccctcattcggctggtgactgccacagttctgtggagaatgaacaccatctgaagaaacgaaaagcaatgaaattgaggaagtaatagcaagaaccagtggggcaatactgatgccaatggtggacaatgatcacgggcgcgggtggagttggagctgccacgggcagctgaagaggaggaacaccaagaaatgttgggccgggtaaagagccattgggagaaatgggctggcaatcagaatactttggacacaattcctcctctgtttcttacgagttgctgattcctcagctcatactcagctgagagcgattccgagtagagcgaaggagtggcggcatgcattccgagggggccgtcattcggcccattttgcctgagtgacgacaactgtccccgctccactcgcgatctgtgccgtcctcgggccccttccaaactgctcagttttcgcctcctattcctccccacattatgcagtatcgaattggttgttgatgctaatgaatgaatcattagttcggttcccattggccatcccatacaatcgattgcggcatatccattcgaatacatcgaatcagccaccgatgctcggcaattgctgtcgctgctgctgggattcgttctgggtccgttcgttcgccgacgttcttccctttccccattctccaaagtgtccatttcgaattcatttttgttgtcgtcgtcctccgcttcctccccactttttgctttttcatcgtttttcgacttatgcaattttgtcaaatagtacgaaaccacacaaagtgtaagggcgagatggaatacgacggcgagcgaattggcgtaatgccaaaacggaatccgagggatcgcgcgacaattttccaaatgctcattgcccttccatcggtcattcgaaagagcggacagagaacagctgaaattcacaatttgtgaaaatgggaaatggaaaagcaaagcaacagacttaatttgggcggagagcaaatcactttcatccatctcagccaaagggtaaaaactcaaaacgcagccaaaataagcaaacagcagaaaaagcggagagatctgacgggtcaatccgtcgacaaatctctgcgaaaaagagagttggccttgttcatctcggaccattgcttcgttggcacgaaatttggcttcatttttcccaatgtcaggaagggaagaattgtttagagtttcatctacgagcatttggtccatttgaggtccctttttaccattctctgaaagaataaatgtaaccaaaataacagagaaaatgccaacttttagagtcgtttttggccttggataggaaaaggatgaaaaatgccaccagcaacaacagaacaaaatcaacaaaaataagccaaaccgaatgaaagtgaaagtaatggcacacttttggcacaggatcaattgaaatctgaaaataacgaaggataacaaaaagtgtaaaaacattttagcacaacctctct

SEQ ID NO: 4631 - DNA, 4610 bp, Heterodera glycines
  misc_feature (664)..(664): n is a, c, g, or t
  misc_feature (672)..(672): n is a, c, g, or t
  misc_feature (715)..(715): n is a, c, g, or t
  misc_feature (732)..(732): n is a, c, g, or t
  misc_feature (4508)..(4508): n is a, c, g, or t
  misc_feature (4598)..(4599): n is a, c, g, or t
ggtatagttgtttgatggcacgttattggatgccctccagaattcggcatttgccgttgaaaagtttgatttaccctaaacgaatttctggcagccgattgcgttgcttccgctcgggctgcttgtgcaatgaattcatcaaatgtcgctccgggtctgcgtgtcatttcaagagtgatcgccaactcgggattagaaatggctcttataaagtgcatgattgaataatcatcgtattgctgttcggttaaacccggataagcgcggcggaccaaacccgaaattctgttcccgagctcatcgacactctcgtttggtcggcgccgaattccgcgcattagttggtcgaaagacgtcaattgtttggcgtctgtgtcgtccaactgtcgaataattatccgcctgattagctggtattcatgcgggttttcggcaatagctgaattgtaagccctctctgctttgccaaagcatttcgatcgaagagcgcgaagtcgcttatgctcaggccattcctctgtcgctacatcaaactgtttaaaaaatgcgttcactgcgtctgatccgctggtgccgtccaaattcggaatagagttcagagtcattgtgtacgagaagctgtctaggcttctaatggcctgtgccatcatgccatcaaataccnagtccggngtggactggctgctgatattgttcgaactgaatcggatgattntctctaattgcacattntggttgtgatttggaactggggagcttgttggggattttgtgccttaaatcgctgagcataataatcgtcattgtgagcgtaggcatgaggtggcgggttttgtcgaaccaaatgatgctggttttcggcaaccactggtcttacgccttggagaggtcggtaccgttcagcattacccggggcattctcatacaattgttgattcattcggtaactgtttggctgtggtcgttcaatggcagtaaaattgttcctactgtgccccgtttgttgattttgcatgacattcatgtcacgcctttgatttcggtcgggaattaaactcaagttttcagaaaaatgcagtctaagatcgcgctgtaaaagtccaaaatcgcgcgagtcatgcggtgtagaaaatattggcccatcattcgcatttgcatttactgttccaacttctaccactccaccaatttgttcaccccaaacttgatttcccacattttccctcaaattttgttgtagaaccacaccattagcattttgttcgttgtccgcgtccatttcctcatactccaactgctcatcatttgcgctgagttccattccgacaccgataagtcgacgatttgcggttcgctctaaatcattcacatcattcccatttgctatggattcattttcattcgaagctaagggcgagttcggtctgtttccaaatgcttcgaaattcccggtccggtgcgcattcccatcacggtcaactactattccgtgatttaaggctcttgtccgcgtcagcggtggtgtgcgaatcactcgcattacaaatgagttgtttcaaatttcgtcgttccgtcgaacaaaacttttcaaatcgcagcaatgcgttatttgatgaagcggcgagcccacactttcgcagcaatgcgttaattgtggggcaaaatcggtgagtcgcaacaatgcgttagaccacagaaccgcaacaatgcgtttgttctgttcgatgcaacgcgaaagtgtagaaccgcaacaatgcgtttgttctgctcgtctggtgatgaagtgtcaactcttcagcaagccaacagacggacaatttgttgccggagaagcgaagctcgaccaatgagtaattcgcttttgttgaacgccgagcaaaactcggccagaagaaaatttgctttttgtcaaaccccaggaaatcaaataactcccctttttgtgcccaatctcgcccttttaatgcaaaattcccgacaccgcttactcagttgtccaggagcgccacgtccaatttcaattgaattctcctcctttttgctttgccactcggggcggaatagtcgacgtccaggaatgacgacaagaagacaagcgaacggactgtagaccaattaattaattaacacaggcggggaaaggggccaatgctttattaattaggacaggcacttcggtcagggacagttcaattacgtttattttaaattcaatccgaagaaattgacgaataattaaatgcacaccaaatatttagagagaacagtccgaagtaaaatgtaccatgaaaaagaagaatgaattgatggagacatgcggggaaatttagcaaaggaaatatcgattaaaaataacaacataattagagaaaacaacaaaaagaaaggaaaacataattataggtcagaggtaagggagaaaataacacaatttatagaaataaattaagcagagagaggtcaaaatattcaatttaacacagcgcaacccaaaaaaaaaaggcgtccctgccgttaattcggcatccgttaggtggtggcctgagtaagctaatgtcggctgccccttggcacatcgttttggttgtaattttttgaagagtatcgacgggcattgttctcacggcgatgaaaaggcgatcgggaacgagaatacgggcggcggtcgcatagacccaaccccccacgagccgaagaagacgacgaagtccctgggcggtcgcatagacccaacccatggacgttgttcacggaagaaacactggagcggaggctgcggatcccaagctggcgattgtttggccactgcgggatttgggtgttgatccatgccgacagtgtcttaatgcgttttccgtcagccatccgtccgaattgattcgacttcgatcgaacgactctccgtatctccaaatctcgacaagacttcgtcctgaaggagtcacacaaacgaaccaagtgcccaacagctccgccaggcgagtgttcaattcttggcaggccaactcgcatttgcggacataaggcggcggcaaccaaatgaacgacacggatgagaagcgtgagcaaagctgttggattcgctggcattgctcgacaatttggtcgaccgtttcgtccttgaccagtgagtcacgcccgaggatgactatggcggcacggactttgctagagaagacacattcgctcagcggtcgaatcacttccgacaaaaggcctctttccgtccccacaaattgcgtttgggccttcatttcgcaaagaatttgatatgctgtggaatcgccgatcagaactcttggcgtttagacaaagatgcggcaccggtgaatgacttgcgcacgtactttctccagggtccaaccggtctcctcgagcagtgagccccaaccgtcgcgttccgtgtccggcaattttgagacagcttccggcacgacaacctgaagtaattccgagttttctgttgaatttttgcaacgtttttccactcggatttggtcgaatccagacgattggaggagtttctttgccacggcacatttctcgcaccacaaaatccagactctttccacgtcttcatggtttggaaagatgccggcacggacattgtctttacggactccttcgtagacgaccaattccattccgggttcggtgccgagaatcagttgcaccaaatttttagccgccgaagatgaaactgttgcacccgaacgaaggatgaacagactcaaaagggcttggagaggagtgccaatttccacattgcccggctcagttttcgcgtccagcactgggtccaactcgccgcacaaaatttttccgcaaaattcgtgggtttccccttcacacttcatagtccacgaaagtccgtcgttttctttctgctggcgctgctgcatctttcgttctcctaaattgtcagttgtccctaactgattaacgacgattttttccgatgactttaaagaattttccccaaattgcgtctgtaagagcggttcgaactgtccaaaaattccttttgtgtctaattttgaaagttttaagctggccaatagaattgtagctaaaatatttcggtaggggttttttccatgaggaagggtagaaatgtcgggtacaccgattggaacgcgcacaaggcgttctattggaacagtaattggttctgccgattttttatcaaccgggacaacactagcagatgattcgagtgttttgacaatttcgtatggtccgaagtgattccaatgtaattttttgtgctgtgtttttgatttagagccagggtaaatgaccatgcagcgatccctgactgcaaatttattcatggaaacatttggacgtaaatcatatctgtttttggtttccgcccgtgaaatttcggcatttttacgggctgagtcaagaattaataacaaattttctttgaagaattgcaaatatgtctcttcatcgattgtgtaaagagggtttccaaactttttgacgtccatttctcctgngaaatcggcaaatttcccgaacatcaggtgaaagggtgagtacccagtgacttcagatggagtggtgtataagaaacataacgaaggaanngcgtcgtccca

SEQ ID NO: 4632 - DNA, 1550 bp, Heterodera glycines
  misc_feature (21)..(21): n is a, c, g, or t
ggactccttcgtagacgaccnaattcattccgggttcggtgccgaggatcagttgcaccaaatttttagccgcagaagatgaaactgttgcacccgaacgaaggatgaacagactcaaaagggcttggagaggagtgccaatttccacattgcccggctcagttttcgcgtccagcactgggccaacttcgccgcacaaaatttttccgcaaaattcgtgggtttccccttcacacttcatagcagggctggagcgtccgacgttttctttctgctggcgctgctgcatcttccgttctcctaaattgtcagttgtccctaactgattaacgacgattttttccgatgactttaaagaattttccccaaattgcgtctgtaagagcggttcgaactgtccaaaaattccttttgtgtctaattttgaaagttttaagctggccaatagaattgcagctaaaatattccggtaggggttttttccatgaggaagggtagaaatgtcgggtacaccgattggaacgcgcacaaggcgttctattggaacagtaattggttctgccgatttcttatcaaccgggacaacactagcagatgattcgagtgttttgacaatttcgtatggtccgaagtgattccaatgtaattttttgtgctgtgtttttgatttagagccggggtaaatgaccatgcagcgatccccgactgcaaatttattcatggacacatttggacgtaaatcatatctgtttttggtttctgcccgtgaaatttcggcatttttacgggctgagtcaagaattaataacaaattttctttgaagaattgcaaatatgtctcttcatcgattgtgtaaagagggtttccaaactttttgacgtccatttctcctgggaaatcagcaattttcccgaacatcaggtgaaagggtgagtacccagtgacttcagatggagtggtgttataagaaaacataacgaaaggaaggcgttcgtcccaactccaatgagaggaagtggactttttaagcatgttaattaaggtttggttggctcgttcaaccgctccgtttgcttgcgggtcgtaaccagctgtcgtggttttctcaattccaagtattgcagaaattccatttaaagtttcgttaacgaattctttcccctgatcactgtgtagcctttttggtactccaaactgcaaaataaattcctttacgaaggcttgcaatcgtttctttgcttttgtccggaattggtattgctatggcgtattttgtgaaatggtcaatgcagaccaacacatagcgatttccgctttctgatggaccaatcgacaaaatatccacgcaaacaagctcaagaggctccgtagtctgaattattctaagcggaggctcatttgaccggggttttcgggtgtgtgcacagattcggcagctcagacatgtcttaacgcagtcggcgaacatattaggccaaaaatatttttccgataattgacgaaaaattttctttgcactaaaatgaccggcacaatttcccgaatgacg

SEQ ID NO: 4633 - DNA, 3315 bp, Heterodera glycines
ctcgtctcattctttttggccagctccccccgactccgtccatttggtcatggcccctttggagctgtcccccgatgccaagtcggtccgttggttggtctacgcaatggaaagtataataaacgcaattgtgagacatcaaatccccaatttgaatgcctttgttctcccttgtgaaggatgcccctcaaatttgtgccaattctgtcgctggcaataccgaacttcgccctcaaatccgactcgagctgttcatgcccaaaattgtgttgtcttctccctccaccgactgtccgtcctctctctctcagcaaaatgacccccgtctccccaaacggctcattttgcaagcgtccaccgtccttctctccaatttcatgctcctcaacgatccgttggtgccattgcccataatgttcagagaccgattggacgacaaacattttaaattcgttgattgggcccagaaaaacaccgtggagacaaaactattggacgaattgcttaagaaaagccgaaattccatctcgaaaaaaaacggtctgttctttcaattgtgcggaaaccgtagacccatttttatactccttcacagtttattttcaaaaaaaatgcccttgagggaaaataatgttttagcatcttttggtctaaaaatactggacttgaggatttccaccctcatttcctttcgaaaaacataataaaaaatttaccaggaatcaaaaacttttcaacaaaaaactttaaagaatttgaaaacaaaaaccaaaatgttaattattattagttctctgacttttgtatgtttaattttggaggttaggtttagacaatgccgacttctttttggaccatgaacagcgcaacgaatggattctatccattccgtcgctttggaccaattgcgacttcggtccaaacacgtgggaactgccttttttgaccgatttgaatattttcggctcaattcttttggacgactccgatggaagctgtcaaagttttctgacttgttttattttttattttaaattgttaattaatatccagagaattgcattttggtggagccgaggacagatttgggcataacggtcgaccacttccaatttctgcatttgaacaatttgctgacggaagtgagctctctgatggatcagatcaattcgggttgggattctcttggaatggcattttgtttctacttttatagaccgcactttcttccggaccaaattgccgaatctctcttccgacattcccttggccatttattgtcaatgtcaaaaggtgcttttttgggttagccgacatttgcggaccgacttttgcggaccactatttctcgatagaactgtctaaataaagaaaaaaataataagaaattttaataaattcaatattcccaaattgaaattagtgaaggtaagctgatgcaaagcgatctgtctcaattggagacaagtcttatttgacataacttttttctttcttttttatagaatttctaacttataattaaactgtgaaattggcgaaaaaattagctaaattaaatataaaagtcagttcaagaattttataccaagaaaattttttatcttgtttcacttccacgctttagttaaccgagagcttaattttttccggcatgtcaaaccaattaaattaacaaacaaaaactaaaatagtttatatttttctcaaaaattgtccgtaatttgctgttattaaaactatgggtccaaaattaaaaatgtgcaactacataatatatttatctatggaaactaaacttctttaaaaaatgggttctttcgatgttgattgcaaaaagttgatcgattactcttgaagggcgatgttcaacttggtaaaaatcacaaataaaactacttagtcactcaatttttgaaaaaattatttttttttgtttttttttgacagttcaacccagaaatagtggtccgcaaaagtcggtccgcaaatgtcggtccgcaaatgtcggtccgcaaatgtcgcactacgtcttgtaagagcttttcttttagtttgtcgactaccaatttttctttctctcccatgacaaatggtgtgttctttttcagaaggtggaacaatggcgccgcaatttctccaaatccgtaaataaacttacgataatacgtcatgaagccaaggaaagagtgcagttgttttttggttgttggaatgggcaattcaatgacaggccttattttgtctgcgttcatctttaagccttgtcgtgttaacacatggcccaaaaaaggtaattcctcagcggaaaaacggcacttttcaatttttaatttcagttcggcatcctgaatacgttcaaaaacaatcttcaaatgcttcaaatgttgttcaaacgtctcagacgcgaccaaaatatcatcaagataaacgaagacaaaatcattgatcagatcttcaaaaagacgagacatgaatcgctggtaagttgctacagcattacaaagtccaaacggaagcaccgtgaattcatgcagtccaaattctgtgacgaacgctgttttttcaatggacttctcgtccattttaatttgccaatatcccgaaaggaagtcgagggttgagaagtatttttttcctcccaatgcgagaagaatgtaatcaatgttcggcaacgggtatgcgtctttcactgtgaccgaattaattcctcggtaatcaacgcaaaatcttaagcttccatcacgtttcgggacaaggacaatggggcttgcccatggcgattttgacggccgaatcaatcctctgctcaaataatcctgaagcatcattgaaactttttcacgatgtgcaaatgcgatacaaacgaattttctaattcatgccaatcttcgacaagttcaacttgcgcaacattgcttttcgcctccaaagtaatcggaatggccgaataattgacaatcgggacaacaagttgtccattttttcctgatgtaagagttggctcaaatttcagttgttcatgaaaaccgtctcttccgattacagatacttctttatcatccagctcgcgcaggactgacaactcgacaagcgtagatgattgcggaagaagagtgactctataaattatgtgtgctgaattcgcttgtttatcgagtggagaaaaatcgatcacattcatgttaactttgtcgatcaatttaaatcctaattgattcaaagcatttgttccaaaaagaagatcgtatccaaaagtagactggacaacgaacattcgaatcctagcccgtttctgttcccctaacaattggg

SEQ ID NO: 4634 - DNA, 1088 bp, Heterodera glycines
actcggcattcgcggctctttcagcaaaaaataaaaacacttttcttaagaacccatgggtgctctatccacccaccaaatttcattcggaaatcccacggacacccggggaccttcctttgtcagtgaaataaaatgacagcaatttattgtaatgacttggagaattttgtgcaatttgcccgcatccacgtccaacagacgaccccagtcgaaaaagtcgacaaaaccgtcggcgttgaaatcggcctgtttgaaccagtcacggatggccttttggtctgttttgatgccaatttcctgtaaatttaaagtctgaatccaaaaaatggttaagtggtgtcaagaaacccctaactcacgatcagtgaaacagaattaatgtgccaattacaatagttttgccaatgctttgctaatcattcgacctggagtcgctcgaccaattcatcttcgctgagacgactgagcaccaagttctcccaactcgacccggtcagcacgcggaacaaattttccatttgcgcgatcgcttcggtcagtcgtatcagaatacgagggcgaccaagggcggttatctgtgtgaaatgcatttaaaattctgtgtattaaacccaatgtgttttttatttggcaaactcttaacggctctttctcactttgatggcagtaaatccttggcccatcgtggcttgcgcagttgcgtcgatgcacttgcagaaaatgtcgacgttacggtcgcattcgctttcaccactctaaaaaaacatggagattttggaaagtggtcaaggacattaaagccgacaaattcggtgagaaaaagctgttgttaatgggtaaacagtgagacacaaatggacattcacgaaaagctaaaaaatttctttctatactgatatgaagctgacaatgttttaagttggttaaacagcgaaaccccaaaaattcttggaaaatcatcaaattttttctttttggaaaaaaataatcggaaattcattggaggatagagtaagagacattagaacaaatagcagagctaaaaagtgaagcgagcactgcagcacgcattgcgcgtgcacatg

SEQ ID NO: 4635 - DNA, 5469 bp, Heterodera glycines
aaagacgtaaaaaaatcacaaaaattcacgttttcccagtcctacaactttaaaaccattctggcaaaatgaacgaaataagtgccataaatgccatgaaaacgtacataaaagtatgtacgtgcgctgacgacatgctcacgtcggtctccgaattccttgtgcacggtgaactgtttgtgcgtttggtccaccaattccgccactgattgatcaccgagtgcgtcctccaattgcgcggcatgtttaggcggaaccgcgctggccaagacgtccagggcctaaatgccattaaaaatggatttaatttaacattaacagctcatacgggtgggagtggttgcgtttcctcttcgtccagaccttccactgccttttctttggcctcctcctccgaaatgtccgactccacactaaatcagataaataaatttttagtacgggaccaataagggtcagattttaaggaaaaagtaatttattttgagttggtttttgtaggtttaaccactcgcccacccctatcgcacgttccgttgttaatggttggcaaatgcacaacaacaacacctgtagtccaaaatgcatttgacaccgaagcgctgaagtcgagtggccgtttttgaaaccttaaattgtttgggacttaaaaattaattattgataacatattcagagggttctgagttcaattgaatcattattgaaaaaaaactagaatccaagaaagtaaatcaaaagttcattcagaaatggaaggttagcattttaatataaatttaaaataggtcatgtttaaaaaaaaatgaaaactgtcatttatttcaatttgaattattgaatgaatattttcttttgccagcctcgccaatgtcctcgccagccacaaaatgtccgtagaaggtgcttcgcatcaatgcattgaatgcgcgctttccaagcattttgcgggccaagcgcatcaacgacatgttgttttggacaatccaattgttctgacaaaaggcgaacaccagctgagcacggaccagttcactgttcgttttgctctgcgaaaataacaaaatttagttggaacataaaaatatgcgttcggacggccattccttgtctaaagttgatttaagacctttaaaggtgctaacttttggtgaaagactccctcccgcatgaccattttgactcaaatgtaaacatttcgtctgccaaatataaggcccaaagtccataaagggaggttgttaatctattcttgtttcattgctaaataaagacgaaccttaaatgcctcctcagcattctggaaagtcagatccagtcgcttataacattcttccgattcggcgcgcaactgttcaggcgttttcttggtcaccgagagaagcgaagttgacgaaacttgctgaaacgctgaggcgttggaactcactccgcgcaactgctgagaaattgaattgaaaataacgagacggagggagaatataagtaattggtattagaaaccggatttttgagaagaatgggccaacatggcttggctttgaagcacagggccattcaaatgcaacttcgatgaaattatttaattgacctgaaaagaaagaaatgtgggatttggaaaagcactaatgaaaatcacagctaaacttttgctctatttattgaagaagatgtgatccatcagtcagactaattgcatcacgtgttctgccttatttgttttttggtaattttccaacttttaaaaggcaaaggcgtacgcatgtcacaatgcaattggcgaaaaataacttgtggttagtgctcaaggccgaaaattacaacacattcgtacgtataccaaacaaaaagtgtgaggaataaaaacaaatgactgctgctgctgttcactgtgttcagctgcaaaacatttggatgaaagggggggggggggactccaataattcattccgttccgctcaactcattgagtttaaaaatgtaatgaacgccgacgacagatacataaatcgcaactcgttctcgtctcacaaatcagcaaattatattttaaaaaacagagagaaagacagaaaaagatcaaatctcgcaacaaatggcgaaggaaaggtaaatgtcagcgctgtgcaaaatgattggcaaaagaaaacattccgagtcaaaagtgtactggggaaagaaggggagggaatgaacggatgacgtaaccaaaagcgaaatgggaaaaaaggggggggggagagagaggaaaagccaaatgaaacgacggacggaggaggaggcaaaggaatgcataaaggaggacaaaagcacaacaaaacaaaaggaatgaaaaatgacgagaaaacaaaacaaaaaaaaaattctgaaacttttggattttataaaataaaaaccaaaataaaaatttaattatttaatattttcacttgaaataaattaaaatttgaattttttttattttttgaatttttttgaatttttaaaaattcccggttggtcccggttcccggtcccgaacaaaaatcgaggtcccggtcccgacttctcaggtcccggcaagtcccggtcccgacttctcaggtcccggcaagtcccggtcccggttttgcccaaaattcccggtcccgctctactctacttaccaaagcttaagactggtggagcttttaaggaagttgaaatgcacaaaaaaaataaaaaatatttgagattgtgtaaatttttaaatttaaaaattattaaatttcgatattatttttgccaaatttaaaaaataaatttgttttggccttaatttcacgacaatgattgatcgaaactcgccattgcacatgttcgtttttgctaatcggttagcaacttttgagggccgatggaactacaaagaaggatgcaccgctgaaaaagtgagcacattcgaccttagggttctactggactttgatccaggcctgaatttctcatggatccaggtcctggctattttttcagcaacctttattttactggacctggggttttactgggtacaatatggaatcaaggtccaggattatttttaaaatctcaaattctaacattaccaacattaagatttcttttttccaataaaaactgttcaggaaattcctaataaattaagccgatttattagtatgatttagtgtaacttttcagatggccagggcaggtttcttctgcactgagaagcgaaagaagccctctgacgcagcgaaatgttacatttgcctgcacgaaatgtattgggacccggaggacgaaccgtggttatttcatttttagtgaattcggcttttcactaaaaaaaacaacacattttccagggaagagcacaaaaagcaccgcccggactgtcctttggtgaccatcggcaaacaaaatgaggaggaattcactgtgcgcgaagtgctccttttgcttgcatatgaacacagcacgaaaatggttggtgccaatgccattgaataaaatggcgtgaaaattgaaacggattccatttttaaaaggtgaaaaccacttcctttactgtgttttatcgtgtttattttagaaaggcctttgaatttagaattatacttttctaaatttacaccaaaatattcaaatcatttttatgctgaagggcataaacgaataaataatcagacactgaattaggttaaaatcgaattgccaagaaaactttgtggttatttttgttcgatttagtacccagttgcggatgcgtcaatgaaagaattagacgtgttgatgaagcaattgttggcggacacgcaaaaggcagtggaagggatttgaaagcgaatgccacggatctcaaacaacaattctctcatcacttttgtgtgacattatttacgaaaaagtttgacctcctaaatccagaagattttaaagtattaaagaggtattatcatttcatttatgtcgggaaatgggaaaaagaagacaatttcaacgcccatttcaattcgattgttttttcttttcctttctctctctctctgcccttcctctttcatgcactatctcccgttccttctcgtcgcatcgccgctctcctcgtcctcctctgtctccaggtgaatgttgtcgccgaattttgcgtaaagcactgcccgcagttcgcccaactccctctccatggttccgacttgtgaacgcaatgcgtccatctccgcctgagtggaaactttcagcagttccaaccgaccgttcactgtgtccttaaaaaagaaaaaggaatgatttttctcgatggttgtattgaaatatttttggtagaatgtcccctttgtgtaaaacctggtcgaaatggacgaacaccgacccgacgagaaagggaatcgaatcggccgccgcctcgtcgtccatcagcagaatttcatcggaagcgtcattcaaattgttgacatcgttgtccaacgatataagtttttcctgaaaaactcccatttacaatcacacacaattaattatcagttaattttattgggacaaaaaaattaaaaaagaaatagcctatcaattttgaaaaatggaaataaaatttcaaatttcgcggcatttactaaattgaactcactttggctgccgagtaagctttatgaagacgtgcaaatcggttgatctgctgttggtcctccgccgttgcagtattttttgcactcttttggtcgggtttcattaaaattatttttctctaaataaagccatcattggatttaggctcttaaagtttccactactgataaggaaaagaacaactttgaaatttgaaagcaatgcttttttaaaaattcaattgcttttgctttggattaattaattgtttttttaaatatgtctggcgttttatttttttcaaatttaaacaatatgaaatgaaatcacaaatgtaaaatgcactcggttatttgatgaaagacacgcaaaattcattcaccgggacatctctcatttctttacgtcttttccactccgagggggcggaaagcataacaggttactgtaagagggaagaaacggtatttaaaaattaaaaaacaaagtttaccgcttccggacgtcgcttgacagtacgcgtcggtgtaagccacgtaagagaattcgccatttgcacaaatcaccttcaaatggagaaaatgcattcttggccaaaatcaaattaaaattttgcaaaataaattaaaattttgaaattaattaaattatttttgcaaataattaataattataattacatttatttttgcgaatagttttgcctctgccgccttttgaatcgctcgtttcgattcactcggatcggaagtgatgtgctaaacacgccaatttctaaatttaaaataaaaaatttcattttccgcatttaaattttttgtgaaaaaaatttcaaaaatttttccaaaaaaattcacccgcgtaattagcccccattttttg

SEQ ID NO: 4636 - DNA, 1481 bp, Heterodera glycines
agtaaatcaacgaaaaaagcgcgattcggacggtctcccgaatatgcccgagtttcgctgagaaatccttataatatgggggcaaggtatttgtggcattagtattaaataaaatttaataaaatttcaatttttcgcacccatgcctccgattggataaccgccgcccatttggggacccgcaaaaaacggcgcaggcgcggcacgaagtgcacggcaattggggagggcacgggggcggtggaggggcacaaatgaccgggggaggacaaattacctaaaataggcaattaacattaaaaaaaataataaatttttggaaaattaccggcggagggcaaaaagtgggcatacacggagggcacgggggcatcggaggggggcaaggctgaaaaaactaaattgacaatgcaatttacaaaatattataatataatattgtggcaaaagaaaaatgcataataatttatttattcatttttatataaaaaaaaatttggtaaaaataaattaaaatattttgaaaattttataaatcttattttttaaatgcctatttaaaaaaaattatgatatagtaccgttaaaattgataaaaaggattgttttttatttagagctaataataataattttatttaattaatttatttttaaatttttaaataaaatttataatttaatcttttaaaatattattatttaattaattttgaaaatttggtgccaccagtggcggaagtgccggcgggcacattggcggcggtgggcacatcggctggggcggaccgcaaaggccgagcccaccgagcaaaccatggccataagtgaattggacgaacactggagagaaacacaaaaggagaagcagtttctgcatttttgaaatttgttatctaaataatttgactgaaaattggcaaaacaaaaaaaaagtggcagagacaaagtgccgacagtgccaaaccgcgcaaaatgaggccgaattggctaaaagtggcatattcaaggcaaaaagtgccaaaatctctccgcccccgataattcggcatttcttgtgaaaattcggtcaaattccaagaaaaagtgccaaaaagagccagccaattgttcgaaaaagagaaaattggaccagcagcaaagaataattgccggaacattttggttctgttgctgatcaaaaacatttgcgaagactgatcagaatgagtgcttttgtttatttacaccacctccaaatccggtccttaaaaggcccgtcgaccccccaaaacgctttgccccctccagcgaaacccacgtcatcgcccggggcgcaatcaaaaaatgtccaaaaaaccatggtcggtcacacccaaaagaaagtgatgataaaacaaaaacaacacaatcatttttgggcacggatgggaagaagcagcgattgtcaaatttggaacatttaattaagcggaagagagcggcggaaaataggaaaagca

SEQ ID NO: 4637 - DNA, 3752 bp, Heterodera glycines
  misc_feature (6)..(6): n is a, c, g, or t
  misc_feature (883)..(883): n is a, c, g, or t
agagtncattttgcaaaaaataaataattaatgaaaaagtcagaatctctaaaaattttaaaaacaacaagcgttggcattttttcagcttaagttagtcctttacaatggagaaggcctgcaacatttggagagattttatcgattttagtgcgctaggttcgatgaaactttttaaaatataagcctaaactttttggcttatttaaaaagcaattaaaatttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaacatttggagagattttattgattttagtgcgctaggttcgatgaaactttttaaaatataagcctaaactttttggcctgtttaaaaaggaattaaaaatttttaaaaattttattcatctcccttttgatagaaaaagcatcagagtgccttgattaacttgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggtaagctctgctcggattggcctcccttcaatgggtcaatgtcagtaaaaatgcaatgggaaaagagtaaatctaaatgaaaattcagttggaatggtgcccaattcttgccgaagctgaacagatcngaattgaggcgaacggaaacgaaatgttctaacgagatgaattggctgctgaatgcctaggcctccgccgttggcacggacttttcgcaggaacaaatcaatgccgcaaagggcggcgtaatggacatagaaagtgccaaatatgtggtgccattggatggccaacggaaaaggattattgatacaacggtgggcggtatttgctaattatcagagggtaattaggaattgatttgctaattgtcgccattttcctttccagccctttgactttctgtgtccctattccattttctgtaccgtcggctgtcagtgctgccaaatcaaccacgcaaatgaccacctcttctcaatgccaatgctcgagtttcatctatgaaaattggtatcgtgcgcaggccccaaacctaaaaaaattccggagggaagatgaagaatttttttttttttgctcttcggtcttgaaattttttctcttatttaattttaatatgtccagctattttcttccccattctcctgatttctgaaattttttgagtctttgtctatatatatttttttaaattaaatatttctaataattcaaaaattacttttaaataaaatttgcataaattgccaaattcctaaattaaaatttaaattttgttgcattttcaggagccgtacattcctttcatggagaaagcatgccgtctctgtggctcggctgtcactatgctgtttttcatttttttgatcattgctacactgttcgacctcattgtgtaccgaatgtttgtgattcgagttttttatgccagcacattttcaatgcctttttcgagattgcttatccgtaagtaaactcaattcaatttcaaatgaatttagcaattttattttatttttaaataaaaatggaattagtcacaattaaaatcaatatgaaattgaactgttattaaccagggttcttgaccgaaacccacgtttaaaaaacctggattttttcacgacccgaaattttctttgaacgtccctacccaaaccccatcttccacaattcctgccctgaatttcaattcgggaatattttatttacatcccgataaatcaaaaattaatgaattatataaatttttatgtttatttaaaatttaaatttttttaattttaaagaatgctttcctattgggttcgacgatggtgctttaaaaattccagcgacaaagaaacaaaaatgcgaacggatttgcaaagaacagcgtcaaacaattaaatgtatcaatccgaacatcaaactcagattatatgagcagctgggtgggtggtggaagagaattttttaataaaacttaaattatttttattttttatattaaatttgcctaaaaaattacatgttttcatgttcctaaaattagaagccctggggggtttaatttatattccatatgactcattttaaatgttttgaggtaatacaacttggctttgtcaccttgtttgttgccgctttcccactagcacctttgtttgcgctgatcaacaacatcctgggtcttgaaaattcgaattcctatggccgtcaaaaaattttaaattttacaaaaattcttaattaaaattaattcagaaattacatggtttccttcaaatttactttttcatttactaaccctatctaatgattgattgatttcttttgatggtttttccactaattttttcaatgtttttatttatttaaagattactcaacaccttttcaatagaagttttatttttaaataaatataaatttttatttttaattaaaaaaaaatttttttttcaagacttctttgtcatttcccgcaatacaatcggaagcccagcagatgcccaactccgtcgctgctactccttgcgcctccaacccgttcaacaacaatcacttcccacaatcagatgcagaaaagtacaacaacaaacagtgttgaagtgcttcagaaaaatgagcgatgacaaatttttgctgtggttttgatggtcgacaaaaattccgaatgcttttttattttttaatttatttatttgatcggaataaaaacaaggtattgcaggaaaaataattttttataatttaccagctaaatagagaataataatttgggctactccaaatgcttctttatattgaaaaaaattacacaaattgattgacaaaacgtcaagtacaatgaattgcgttaataattttcaaaaaatttcgacatcacccaattgcgatggacttttcaatatttattactacaaaatttttaaattttttcaattcctctcaacatacttaaaaatttatttgtaggagataaattatttattttaatttttatcaatgaactgtgaaagtgatagaaacccttatggattttaggatgaccgaaaaataatttttgaccaaaacaaaaatcatttgtgctttttcatgaaacagaaagaaatgcttaatcgttatattagaaacaaaatgaaaaagtgtaaaaaattttattcataattttgctaaaaaaaaactaaattcttaattcataatattatgacacggatacaacaacgaccggcggtttatgattatttgagcacagcaaaaatttgacacaaggaaattcatttttcattatttcatgatatttggagctaaatagacatatttatttttttagtttatttattttttttttcattatttacctgcaaaactttgtgcaaaatcccgtaaaatgaattgtatttcacgtttttagtgtacatgtgcacgtaaaagtgaaatgcacccaaaaataaattgtaatttgtgttacacgttttcttgtgtacaagtgcacgtaaaagttaaatc

SEQ ID NO: 4638 - DNA, 5495 bp, Heterodera glycines
atatcattaaaaaaaacgtggctcttaaattctgtcccaaaatgaggtcaaggtcccgaaaatcctcacgcgcacacacacatttgtcataattcatgaggaacaattcacaaccaaacggaaagcattttcatgtatcgatatttatttaaaaaaaagaatgctttttaggctggcgaaatgtccattttttattattatcatttaatcatttttatggcaattattcatggccaaatggcagcgccaatagtggccgaaagctacagcagcgccaagcaacagcggacagaattcaattatcaacaaaaattgcaatcaacccacccaccaacaatgaacgtaaggaaagctaacaaataagcactgaaaaatgccgattacaataaatagtgccatttttcgtcaaatttgggctatttttttgaaaaaattggcaaaaaaaaactttaattttttgtgcgcttttttttttattatttttgggaaatttttgtctcggtaatatttttcactttttttctactaaattttattaaatttgaacaattcaaaaaaaatttttgatatttttcaaaatatttccaatttttccctgatttttaccaaaaaaatatagcgttgaataataacacaaacattagctgcttaaagtcagtctgacgtcattccaaatgcattttttgccccctctctcttatctgatcactctgatcgcagattctacgccatcattgacgttcattgaacaaatcgggcgaatggaactggttcagtccattgttcaattcatggaaaaaattggcttaggaacgggcgaaaataataaaaaaagtaaaaataaatacattttaatatgaaattttaaatgaatttttttttaaagaaaaacagcgaattgagcgccgaagtgctacaaataaaaatttgaaagaacaacacagggaaatttttggcagaatggtgagacatttgggcgcaaccgtatgggtgccgaagaaatataacacacgttaccaaatccaacaaacatggaatcacccggaagcttttaattagcattattaaactctgttatatttaactgactatgaaaaattatattaaaaaaaacaatttcttaaattttgttttaatacatagaaccattttaacaacactgcctttgtccgaagtccaatcattcgacgaccttcttttgctaatgacccaccaattatatcaagcatcgatgctcgaccgatgacaattgcgagtaaagtttttgatttcattatttggatttccgggtttgtaccagccgtgatttttttttaaatgtatcattatttaaatcataacataattttgtgaatttttccattttcgaaaacccacaaaacttggcattaattatggttcgacctagtgtttcaattcggtaattaattaaagcctaaaattactaaaaaaaattaatcaaatacaaaagttcaaattaacagtgtttctaaattaaaaaatatatatatatatattatgctaattatggtgtaatgtgatcatttagaagaacaacgatgaacagaaacatcacaactcaatgaaatagcgccatcatttcatgaggcaattggtatttgttagaatattaaaaacatttttagcaatttaaattttttttttttgtgtaggtaaagaatggaaacaagcattgttcggcagaggtggcttattgacagaaattttcaattttgtcaacgataaacgcaaggaggatttggccaagaaacaagccgctccaaatttgaacggtgggcatataagaaaaaatttaaaatgtgaaaaaaaaagtgacgacaattatttctttgggggattttaattaattaaataaatttttgaggtagcaggaattaagttgctaatgaaaaataattttaaaaatttatgaaagacagcttaggtaattgaattaaattctgtaattcttcagtttatttggccataacttttcttacttgaaccacccatacattcttggtatcaacgtaaactaagagaatttttatatacaaaaaattatgtgccaaaagcaacagacaatttcttggatatacccgaaaaaaaagtggccatagaaactgaaattgtataaaatttgaaatccattagcagataaggccagcagggaattcagccaaattttggatgcattattgcgcaaggcgaaaagtggcaattttgacgaggaaccgttgccagaaataccattcattggcatttgcaaccgacttagctgtgccgacatttacaaagcattggaccaattccggaaaagtgaatttttctcaaattttcaggtaaacccgaaagtcttggcgaaatgtttggcagcaataaggcacaaaaaggtggcacaagtcgtgtcgaaattggagaaaatgtggtaaaaatatataaattacgcaaaataataattaaaaaacctaataattaattatttataaaggatggtgaaaatattggcattgatttttcatcccaaattgatggtttgtttgaaagaaaattcaaaaatttaaaataaaatgaacaaggtcaaaacaacacgtccaatgttcatccgccacaaattgctttatccattgactcgggcgcaccagattactacagttttgcggaacaaaaaattggcaatgccgaaaaagtggacaaaatacagaaaaacataagtcagattgaaaaattgctttatcttaaatttaaattcaaaatccttcgtttttaccaaaacaaaaatttttcacaaaaaaacaaagaattttttctattttagccagcaaattaaaaaaatatgttaccataaaatatatgatttcataacttctaaggttctatagaaaaatttctttgaaaaattctaggttaaaaaaaattttaagttttgataaatttttattttctcggaggaacgatctgctccggattggtattcattttatccaattgcacattttaagttgaattcacaaaaccgaaggtggaaagtgaaaaaaaagtgcagtcgtcaactcagacaaagattgacttcaacagggaattgcctgaaattgccgaggccattgacagtgtacccgagggtaaatttaaaaatattttttagacttttctaaaaaagttcaaattttagaggaagaatttccgggaggggacatgttggtttttgagaaaaatgaatggcttccttccgcgtcggctaatgacacaaaaaaggtgggataaaaaatggggggataactaacaataaatagggctcggaaaatacggatacaaaaaaatcacgaaatatggccataatgccccaaaatattgaaaaaatgtggaatggaaatatggacataaatcgcgaaatattatagaaaataatggaaaatatggatattgaaatccatcatagaagcttcaaaccaagctataaatatgtttttcaggcagcctagtcacagtccaggaaaaagttgggatttccatacaattccgaaccctaacaataaatgtggtggtgctgatttctatttaaaattccagcagtttgttctaacaccggtttttgaacgaactcatgaaaagaaaagaactcaaccatcgacgacggtaactgttcagcaacagttgaggaacacaaaaaacaaaattggacaaagtcatggcacaacaactgcaaaaagcacacagcaggttaagttgggaagatgaaagaaatttttttaactaaaaattaattcttttccttaaatacaaaattagagaccggactgtatcgataattatcggtcgatgttttcaatatgtatttatttttcggtatgttattgaaagatatcgatcgaaagaatttaaaaaagaacaatcgaattgatctaacaatgccattcatacatgtgcaaggggtgtctcaagccaagggccatacgacggacgattgggaccagggctgcacgcaattacggattgcggattacggaaattacggggttttgggagttacggattacgggttacggatttttgggatttttccgtaattttgatccgtaatttgacttttggattattttttcgagacgatttcttgtacgattatttttataaaaaacaaatttttctattttttatttaaagggctacgcgtatttcgatttatttaagaattaaaatagatttataattttttattatttgttgttaaggctatttgggtagttcgcctagaaaatagaggcatcacttttttgtcacacctatttttcacgcattttatgaaaattcataaaaccttagccaggtgaggggaggaattccccccttccccgcccgaaatgaaaaattaaaaatttttacaggaaaaattgggacttttaaatttttttttgtcgatttttcttaataaaatcattaaaattaaaaaaaaaatttgcccggcggcacctatcggcaccgccggaccacgatttactcgattttaccttattttttttaattttgactacaaaatggcaaaaagtagtctttttttggctaaaaatggttacaattcctgtttttgctgtccggcgctgaacttttttaaaaaacactaaataaattttaccaaaaaaaattcttcggattcccccccccccccgtaatttttttctggctattaaaatgttgaaataattatatacatatacataaatccgattataatgatcagactttcaaaaaattttcaaaaatcaacccataaattcaaaaagaatgatttgatcagacacaaaattataaattatttgtaaaatttaaataaaaaatgaagaaactccatcaagaaaatcagttttttgatttttattaatcactatttaaaaatttttttctaaaattctgacaaaaattgatttttaaaagattacggattgcggattacgggaaattacggggtttttggacccccgtaattacggattacggatttccgtaactgagaaaatcgccgtaattacggattacggatttccgtaattgcaaatccagttgcgtgcagccctggtgcatattgcgaaatcgcttcaaaaacggacagcctatcaatcaaagatttttaaaaaatttcggcgccctaccaatagagatctttgatcatcattaaatttcatatttgcttctgtcatcgcggcaattaaaatttccagggtttcttagggaataagtattcaattaggtcatgtggtgaatttgttttaatggtcaagtggtgaactacattagaatcgaaaacggcatattattttgttatgaaccaaaatttccggtcgttttttccaaaattcctcatttttgtttattttatttgttttactccgaatttcccacccctcccccctcccttaatttgctcattttatgcatttattgtaatatgcttttctttttcccaaatttccccccccccttttcagatatctctgccc

SEQ ID NO: 4639 - DNA, 4299 bp, Heterodera glycines
tatatgaccccgaaagcgcacggttgcgcacgggtgtttcccgcacaaacccatgcctatgggaggggcgcagccctttgatgttgccgcccggggacattttcccgcacaatcccaagcctataggaggggtgaagtcttttgatgttgccgccttgtggattttaatttacccaaatccgtgcggatgttttttcactccgcgccgcgcagcgccgcgggaaggtcatcaatcatccacctgtcaccaaaagtgacaggtggaggaaattcaatttttcttttgtaaatttaaatctttttgatcccaaaccttttgggcggttttaatttctcaaatcctgagtttttttttatgacggtttctctaatcctgaaattaaaaattcattttttgaaaatgtgccaaaacagtgcgggttttttttgcatttcctccccgctcgccccgcgccgcgatgccgccgccgcgaaaaaaaaaatcgataacggaatttggaagaagtgtgaattaattgatattagcagcaaacaatgacatgaataattattgaattgcacaataaaattgattatttaaaaataaaaatcgaaaatgaataaataaattaaaaaactttttcaaaagtaggtcacctttcaaccaaaattgattgatgggtttttatttctcttccattatttcgaaatctgcacgtgactttttgttcaaattatttcgcaatatctcccctaaattaggtcaactgtcaataaaatgtgattgattggcttcttatttaaatgtctccattatttttggttccaactatttcgcaatatggcccgtaattttgcaaacctgtcaaaaaaaaaatgattgatgactttcgaaataaggaatatccaaacgatttttgcacggtttttgaataaaatgtgacagctgtctaccgaaatgattgattaccctcaaaattaaggcaaccccagacagtcacgtgactagacccctcccctctcgcccaatccgtacacccggcccaaatcgaaaatcattcaactaaatagttggatttcattaaactctcttcgcgctctaattttaattcactccgctctatttttatttgcattaattaaatctattactatttacttacgtcttttttcttttaaaatctctctaccctctttaattcttctgctgcaatttcttgtttaaaatgtcttttaaacgcgtgaactccttccaacccaccgtcccattggccaagaaatgggatttccgatcaatcgggtaagtgatttttaataaattaaataaaaaaaataatttcttaaacaattataaatacaattataagataataccctttaagaattatttcaaaaaatttttttttgttcagaaataattttgctgaagaaatggaaaattataaattgatggattaccaatcgacaacttgcgaaaaatttggatttacgaaaaatattacggaatttcgtgtcaacccggatgtggagcgccccgatgaagcgatgaaggacgcaatcgacaacatgataaaggtggctttaaaaactacggaagaaaaaatgaaacgaaaagtgcggatgtttggagttgcaattacgggtgccgggcttgctttcccggtgtgggtgccgtatcgggcgtacccccagaataatgcggatgttatcatggaggagattaataagttggggcagagcggggacggggatgaaaataagaaaatgcttttattatctgagccagttactatgaaaattacttgcgtgaccatgcccagtggagaggggccgaggaatgtccacaaatttgactttggattcaaggaacaccagcggatagggtaagatttttccaattaataaaaataaaataaaaaatagaaaaaatcaaataaaaattaaaaaaaaaataaacaaagaaatttaaaataattatttctaaaaaatttaatgaagcaaaaaaaaaaattttttttttaaagaaaaaaaatgaaaaaaagcaacaaaaacccgaaaaataaattaaaaatattaaaaaataataatttaatgagccaaaaaataaataaaaattaaattttaaaaaatcaaaaaataaataattaaaaaatattaaataaataaaaaataaaatttaaaaaatcaaaaaaaaaattaaataataattaaagtaaagaaaaaaaagaaataattatttttattaagcaaagcagcaaaaaaaaaaaacagaaaaaaaaatttaaaaaataaattaaataataaagaaaaataaatggaaataataataattttattaaggattacaaatgcggataaattttgtttgttttatgctttggtggcgtcaaagctttatttggaagtgcatcgaaacatttttaatcgatttatgaaaaatattgtgagacagagggattcagctattgaacttttacataattgtggaattgatattaacgaatatagctatggtgtggagcaattgccgaatgttcagaaatattgggtgggtttaaatgaaaaaatgcaaaattaataaattttttcaggatgagatttaccccagaaagtaccgggttgttgcgtttgagaagtcagctgatccgcggaaatcgatctgtgttttgtggaaggcccctatgggacgagagaaggtcgtaccgatatttttggagaatggtcactgggatggtctgaagaattacgtctctttttttaatcgtgggagaaaattttgtattgattgtgagtgcttttttgacaaggatgtcaaacatactttcgagtgccgggcaaggtgttattattgcaataaagtgggcggagtgccgtgtcaaaaggagagtggagtgaagattgaatgcccaaagtgtcaccgttacttttacaattgggagtgttataattatcatcatggacatcagacttgcaaattatggaggcgttgcgttatctgtgacaagacatatttatttaacccgaagaaggaacatgaatgtggagagacttattgccagctttgtagtgtgagccatgaccccaagcgggggtgttatattatgccgatcgaggagaaggaggaaaaagatgtctacagaattgtagtttgggtaagttctacaaataaaatcaacaaaaagaagtctttaactccaggattcggagacttcgcaggatacaatttacaagggggaccagaaggagcatgttattaattatatttcggtgagagttacgtgtacggaatgctgtgatgacaaaaacaggacgaattgcaaaatttgtggggaggagaggatcaaggattggagcgaggcggagggacatgagccgaccaaggattttgtggagtggattttaactgcttttacgaattatgatacgtacatatttgcacataacgccggacgttttgacggtaatttcaaaatttaatttttaaatcctaaatttttaggtcattttgtttttaattacctctgccgtaccgggaagaacccgctaccgctcatcaatggattgaaaatttatgaatttaaagtgcaaaactcgaagaaacattcaaagctgatttggagagactcatgtttattgatgccggtgaagcttgagtcgctgaaggcgacatttaatttggactgtgaggacaagccctttttcccctattattacaacaagaaagaaaattatggaatacgattggaacatctgccaccgatggaggactattcgccgggatctatgaacaaggataaatttataaaattcgaaaaatggtaagaaaagaagggcaaaattaacaataaaattcttttgtttttcaggtacaacgaaaacaaggagacacctttttatttggatgaagaattgaaaaattattgccgaaacgacacggagattttattgttgtctattattgagtttaggaggatattgattaacgacattacgaaaggatttgaccccctgccgaggagttgtacgaatgcgggggttgcgatgaatatttttaaggcaatgtttttgttgacggagcagttatcgattgtgccggagaagggatatgagcggtgtgatcgcgccagtgtgatggcaataaagtatttggagtggaggagcaagcaggatggaattgagatacgacacgcggggaacggacgagaggtcaaagttggaaaatataaattggatggatttattgcgaataacggagctagggacaaatacattgaggttatgggatgttacatacatggatgtttgaattgttatgacccg

SEQ ID NO: 4640 - DNA, 3172 bp, Heterodera glycines
  misc_feature (99)..(99): n is a, c, g, or t
  misc_feature (128)..(128): n is a, c, g, or t
aattttttgaaagaagtaaaaaatacaatctaaatatttgctacagaaaagtataaggaattagcagttaaaaccaattaatattatgaaatatttaantacataagtaaatggatacttaaatcttnaaaagaaataaaaaataatactcatatattaagataaaaaaatacttaataattttatctaaaatatactcaaacaaaaaattcacaatacaccgtttggcaataaaccattacattcgggcaagttaattaaaaaataagtatttaattaagtttggctaatattttgttattatataaaaagaaaataacaaagagattaaacataaaatgtgcattttccattaaccatttatgtataagaaaattattataaataatatctttaaaaaaatgtgttatcaatcatttctgtgaatattataataaatattttttcaataagtttttcttctacatataaaatgatatttaagttttatgaaaatctaacaattatgaaaaccgtaaagggttctgtttcgttttgtccgaccttaaaattatttttaaaataattataagtaaaaataaattttaaaatttgaatacataatttacgattatattgccatgaatctgataattttattgtattatttactagcgtaaaaaacagttttatactaaaatttaatttatttcacattataataaaattcggcagttttcaacattaataaagtaaattattattttcaagctaaaatctcaaaaaaaactaaataaaacaattaaatgttatcgcttaattcaaaattaataatttaatttacaataaacgacaaaagcacattaaataatatagaaggtttttattttcaattataataaaaaaaaaattaaaaatcacagtttacatgaacaaatttaaaatgagaataatgtttgtgattgttttgcgctattagccattgtttaagtatttttgattgaaaatgtgttaataaataaatcaaaattcaaatgaattattaaaaatttgatccaaaggcccacaataacgtttttcatataaaaaagaacaataagaaatacaaaaaaatagcagaacaataaaaaaaagtctttttttgttaaactttttaaaaatatttgtgaatgtaaccaaacaaaagaaaaaacatacaaaaaactaactttattagtaaaaaaccaaacaaaaacagtaataaaatttagtaaaactttattttttcaaaaggctaaatcaattatttatgttaaataatcaatcaactggagttcattattttatatttttaaacatttgttaatattgaaaaatagaataaaggaaaattctttttaaatttatttaattaaataagaaaaattaaataaaaataaaaatgttacatatttttttatcaattatttcattatattggcagtccgttaaaagagcattcaatctcaaaaataaaaacattgcaaaaataatattataaatttgtatttgtttttattttaattcttttatttagagttaatatctttttctaaaaacaaatttaaatatcttatcggaaccataaaatttataattggaaaagtgccattgagtggcggcgggcgccgaaagaacaacagttaaaattaaaagaaagtgaattaaaattcaacaacagaaaaatatgaaaaaataattctaatgataacttgggcccggattgaaaaaggaatgaattttttcccgaaattagcataatgaaaacatattttattatcattaattttaaaaggaaaaattctatttgtaattatttgaaaatttcaaaactaatattttgaaaaataaagaacactttatttaataattattcatgaacaactaaatttccaccttgataataaatatttatttaattattaatccaaagtgacatttaatgtgaaatgactaataaatatccaaatttattcttatttattcatttgttagtgaaaatcagggccggattttttcaattaaattaaaactttaaatagtgttgtgccttggacttgaccaaaaccaaagtgaataaatatttatttattcaaggttggtgaagacacaatttaaataaagaagtgaaaatgggggcaaatatcgattgggagaaagtgcacaaatacaaataaatgagggaatgaacggatggtcaaagggacgggggtatttatggaagggagaacagagagagtgggggagggcagaaatagaaaggaaataaataaaataagcggaacaattgagtacctttcccaacatctccccccttaaaaagagtctgtcctcattcatcagtccgttaatcagtgatcagtccatctcagctcggagtgtagcgtagaggtgggcgtcgattgcggtgagggcgaccgacacagactggacttcgttcggtaattgcttcgtctgtctcttgtgcaggtgccgcttgttgaacagctggcagagctgcttcgttgggaccatccagctgtgccaacggaagaccaaaagcatcgttgaaaatgttcaactcatcattgccttggtgatccatgtgacgggccgtcatttggtttgcgtagaatcggttggaagtgccattcgggaactttacctcgtaaatgactccctgacattggctgacgattccagcgcgccatgattgcgattggcgatgacgagcaaaaactttatcgccaagacaagactttcgaggttttgcaccgtaacgacgattgaactgcttttccatcgcctcgtctctgatcagtggtggcgatggttttgctctcagcaaatccaatgttgtgcaaggctttcgcagaatgaaaagttcggcagggcttttgccgttgggcaaagagtcattcggtgtcgtccgatatgatgtcaaaaatgtgttcaccacatttttcgcgccctccttcttcagtttgcgacatgcccttttaaaggtgtcgacaaagcgctccgcttgtccatttgacatcggattgtacggcgctgagaagaggtggttgatgccattttctttgacgaattccttgaattcgttggagctaaactgggtgccattatcagtgaccaaagtctccggcagtccaaaacgagcgcatgaacgtaattgttcaattgttgctgctga

SEQ ID NO: 4641 - DNA, 1012 bp, Heterodera glycines
ttccgttttctttggcgcattcgctttggtggcacacggctcacattttctcaccacttcttcgatttgttggtcaattcctggccagtaaacatgctggcgggcgaggcttttcatgcgcttcatgcccgggtgtccacgatgtagcattttaagcacttccgtctcaagcgatgctgggacgacaatccggtcggcgtacatgatgcatccgttttcgaatgacagcgcttctcgccttcgatggaattgtaaaatgtcctctgacatatattcgctttgtttggccattggttcaggatgaatccgttaatttcctgaagcaaattatgggattttgtggcattgacaatgtcctcgtggacaattggaaattgtgccgtaaaggcattcacagttgccaaatttgcactttctgtaattgttaccacaataaattcatcttcgggcactggcgcttttgcaattaagcgcgaaagagcatcggcttgaccaaaatctgacgtgttttggtattcgatctcaaagtcatacgccaagagtatgagtgcccagcgctgtaagcgatttgctgtatacgctttaatgcccttgttaccaaaaatggtcaacaatggcttatggtcggttggcaggacgaaatgtcttccaaaaagatatttatggaacttctgaactgcaaaaacaagagctaatccctctttttcgatttgggagtagttcatttcggcaggcgacaaagagcaagaagcatgtgcaattgctttcaagctgccatcctgaaaacgatgggagatcactgctccgattccataatcagaggcatcggcagatacaatgatgtccttttccgggtcgtagtgggtcaagagttggtcagatttcagcacttcgatgattttgtcgaaggcattttggcattccgatgaccagacccaagccacgtcctgtttcagcagttcgtccaacggctgtcgaagaaatcgcatgttcttcacaaattgctggtaat

SEQ ID NO: 4642 - DNA, 2841 bp, Heterodera glycines
  misc_feature (2835)..(2835): n is a, c, g, or t
agtatgagtgcccagcgcttgtaatcgatttgctatccacgctttgatgccctttttgttacaaaaatggtcatcaaaggcttgttatcggtctgcagtacgaattgtcttccaaaaagatatttgtggaacttttgaactgcaaagacaatagctagtccctctttttcgattttggagtagttcatttcggcaggcgacaatgagcacgatgcatgggcaatagcttttaagctgccatccggaaaacgatgggaaatcactgctccgattccgtaatcagaggcatcggcagaaacaatgatgtccttttccgggtcataatgggtcaagagttggtccgacttcagcacttcgatcactttgttgaaggcattttgacagtccgttgaccagacccatgccacgtcctgtttcagtagctcgtccaatggttgtcgaagaaattgcatattcttcacaaactgctggtaatgattgatcattcccaaaaatgatcgaagctccgaaacattggtagggacgagcatttcagaaatcgccttaatcttcgatggatccggtcgccttccgtttttatcgatgacgaacccgaggtatttgatctgcttctgattgaatgagcacttgtcgggtttgatcaggaatccaaaatttccgattcgcttgaaaacttcgttcgtgttttcgatgctcctcatgtgaacgactgaccacgatcatgtcgtcaaggtaagcaaacgcgaatggacaatcggccaaaattgaatccatgatcgattggaaaattcctggcgctgattttaccccaaatggtaagcgaaaaaattggaaatcctcggtgcgtggcgattgtacacagttctttggacttctcgtccaattcaacctgtagatacgcatccttcaggtcgatctgagaaaaaatctttcctccattcaatttcgtgaagatgtcttcgggcaacggcaatggatgctgatttaaaagcaatgcgttgttcaagcccatagagaaatctgcacaaacgcatgctgcttcgttagccttcttaacaaccacaataggtgcggcccaacgggtgtgatcgattgggttgatcactttctgcgccagcaatcggtccaattcggcctcaacaatcaaacgtgtgttgaatggcactggacgtggcctgcagtacacggcaacagcatccgccttcagttccaaatgggctttggctttcgtgcagtggcccaggccttctgcaaaaacgtgcgaaaatttgactgaaggtcaagcaaagtggtgtccttcttcgacgggatttactcttcattcggtccttcctttccgcttgaaccacattcactttcattgccattttagctttggctctgaatgtgtccaataagccaaaagcgtccaaaatgtcaattcccaataaattcagtgaaccctttttggtcacataaaattgtccttggtgtgtgcgtcctccgaacgtgaaagtcgcaaaacccttccctagcagggtgcattcagttacatcatggtatttggcactttcactgcattgaatcaatcggggacgttcaatttgaagatgtgcttcttcgtcgatcacggtgatttcagctcccggatcaaacacaaaatcaatgggtttgccattcacatcaactggtgcctcgacaagacggctcggttggttcagtgcgttcactgaaattccacccagttgcaaagcgttcatttgctttcgttgcgtctgttttctcgaatgctttaaaagccattcgtgatgacgcgcacacatattctgtaaatgtccaactttggaacattttctacaagttgcctttgaatggggacaactttgcgttttatgtccactgccacaacgccaacaattaggctgagttgggcttttgttttgttccctcttctgaaatggttttcgattgactgccaaaacgttggaatgggacgggcgctcaatggccttagcctcagcaattgtcgacaggaacatctgcaaatcgctgacgacattgtcgtacatttgctttgtcgccgtccgttgtcaactttccaaaaattcgtttcctcagttcggcgtctctcggcgatttcagtgcgatcagaagcatgaggcagttgaactgctcttcattcagcttcttaaattcaaaatcgcgaagcagtcgcttgtggcggttgacgaaagcacggaagtcttcatcgtcacattcgtatcggtctatccaaaccgattggggcttggcaaacaaacatttaagttgtgccgatgtctccaaaaagtctaaatcggtcggtttcttcggcagacaaaatttgctgtattcgttgtaggctccctcgctcaattttgtcagcaccagcttcactttcagttggtcttggatgtttggcgaagaacagtcgagggccaacacaaagcggtcgatccaactttcgatgttcttcccagaatgatcatcaagatcaaaacattccatatttgaaagcgctggaagttgggctgtttgagttggcgcgacatttgtctgttgagcgttcagcaattgttcgactaacttttgctgtttggccagcaatttcgtcaattcgtcaattgtcggatttgctgccatttttgtcgttctccactcttttatttgcagcgcctagatacaaattgagtgggtgcgcgtggatgagctaataaatgtcgcctagacaaattattagcagcgctataacttctactgaaagctaaaagctaatcagtagggatgacaaacaattggttgagttaaatgccgactggctgaagttgctccgatgangtttgg

SEQ ID NO: 4643 - DNA, 2826 bp, Heterodera glycines
  misc_feature (2698)..(2698): n is a, c, g, or t
  misc_feature (2725)..(2725): n is a, c, g, or t
  misc_feature (2737)..(2738): n is a, c, g, or t
  misc_feature (2759)..(2759): n is a, c, g, or t
  misc_feature (2770)..(2770): n is a, c, g, or t
gctcgtcatttcattcacaggcgacacaaacgattcatcctccaggatgctgtcattatgtgattttgcgggacgcgtcgtacaacagcaatggtgaaattagtgatctgatgtcggcgcttggtctccaagttggaaggatatgcgggaaaattgagagatttggaaaattacgatgattcaattgtccatgttccgtgatgattttattgaatgtttaataaaattattttttttcaatatgtgaagctgagggtgtgtctatagagagaattcggatcacataggagcattaaaaatttgttcgaattttggtcgccattagattagaaattaaaaatttttcctatttcatggttatatttgtgtttagggttaggcaaggggctatataaatgtcgtattcgtattcagcgaccccgaaaagcctaaaacagatccgttttccggctttttatgagctttttagacttttggacaattcgtgggtttttactcttttggacaattcgtggcttggacaattcgtggcttggacaaaacgtggcttggacaattcgtggcttggacaattcgtggcttggacactttgtgggggcgccgcagaaatagaaaggaaataaataaaataagcggaacaattgagtacctttcccaataaatagttagtaaatcaaaataaaattttataaaattttcaaaacgataaaaagctattcttcagaactttaaaaaagagacagtaacaagagtgatttgattaaataaaaaaataataatattcaaaaacatattattattacttaagtagtgtgataatcaaatttaaaactgaataaacatttttatttataccaacaaaataaaaattaataaaacataactttaaataaatgtctatttacaaaatgataaatattaaatatgtaaaaaaaaattcggaattcaaagttatttcgaatattattgaaagaatatataaatatatttgttgttttaaaaaaataaacaaaaatttaatttatttttatattaaaaataaaaaaatttgaaataaaattatatgcaattaaacgggtttggttcttcggggtcaaaaattgttttcctccataatctatgtagcgctatttaagtcaaattttaaaaatatattcgttgtcgctgtcctcacaaaggatccaaagacaaaggcttggctttattattatatgcaatgaattcaaatggcttgtatttgtcaccggaataaatttgaacgatatttaaaattatgggtgtaatttgttaacagcttttcaccgaaaaaggaggatttttcgattttgagataattgtgttttttacttttcacaacgcttcttccgggcgcatttttccgagactttttcggaatggcggagaaaatgttaatgtgtttttccaaaattggtcattttaacgctttttgggttctctttttgaataaaaattttaaaaaatagaaagagagatcccggcgatgcctatcgacaccgccgggaaaaaaattgggaatttttgtgcaatttagtaccagattttgcaccaataatgcaataagttaataaaaacttggtataaaaggtcaaaaattaaaatttttgaattattttttcaaatgctcattttcaaggacttcttgaattcaaggatactttgaaaattttcacgcgagaagggcccaatttcatgtacgtccttgacattcaaggacggatggcagccctgctcatgtgttatttgaatcaaattttacccttaatcctgtaataataattatttttttaatatagttttaattaaattatatataaacattaaaaatactattgaagactcgggactcgaatttatgaaaacccattccgatccaaaaaccgcattattctattttaatttatacggactcttggactcagattatcaagatatttaggttggtgaaaatgaattcagatgtttttatatttatgaataaacttaaaatacaacacattaatcaattcacaaaaaaggaaaataaattataatgcgaaaaacgatttattcaatgcattctaatttttaaaaatagaaaacaatttttattacatttatagaaataaaaaaaatgaattatgctaaaagataaaatgcaaactaaaaaaagttttttaaataaaaaaattctgacttttacattagagaaaaacaaaaaataaacaaaaattataaaaaggagagttagatcttaaaaataattaaaatttaaataaaatttaattatttttcaattttaaaaagcatatagcaaaaaaaagatccataaaattatttttaattattgaaataaatcttaattattaaattttatattatacaatattaaaaaggtcatttttaatttagtttttttttaaaaggagaatttaggagcaatttaatgcgttagaataaaaattttaaaatttatttcaacaaattttactagaaaaaatatataaattaaaggcttttagaaaagaagaataaaataaaaaacatttgtatgaaaacaaacaaacaaataaaatcttaaaaaatatcgatattattagttagcaaaacatttttgtttttgcattttattaaaatctcggacctatgaatattttaaattaatggatttaaggaataaaatattaaattttattattanattttattttcatattaaatcaataanaagacatgttannagcacatatttacttaataanttataatctantaacagcaagcttataaaataaaaataaaaaataataaaatgcaaaatataaattt

SEQ ID NO: 4644 - DNA, 1920 bp, Heterodera glycines
  misc_feature (1848)..(1848): n is a, c, g, or t
  misc_feature (1861)..(1861): n is a, c, g, or t
tttatttattttttgcaaaattaattcttaaatattttttcagaaagggttctgaaacgcaccaaattttatttacatgttagtttaggcactctgatgcttttactatcaaaaagggagatgaataaaatttttaattgctttttaaacatgccaaaaagtttaggcttaaattaaaaaaattttcttcggctctagctctttcaataagcaataaaatcgtaccaaattttataggcatactccccggtacaggactaacttaacctgaaaaaatgacaattgtaattgattttaaatttttttagaaattctgagtttttaactgtttatttattttttgcaaaattaattcataaatattttttcagaaagtgctctgaaacgcatcaaattttatgtacaagttaaataaggctctctgatgcttttactatcaaaaagggagatgaataaaatttttaattgctttttaaacatgccaaaaagtttaggcttaaattaaaaaaatttcttcggctctagctctttcaataagcaataaaatcgttgagaagaagaggtaattaggtttaaatttccttcccattttgtggaatttgaaattttttcggtattcttattttgcgtacatttcaaattttcgaaaaaataaattcattaatattttttcagagtgctctgaaacacaccaaactttatttacaggttaattaaggcactctgatgcttttactatcaaaaagggcgatgaataaaaattctacaaatttttaattgctttttaaacgagcgaaaaactttaggcttagcttttttagtgaaaattcaagcactcatagtttttcgcgttctgatcagaaatgcaccaaattttgcagggtaacagctgagaagaataggtaattaggtttaaatttccttcccattttgtggaatttgaaattttttcggtattcttattttgcgtacatttcaaatttttgaaaaaataaattcattaatattttttcagagagtgctctgaaacacaccaaactttatttacaggttaattaaggcactctgatgcttttaataccaaaaagggatatgaataaaattcttaaaaatttttaattggttttaaatatgcgaaaactttaggcttagctttttagtgaaaattcaatcactcatagtttttcgcgttctgatcaaaagtgcaccaaattttatttacatgttaacaaagtcctcttaggcttatatttgaataagggtgaagaataaaaaatttttaaagttttttccttatattttggttatttcgttctactttcggtggggtgcttggaaaagtggaatcatgcgtacccgtccgatctgacaagttaagcaacgctggcttactagtcaaaaggatgggggccgtgatgaaacgaaaccagcactgcttaccccgcggcacccggcacggacccccgaaggaatggatttaattaaattctctccttcggggatttttttccattaggtctctctgatgcttttactatcaaaaagggagatgaataaaatttttaattgctttttaaacatgccaaaaagtttaggcttaaattaaaaaaatttcttcggctctagctctttcaataagcaataaaatcgtaccaaattttataggcatactccccggttgtcagagtacgcctgagttggcggtcgacaaatacccaaaacacggtagtttcgggtgcagttgggttaggacggtgatgtgtggcgatggcgcaggtcaattaaccccaaattatgaatgtgcacagcaacaataaaaatgttttatcggacggacctcaaacttgngtaattaaaccanaaattttaaataccaaatgaaaaatacaatttttacataaatgatcgattgggggagga

SEQ ID NO: 4645 - DNA, 6950 bp, Heterodera glycines
aaacccattcaaaaaaaaggcattacttggaaacaattttcttcttagtccatttggtttatggtgaactaagtataacggtacgttattaaaaaataatagtaataaaaattaattttataaaaaaatgtttattattttatttaggtaacgatgtgccaagatgtcagagtacgcctgagttggcggtcgacaaatacccaaaacacggtagtttcgggtgcagttgggttaggacggtgatgtgtggcgatggcgcaggtcaattaaccccaaattatgaatgtgcacagcaacaataaaaatgttttatcggacggacctcaaactcaaacttgggtaattaaaccaaaaattttaaatacaaaatgaaaaatacaatttttacataaatgatcgattgggggaggaatttgggggaatgtggggttttcctccccaagttgtgttgcgaatgaatgtgccgataggggattttgatcggtcttaaatatgggcaaaagtgagtgggccgacaatgaattgcatgtgaaatggaaggagaaatgcgtaaatgagtgacaggtgggacgagtgaacaaacaaattctgcaaaacttcggagaaaaaaggggtgaaatcgtaaatggggccacaaattataattactaaaatagataagaaatgagcggggcgggggtcacatgaattacgtcaatggccaatctaatttttgattggcggagaattggagaattttctagaaaaaaattcctccagttcgaacattccgcgcgtaaaacgatgggcccttcttccttccttcttagtcgtcggccagtttcatcggtcgtgatcgtccgaatggcgtgtccaatgtgacgcttgatgcccttgagcggaacgtcgcgcttttggcatccaaatccagatggataggcgtgaatgggcgatctgcgcgttgacgaagtgaagggcgctttgggggagttgaaagtcgatggagcgggacgatttcttcgaattgatcacggcgctgccgaatcggttgtcttttgggtcggaatccgattaggctcatgaaagtgatgcggatgggattgagcagataggctagtgcgcatggaatgatgaggtcgcggatcatcaagaaagttgcgtaggcgcaggcgatacggatccaccagttaaccagctcgttgagccaatccttgaccaatttcagtgtccacccttcaattccatcttgaagtgcgccgagagcttgggctcgtccgcttttgtgctgctccagcttgtccttaaaaacttctaagtcggcaaattcgtcgatgtgtgggaacattgcgttgtccgtgtcgttgtcgagttgccattgatggaagatcagcggatttaagtcgaaatcgctgtctgatcgattgatgaccgtttcgtaaagctcttggacagctgttggtggaagttgctttgcaattccggtgttggtgtcgatcttcagccatgcgttgggatttttctgcagttgcagataatgatagcggagatgtgagcagctagcgatatgtgaggtgaatgaaaggatgcgcatttcggcgtcgagaaatgcatccctatcagcgtttgggaggtgaattctgaccgggatgaatttgtaacagtcttttgttgcacggtagctgatgttggtcaggctgacgttaatgcacgggaagacttcgattgttgtctctccgatccatcgtgcttggagattctctcggttgagcaatttgcgcgcttgcaatgtcgggtttgcgactcggaagttgcgttggcactctttgaggtagagttgtgaaagtgccatgttggttgagatttgagcggctgacagttgagaggcgagttgttccggttcgacgtaacgttttgctcgtttgtagtagccgttcatgatgcgttcgtactgttcctttcgaatgccgaaattttgttcggataggacgatgagtttgccgtcgcaggcctccaatggttgtgtgtcggtgaatgtcaaggccttttgtcgatcatccgaaatccaaattgctgaagtttgacccgggattttcgtgaattctccagaaatttcttctgcgtgattgaagtcgcaggcatggcaattgttatcagaacaattggcattccaaatcagcgaactgttgtctgagagttggcaaaattctgtagtgtatgcgcaatggtccacgtgatggattggtgacgtgagttgcaggttgtgtcgtctgatgaacagtgttgccggttgcgcaaagcaatttgttgacgtgcttcgttgcagtcctttgaacaatccctcgatcggtccagggaagttcacttccaactcatcgtttgttgaccacgtgttattgccagaaatcgtcatttccgtttttgccaacgggcaaatttgatggagtgccatttgtttgcacaatgtccttgaaactgccatcatggttttgttgatggtgatgaagcggtcgccgagcagatttgtgtagtactgctccgtcgttcttttgactgcgcagtgccatgctgagtgaacttgatcaggccgatgaattttggtgtacaggtcgatggtaagcggagtccaatgcgcggtcaaaacaggtggcgggcggcaaaacggcgaattttccgaccctttgagttcccaaagggtgcttcctctgtcgccgcaccagaagacatccattccatttttgttgatcggatcaccttttcgttgtgcagatctagcaagttgcggcgcgctttggacattgtttgtctttttgcccttttttcgaagtgcgaggtagtagtccggtgcctgcggaatttcgttgtctagcaagttcgatgagggcaaaaatttcgagcgagtggtgattggacgttgcgttgtcgtttttggtactatttgcgtcgttggttgtaccgttgtgtgccaagttctgcccgtgatagttgtgcgtggtgttgctttcgtagttggtgttgcgcgtgttgtggttgtgtttggttttctcgttgttggcggcgccgtagttgtggcgaattgttttgctggcggagttgcggttgcgttgagtgcgagtactcgttgaatgtaacgttggacggatggtgccaattttgaagtgcgttgttcgatgtcggtgttgcgtggccagagatgcttggctaggttacttccatgccaaactccaactccaccaaatctcttttggcggattggattcgcaaatgctgtgctgcttgcgaggagaatgaacaggctgatgaacattagcgcattgatcattcgttgtccgacggtgattcttttgcgtgtcggttttctgccgcgtgtttcgatggccggcgaagttgttggttcatcattgagttgcatgggctcatccatagtcattttgatgcgattcgccaattcttttgcttctccaattcgcttattgaacacgaaaaatcctgtgtcgagatgttttgtcagtctaatcagctctcgtttgtgccataaccattcagcgttgtcttctttgctgagaatgagggtcacttcaatgtcgtcgtctttgaaacgatgaagtaatggcgcgagttgtttgatcatatcttcttctgtggcctcgtaggtgaagatcacatttttgacttgcggtccagtggtaagtcgaagtcgttgatccggaaagtgggtgtaccagcgagagtttggaaaatggtgttgaaatgcttcggctgtattgtcgccgatcagaatcgttctgacattgaagtaaatgtgatccggaaattgtttcttggcacggtcgcgtgctgtgatttcgcacgatcgttgattaatcctttcaatccatttgtcgaattccgttgtctgctgatctgccgatttgattggcttgaatttaagttgcgtccacgctgactgatctgtgatttctcggaagttgtcgcacgatgatcgccatatttcgatggcttctttaaggtgcttatctcggccgatgtcgcgttgactcttgacaatttgttgctcgtagaagaatttggcggattcttctgatgagtcgaaggactgcgtgtgttgttcgtggatagtccagatttcgttgccgggccggttgaggttgcagttcagccaatttagcatgatggtatcgaacaaggttctagcgcggcaatttgcgaattcttcgattttttcgcggttggcagcttcggcaattcgtccgtaggtggcatttcttgcgcaggagatgtgcgtgtcgtcacattcggtaaagatgttgaagtcgacgtatttctcttctttgcttttggctgcatgatattcttcgacgatgtctgcttcgattggtgcttcggttggtagttgcgcaggttgaagttgtacaggcggaggtggaggagtgtgagctgcgcggtgcttcatgaattgttgaggctcgggtgacggatgacgaaacagtaaaggcggtgtgtgtccggcacgctcggtgatgaattgcggttcgatcgatgcttctcgttcagggtcgtcttcgtcgatgaccaccacttctggcgttggcgatttttctttcatagcgagttgttcttcttctggatccgcggcgactttgaattcgatttcgtccaagtattgccatgaacaaatttttccgatgacaaattctccacaaagtccttttttgtgctcagtgatccgatgcaaaagtgcgggttgtccgttgacgtgctgtagagtgatgcgctcattctccaaaagttcttttagctcagtttgtactctattgcgtctccatgatgccatgagatttgtgccatatctcctctcgcagtaggccaggactttttctccatctgtcggatagaagtcggacattctttgttgcttcttaatcaattgcacgttgttttgttgccgtagtgatggtttggcttccattgcccgagctgcctctttacttccactttttgccaattctcgcagatgttcttcgtcgtccttttcagtttccttcatttctttttcgatgtctactactgaccattgctttttgcgtagctttatccgttggcgaagttcatccactgctgcttttcgttgtgctgcccatcggattcgatgctcatcgtgctttttcctttcaactgcggggtcgcttctgtcgataagctcttcttttgctgccttccttttcttcgtttccatttgtttttcctcctcaattcgtcgcttttcggttcgttgtttctgtctttctttgtcttttttctctcgcgtttcgtccatttttcgtagtttctcttcgcattctctcagtcgtttgtcccattctggcattgggatttttccgtagagttcaagcagtccatctgccatcttcttgccgtcttctcgtttgaagagcgtgattgattcgagcagtactttgagcgttccatccttgaacagcttgagtttgttgtcgggtcttttggcgtacagtagtccttccacggggtcgttgtcttttgcgctctgtgtcacttctcgtaagccgtggtttcgtccggtgatgaagcgttgcgagcgtttgatcacattcttctttttcggtatcttgaagttgtcgggcatttgaggctcttcgtcgcttccgactaatgagagaacgtcctcagatgccatgagcggagcgatcagttcggagtcggactcggtgatttctggaatctcgagtgaataaagtggatttattgctcgtgctttttgttgcccgtttatctcaatgattgcagtacggatctttccatcctgcccccgaaggatttttagcactcgtgccaaacaccacagggaacgaggtaagtcatcgtccccaacaatgacaatgtccccttccttagggtaaaggggtccggtcgctgatttggttcggtcgctttcgcgcaacgaaagcaagtagtcgtttctccacgttgtccaaaatcgatcgagcatgttgcttgttttgcgcagcatggtgacgagatggttacgactgttggatgttggctcgtagtccggatcttggtgatcctcgttgatgacgggaaagttggtctccgtttggttgtacggtatgaggaagttgatcggtcgaagtgaaacgtaaggctcttggtcagattcgaatgtgagcggccggtgattgacgatggtttcgatttcacaaatcaatgtgtgcatttcgtccaatggcaagaggtttttcccaattgttcgtcggagagcatttttcgtgatgccaacgagtcgttcccacgttccgcctttccatggtgcgtgtgctgtgttgaatctccaagttacgccttgttgtgccatttgttgttgaacatgttcagggagtagcgtgtccgtccaatgttgctggatgactttcgatccggccacgaaattcgttccttgatcagtcatgataagcatcggtagtcctcttcttgagacgaatcggcgaaatgtgcgtacgaaggcttcagcagagtaatcttctgctatttccaagtgaactgcgcgaatgacgaggcacgtgaagagagcgacgtagatcttcacaatttcagtacctcttttgactttgagaggtccaaaatagtcaatgcctgttgaattgaacgggcgtgattttagtcacgaatcgatctgcttttctgccggatttaagcctctcaattgagctttgactgtcggtccaaaagatgacttggtcgtcgtcaaattgaagttgagtttggatgaatttaaccgctttgacgccaagtgtcagtgcttgaagttccaatttcggaattgttgcgtcatggttgaccaatttgagcggcttgacgaggcttttggcaaagattaggttgcattccgcttttgcgtaattagttgttgccttttgatacacggcaattcccatgccgtaattgctggcgtcgca

SEQ ID NO: 4646 - DNA, 2585 bp, Heterodera glycines
ggttgccatgtgcagggagacgggcgacgtggtcggcatgtgtcaggcgcggcattgctcggcgaccggctcggcatcagcctgttctatgccaacagtgcggtctgtcggtcttgtcccccgctttacgctccgtccgttttttttttcttcagtccgtcgcctcggctcttctccgtgccgttctgctccaatttgcgggccccgacccctcccaccaagtttgactcgttcatctacaaaactccgtccaccaacacggagtccgtccgcctcttccgccaactcgtccaaaatgggccggtcgaacgtcggcttttctacccgcaattctcgcgttattcgctgccttttcccggccatcgcatttattcgatcggcgatgagcacgtgtcactgatctgaccaaagaagaacgacggaggaagagaagggaaagaaagggacaaacggaggcaaagagaatacaaaaaggaaaattgccgaaattggcacacaatttaaaaagtcaaaagatgacagccaaattcacaattttcacatgtgtataaaatataagggcgaaaaagtcgcaaaataagggcaaaaatatggtcgaaaaagttccaaatttacctaagggtataattttttaaatcgctgtttttatatgaaaataattttatattaagcaaacaattctaagcgattgaacaacttataaaaaagttgcaacatgaatactaccaaaaagtaataaattttgcatattttaatttataacttttttacatgtcgatatatctttgtgatttttgtgaaacagatagagctagttaagagctttcgaatgataccaaatttgttggatttggtcaacaaagaaaaaagtttcctcttttacccgttgccggcgacccccttcccgcaatggtcatccttaacagagtaaaaatttttcggtttccgagactaaaaactcgagaccgggaagcgaaaaacccaagaaatttcccgagtcgagaaccgagactctcgcacagccccactaaatagtaggaaaaaactcctctttttgattgcacccaaaagttggggtttttatttgcatattttgttttagggttcggaccccgtgggcgggggtggcttttcacgggggcgggggatggcgggggtcagagtcgcggggacgggggcacgataattccgcccccgcgggggcgggggcgggggtttgatttgaattaactccaaaaattttacaaaaaattaattttttatgaatgatgtgatggctccacattcctttagtcaatgtatcgcctcaattcaattccttttggcataaattgcacagattttgtctaaagaattaccaaattttagagatttttggctaattttttaagaaaaaataggtttttggggggcccgcggtgccgataggccgccaggcagattttgaaatttaagctcgatttctaacagatgtttacaaaaaaaataagatttttacgataaatttttgtttttttaatatattaaattatcatgatttactcaagcaaaattggaactcagatttgtaacatattttcttgaggcacatttttccaaaaaaaaaaaacttggtgaatgtgcgagcgtagaggtccggcggtgcagataggcgccgccgggaatgttaatagattttgtccaaaaaatgataggtttttgcaatttttagagaatttttttaataagatttacgaatttttgggccctgcgatgccgataggcagcgccaggcgaattttaaaattaaaaaaataaattaaaaaagaaaccgtcaacctgaatcgaactcacgacagaaagtaatgtaaaggttgattcactaaccactacaccacactacacatcaatgaccaataataaaattaactttaattcataaaaaatttgtcaaaatggttaaaaaaatcaaaattgtataaattttttgccttttatccatgaatatgtcattcttaggggtgtattttcacccccgcgcccccgcgggggtgaaggtcgcgggggcgggggatggcgggggtcagagtcacgggggcggggacgggggtgaggccaaaaaacctgtcccgcccccggcgggggcgggggtgacgggggcggggtccgaaccctaataaaaagatcaatttttcatttaatattttacaataaatcacttggcattatgcgtaatttaaataaatacaatgcgctgccagttcttttttaacaaagtttttgcaggtttcgtatttcgttttcaattataatattgctttagatattttaataaaaaatattcacactaataaaatttttaaaaataatattatttttttctatttttttcaagttgattttttattatattgatttatgcatttagtttattgtttctgttttataccaaacaatgggtttttaattggtgctaggtcgatccacaaaaaaactcagtgattgataaaattaaataaataaatttaattatcaattcacaaaatcacggtgccgtccgcttaaccataatgtacggtgggacacaagtcattttcaatttttca

SEQ ID NO: 4647 - DNA, 2076 bp, Heterodera glycines
tctataatgaaaaaaacaatatgtatgcaattctgctccttgatttttccattgtaaattattcacggaaagtgaacttaccgcgtgaatcgtgaccgtgagtcacggcacaactctaccatttagtaaattgccgtttttgattttaccatggggggaccctttttgtttgcgaaaatgtttattgtataatcataaaaatttattccctgtgtgtttttggggtccctgctgatcacgaatctttcaatttttttgacaattccgatttcctaatctaaatttgaacaaaaattcataaatcaaaatttatgtgttttatcacaaaattgcaaaccaaaagggtcccccctttattttttgataaaattcaaaaacggccacttttcatacagcgccaaatattttatacagaattcatataaaaagtttaaaaaaaacgacgacactttctgtatgcgaaggcaaagataaattgcaaaatgcgaaaattgaaataaaataaaatgggaaaaacaaaaaatgaaaaaaagtgcaaagtttggtgataagaagtgcaaaagtccttccaaaatggtcacattcaatcagtggctttttctttgtatataatgaaactcggctgttccttttcaatgcctttgccttttccatgcttttcctccgcttccgtccctccccctccctccgcttttccctctttccgccctccaaaatgccgccgcatccattgtccctcctccgtgccactttttacacttattatcccatcgatgaccaaatgttcggtttggatgaggagcagcgtcaggtgattgtgatgattaggacttccgtttttaggcacaaaaagtcgcaaaataggcacctaaaaaggcattaaaaaaatcgcaaaataggcattaaataggcacaaaaataggcaaaaaaattttttaattaatgctttgtaggtattaaaacaagtaaaaacttaaatattcaattgtaaatgaaactatttgcctaaaaatggagtccttaacacacagatttggcatttctcagtgttccgtccgttttccattcattagcttcgtcaattggtctttcgactcgcccagagggaattggccccattcgccagtgaaattgaccgtcaggaccaattcacaatgctccgcgagttttggcgattacttggccaaaacggacttttgggcgtcaccgttccggcggagtttggcgggtcggaacgcaattactttgaccattgcattgtgatggaggtgcatgattaccaatttattttttcaattactaatccaatacagtattttgtaaactcattttgttacagtactcatgtcagtgctctctctcttttttaagagattcaactatcaaaattcccacttagcagggcttccatttttatgtaaatacatgttttttttcctggattctccatagcctaattagtaggaaaaacactttcttttttgtgtttgcgaacaaaagtgggacttttatttacatatttttacatatttcgggctttttctacatattacatatgtacatatttttatacatattttagactttttcgcattttttcgtacatattttgcaatttttttttcattttttaaaaattttttgaaaatgtaccccaaaaattcgatttttttcaaaaaaagagatatcaaaaattaatttttaaaatactaaaaggtgattctaagccaatttaaataatttttatggcattttatgcctatttcactttttactaataatttttttccaaaaataaccattttaaaaattttatttacatttttttattacatattagggggtttttgtacatatttaatacatattttagcattttttatatgtatttcgcgatttttcttacatataaatggaagcgctgctaattaggcacaaattcaaaaaccaaaagcgttcaaacaaattttgaacctataaatatttgtgtgcaggaattgtcacgtgccagcggtgccatcggcctcagttacggcgtccattccaatgtttgcatcgaccaaatccgacggcatg

SEQ ID NO: 4648 - DNA, 955 bp, Heterodera glycines
tagtttttaacatgatttttgtgcaaaaaataaccaaacctccatagagaccttaaaatttagataaaatattgacattacttcatataatttcaaaattataagtatgtgtaagaaatcagaccgaaatttggtcatcactacccttaaatcagaacctttctgataaatcagaacagattgaaaccctgcatataaaagggcaataaaaattaatttttgaaaattcgacacagaaattgggaccaaattgaaaaggcgacaaaattgtccaattaaaattgggcaaagcattttgcacattttttgttagaaaatgaacgcgcggaaaactgcggacggaagccattttgtgctgaacggcacaaagttttggataaccaatgcacaggacgcggatgttctggtggtatttgcaaaaacaaacagtgccaaagcgaaacacggaattacggcatttatagtggaaaaagtgggcggagaggggagggcgggggatcaatggacggacaaacattttaaattaaaaaaaaggaatttacgggcttttggccggctcagaagttggacaaattgggcatgcgcggctccaacaccggcgaattggtcttcgaaaattgccaagtgcccggtgagtttatttttgacacaaaaagaggacggacacacacacacacacacatccgttttggcattcagcggagaatgtgcttggcaaggaagactgcggcgtgtacattctgatgtccgggctcgattcggagcgattgatttttgcggcggcacccctcgggtaacgaaaaatttgtgcctcattttccctttggcgtccattcattcacttcccccccccccccacccggagcaggacaaaacgtcgtcgccgaaacgtcgtcgggacaaaacgtcgccataaagaaaagcgccaaaaaattactaacttagaaatttttca

SEQ ID NO: 4649 - DNA, 2881 bp, Heterodera glycines
  misc_feature (450)..(450): n is a, c, g, or t
  misc_feature (2731)..(2731): n is a, c, g, or t
cagcgctggtattcatactataaaaaaattgaattatgtaaatgtatataacattttgattttttctccctcacaatgcaggagacggaacgccattcgtacttgtcacatttccattaatcagctatgcacacgggatgggctaaaaatattaaaatatattttttgcaaaataatacaaatatttttcctcattatcctatcgctcattcgcaataagatgaacattttgatgggatacggttcagaaaactgtaaatccgtacagaatactgctcatttacaacaatttcagtgtttcatagataaagttcgatttaaaaatcacattctgtatgcttctaaattaatttaaatgagatataaaacttattctaatatacatgcctaacttgggaaaaccccccccccccactttcccatctttcccctcccccccccgcctttcgnggatcttggctttatattcattcattatttattccccttccctccccctcttcagattgatgcaatccgcatgcgacatcgctttcgagtacgcccattcgcggattgccttcggcaaaccgatcggcaattttcaggtactgttttgacttctgctgctgttttccgattttcgacctttccattccatcaccgccgcccgttcagcttatgcaaggcaaattggctgatatgtacacgcgtttgtgcgcctccagggcgtatttgtacgcagttgcacggaacgccgtttctgctgaacgtttaaatgcaaaagtgaattttggacactttgaggcacaaaaaaaaaattcattcatgttgttttcaaacaaaaggattcggcagcaacaattctttttttggcagaaaacgcaacaaaaatggcattggatgccattcaggtgaattcgggggacacacacactagaagacggatttggcaattacctaattaattgttggtgaataattgacaatggaaaggtgttgggagggaacggatacatcaacgaaaatgccgtcggacggctgctcagagacgcaaaattatacgaaattggggccggcacttcggaaatacggcggatggtaatcggaagggcactgaacagagaatacttaagaaaatgatcggcccaaacaaatcgaaagcgaactttgttctcaattttttcattttgatgtttgttttttctatttacaatgttataataagcaaatattgaacgaatttttgagggtttaaaatttatattttgtcagtttttagtccatctttttgtccatatttgacgttttttagtccatataatttcgagccctagttataatttttataatcggaatttttagttaataaaaattctttgcaacaaaaaataaaaagtataaaaatccaatttatttaaatttaattttgtaaatctttttaagtttccttcttaaattgcttaaatctcatcaaaagattgcatttaacaaaaacgttattaaaaataaataaaacatttaacgacggaaaatgggaaagtttttaattaaaatttcaaaaatttttaattattttccagtgaaattttcataatatttgatttttttgtttatttaaaaacttatcatttaaaaggaaaattaactaaaaaattccaactaatcaaaaagataaaattgcaaaataaatgaaatattctatcaagatggcaattagcaaacctaattaataaataatgtaaatttaaaacctttaaacaaatgaacggcaaaaaaaagttataataagaaagcaaatttttgtaacttttatcatatatcttttattaggatatatttttaattgtacgagttgcctttttgtgcgagaatttccatggcacctccgcaaattgtcgcaccatagagaaaagtcatagagctgtgcatttatttgcatcattatagaaaattttgttctttcattatttactgggctgaatattccatagacattcagctcgattagaaaaaaaaagtaacgaatttacggttttggttattcagtagcaaaaatggatttttaaaagaaattcaaaagggacattttagcgccaataccgtatcacattcatggcgcttccccaaacggatttatttaattgattcattcaaattatgccattaattttgtcctttgttcatttgaattcttcagttcgtctcatcaaagattaaaagaaatttctctattctgttaattaatgttttgggttttacataatctttcaatttcaaatgaatttccaactccctcaaacttttttttgacatatttttatttttaaatagaatttctgtggtaaaattttttgtccatataaatccatattttgggtgttttctagaataaaacttttaaatttttagaccatatttcgaacatttttatgaaattttcacaagccaaatgcaaaaaaaagtaaaacaaaaaaaacaccccctaaggacaacacacacaaaaaatgcgaaaaatttaaaatgacggatttttctaaaataagcaaaataaaaattttttattaaggatttttaggccacaaaatacataaaaacttaatcaaaaaatataataaatcaaattttaaaaaatttaaaccaaaaatttttttagaaaaaataaattaaattttgtgggtcaatttttgagaaaatttttcaattaggggtgtattacggaaatttttcgggtcttcttaggggtgtattnttttgtgtattttaaaagaagaaaaaattaggtgcagataaggggtaaaggggccaaatatgttctggcgcaaatggaaaacatttattgcactttagaaaaatatcctttcataaaaaaagcccgctcttcaaaatggcccccggctta

SEQ ID NO: 4650 - DNA, 5571 bp, Heterodera glycines
ccgtcctgaggctgcgttgggcgctgtatgatttcgtcagtaaacgatttcgtcattgaatgaattgtcagtgattttcgtcagtgactttattttcacgttaaatgttctatatacatacttattttctttaatgtattttaaactcaaatagcggataattctttcagtcaatatatatggtgcttaaatatgaaagtaactttttactatcaaacgaattcgtcagtggacaatttcgtcattgaggtgccgaaaaatgtttaaaataaaatttaaataaattttttaagcgccttccggcactttggcaggaaggcgtcgcctgttctcgtcggatgaagacctgctgtacataccgcctcgggaccctgggcaaatcccgaccccgtctggtttccagctacgggtatattcgccatcgggcgacctttatagtcatagtcccagaaaaaatattcgatttttagatttcatattttatttttccaaaaaatgtttgatgaaagcctaaattcaatagaacaggttgaataaatgtgcagaacaaatcagcaaaaaagaaataataagttgtaaaatgtgcaggaacaaaaagccaatcgtccgttaattaattaatttttcgtcgtcgctaattggcaccgccagtcgtctgctgtgtgatgaactcagcaagcgctttctttttcggttgctgctgttgctgatccggcccgccgtcatcctcttcctcctccacctgtccgccgtcattttccgcgtcctcctcgtcctccggcgggggcggggcctcgtcccccggcggcgcctcgtcccccggcggcgcctcatcctcctgttcctcttcctcctctcgcttacgcatcatcttacgcaaatacctaaatatggaaaaatggcattagaaattaattaaatgaaaggggatcagacgactcaccaaacgccaattccggcgccaaacgcgacgacaacaaccacacaatagccagcaatttttctccacataacttaaagaaaagaataactgtatcaatgaattcgtatattggagaatctgggtcccacccaaaattatttttctctcatgaaaagaccaacccgggggttttcggggcttcttatcaagaaaatatcttcttaaaagttttttggaataggctatgcaactaataattttgatacttaaattgaattttttttctgctttaaaaacgctttttttgcggcgcgcttcttcaaaaattttgtgggacagggggggtgatccggcggcgccaataggcgccaccgggaaacatttgtaatgtttaattcgatttgtttacagctttttgtccaaaaatggccaaaatttgcgattttgggctaattttttaagaaaaactttatgccataaatttcaaaaattctcaaccatgagaaaaaaattacattttgttgacataatgccataatttaatcaaaatattgttgaaaattacaaagatttctcaaatttcttaattttttttttaaacttttccaaatgctcatttccaaggacgtccttgtcatccaaggacattttttatttccaaggaagagagtcaaattccaaggacgtccttggcatccaaggacgaatgggagccctgccataagttaataaaaatttggtataaaagttcaaaaatttgtaaacttttgaatttttttctttcggatgctctttttcaaggacatcttgaattcaaggatatttccaaattttcaagtgagaggacccaatttcaagaacgtccttgccattcaaggacgaacccgaaccatgatctaaactattagcgtcatttcatttcgtatttatttttcagattttctcattttatgtcgtacagttcaagaaaggttgtcacattattcatccttagtcaaggcgccttttttatcgacgtatttatcggctacaaacttcttcaaaaacacgagtccgcgcgtcattggctgtactccaattgccccaacattttgcttgcttattacaacacgcgtgatcattactcggacaagggccaattgcctggcaccgaacagcgcaaagaagacgtaaaacggtggaaattggcggcggcgatcgaaaacgaaggccaacaaaaggagcagcatcagaagacgaggaagggcaaatctgcggacagcacaaagggcgaagcacagtgactgaaggagaaagccgaggaagaaaagggaaagtgggtaattatgtcgtttacagaccataaaacaattcgaataaaaaaaccgaagaactttcgagtttttgttcgaatttgggcccgggttttcctgtatttaataacaaaaataatttttttcaaaaggggggggtaccatcgacagttatatctatccctccaaaaatttttgtttaaattgtgtctgccattttcagcaaatggttcggcagtcctccttttattacatgattgtgggcaacttgatcgttattgcggttttcgcggacagggccttaacgagacgctactttggcaagaagatggagccgatggcactgccctcgtggaatgcttttgtgaaaacggagttgaaagaaggcagggaactgacgatgccaattagcgacgacggaaattaattaattaacggacgattggctttttgttcctgcacattttacaacttattatttcttttttgctaatttgttctgtacatttattcaacctgttctattgaatttaggctttcatcaaaaattttttggaaaaataaaatatgaaatctaaaaatcgaatattttttctgggactatgactataaaggtcgcccgatggcgaatatacccgtagctggaaaccagacggggtcgggatttgcccagggtcccgaggcggtatgtacagcaggtcttcatccgacgagaacaggcgacgccttcctgccaaagtgccggaaggcgcttaaaaaatttatttaaattttattttaaacatttttcggcacctcaatgacgaaattgtccactgacgaattcgtttgatagtaaaaagttactttcgtatttaagcaccatatatattgactgaaagaattatccgctatttgagtttaaaatacattaaagaaaataagtatgtatatatgtagaacatttaacgtgaaaataaagtcactgacgaaaatcactgacaattcattcaatgacgaaatcgtttactgacgaaatcatacagcgcccaacgcagcctcaggacgggcgcttcgcgcccgttttttaatttttgggagacattcgttcgcttcgcggcccaggactggcgcttcgtgatgctcattgagcttcagggcaccattgaagttgcgcttctgtcgcgaaaacaaattaagtcggtgcaacacattttgaaatttgaatttcaaatttaaaataaaataaaagaaaaataataataataaaaattaggcgttccccacgaatatttttcgtgcattcacaaattccacgcttttgtcgaagtgcgctgctcctcctaccagcaaaaggcggtccaactccgtctggtggccctccaaattcgccgtcggcaaatgcccgtcgatgaattcgacagcgatgacgaggatggcacagcttcaaatgccgatgaagcttatgccgatggtggacacgatcagcttggccatttggttgaccaagtgggacacaaagacaaaatgccaaagcgtggaaattcaaacagtgctaacatgcctttccaggaagtgtgcctgctgctccaccaacattcgacttgtcttggcaatgccctcgggcggcactgtccgttagcgcgttcgttgttcaccagtcggcacgccttgcgggacaattttctgtcctttgtgctgccctttggcaccgccgtggaacggaatgccaaaggagcggaagcaagcgctaacagtggtgccaccatcgaattggatcaattattctcggatgaagtgcttgacacgtgccaacttttggactttaacaggtgggccccaaaaaagaagcaacgagaagcgaactaattaatgaatgaattaattacctaatttgcaaaagtggacagtgagagcgaaaaggtctttaaatgaataactgcttaattagctaacacttcggaacagtggcaaagactaattaagagtgaataataattagactgagataattaatcacagttttttacagaatgatggcacaatggctgccaccggtggcagtggcgtcggaataacaccgacgcatacggtgacggcgccgacacggtcattggatacggtatcggcccgacaaaacgaacttggctactgaagtttttttttttattgcagcattcgccggctgagttcaaaattcaaaaatttccgaatgatgccgatgaaagggtcggcgacagaatgccaacaaattggccgccgcatggcattgacgactctgaacagcttcaacacttgcgaaccgatgccaacaatgtgtactttgccaaaatcttggaatttgatgacgaggaggaggaggaggacagcacgggacgagcagtgggaagaacgacgccgcagggcgcgcgaggtgagtgccaagggggaggggctgaggacaaaattttaggcttttatctaacaaaacaccctgccaggcatttttatgccgatagtatacctaattcaccctcctccggcagaatttgctacaaataaaaagaatatctctgcggcatttagtgactgcctacattgaacacattccacgtggtgaacaggccaagccgatgcaaccacaaaacggtgccgtcgatcatcctcattttggggaggaggaggaggcgaagaaggacaaacagctgctggacgactcttccgcagcggaagatgatgattattttgaggatgacgacgaaaatgacgatttatatacagacgaatcgacggagggacagcacgacattcggcaccgaatctcaaacaaaagcccgggttcggcacggcccattgcgacaaatgaagcgagccgaggattagccgacctaagctcgaaaacacgaggtgcggtgaactaagcacacgaaccacggcatggacacagcggtccaattttgggctccaagtacaaatatgctggatttttcgtcttagtggtctgtgagttagtcaccaaaaggggggtctcaagttcaattcctccttgtgtttgtgtataaatttcaattttttaaagcaaataaataaaataataataaatacagaacgccaaaagaacaaatacaaacagtaaaaggtacacactatattttacccttgattttatgaaatttttttagcttataacttggtgaatactagagcaaataaaaccattttatgctcattttgaagggaaaattctggagaatatttctaagttagtcaaaagtttaaaaaaattgtttattggcagataaatgattcatgtgttattttatatgttagagacaaggaaatagtacgcccaaatgaaagaaaaagaaaaacctttgtccttgaaaaaaattttttcct

SEQ ID NO: 4651 - DNA, 2622 bp, Heterodera glycines
tccgtccgttgctgcatttttcaaaattctggaaatcgttttaataaatttcctctttcctcattggctgtccaaaaatgcccaaaacattacccaaccttcgatgcattttctccactttatctataaactcgaacccaccacttcccatttttttcaggccatttcaattggtggtgacatcatgacagcaaccatcggctggcccctggtgacaaccggcgctgggaattgtctgcttcataccgcatcgttggttggttgaaggcaacaaaaatggcagggggatgcaattttgggagcagtttgttcccccccccccttccccacattgttcccaccgtgtgggtttgggggggacacgcaaaacgaaaaattacggattggggcaattttggcgttatgccacaatcccaataccaggaacggaaaaattgccgaatacggtatcaactcaaaatagcctaaaaacacgtttataggttttcttagatgcttagaacgatagaaaagcttaaaattgggcgcggaaaagcatttaaactggtttttgaacagggttaaaactcgaaaaattgaggaaaaagctggcctcctgaccttttaaaaaggtcaaacccagacaaatttggtatcattcgaaatctcttgatgagttaagtctaaaaatcagggaatgaagtcgatccaaagccatctgagcgctaggacaactgaattccagtgaaatgggaatttcagtaccaaagaaaaacaaactttttttttactttttttggtaagggttggaatcagccccaattatagaataagaaaatttgcatgataattacgtttagagcctaaacctaaagcctaaacctagtccgtcttcgcatgctcctttttgcgtgagtttttgtgcgattttgagccgatggcttgcgttgccaaattttggactttgagacgtaaatatccggaaaaaccattaggaataaaccacaaagatgtgtcttgatcatacttgtcggactataaatgttcgattttgggcgggctaatgtccggaccgcaaatccgggccgaaaatgtcgtgcatcttaccaatcaaggaattggaaaagtccgggtcggaggacgagctgctcgtcactgatgccaagcgtaaaatgcaccccattggaactgttgcaccggctttccagtgccgcccttgtcgacatgagctgaaattcgaatgacgattatggcccgtgttgactacgcggccgaaaatgataaggagcacaaacccggacttggttacttagacagatgggaggttattgactaggaacaatttcgagtgctagccttaaatcttagatccgaggaaatgcgccggctgctcttgtgaaggagataaggaaacgcctgaattcaagcgcgtttgaaacgcaggagcaagtgggaaaaatatgctgacgaaatttgtaggcattttttgttagtaaatgctcgaaagtggacatgcggcctcacgaccaagtcgacgaaccgtttgacattgaataaaaggttgcatagtttttctgcgtaaattataatgaatagggttcgaagttgttttagagaattaaaaagaattggattttgtatatttttaataattaattttgaatttgtttacatttttcaagagttcttacaaaagcccatttccgattttaaggataatgaaacaaatttttgggttttgcacgggcctgtaatatcaatttgtaagaagtgataaaaatgcgaaatattctcgcgcctataggcactgcgacaagacaatcaaatttgcctcgaaaaattgacttttcggtgatgtacttaaaaaaattacaaatacattttgaacaggttgtggtgctgcacgatggaactgacgaaacgtacccgatatgtgtcggcggcctttttccgatgctcagtgcggactatgacacaaaccgggagccaaatcaaacattcacgccattcccgatttgttgggagaaatggccatgctaccctatgggcaagacagttagcctagaggtgctgaattaattattgtatttgaacgcgttttatacacaaaaaaggaggcattcacacgcttggccgactacaagaaacaatgtcgggcggggctacagcgtttcatgttgcggtgtctcgaacaagtgccacaatgcggaggaggagcagcggatgggacggaaggagggacagcttgtgtgaaccccttgtgcgggcgcacatgactgtacatgatgtgaaagaaatctgcaaaaggcagattaagcatttggagatgggaaaattgggcagggaattcggacgccgtccatggctcgcgttgattacggggcagccaatgacaaagaacataaacctggcctcaattacttggacagatgggaggttgtgttttggcaaggaaaaatttgcgaatattggcgttgacttacagatcaaaggaaatgtgccagttgaatatgtgcagagcttacatgaaagcatgcaaaagggcgaatttgaaacgcgggagcaagttaaatgatgttggaggaaatttcagtatcttttgttagtaaaagggaaggacagttaccgaaaagcaatgcaatt

SEQ ID NO: 4652 - DNA, 2325 bp, Heterodera glycines
  misc_feature (2294)..(2294): n is a, c, g, or t
aaagaatggatgcagtgattaaagctgctggcaatagggagtgcgggcacatttattgggtctggaaccggcagactacttcgtggctggcgtgcgaacgacggtggacctggtgttcgtggccggagacaaaattcgtgccgatggaacatcgacccggggcaagatggcatgttttctgctgctatcacacccactggggcgatgaatcgaagccggaaacgaagggaaaagaaagccgtgcaaaaaggattggcaaattggaggaccgttataaaaaaggtgcgtttttgcttttgagtacgcaattacctaaaaaaatcagctggatgtgctggccgatgcttataaggagatgaagtcggcctggccaccttcgaagaagcagtacaaggacctagcggaaacatacactgcggtcataagccgtggacggcaattgatcgaagccgaattgccagtgggaacagacagggcaaaagagacagaaaaagtggccaaaaggatggagtaactcagttttgagtttgccgaatttttggacatggcacttgaagaagatgaagacctgcagcgaatgatcgaccaaggtccaggggagcagcggcagcagccgaagcagcgggacgggcaacaacaacaggagggggagcgacagggaaaaggagtcacgaggaggaagacggcagatgaggtagtaaaatccaagcacaactttaaaacaaagcttccacaggttttgcggaagaagagaaacaagaagatagagaaggcggtgggtcttgaaagggaattggaggaattgaagagacgcaggagatatgatcagaagccagaggggcgggagaaaattttggagacatgatcaagctctgacgttgacggaggatcagatgaaggcagtgtttgaagagcaacgccaaaggcgcgtgcgagtgaaattcgaagagaatgatcggcaatagcagacggagtatgagtcccgacctgttccattcttcttgggaatcgggttgagcgaaggggagagcagcagcagaaccactgggcaggaagcgggtggaggatgaaggaggaagcatcagggatgagatggcggaagagcaccaacagcggcatcacccgatgaagcagcaggaagaagaggaagggttgtgatgagtggttgtgatctgagagagcgcaagcagaagtttgaagatgaggagcggggatgggaggagatcaagaagagcagcgcctttccattatttgtaccattttacacctggcctccctccgcacccggatgcggttgtttcatttttattcttttacaccgccgggcggtttctttcctctttttattttttctgaataaaaaatgattggaaaaatacgggagttgacgagtgggagcgaggaaggggtaataataaaaataaattatatgatagaatagtaagatgaagaacgacttcaaaagacaaaaaacacttattgttggacgttaattgaaattttaaaaaatccattattcatgaaaattgaaaaaaaatttctagtatttttggaatatttttttgaaaaaataactatcggcatcgcctagtaatctgtcgacgtcgtccctttccctacagtaacccctttttcgaatggcgctaggacttttcgacagcggacctttcgacagaaggacttttcgacagcggacttttcgacagtaaaggacttttcgacagtgaaggcttttcgacagtgaaggacttttcgacagtacactaacaaatcaaatttttcattaaaaacaaataatttctaattaaaaaatatatttttataaattactggtttataaaatatcttaatttagcggggtttaagaaggcattttagtttattgcactgcatttttggagttctcatgaatggttttcttatcaataataaataatttatttgtttgacctccgtttctcgaccggcccaaaaaagagtgaccatgccattcataactattactgaaaatatttttgaattgctgtgaaaaatgtcttctggttctagtggtcccgaagaaggtgaaattggggccgaactctttgcaaatgaagcctttgaagaagcagaggaaccagctggtcttgtccacttttttcaagcagaaagcaagcgtggccgagagctaatcagaagcggcggttttgaatatgcctttgaagcggacagcggacttcaagaaggtgcaaaacttggaattttttgtccaaaccccaaattagggatcgaattttggcgctgtatcaatcggnccccgtattgccctgggagagtgcatgtcag

SEQ ID NO: 4653 - DNA, 3198 bp, Heterodera glycines
attttggcacctttggaaccaaattagcccttgatggtgcctttaaggtaagaatgcaaataggttctgatcatgggcgaagccaggtggccgaggccccccccccccgaaaccaaaattttaaaaaattaaaataaatattatgtaaaatttgttaaataatattatcaattttaaaagaaatcccatagaaatcggctttttaaaaaacgaaaaatattccccaacaattgaattaaaaaaaattaaatcccatttgagaactggccaaatattttgcaaaaaattggcttggatgccgtcaaatttggcaatccgatcctgtaaatgatgatccggctgtgggccattatcaacatgtcgatttgtttatgcgaaactggattgtccaaaaaaattaccaaaaccgtaatgccacttttccaatttcattatggaatatgtgtttgaatttgaatgcgaatttatgccgtaccaataactccttggagtcatggcatagagtttggaacagcaaatttaagtaaaatttttttttctattttatttttttcgaattttactttttcgatttagaagtggtcacccgaaagttagtgaaattgttaggggaatcgaatctgaagatttgcattgggcaaatgttgttcgagactgggatgacacgcctgtgaatggaattcgtggtaaaggcatgaaaagaaaagaaatttatgttgaacaagacgaaaatttgctcgcgctttacaacacacgtgaacagcgccatccctaccaatatttaagagctgtggcctatcgaatgccggacccaatttaacttttccataaaaacggaaatcatttcgaaacaaaaataattattttgcttactaaatgaaatagcattgtcttttttaaaactaccatttactgtcgaaaagtcctccccttaaacaaaaattttttctgtcgaaaggtccgctgtcgaaaagtccggcgccctttcgaatgagatatccccatacagtacccttctttgttgctaccgcaactgttggtcccattcgctgatatttgtggtgatggttgctgcagtagttgtactgctgctgttttgtggtgctgctccgccttggccgtcctcgaataatatttcgtgttaaaaaatggaaattatggaatcccccgccccccaaaatttaacttttgtttatttaacgcaggggtgcgatcgaaaatttttcaaaataagaacatcaaggtcaaaaaataagatttttgggtcaaaaataagaacattttgcgaaattgcttcaaaacaattatttttcaaatttttcgatcaaaaatgtactaaatactatatttttagtctcccattattggttttaacaattttggggaggaaataagcaaatcataaatttcagtgcattccggatcaaaaaatcagatttttacgaatttttttgcggtgcattttttaaaagactttttggggaacacgcggagcggaaggccggcggtgccgataggcgccgccgggaacatttttgaaaatttgagtataatttgttaacagattttgtccaaattttgtgattctgagccaatttttaagaaaacaaagtatttttggggttcggcgatgccattaggcaccgccgtggaaaattttggaaatctaaatgacattacgccataaaattacaaattttctgaagaattttaagaaataagaacaaaataagaacaatagcccgaaatcagaacatttcttacaaataagaaggtgctaggtcgttccacaaaaaagcagtgtgggcgttccacaaaaaactcagtgattgattggtcattttccggaagcctatcgcaccactttcggggcaccaaaagtgcctgatccggaacccggaccggcccggttaagaacaattttttgttcagtttttcaagggctatctcccaggccgggtccggttcttgatccattcacttggagcccgtcatgggtcgggcacatctgccggaggaccctcagcctcgcctccgaccctgtcgatggccaacccaagctaagcttgccggtaccaggcttttttgtacagctcgatgaactctacaaaacggtatcaatggcgtcaggctatgtctactacaaatggagaaaattggcgagaagtgatgtcaaaaattaaaaaatctgaaaatgacttgcgtcccgccgtacattagtattaaccggacggcaccgtgttttgtgaattgaataattaaatttatttatttaattttatcgatcactgagcttttttgtggaacgactcaccacgaaataagaacatttttattttgtaagatttggccctccaaatcagagcatttcttataaataaggacagatcgcacccctgatttaacgcttaagtagtgaaattattaaaggactaaaataataatgtgactgtttttttccgagaaaaaggctcagaaaaacggttcggcagaaaagcgaggccaattttaatcatcaattcctttttgaacctttgttttacctttatcgtttcgaaatttattgccaaaatcctcgctatcgttgccaaggaaatatgctaaatacgggaacgggtcgtttcggcgccgccaattcggcgccgccgtttcggcgacgccgtttcggcgacgccgtttcggcgccagggtcgtttcggcgccgccgtttcggcgccagggtcgtttcggcgccaaaaattttttaaggccctgcaacttttgaagcagacgaaaatggttaaaaattcacaataaagtttacaagacccaaaatgcacaaaaaattatatcgaaaggatccgaacctgaccagcgccatcccttcagaatcaactgatacggatggattcttaggtcttaacgaatcttaagatccttctgattatattttcgtgatcactgatcagcggcttaaataacttctaaaaaaaattttggaagattttggtgaaaatttttcccactcaaaaatcatgtcctccccctttggtcctgaatttcaaaatcatttttattgaaaatagggaattcaaataaaaagtataaaattctccagatttttctttattttagaccttttttgtaacataattggtccacatttaagtgtcaaattggcaggaaatttaaactcgtttggcaaacaaatattttttt

SEQ ID NO: 4654 - DNA, 1388 bp, Heterodera glycines
aattattgaaatgccattagagggatttatagcaattaccaaatgaatagatgatgctttcttgtatcgtatattcagattttatttaaaaaagactttctgtataaaaatttcgatatttaatctcatgagtcgcagttggcccttttagtaataagacgcagttggcccgttccgtacgtaaatattatactataaaaaataaaagttcaagaaattaatattaaattttcaaaaatttcatttcgcttttaacagttaatgaagatttagaaatttcggaaaaatggctgaaaatgcgcgatgctttttcatatattttttggccatatccacgatttttatgaaatattttaaccccgagccttctttgggtttttacgtttaatttcagaatattgtacatagtgttgtgtgtatacagacaaacatagacttaagattcgtcccgttctccgacttccccatttttttcgcttcttccccgacccggtccccggcatttttgggccccctccccgacccgatccgtacattttgcgtctcttctccgacacgatccttaacatttcttcccctattgtctccgaaatggccggggacgaaccctcctaatacaaacaacaaacagaaaaaaatgtagtagcatttgttgtatgtatatatggggtttattattcattccgcggcacattcaacggaagaagctggccaaagatgacgcgtcggcgccgttcccacctccgcccatcgatgccgtcgtcgtgtgctgctgatgtgatgcagccatcgaagcggtggaacattttacgcccgttgtgcccgccatggcaccaaaaccgttcacgttgttgtacatgccggcgaccccgccgttggctgccgccgtgctcatcgccatgccggtgccgtacagtgatgggaaacaaccgccggaggccgccgccgccacgccgaactgattgtaggcggagcccatggtggagttgaagaagcgggcggccggcttaaaatggcatttcgggtgcaaataatggtatttttattcaattaaggattaaagtcggtgggaaacctttcgaaattcttatagagttttgaaaaattctttcccaaataattatcgaaaatatttgaaaaaaatatttaaaaaattttaaataattcagtttttaaaaaatccaaagacttaaacataaaaatattaggtttactaattctcattttaaaaataataaaaaattatgtgtttttattttaaatcaagtgaaccttttttcaaaaaagtttaattctaaatttcactttcattttttaaatttaaacagagtttcaaacaactaaactcttagtgtccgatcaaaaaatgtctgccccacttctgccga

SEQ ID NO: 4655 - DNA, 5966 bp, Heterodera glycines
tgcagcactgccggggctgatcagcgaccggtagttggccgcggtccacaggtcgctggcggttgctgctgccgcggcaccgttggcaactgccgcggcaccactcagtcggctggccgcctggctgaacaggtcgccggccgccgccgccgccattgtcgcgtgggcggccagcgacgcgccgctcgccgcctcaccgctatggtggagatggtgatggaattggtggtgctgatgatgatgatgcatgttctgcgcaggttgttgaagtgccagtgaaatgcctgcggcggaaaaaaggaaggcatttatgataggggggctgcatgcaaagtgccgagattttgagtgcgaaattcgtgaccctaagaaattgtgacgagagtcggaacccacaaaaaacccgatgttttttctctcgaatcaatattcgagatcgagacaaccccaagaaatggtaacaagagtcggaaccccaataaaatcggatgttctttcccgaaactgaccacgcgactcgagaccaagactcggcgacccaaaaaccagccgggaacattcccgactcaacaccgattcttgatatcgagatcgaaaactagaaaaaggcctgccatccgcagcagagcaaatcatataaccatttggacaaaaaaattgtccgaaataatgccattgaaaaagtggcatgataagcataggagttatggtttttaccatcgaagtcgaatttgtaggcgtagcgcttcccatgcactttgctcatgatctgtttttcgtagtagtagcgcaacgcgcgcgacattttgtcgtagttcatgtgcggcttggacttgcgctcgccccaccgtcgagccacttcatcaggctcgcaaagctggaaattttcaaaaaattttggtctagcctaggagggggatggggattggggagctaaagttaaagagggtcgaattttcttgttcaaatcccggcgtcatgacaactcgtacaaaggcaaaatccgaaccatttttggccaaccctggaacgtctctggtcgtgacacgaactaatttttaatcaaaattcctccctccttgccaaaaatcgaaaattttcgggtagccccccccccctccgccagaaatggattttttagccaaggcttgacactttttctcaccttgaattcgccatgggtgccctcccaggtgatcatttcagcgttcagcggattggacaacagttccaataggaattgccacagttggatttggccactgcccgcagcggccagccgactgcaaattgggcccagcacttcatagggattttctgtgaaaatgggttactgtagtattacactaatactgtaagagagatagtgaaattttcctaatttctcaaaaagctagcggggcacggcagaacaagagagttgaccaagagagtcgtgatatactgagaatactcgggatcgggatggacaccaagaattgttcccgagattttatactaaaaattctaaggatttttgaaacagagtttttgtttttcagggagtcgaaatgtgtggccccgagacccgaggctgggtgccgagaatggagaccaatgttgttgaccaaaagaaactcagctcgagactgagagccatgatttttcccaaagaatgatgccaatgttctgcttgtgatgaattcctggactaaatctaatccctagccaattttgcgaaattctctaacatttataaaaaattttaattttctttcattcttttcatgtaaattccaattttccattaatttttcgttgattggcatgctcaaaatcccgacacggttcaccttccccccctctctttagtcctccttttaagcttcatcagtggccccatctatcaatggacacagcagtggtaattagcagcgaatttggagcgcgcgcgcgtccctaatttgtgtccgagggaacggtgactaatcgctcacattattaattattaccgtaccaatgcccaaatctttgaccgttaattgccaatggacacacaacgccacaacacatcatacaataaaccttgtgctcaacctaatgcaaatcccattctcgggaagactcgggcaatacacacaacaatctgttggcgtttgaccccattttgccctgggaggggaggtcagcagaatgccaagaaaaaacaattaggcatgcattgtgtggattaatttgagtccgtcctcgggagcaaaattggcattttgtacaaatgccataaattaaaatataaaattgagagaaattttgttcataatgaagtgccaagatttaaaattctttttttaaattttatatgtaaaataaaaggttaagaacagaaaacaaatgaaaaggtcaaaattaatctgaatatatcttcttttaaaaatttaatttcagggaatggataaaaaagattatttttttgctgtcttacataaaatgccaaatatatttttttaatttcattaccaatttacaaatccccccccccctctctctctgattttctttccacaaacttttcaacagattttctcaatttatactacttaggttgtttgacttaaggactttctgactggaccaaaatccggtgccaaattatgcaaattaggggaggcttgggggtagaagcgctgaaccatgcatcaaaggagttcatcaacaaaatccggtgccccaaaacttggcccacaattgtgacgccgcagagctgtcgggcagccaatcatggcaccaccaccgctcactcacttttggctctgctgccgtgccgataacgacggcacggcccgccggcaatggtggggcaccaccgacgggggccaaattgaattttgccaacaaaacaacaattgaatgatgtgccctttcgtggggcacccatcgcagccggaggcaaagtttaattaagagaggaagaaaggactaagttgtcgagaatctcgaccccggaggcgatggccaaccgcctctctcccggagcgagctgaaaacaatggcaacaaaattggccatagtgcgccgaaggcacggacgggcggcccaatcggcggcacaaacaaaagaagaaagggaggggagaggagtttgagctgatacgaaatttggcattttgttggtgcatatacggtatgccgtacataaaaaattgtgcgcccccttttttggtggtccttttctgagacatgcaatatgatgtggtgacttggcccaataaatctcatgccaatatcggtggcactattttaaaattcagtcggataccccccccccctcccgttttattgccctgggggggaggaaaagcatcgccgctctttgcctctgtcccctcaggccgataaggggggagggataatcgttgcacaaaagcccatcgctaaagagtgccccccactctccagccaataaggggctgcggcgggagggggtaattgtcccgtcgtcgagagtcttgagaaaacggcacggcggtgggatgaatggcacaaaggggacggcattggcaatgggttcccccccccctttcccgcattcgttggacaataccacaaatgatgggccaacgacatgcacatgatacacgcgcatacaatattcagctgctgagggtgggcggagggcacacaatgccaaaaaatttgagggaaatcaaaaaaaaattctaccaaactttatggtatcggtaattgacaataagtgttaatttgccaattagtaaaagtgagggaaatggtggctcaaacacagaagcaaccaacatttgacatttatattttaattaatacgagcacgcgtaggttatagtgccaaaaaatgtttgcaatttggcacactttcaaaatatattttggaaataaattaaaatttaaaattagaattttacctctgtctctctgctgatcattagggtgttgaaaagcacagctcagtgcgaccgattgatgagcgaccgacaaagaaaagggctaaaatttgaaaaatcaccccaaacggcatatgcagccccgccgctcgaaaacggacctcctctttcacttgcaaatccgccgttgtcccgttgctggtaacgctgccgctgtcctctgccccatttggcgtcagcgcaccgccatttgccatcgacaaattcagtccttttaggacaattgaagggggcaagggttagggaaaaaattcagaatttttgtgccagaaatttaaaaaatcggaataccggtaccgaaactgccgggtgtcggagttacacccaatttatataccgctctctactaataatcctcaagagtctcggtatatccctatttcgagtctcgacactgtctcgaaaagaaccaatccaaaatttttggggtaattcgccagcttcattcccaatttctgcatttttgtcccccatttttacctgctccagttgctggtgcccttctctccattccgtggtgctgaaggcgtacggtagcctccgccgccgccgctaccgtaccaccaccaccagtcgctgtctgtgccgctgttccccctcctcctcctcttcctacagaactgttactgttgtgccgtttctgctccaccgctgctgctgatggtgagccaattttggcaacagttgtgccggtgccattactacggtcagcttctccattggtactgttgttgttactgtggctgttgtgctggtgccgtccaatcagtgccgtcgttgtcgccattgcttcgcccgtgtaaaatgccatggttcccgggtggcaatagcgctgcatcgacccatgacacatcatcccattctatgatggggaatttatcaataagatctggttcctaaccaaaatgtctgatttaggcatatttcccaacattcggaggtgatcagggccaaattctcgaccccccccagcactcgggtcggcacgacattggctcaccgttgagaacggcacaaatggaaatgtgccggccattgtgaaatcaaagggcgatgccgccgttgtcgctgccggcgacaacatgtcttgttgctgatgttgctgctgattgtggttatgcatgtgttgctgtagttgttgttgttgttgctgatgcggatacacaatgccctgcggcttcgtgccattgtttcctgtactgcttgaagaagacgacgatgacgaggaggaagaggacccggatgccgaatttgcatctgtccatgaaaagcaatttaactcatttgtcagtcatcattttagcggtcaagtaaccaggttttgtcccagaggacggtttttggtcccgaaatttcgattacaatgccaatggcacgaagccaccactaaaatgccaattctatgcgatttctgcttccgcgagcttcggatatcccagatttcgtaaattctgtataatcaatcccgaaagctttgtttggtcatgccctgaccacaaatgtcaatttatgctacggcttggctatttgacccagcccgagaattgtcatattcccgaccaactccacatgcttaattacccgctctttccgttgcagctgctgttcgttgtgccgatgttgttgttggtcctgttgtgccatcgttggcatttgtcctctgctgctgtttttgcgttgcgccctgagtgccgacgacattgccgctggcggtgccaccgttattcaacataaaacgcctaatggggcagcacggggatgtttcaatgagcaaataggcccccaggggggggggggaaatccgggccacaaaggaaaaggatgtcctttccgagctgagacacactgcaggggcctggatagaaatataggaaggtatggggcacattctcttattcccccccccctcccccctctacccccctcgaaaaaaaccggaaaaaatttccctccccacccaataacccctcaaatacaaacttttttcttagacaatttacaaaaaccacaa

SEQ ID NO: 4656 - DNA, 911 bp, Heterodera glycines
aattgcggtgtgccaatagaaaaaagagagaggacaacggcaaacggcgaaagcgcgggagtgtgccgttgccggagatttggccaaaaaggtaatttaatccgaccaacaaagtcaagccgagctgggctcggcctggggataaaggggatgagtttatccctccccccgggcatcctcaatccgagtccatagcattggcataataattataaatggcgggaggggggggggagatgaaacggacggatggatgacattgtttgattttgaagaagaaaatgaggagaaaacgcggcactgcacaatggcggacgaatgaaatgaaaatgtaatggaaaacgaagatgaaattgatatatggtatttatatactatttttgagagttaaatttgaagtgaaaattaattttttgggaattcccattttttggcataaaaatgaatttttgccaaaaaagaaaagttatttatttacacatttaaatatttgtgaaaattaattaaataattaattaaagttgctttaatctgggaaatttgtattttgattttcaaaattatgtaaagcggtcatgcccttgaattcaaaaacacatcactgtctgatccttattcaatgttggggcaaattgattaattaaagttgcattagtctggaatataaattttggtctcgcgaaattttgctaaaactgtcattgtgtgtccttgaattcaaggacacacgattacccgatcctttttgtaaagatattaaacttgttcttattgccttcaataatatacttggattaggattttgcacacaaacacatcgacaaattaagatttgcctttttttgtttttggattcattaattgttcataagcgtccttgaaattcttggattttctattcaaactggaaa

SEQ ID NO: 4657 - DNA, 2951 bp, Heterodera glycines
cgaaagactgccgggaacgaaaagcgactgatcacttaccgtattattatcattattattatacattttttgtcaattttttttttaaattaaaaaataagtaactttatatcgcattttccattatttttgaaacatttttatttgttgatttcaaagcaattttctgggtcaaaattaggcggaataaataatatgtgtaaaaataaaatcgtaaataattaatattgctaattaggtaattattgctattggtatgtccaaaagttaggcaatcccagcggcggaacggcggccattcttcccttcctcctcatcgtcctcctcgtcatcggttgtcaacgaaaactgaaatttgtcacaattcagtggtgcaaattgcgtacacaaaaatgggatggcatatttcatcggctcattgtcagacagtacagcaataacaaagcgtacgaatttgttcgggtccgtccaaaaattggccgtcgtcgtctctttggcattcggcgccgctttgctcccggcagcggtttccggcaccgcttttgcggcagcgccggtggtgtccaccgtcgtcgtcgtccgtcgcgtgccgatgcgaccaccgctgccgctgctgctcagcctcaacccgcgctgctggtgacgttgtcgagacgtggcgacgggcgtcgtcgtccgtttcgctttttcagcgttggcaatgccaccgtcgtcgtctccgccatccgcttcaattgttggcactttgtgcagcagttggcttttgccactcgcccgttgctgatgttgcgtaaattgtgagtgaatgaacggtccgttggatgacaacagtggcgcactgtgaaaaggcgcaaaacaaataaattcttatgagaaattttgggtttttaaagatttttttcctataattacatttttcagggaatttttttgaaaaaaaaattttgtataaaaaacgcattaaaactttggaattcaaacaaacaattcacattggaccagaatttggtcagaatgggtgtcccaattttgcatttcgcatcaaaaaatgcttcaaaataatattcgaacggtttgctgaaacatattttcaatataaaattggaagaacttacaaaaacgtaaaataaaaggtattactcgctgatgtgaacgcggaatgaccgtcctcctccacgacgaagacgacaacgacggacaaatgggcgaaactttgccaacgcaaagtcaaagagacgggcgaagacgaacagcgccaaatgggtggccaacgagacggagacggcgatgagtgcacaagtcaaatggggatggacagtgacaaagtcatcctaaagaaagagacaaaaatgaagaaaatggaggaaatgttgggggaagaagttggagcagtacacatggacagagctggaaaggaaaatcatcaattaattttaaaggaggaatacattcgaaattgggaaataccataaacacggggaagagagaagttggttagtaagaatggtaaatccggtccaattatcggtaaaaggacatttaaccgcgttcctgtcagcaaaattaggcaaggatagggtcaagaaagggttttaagagcagaaattttgaaaaagaagaccataccgaatattaaaccaaactgacacttaccaatgccagtcgaaatcgttcggtcgtttcattagcaccagcggccgccgccgaaaggattgtcgatgatgaagacagcgtatggttgagaaaattagacatggtaaaatgaaaatgcaaaaaccgctgaaaccggaatgaaactttcctattcggcggaactttgaagaagtaaaattttaaaatttgaataaatgcaaacataatgccaaaatttttagcacttaatttgaattcaaatgaaaggatttcgaatcacaatgatacagtatgtaacaaattatatacggttaaacattgtcgctgaagaaaaagttgcgtaaaattgttaaaattgaatatagcaaaaaactttcttcacttaaatttagccctatccctgagctttcgaaagcatccaaactcactgcctttccacagctctacgaattgttcattaattttgaaaatgtttgctcataaattaggtgctcaaaaatatatgattaaaactttaaaaaaaaaaaaattcttctcggagctaagctatggtaaaaaactgaaaataattcctgctagggcctaacttttggctgaacaaataagtcaattacaccaagttgatcagcagatcactccttcagcagaatgatcttttcataaaaatgtaaataattttaaatttattttctatccttcgttccgcttttatcaataacattgttgaggaggagatcacgggaggaggctaatgtgtgtgtgcaaaatgccttctcttcttctgtcgttcgttgtcctctttcatcaagttgtggtgtggctgaaaattgacaaatgatcccaaatgtctgcttcatccgttccccttataattaattagtcccggacagacagtaaatgattttcgattaattggcgttttcaatggaattgctattcgaatttaaacatagtaagctctaaaatgtccgggcacggcctccacagacagtcgaccaaaagtgatgacagaccttccattcggaagcgtagccattgccagcccaagtcgttgaacttgggcagataaagcgtcaattttggcataaagacgctcagatttggtgtcaagatgatctcgaattctgttgtcgacattgccaatttgggtataaatccggtcacttagtaagctaattcgtgtataaaggaacattgcagacatgatgaggatgaagaatgcaaagaatgccaagatgaggtaataaaacgaaaaacttgcaagtcttcgattcgttgtgccgactctgcacatgcttttgtgtttgccttttgatgtg

SEQ ID NO: 4658 - DNA, 3345 bp, Heterodera glycines
tggtataaataagcgtgtataaaccagggggggagtgcttcaaaaaaaatcccgtggccgcggatcgcgtaaaaaaagcccggaatcgcggtcgcgctaattaacttctatatgcttacaaatagaagcttatgctagactaaaaaaagcgaacgaccggggatggtggcgaatttttgcgttatggcgcgcaacttttaaagtgcgaatttcgtgtgcacgtcagttttctgtccgtgccccagccgggttaatgcggcaactcgtacaatcaaaaatgttacaaagcctggcctaaagcttaggcctaccctaagccattgtatgaagaattgcgttttgtacgagttgtaatgacaacccccccccccatcctgctgggccatggtatgaatttttgtgaagcaaagcggcacagattggctttggctgttgtgttggcgtcgtcccagcaacataaaaagcagcggtggtcggacagacggccacttttcttcccccgcgggcgcaatctatgcgttcttcaccttccttttcgtttctcacatacactctctccactctctctttctttttctctctctttctcctgttttacgctcctttctgtcttatgtgttgtctgttgccgctgctaacgattggagaatgggaaaagcatttctttttctaaaatttaacccccccgctgcgaaaggggaacactgcctaaaaattaggtaaaaactcaactcgtacggcatggggggggggagggggggacgtaatgctgcattttagggtggtagtcctcaaattagcatttttgtctatttcgacagtttgttagtcgtaattcggatgaatttcagtgagctcgaataatcgcaacaatctgatcattgaccagcaaaaaaatataaactaatctcgaaaacgacgcttttccttgtccaattcgcaaatcctttgttccgttgcaatgtcggccgactccattttctcgaaaaagaaacccacacaaaattttggtgagtttgtcgtatctgcagtcacaagtttcattaaaacagctaatttttttttgcatttttcgaatgtttaattgcggctttttgttctgcacgaaacgacaattcgaattcgcacactaacaccaatctgcaaatctatgtgtaagtatagaggggggggaggattcattcgccacatcccttcgaaaagaaataaaatttctagacaaaagatatgcatttttgcaaatttatcaattaatttgatatgaaaagcacaaattgatcattttttgcaaaaatccgataaaaatcacttttagcgcgtagcatatataattttgaaaaatgacacgaaaaaaaagtcaattaaaaaaatatttacctaattaaaattcaattttaaaaattttcttttcgaagttttaattcattttaaacgtttcggtctttgttttgaataattttgtcacttatcgccagttttgagtagttattatttgcattttttaaattttcttttgttagcgcgtagtatactgaattttgtcttattaacatgaaaaatcaaagtccaaaacttatatttaattcactttgtcctgaaaatttacgaattctatccggtctaagcaagcaaagctcgtattctaccgaaatattatttattatctttatcggctcaattttgaactttatgcgcaatccacaacaaccccgtaggcgttctcttgcggcaacccgagttgaaccaatccaggtcgcccaacagccccgacaaccgcggtacgccgatatcacagcgcgtcttgacacgctggaaagaaacagccaacgggtagaatggacgacgtcgaaaattatcttctgcaaatttaggaccgcgacgcgtgcaaggaggccgccaaaaaattacgatcagctcaatgttttcccatgtttatatttttcactcatcgataactttagggaagtacttcctgttcatctgcactgtgattattggctctggaattggtgcctattatcacctcagcagccgcatcgacggtcttggcagccgcatcgacggtcttggcagccgcatcgacactcttgacagcactcttggcagccgcatcgacagtcttggcagcactcttggcagccgcatcgacggtcttagcagccgcatcgacagtcttgtcgatcattttagtgcctgcaattgcaggtttattgttttcaaggggttgcgtagtcggtgcacggaaattgaagatcagtcattaagtgcaatttctattcacatttgtgtctatcgttcaaattcaagaaaatttcactctgttaaggtttttctttgggtccctgccccaacgccctcaagagtttacgcgttttaaccgccaattcactgataaattgaatacctaaaaaactctaagactcttgcccttttcggaccgattaggtgcaaatgtcagtcaagcgatacaatgagacactccatttttaaagtttaattgccttgccattgactcctcatgtgtactacttaatagggacaggacgggcccggggcctggcgggcttttgccagcccgcccggttcccttttttggacaaacccacgaggccgggccgaccggcaaaacgggttttttgaacgggcggcccggtcaattgtaagtgttgcccgggctcggtagttttaaacttccggtctctactgcgcgtcttaccacgccttctttgccaaaagtttccactcaataatttctttatcttttcagtcttccgaaatgatcggttttcgccttcaacaaaaggaatttgccacctctgacctccgatctcacatcgcaagaaaaaacgggacatttgcgtataaaaattttttcgtaatttgtgctttgcgttaacttcacgctcgaattccaacaaaaaagtctaaaaatgcaaatttttgaaaaactgattttggccaagaaggtaggcaattaataaggtcttattgcagttcacacgaccacaaaaaaagacacgaccataaaatttttggcaacttcaatgcaccactttttctagaagcatccaaatgaaacatttttagtaacattcgacagccctagaagtcctctattattctataaaattgcaaaaaaatttcgttgggtttcaaaaaaagttacggctatattgctagaaaatttcaaaaaactggtttaattttataagcatagtttttttgaactcaaacgaaattttttgaaattttgtagagtaatagaggacttctagggctatcgaatgatactaagaatgtttcatttgtatgcttctagaaaaagtggggcgcccccgcaaaaat

SEQ ID NO: 4659 - DNA, 4395 bp, Heterodera glycines
ttacacgaaaatgcccaaataaggctaaagaaagtgtaaaaaatcacaaaattttgaaattaggggtatttgaaaattcaaaaaaaccaaccttaaagggctttcagttttttattgcatttttctcaacgcgtttcaccaaaaaaggcctttcttcataacatacgcgcaaaaaatggattcccaattccccccactttgtttgtttatcgattttaattgtttccaagtcaaaaacattcaattataaatacatattaaatttaaaatttttaatttccctgctgctggatgagcatcaacaaaccaaacaaaattggtcacaaaacaaagcaataaatatcgatagatttcaatcaaaaaacaaaatgcaatacaaaaaaatatttctctgtatgtctctttgccatttttcactccattaatcggacgttttctgctgctgatgaaacccaccaccgccggtgggcgactgctgctgatacgtgaacagtttttgttgaatttgccgacgacgttccgcttcttcgtccgcgctgatgcgctcattcatggccaaagtgacctggaaataaattgttgaaaatatatatttaaaacccaacatttaagaaaaaactcaaaaatttcgaattttttttctatttccattttataacttttttgcaaattgtctaatcaccaagcaatagcttagaaaagcttttcaacatgttaagctttctgtggtatcagattgttggatttggtcaactgagaaaagtctggaaatccctggcttcttaaacctcattggcacggaaacgtgcgcattgaactgaaaccaacccggcattccgtgggttcacatttatggcacgcaaagaaaaaaaaacaaatcctactcacttttttcatttccattcggtcacgttcgcgcgcctcttgggccagtcgccatttctcgtccatattggccacctcttccgcaatgtgcacagcctgtcacagtaaaatgggagcaataaataaagagtaaaccaaatggttgattaggaaaatgaatgtcatgcttgaatcaaatgtatcaaccaatttacacacctttaactgcactccgcccgccttggccattgccccgccactgccgccccctttcgcagcggaagcacggagcatcagtgccatccgtggagtctgttaaattggcaattattttattgccgatgtacaacacacataaaacatacctcctgatggtgctgttgttgacgaacgacagacgaaacgccatgggaaggagtcaaaacaccagcaggagaagcgggccgatcaattggcgtcgccgttgtaggctcagtgggatcggctaaatttggaattaatcgaggcgaaaggtaataaaaaaaaaaatgcaaaagagattttgtatgtttaccaaatttgagtttccgctcaaatttttgccggacaagcggcggaacggccaaatcgctcatcggtccgtgcagcgtggcgggtgcggactgaaatattaaatttagataatcaaaaaagcacgctctttttaaagacctgtaatgactcaaccatcaatcggtcaaagtcccgcataaagtcttcgtcctccggctgcacttgctgctgttgagtgcgcacacggatgtgctgtgcctcgtcatcgtcgtcctccgctgtgatcattcccacttccgagacgtcctcatcctcctcctcgtcctcgtcactaaacatagaacgaatttcaggataaaataatatatttttttttctcatcaaacaataatgcaaacgcaaaattttcgtaacaactttaaaacagaaaaaaaactactcgaaaaaccggaaccaaacttcagccctttgaaataattgtttactccataccaattattagtaataatgcacacctttcctcgtcttcctcctcctcttcatcatcgtcctctgatagtgactccatgttttcttcctcctcatcctcgtcctcctcgtcgtcgtcctcctccattattttttccagcctccgctgttcgtcgctctcatccgcgccgcctttggcaccggctgccgcccgttttgcggccgctgaacgcatgtttgccaacaattcgtcgacctgcggagagtattccttgacaccaatcaaaaacccaaattggctaatcaacaccgcactttggccttgtagaactgctccacctcggccactctttcgtgggcctcggccagccccttggggaaatgttcgcctttacgccaagtgttcaagacatcgtccaccaaattttccacatcttccggaaattcgtcgagcacttcaatatgttcggaccaggcctcgcgcgtttcgtagtctgcaatttacgaaaattatatttttggtgttgattggggataaatttttgacaaacagaatctgaagaagaagcacagaaagtggtccatccgccgtttgcttttgccgctgacgaagaactcgcaaacagtgtccacgagagtgatcgcgagccgaatgcgctggagacgaaccaccaaatggtcaggaccgtcaacggggcatggcgcaatggcaaaagtgatcagttggtaaagagcctggaatatcggatgcataatgatgattgggttgacaagtaaacaatgataatcgaccttaaaaagggtggccgtgttgcacacgttgtagttgaacagttggccaaagtaggccaccgagcaaatggttcgctgctgaagacgcgtcatgttcaactccatggacagacgaataaactcgagcacctgaacaggtagagcaaccaataaaatggttttttcagttatgttacatcttcaaatcaaaaatcataggacgatttctgtcttggtgatttagcagtaaacagaaacaaaagaaaccatggaaccaaaaaacattgtagaaaggtcccaaaattaccaacttcgtccaacacgcgcactccaacccaatcgtggtgatcagacagtgcgctgaccagcgaagcgagccgtggcaattcgtcaaattgtacccgttgtgagttggacaagaggcgaatggcaaattctaacgtcgatagaagtgattccgaattttatttaaaaattataaattaaattgtacacctgcaaagccgggatcggaccagttcatgcgacgaaaagtgttgacacgaaattcggtggccaattgttggcgtacaaattcgtactcaggcggcaaatgcgcacgtactgcccgagcaccggatgcctgctcgtcgggcgggatcaccgcgtaataggcattttccaacaaaatcttgcaaaataaataaacaattaattaattgtatttaattaggagcaatctcgagaattttcagtctcaaccattactttagagtaagtaatattattgacccgacgatttccgctaattctcacccactttttgccgagcgtcttcaatgttggatgacttgtcatgcatcacttgcatgatcacgctcatctttgcgtgtgcatccggcgaccggtggagaaaagggccacaatgttcgacgaacacactcaacatgtcgacctgcacaaatgaagggaattgaaacaatacaacagtggtagaaaattatgattttaatcaaaataaatggaatcgccgactttgagatgggtcttaataaagcaacatttccgtgttatcggactgtaccttaggtccgcgcatggacaccaacagctgacgcaagcaggtcaacgcctccgcttttggcaaaatgcaaaacttacactaaaaacattaatttaatagtgtttgaatttctttagtgcccatggttgttataaaaacgaaagctgaccagttcggcaagaaaagtgcacaagtgcagcttggcgtccagtcttgtcaatgccgtcaacacttcggccacctttttgccgggcacccgcggcccatcggtgggtttatggccactgacaatgcgaaagcggagcaaaagctcatgaagaacctgaaaacaagacatccaatctatggcgttgtatgatagaagggattaaagcgaaattatctcactaatactttccaaaatgacggaatattggtttatattttcacatggatttttgggaataaaaatgtctattggcttatataacaaacaataattaatgcgccccgttacctgcattgtcaggtcaggataagcgggccgcaccgttgctaaaaagcgagcgtagaaaggcagcaaatccaaccggtcgacgggggcctaaaatggctggcaaaagatcagacgctttttattgctttttaattggtattattaaagcattgtcatatagagcgagcattattgaccatttttaaataaatttaacaactaattacctgcaaaaagtgttgga

SEQ ID NO: 4660 - DNA, 5843 bp, Heterodera glycines
taaggaaattgaaaaacgaaaaaattcctgtttttttttaattttcgaggagagaccaagggatgtaaaacgcacatgtacacactccgtggtgtaccacgtgcatccttcgtttaatttttaaccgacaactttctcctccctagcgtgggtttctttgttttctggcgcaattattttatttttcacgaaagcataagttcatttagacaaaggttttttatggctttatgagttggaagggctacatggaaattttgtggtttttggatccggattttcgagtcataacttacactaattaattggttcatcgtttttcaggaatgtgttggtcagtcatcagcgttcgaaaaagcatcgtcaaatggtggaactgttgcgtgcgcacatgcgaacggaggaccaacagctgttttttgctggcggggagggagcggcggcggcggaagagagcggaggaacaaaaaacgacggaggaggaagagagactgatgaagacgaggagagcgacagcagtgatcacaatcatcatgaccaacagggacagagaagagggaagaagaagagacaacgcaagcagcagaggagggaagcagcagccgccagacggttggaggaggaggagagagaacagcagcggcaagacggagaggagcaggcgcagagagaggaagaaacaggagacggtgatgagagagcacgttgtgtggcggcggaagagaaggagaacaacaacagcggaaacaacagttgtggtggaagagaaggagagtgctacgaaatagcggtggcaacggaagaagcagagagcggaaacatcaccgtaaagaaggaagcagagacggccaagaaaaggaagaagggcaaacggacggatgagcagcagcggaaaacggcagcagcagcaggaggccatgaagagcaacagtcgaaaggcccggtgcattgcgagtgcacgcgctgtggagccgagttcgaatcgaagaccaaactgcacgcccacctgcgcgacagtggtcacgcgacgctcaagacggtggcggacaaaattggggcggcggccgccgactcggcgacggacagcggaggccgacggaggcggaaaaagaaatgacaaatggtggtgaaaacgattctataaaagtgctgtcggtatgttgttattttgttgcacattattgtcgagtatattatacaacatttgtggttgaattttcgataatttttctctcttccatttcgacaaaaaaaaagaggaaaacaatttttttattaagaggaagaaatgagaaaaaaccatacatgaaatagtgaggggggggggagaccaaaaacaattgctcttcaaaaccgcttttttattgtggcgcgctttttccaaaaaacttagggaacaggggcgccggcggtggtgtaaggtcaccgccgagaaagtttgaaaatttggtgatttgattatcacaattaaatgaccaaccaacaggaggggtcgaccccccccccccctatttcatgtatggagaaaacaaaaatgaaaaaaggagaaaaggtcgtcatgaaagcatcgaatttgttcagcaaaaactccccaactgtccggcgtgcttaaatgtggggacaaaaaattactgtttgaaaggtgcatttttcgagtgcgaccatttaggcaattaaatttaaatccccccccccccgaaatggatgggtttcatttttcagtaaaacttaattttaatacgcgcactttttcgttgagctccttaaactgtgatttgacccgaccaccacactttgtcatcggcgcagtgattgcagcggctccggcggaaacaaatatagactgaaaaatggggaaaaaagctgactctcaaacaaaaaataaataatgccaaaataatgaatctgatatcattcagtatcattaagtgctctcgatttccctacaaaacttcaaaaaattgcgtagtttcgaaaagttacagttaaagattaaggaaacaagttgttttttttgaaaattttacgatatttcacaggctcaaagagcacatttaagactatcaaatgatgctaaagtggttcatttggacaacttgcaaataagcaattgttgtgtgcatagccctctgaatattaacccgaattttttattaaaaaaacacgggcctaaaaggtgcgcacttacaacaaggagagaaatacgagcataacgtggcggcaattggaccaatttgagtcgaccacaaatttcggcaccgccggcaagcacaacaaaagggccacagaagaggaagatattctgtgtacaagaaaaaaagtatgaaaatcaatttcaaaaatcgggagtaattcgtttccccttagaaaaaaaaaattttttttttttggtaaatattaaacaaaaaatggccaaaaatatattttcatcgggtgaaaatgtttgaatccatgcagtttgaaaaagattttttttgctgcttttttatttattattgtttgatttatataaaaaaagtgaaaccttcaacaagcacttaaaaaccattgtcctcagctccctgaactcatcgtcggaaagagtcctaaaaacacaataaatttttaacattttaaaagcgaaaattcaggaatacattcttgcaaaaaaacgcaccgtacgtggtgaaaaacctccctcaatacacacatgcatgcaacccactgagtacaaaaaaaatttattttttttggaccccgaaaatagttaacctattcataatttattgggtggcccaccgtttattggcgcaaaaaatgcatcgaaaatgatgtaaaatggaaaatttaaccgacaattttaccccccccccccccttccattaaaaccataaatccattgatcggaattccgacaaatctctgacacagaccaaaaaccaacccaaggaattcgcgttgtttcggcttgtaaaagctccaatgattggcttgcatgatcgagtaaatattatgtaaaaagctatgttttaaaattaaacattttttattcggtgaaaacataaagaaagaaatttgctcaaaaatttttagtgttttgtcataacaattagtgcgaaatcgaaatttgaattttcgagttttggttcgaattcgggtcctggttcgaaattggtcgaaatggatgtcatattcgtgctcacaatcagagcgcataatgggagggggatccttacaattcccaaagtttaacattccgggtatcacaaactaatgcagtggtcgaatcttttctgatttgtcaaaaatattctgattttgtggtatagtgacaacaaaaacttgtcaatcagaaaccggcggaattccgacccatacctaacaaacacatccacgacctactcaagaaatttgcgctgtttcggcttgtaaaagctccaccgattggctgcgggccttaagtcgtcgctggccgttgacggaacctccgccggttgcccctgctcttgctcttgttgttgttgtggcgctgtagtactactaatagcatttgtggtgctgctgctgctgtctctgggttgcctttgaagaagaattgcctctcggttgcccataattttccggcaaaaaaatggcttgaattttataaaaaatttggcaatagttgcttatctgcgaaaattatccggcgcggcggccggcgcctatcgatggtagcactgctggatttgactagttttttatggttgtagtttatgcgtccaaccaatgactttgctgttttttgggccataacttttttttaaaggtaaaagcttaacattttttgtatcaaaactaaagcttaaagtctcggaatttataatttacagtatacctaaatgtaagaagaaaaaaaacatgcgatgcaattatatgaaagttgtgttaattaactaatgcaaatgtcatcaacttctgcttgtgaacagaaatcatttcccgtagaccaaaaggtacgtggaggctggtgaccaaaaaataatttaattctcccaaaatttgtcgaattttgttaattttgcggtaatactggagaattggtgtcccggcgaaaaattaattgaaaatttttctttttctaaaagtcgttaaaatatatttatggaggttttctgtggtcgctgatcacgaatctgacattaattttgaccaattttgaatcccaatacacgaactcgaacaaaagtgaaattcaaaattctcacacacaaaaatcaattttgaattttcgactttttgtccgagttcgggtttgggattcgaaattggtcaaaattaatgtaaattaatgtcagattcgtgatcagcgataccgaaaagcccagaatgcatgttttcatgttttcttagatgaaaatttattttaaacaacaagtatttgatgaaaaatcatagacaaaatcaatgctttttcgaattttgagcccagatccgtaataaatttgggattttttttaatttagaataaaacgacgggaacaaagcgaacccgaacaattgaaacaataaccgttgctgaagagacggacaaaaacgaagaaaaagtggacaactcatttgacaaaaagaaacggaaaagtgcaaaacaaagagtgccgacgaacccgacgaagttggcaccgtcaacagcggaaaacggcacggaagaaaagggaaaacaaaaacgaaatcaaaagcaggggcaggtagagttcgactacgaaatgcgccgggttttgccacctcagaatttggaagtgacagtgaagaatggtgagatggagagagaggatttggcattggcacgactttttagagggatttggcaccagttttaaaatgattttggcaccgctttttcaaagggtttttgcgacaatttttatgacgaattttgcaccgtcttttagcgactcggaaacccttttaaagcatttctggcaccgttttggaaccacttaagacgatttttgcacctttttggggcggtttttgcatttttgagcgattttggcttataattgggggacaatttctcttttaacccgatttctgattttatttaggtgttcgttatctacagccatattggtatgtctttttggatggtaacagcgagaggacgtaaatattaaatttttcttttcaggggccttttttgcggttattccaagcggcgatggattggaaaaacaattgccgaagtgtacgccaccgagttcaacaaccttctccacccgctttacgcggttttcactcaaaattaaaaaaaaaaaacattttttttcagcaagccgcttgccggaagggtcgcatttttgtgaacagtcggccaattttcagtgcgaaccatcgcattcgtgacaacgaatatttcttgcacataaatcacagggtttgtgttgtttttttgtgtttggcgatttttccctttttagcggcctccagtcttttatcctcatttttaaggacggatcttatttttagaaaaaggatgtaaaatgcaaatttttgatggtgtcaaatgaattttaaacgaatttcaaaaatattataccaaaattaaaccctatttagcacgagactgaaattccgcacttgcccatccaaatactggccgaaactgacgacatattggtgctgaacaagccggccggcctgccggtccatccatgttggattttcatattttttaagagggtctttgaaaaaaagatttcgttttcataatttacatgctctgaatttcaagtaaaaaataataccgacaattttcagcaaaattgggagagggtacgaaaaaattatcaaacaaaagcgcgaattctttttagaaaatccgt

SEQ ID NO: 4661 - DNA, 1715 bp, Heterodera glycines
  misc_feature (396)..(396): n is a, c, g, or t
ttttaaaaaaattttttttttgggggggggggggggggggggggggggggggggggggccccgcgagccaaacaaaaaaaaattttcccgattcggaataaaatttttttgaaaattttaggcccccaataggggaacaaaaaaaggaaattcgctttttaaaccaattttaaattaaaaataattcattttgaaccttgctcagtttgttccgctatttcccgtcgaaaatgcgtcggtggtcagctgcaccatcgtcaccggtcggacccccccaatccggatccatctccaattccctggccacccgatcatttgtgatcggttgtacaatgacgagggatggggtccggagaaagggcaaggcggccaatttacggtgaaagaaccccgganacaggtgggtgcactttgggcaatggacaaaatatgtcccccgataattaaaaaaattacgatttaaaacaaaattatgagggtgggggttagtgaatgtccccgaaatctgtaaactctactcgatttcccattttttcgtccgcaacattttcagttggcgcacgacattggcacaaggcattcaaaagacaattggatcattgaacgggacgaagagtacgagcagcgcattcgacagattggagaagacgaagaggttggtaagcggagattggataagcactcgtcccgaaaatttaaaacatttgaatttttatttattttttttttggaattttactccccccccccccctcatccaattgaatttcttgctccctaaaagaaaaacattttccctagtgcgcggtggacgagttcgacctgaaaaatttggacgcctgcctcaaggcaatgccggcctttgacccgctctgctggggctgtgcaatcaaaaagaagcgggaaatgcaggaaaggtgggtggtgtggtactgtgtaatattgggggggggggtgtacagtaggggcagaagggaggctatacgataaatcggtcaaattttaaaaactttggaaaaaactgcaagtgcctggggagggcgtgctgccttttttggtgatttttgagccgccaagcaaatttttttccgattaacgtggtactgtattaatatgggggtatggtaggcgtggatgaggcctgatactgtaaaccggtcaaatttaaattttggaaaaaacgacatcattcctctaactccgaatggaccattctgcttttttgagcggatttttagtcaaacaaattttttttcgccgatttttaaatccacatttttgggttttgtaaatttagcttccacatgccaattttttattgttttttttgtacagagattggctgatggcgctgcattgtcatcgctattccggcgacggatgggcctacgaggcgccgttgcccgactgggccaccaccgaaattgaagctgacagtgatccgcaacagggggaggaggaggaaaatgccatgaatggcgacggcacggacaatcaacaaaagcagaggaggagcagcagtacaacaacaacaccagcaacgacaaaaacgacggcgggggaagaaacggtgccgaaaagtgtggcaccaccgacggcgatgacagaggaggaggatgaagaattggtgccgaagaatgcgcaaaatgctctatgatgacaatgacaaacgggcatttttttttttttgttgttttgtttgtctgtttttgttg

SEQ ID NO: 4662 - DNA, 4460 bp, Heterodera glycines
aaaattctctcttcgacttgtttcgttttcgaaaataatttttgtcatttttgtgcatccctggtaggggttttaatataagaagtcccattagattcatcttggcaatgaaaaaacgaagaaaagtatcagcaaaatcgcctgcggccatatgagattgatgcaacccgaggcattgctgagcgtccacgattgaaaaaatacataaaaaatgatgcagcaattaagcaaatgatcattgcatacgatatcaaagagaatcgcaatgacgctgatgtgctttcccacttgtacgcattacaatatcgtttagggatgaagggttttgaagcgtgggattagaattttaacgatgaaaataaaagaattgttgttgataaaaattttgtcactttggctgggcgccgcaagtgtcggcgccgcaaaaaaaatagccgcaaatgtcgggccgcaagtgtcagcgccgcaaaagtcggcgccgcaaatgtcgcatcaccgaaaacatcttggaacttttcatcccaattaaaccctaaccaatcaatccaaaattagggtaattcataaaaaaacaattgggtttcgctccgacccttttagcatccatccatttggcaattcgatcgctttgcaattttcaagccgatcaaaccgattgtcagtggcaccagcagctaattgattaattaataaatttgtcgattttgaccggaaccaaatgattttatgttgttctcgcttcacccttttgcacccacttttgtgccctttcccgcttttgctcatccccacaatcattgtccgactgcttacaaaataatgagttgctgctgatcaatacgacaaatgaaccaggaattgagcgaccttaggacggaacactcacggagagaaaaataatcggcgaattaaacacagagagtggataaatcagtaacaggagcaaaatcattttagaatcatcgattatttaagccgtgtcgagcgacgagaccgagcagtacagatagacatgggtgctgcttctgatttgtttggtacgcaaaatcgttttcacctgcgagaggccatccgttgtttttcagcagccgcaaaaacaaatgggatcgcaactgctggccatatttgaagtccgcaaaaaatgatttttttggcaatttaagtcctaccgatcggagactattccgagtcaccatgacttatcgctttaattcacgacgcaatgacaagcggtcaatttgaagcatttcatgagcaaatgcacgagttattattcgccattttgagccgggctcgcagtgccagtgaaaatgcgacgagggcacaccgcgagacgaagtcgggccaactctttgagcagtttggctagtggtttatgatgatggccgacggggagaaatgccaaaacgaactgcggagaagagcagaaacattgctgtgggaaaaagatgaataagggaacagttgagaaatgcattggcagagttggaggtgtacatcaggacggagccacgacggacggcgtggaacgatggacggcaaaaatggtgaggagcagtagcgcggaacaaatcgaccttaaacctttcttctttaatgagttttcgggtcaaaaaatatccgattctgatcatatcagcagattaggagaatgcaatggcatttgctttagtgtcccaatttttttgcgagtaattaaccattattaaattattaacccaccaaaatgccaaaaaaggtgcccactgaattggtttttgaaattgctaattttgtgcagtgccatcggaaatggacacactttcgtgtgtccagaaaaattgactacccaatggttaaaaggatgaaaaactggctaaaaaccctcaaaattgcggttgtaaattcaaaattaattttaaattaaacaataattaattgttccaatgcctttagattgtccaattccgcgcagcatttgaagaactgtgccacaacgtggtcaaatattcacaaaagaatcagcgcaacttgttccagcggatctacaaaggcaagacaatgttttaataaaaactttaaattaatttagttttaaaattaagagtttttcaaactgtcgctgattggtcgaatgccgaatgtccgtgccattgagagtcttggtctgagcccgggggacgccaactatgtgggttttagctgttaaatcataattggttcacagtctcaattcacgggttctgttggtctcgacttttgggggtatacgttttgcccttctcggggtcttcggtcattcacagtctcaatcaaattttgaattcttggggcccggaaattggggatctacttttgatgatcccgacttttggtgacccgacacattattctccgtctaattctcgatggcattctttttgcccttgtcggggtcttggccttttggctacccgacttttaggcatgtgaaaattgggggcccgaaacatgggactatacttttgaagatcccgacttttagtgacccgacttttgggtacccgacatatatgctccgtctaaattcttggtgtccttccttttcccttctcgggatcattggcctttccaagtctcgatcaaatttttaattctgaatacaaaatcatcgttttgccatttcagatcactcagttgaaggcggcttgtcagggtgttgtggacgcgtgctgtgaatcgaactcggcgagtgcggaggcctttgcttttctcactaaccgtatgtttgggagagagtactgtacttttgaataaaatctaccgtttttagacgtcatgacactgaacagtatggttttgggtggaatgccggaatagaactggtcaacaactctgctggattcaaacaacctgcaggacaaaacccattgaaaatttaatcaaaaaacaaattttcgaacgtccatatcttttttctactcatgaatcggttagcatttgcttataaaaagcttctcataagatctttcgatttataccaagattttccaatttggttgtcaaaacctttcagaagctcattttctgaatggtgtgttaagtgaaatttcataccatttagcacaaatttaatgggttttggttaaaaaatttataaagtgtatggcatagtgtttaatttttaaaaatttatttcagtgacgaaacacaaaaaagaattatcactcacttttgccgtttcatttcgtatttaatcaatcctttttcattggcacattcggacttattccttcacttttgtatttaaaatcatttgcatttaaattgagccccgtcactttttgtcaaatattttaaaattttaatgttgacaagtaaacagtttaatcctttcattcatttgctactttcacattacttacaaatttaataaaaggatgtgagaagttcaaaatagcaactctaaaatgcccgagaccttataaaatcctgataagtgtaattaaaaaatggatggctagaatccctaccggaaaccccaatcaaaaatacgttcctaagaatcgaattcaaatatttccagggaatctcggcttgagaattcattgaaatattctaatttttcaaaaattacatatcttaatgttagaaaatgttaggaaaaaatgcaaattcaaattataacaccaaatttacccgaaatgaaacattattaaatcatttgtgaatagcgaataaacaataagtattcaaataaaaaatgatgaaagtaaaacaaaattacaattcgcattgatgaaaatggaggaatcaaatggtcaaattatgatggtaattaaagacatttaaaaattcaattagcaaaacattttttagcacagggaatttgttgataaaacacattgatgatgattataaactattcgagaaatgattaagtaaaaaatgcacgagaaatgttcaaaaacaaacaaacatttaaaatctgatcaaaaattaaattactaaagctgatcagatcaacaatgggaactgatctaaggagaccaaaaaattgaaaaaagcatctcattaatataaatgctttgttttttcagatcagttcccaagtgatcgacattggacttttttaaaaagaataattgattgaaatttttgatcagaaaatttaaaatgtgtgaaattggaagatgagaatgagagaatgtgttggagcatcgactaattagttaattaattaatcaattagctgctggtgccgctgacaatcggttttatcggcctggacacttgcaaagcgactgaattgccactggaacgatggaagtgacggcggaatgctgaaaagggcggaaatgaaagaataaataattttaaataaaatatttatataaaactcatattttttttaaggggggggggggggggggcccccccccgcccccccccccccccctccccctcaaaaagggggcccgcccgggggggggggggggggg

SEQ ID NO: 4663 - DNA, 1856 bp, Heterodera glycines
  misc_feature (1806)..(1806): n is a, c, g, or t
  misc_feature (1846)..(1847): n is a, c, g, or t
ggtgtaaaagaggtggggggggagaggcttcgcagcgaggggttcgcaaattttggaaattttcttaacaaattcattaaaaaccccaaaaattttccccggcggcgtctatcggcaccgcctgaccccaaaaatcccaatttttctttataaattggctcaaaatcgcaaaaattggccatttcggcggctgaccccccttcgcaaaaaatttttccgacccaccccccttttttatgtatgataaaagttaaaaataatttttatttaaatattttttaatttaaaattaataaaaattatttttttaaatttatttttaattattatattccttaataaaaaaactaattttgatgttcacctgcgtgctgacttcgtgtccgttcactgccataattcggtcaccgatcgccaacttttctgctgccgaactgcccggttgaagcgaagtgatctgaacgagaaagttgagcaaaacttgggaccatattaagaactaattaaggcgaagagagagaaatggcgagacattttttgtgcccaataattaaatgttaattaggcacagaaattctgatgcattattgcagattcttatttattatgatactcgtgacaaaaaattacgagactcgagaccgagaaatgacttaaaaatttcggtagctttattttatgattcatagtgtgactaattaggtgaagaattaattccctaacattttcatagactcaattcctggaccttcaattagggactgtttaggaagaagtgttgttccaagatgattttcaacgccttaccaaaatgcccctcggccttttgccgatgcccatgccccattgttggccctcgtccttcttcagcagaatcagcacactttcgcagcccatctccttcaggtcggacctaacaaaaatattcttacaaattagggtcacagatttaatctgattttatgatcagtttaaaataatcaaacggccaattcctgcgaataaatatgccaataaggttttaaaatgaattataattattgggcaaaatacattttacctaaatgccaaatttaaatttatcattatgataaggcggaccaaatctgtttcggtaataaattgaatcattatccaaatttatgatcaagaatgatcagcagagaccaacattgatctgttttttcgatatattttgtttcggtaccaatagatcgaatattttcgggtttgatttttttgtcgaaatgcgtcgatcaaaccactttggtcggtctttaatggcattagcatatatgcccacctcagcacggtgcccatcactgccgcggacgccaccgtagcggagcctccgccgctggcggatgagcccccggcggccccactgccggcggacgaacggccgctgctgccgccggcgccgctgccggcgaaaccgctgatgcttgtgctgccgcacgcggaggacgaagcggcactgctggcggtcggcaggtgcccaccgcccgcgagaggacgccgctgggaggaggcgccagtctcttcggaagccgacgtttcggcgatggatttctgcaaaattaaacatttaaatatatttttaaaaggctaaaaatttatttaaaaaaaacaatttttttaaatttataaaatgaaaaaaaactggtaaaaatgatttcttacacattaaatgcaaaggcacgaatttgttaaagtatttcgaaaatgaaacttttttaataaacttttattgtttgctttaatttttgtttttataataaaaaagattaataaattataggaganaaattttggggtaattaataaagttggttttattatattnnaataaatta

SEQ ID NO: 4664 - DNA, 1945 bp, Heterodera glycines
aaaaaaaaccaatttgattatccgctgatcaacagtgattactcatcacatcaaccggggaaagtggtgggatgggatggaatgtgacggcaaaagcggcggatcggacggacggacatttgacgattaacaatatttatgtaaattaggttagtaaatgaaattgtgtgaacagcaaaaaagtggttgaaaaataatcgtaaaaatgggagccgggacaattgagtacggactgacttagtggagccaaatgaaaaagtatcggtcggatttctcaaatctcggcaaaacattttgtgccgatcatctgctgctgttttcggcattaaaaagatcaaatggaatgaatgcaatgaatgtttgtgccaatgtgttgtgccattgcttctgctgtgcagcttttcttgcctctttttttaaatttttttaacaaatttccgccaaattttttctcgacaccgagacccgaagcccaacaaacccgagactttaattgattcgagatttttttcagacttttaaaataaaaaatcgaatgctcaagttaaattgtttttgaggaaatttaacagattttttcaaacattgaaattataatgaaatttctggcccggttaaatttgaactcaaaaaacccctcaaaataagcatttaaatgagaaaatagtttcttaaaattgtcaaatataatttaaatatttatttatagattggtggaacagtaaattattaattaaaataatttattgggactgaaaatgtgccaccctcggccatttcgagaagaaaagtttacggttcacaagaaaaaattgttattttttaaaatttgaattgattgaattgaccaaatcttctcaatttcaaccggcctcagcctattttgttggcattcttcagcattttcattccttggatgaatcaattaaatttaaattcaaaatttagcaaaaaaaaaaaataaataaaatgaaaatgatttgtgccaatgtgttgtgccattgcttctgatgtgcagcttttcttgccttgggtgaaagtctcggattttctcagccctcgtaaacataaatgaatgatgcaatagcaatgtatgttttgtgccaatttgtggtgccgttgcttctgcttctgctgcgcagcttttctcgccatttctgatcagtgagtgatcagtgccgccgaatgagaccattggctcggcaggggatttgagagggatgcgattttgacgctaattaatggaattggtcataataattttcttattcaaaatatttaaaaaattgtttttatcaattttcataactagggtggggatttttaggggcgaaaaattccaatttagggacctaaataggggcaaaaaattcgcgaaataggggcgaaaatagggggaaaaaagtttcaaatgtagaggtgaaatttattaaaattgccgttttctctatgtaataagttaaaattaaggcaaacaattttattcactgattgcagttagaaatgaagtacattccgaaattttcggggtttaagggtcgattcttaggggtgtatttttccaaaattttttgggtcgattcttaggggtgtatttttccaaaattttttgggtcgattcttaggggtgtatttttccaaaattttttgggtcgattcttaggggtgtatttttccaaaattttttgggtcgattcttaggggtgtatttttccaaaattttttgggtcgattcttaggggtgtatttttccaaaattttttgggtcgattcttaggggtgtatttttccaaaattttttggatcgatttttaggggtgtatttttcttttttattgcattcttgttaataaatttcctaaaaatcgcgaaataagggcgagaataggggcgaaacgccaaaatagggacaaaaacttattttaggggcgaacactcaaaatag

SEQ ID NO: 4665 - DNA, 4582 bp, Heterodera glycines
  misc_feature (46)..(46): n is a, c, g, or t
ttcataacatattttaaatttcatccacaactaaacccaggggccncaatggccctgtgaaagcgccggggccgctacaaagcatgggattttttttttgagctcttttctcaagttaattaactaactatttggtacaaatggatgaaaatattaatgccgacaaaaaaatgccggagaaaatttgaaatttttattgaaattttgagtacaaatttttgatttgaatatttttatggaaatggatccggcggtgccaaaaatgatcggctgctgatggtcgggcttggctgacttttgcgctgcgaaacttatgccaccgaacaaaatcggcacttacgccgcgcgatatttataccggactgcaaaaactggcatttgcgcaactcattaagaaacaaaacaataatctaattaatccaacaccaaaatattaaattagaattgattaattaaatctaatcgtttaggcaattgccaaaaaaggcatgattaagttgaatatgtttttttttttgtttataattattcattaactgttaacattctcttgttttctcgaattcttaacttattcagactttatgctttcgagtgataccaaaaaaataggccaataacaacccgtacaaaagtcgactcatatttttcaaaataaagcctcccaagcaagcctaagcctagaatggcgcggcacaaaattctcatcatacaaaatatgttctgttaatagattttcgccgaaatcctccctcattaaaagtctcgggttagcaatgttcgagagtctcggcgcttcgagtcgttgagagagaaaagtctcggattttttcaaatctcggcaaaacattttgtgccgaccatctgctgctgttttcggcattaaaatgatcaaattcaatgacattttgtagtgccctttatttctatttctgctgcgcagcttttttcgccacttctgatcagtagtgatcacgcatattcaattgcaagcttggcatactgtaaaaaaataatttttgcccaagaaatgaaaatacagaagaataccaaagactgacaatgaaatgagaccggtaaaaaaaaattaataatttcaacaaaaaatttcaaattttctacggcaccatctgttggcactgccgtcttcatcttttataccaaaaaataaaaattgattgaattgactaaatcttcatcatttttttttgttctttgccatctcatatcatatgcgattacaaaggttcttattgcctgatcatttccaagcatttttaatgcatccctctcaaatctcctgccgagccaatggtctcattcggcggcactgatcactcactgatcagaaatggcgagaaaagctgcgcagcagaagcagaagcaacggcaccacaaattggcacaaaacatacattgcaaatcgaatgattgaaagcggccccggcgctttcacagagccccttggggccctggttttttcaaaaaattaaaaaaatgcatatgttgttaatgcaaaaaattttcttggagtaaaaaattctaagaaatttgtaaacattttgaactgttcctttgcaaagtttggtgagcttctgatcaattaattaaatgagttgtggatgatcaaattttggtaattaattaattaattaattttgaacttaactctttctattatttataaaatcgcaccagatttatttacacgttattaaggcactctaatgcacatatattaaaatggctcatgaattttattttagaaaatttttatgaaatttttaattatgcctatttttaggcttaattttacaagttttatcgaacttatccctttctataattcataaaatcgcaccaaaatgtacacgttaataaggcacaaaaaattttcataattctgagtttttcattattttaaatttttacgcagcagaagtagaagcaacggcagcacaaattggcacaaaacatacattgctattgcatcattcatttatgtttacgagggttgcgaaaatccgaaactttcgcgcttaaagactcggcgccgagattctcgaacattgcgaacccgagactttcttggttcaatgacggacattccacagcagcaggacattactttccaccacctgcaccaccacccaattttgctccaaactcagtcagcccgtactcaattgtcccggctcccagttttacgattatttttcaaccacttttttgctgttcacacaatttcatttactaacctaatttacataattatgtttatgttttgttaatcgtcaaatgtccgtccgtccgatccgccgcttttgccgtcacattccatcccatcccaccactttcccagttgatgtgatgagtaatcactgttgatcagcggataatcaaatagtttttttttattttctgctgggggttgggccaattcattgtggttggctctgattggctgctgcttttccagaggcaaagctccgccccttgccaatgttagccgaacaaccgcagaattcattcattcaatcatttgttttcaaatgaaataaattttctaataaaatatttttaataataaaaataaattagggataagaattaagttagttctctgatagagccaagttcctaaggacactaaatgggattagtcggtcattagagggaagttacaatttaattagcacgactccgggtcggtcaagtctgctaattgagctccattagtactggcctgaacacaaaaacattaattagggaggataaaattgtcagcttaaggcaattagccctgtggcttaatgatccttaactggggaaccaagtgcaattagcctaacacctgtgggtaataaaaacgattagttgaatagcgggtgaaaatgagtgtgttgtacgtacgatctcaatgccaaacctcgggccaattagcttacactgatggcaatgactaattaagacattaaattagccccgtggcttaatgcctcttaactggggaacaagtacaattagcttaacacctgagggtaataaaaacgattagcttaattaattagtgtatgctttggacgatatcattgccaagctttttacacttatggctaattgagacttttgttgcctttcagaatgttcggcataatgtgccgtccggttctcttcatggtctgtgcctgtttcgtattgttttttgtgcacatcacccaacctgaactgttcatgcccaaccatgccccaaccgatgaaaacgaaattccaaacatcggaaaagctgaaccggatgcaattggccgctttggacatgagcacccgcgcaactcggacacggaaacggaaaagcccgcgcacggattcgatatcggtcccgaattttcacccgttttggcatttgaataactaattttttggaaaatgaaaatgaaaaggccaaggacaggattaagacgtggaaaaaatcatgaaaaaatagttaatcggcttaatatccttgttcaaggacgtcaaaaagcaaggacaggagaaaagactttggaaaaccctgactaaatagttaatcagcttcatgtccttattcaaggacgccgaaataaatggctaattacagggacgtaatgagtgtgactctttagaagggcataattaattattcaatgaaattacctaatgtaagctgttaacggaattaattggaatccatggaaaattaattgattgattgactaattgattctgatcaattgattgtcatgcactgatttgaaatgtctcattgatatttagttgaccaattgtccatgattggtgcactgttctttggacaagtgctcatcgcgattttggtcaatcccccacccggcaaaactggtgccgaatttttttttttggaaaatccaattatttatttatttttttgagacatccgattcttccgctcgctgatcattgttttggttagcattgttgtttcggtggaagcgccgagctttggagcaggtgtgtacacaaaaattacaccataaataacaatgatgtgtggtgaagtcagataaatgtgccgaaatacacataattagctgttatcgattaagcattaaatttaaattaaaaaataattatttttcgtttattttaaaaatgaaaagagattgctaaaaatggtgaataggcgattaagaattttcaaagaaaaactttatgaaaatatttaaaatttcaaattatgaattaaaattcaaaaaaaaaatcttgaaatttatattttttcttaaatgttttttaactttttttaaaaatatatctgattttttgagagatgtaaatttgatgggtttaagcgtacataccatgaacatagcttttaaattttttaaacataataatttgaaaacatggaaccaagggcgtagccaggggggccgagggggggtttaaacccgctgaacactaagcgctcctcgtacattgttcaagcttttgagaaaatattccgccgggttggctatgtgtcatgaaagatgatgacggaccagggcaaagagttcaccgccgccccagagcaacgcttttt

SEQ ID NO: 4666 - DNA, 1160 bp, Heterodera glycines
aattttttttttgaaatttttgcaaggggcagggggcgaaagggggggaggggatggtggagggatcaaaacaaataaaaaatgtgttcattctcgactgaagaagcatttattacatgccaattattcgtaattagccgccgcccgtaagtgcattttccatggctatccaatcaaatttgttctgtgtaattagccaacccccggagcaagtgaaacaaattgacggttgtaaagcgtctgcaaatcagctttgcaagtgtggctggttcgcatgcgtcaaaaaggagggctctcccgccaccccatgctgcgccgaacacttcgagttttcgtgctgcacggaagcaagattttctggcacttaaacctccgatttactaaaatttaaaaatgagattagtcaacaattatgcaaaaattggcatttttgccttatgtcagtcagtggtcctttgaattttatcaaaaaaataatggatgggtgtgctgagctttgattccttccaatgaatttaataatattaacgaaaataataaatttgaaaaagaaaaacggatggcccagtaaaaggacaaggttaacccctcgggggccgcccgtctattaaattaaattggccaatttttattgccctttttaaggtgaaacctccaccgccggtatgcacacacatttatttgttggttttggaaagcaacgaatttgatgaacgaaagactcaacttttagacaattcattaaataatattttgctaattggtcccccgtttaaaaattaagcctcaaatcgaacatgaattggaatgcaaagcagcgcgggagacttgcaaatgcgggtgggccgaatgcattccgaaagcgggcgaaccatcgactccatgctgtgcggagcattaccgctttgcgtgctgcgagaaggcaagcaacccgtacttcttgattatttttggcttaaccaggcttttgtactacggccccggcggggagggggggggggcgccctgggccacaaattctcacaaaagagcaaaaaaatcaatttaaatttcttaaaataatttgaatggctaacttgtgtaaaaaaaaatagttcgcaccacgcccctcacgctctccggagcccgcacgaacccaaatattccggcagtggccgggc

SEQ ID NO: 4667 - DNA, 907 bp, Heterodera glycines
tcagttagccaagcgcgcaggccagggggtggctctatcattaaaataaaaaataccatcatgtagaggacagttgtggggagtgccctcacagcgagcactttttgattcgagttttagaaaaaaagttacgggccctaaactgcaagaaaaagtgacaaatcacttcccgggactcagtcgtccgcgctgaatttttctctatagttttcccggattctcctcaaaaagttgtaagacccttccactactttcagggcgctcccggccttcggccgggagaaaatggttttagcaacgaaactccttgtcaatataacatatatagtaactagcgggtgtgtgcttacatgtttcttgggtgcttaaagcgcttcgcgctttccgagcttcgctacctaggaactgtgactaaaagaggcacaaaagtgattaaaagaggtacaaaagtgataaggggatgggaccatccccttaagagtgtttaaggggatgtgatccatccccataagagtgtttaaggggatgggagccatccccataagagtgtttaagtggatgggaccatccccataagagtgtttaaggggatgggaccatccccataagagtgtttaaggggatgggagccatccccataagagtgtttacggggatgggagccatccctataagagtgtttaagggaatgggaccatccccataagagtgtttaaggggatgggagccatccccataagagtgtttaaaggggatgggggccatccccataagagtgtttaaggggatgggaccatccccataagagtgtttaagggggatgggaccatccccataagagtgtttaaggggatgggaccatccccataagagtgtttaagggggatgggagccatccccataagag

SEQ ID NO: 4668 - DNA, 3368 bp, Heterodera glycines
accatccccataagagtgtctaaggggatgggatccgtccccataagagtgtttaaggggatgggaccatccccataacagtgtttaaggggatgtgatccatccccataagagtgtttaaggggatgggatccatccccataagagtgtttaaggggatgtgatccatccccataagagtgtttaaggggatgtgatccatccccataagagtctttagggggatggaatctatccacctaagtatgtttaaggggatgggatcgttagggtctttgcgtcagccgacatgcacttggtttcaccttgacacattgcattttcaatgcaatggaaaccggaagtgccctaactcgcacgtcatggcccacctgcctccctcagtccagctggcagcacttttttgaatatgtgtccgttttaagtgcagatgagaacgggatgacatcttaaagtgcgcactcgctggacttaactcgtttgctttattgcaaattgagcattttcgttgcaacaatattcagcactttgactctgtcttgtgcatcggtctcccttctgggagcgtacactcggacgttgttccagtccgttgcccttgaaaaggcagtgtacaattgaccatgagaaaacacgtccctttcaaggtcaattccgaccgtgctgattgtttgaccttgacctttgagaatggtcatggcgaaggcaggtttgatgggaaactgcaaacgctcatattttaagccgccaggcgttttgtcctcgtagacattgcgtgttctttcgatgaagaacttaacttggccaccaacagcgttgctgttaatgacgcgaccgaccagacgatcgtcgccaagttcttcaagaacgatgcgagtgccgttgatcagtccttccttatcgcttttgttaataaggaggacaacgacgcttccgacctttagtcgcagacggtggggaggcatcccagagtctgtgcgtcggttcaacgctgccacttctaactcgatttcatcgatgtccagtggccgctcgtcaagcggtttgtccgaggacaaatattcgcgcacttgaccaggcacgttcgccatcataatttcgttgatctcatcgcacgtgtcaatgtgaggtgcgaggatcagacgattgagcagttccttgtcatttccaaggagtctttggaagtcgggatagacaaagtctatcaactcttccctgctctttacgaggaactgcggaggaatccagaagtgttctccggtctctccgaggccgatttggcggcacatttgcaagtacgcttgctgcccttggcccaacctctggtttattgtcaatttcatagtcgtgaattgacaaaacagtggagaggtttgaaaacaggccgtaatttgtgcagttaggccttcgtgaggcacaaccggtagtgactgtttaaagtcaccgctgaatatgaccgtttttcctccgaagaggaggtccttgtgctggggaattgccatttctttgcacactcggtcgatgacctctatcaccgtgttgtgaagcatggtgatctcatcaatgatgatgagctgggcctcacgtatccgtcgagcaaagaagctttcaagcggaatgcttggaagcttgtctagcgagacttctctgccgagacggaacgtggaatgggctgttttcccatatggcagcaagatagccgcacacccagtggatgccgtagccagcactttataggtgtatgggggctttcgcaagcgtttgataatttgaccaaacaggaatgtttttcctgtacctccatcgccgaaaatgaagaaacggcgcggcacagtctggtccttcgggtccgactgtattgccctcacaacagcatcaaagaccttttgctggtcgttattgaggggaggtggggtgttttgttgtggcctttgatttggctggccaggcggcatattcagaccatcatcaccaaagaaaaattcttcaactgccaaattggtatttttagcttttgaatttggtggatctggcaggccacagtgcacacagcttaagttaaagtagtgcaaccgccaatcaatgtcggctaaggcttgcagctcgcgtgcttggcgtatagccgcactggtgatgccctgtgggttgtacatttggtctttatacttgtcccacagttctatggcattgctcggctgcccaaagacaaggatgctcacgaagagccatctcatctggtccggccagcgatgcaaggctgcctcgccgagcgttttgtgccaaatttggtcatcttcaagaagcccatgctgtagagcggcctctgtaaaggtgttgtactgctgtccattgaccagtttcaagtggtccggatcaccgggaaagtgacgcatcaacgcataaagtgcaaatctttcccggtccgttggagggacaggtacaacacgaccgattgggggcctcttggcaggcttccttttatacggaagccatcggtcttttgcccatcgaaattgctctgggactttttcaaaaagcatgtccttgagcgatggaacatgctgccattcgttttgccattgcttccaataggcagagcatggcgtctctgggagctcgcctcgctgaatttcctcagctttgctcacctgttggaatgccctgtatacaacgggctgctggtttggcaaatgaatggacaaatgaacaacctggtgcgagagttttgcaaatggcattgaatgcacaactgcaaaagcttccgtagcaccacggaagttcattttggcatattgagccggctcatcgataccgattttgctgccggactcctctttgcactcgacataacaatgtccaggccctttgaaagggtatttgagtgcatatttgatgttcgctttgttaccgtatgcgaataacacgttgtggtgtactcggtaacgcagcaaaatgtatgggttgtacggcacgacttgcgagttgtcgtatattaagccgttcacctcaatttgggcaccaccgtcggttgggctaggccggtaatacaatgcgggcctgtccgggtgtagtatcgtacatttcgagtacggggctgggaagccctttttacaccgcccaaagttggggtcacgtggaccacaccaactatcactgcatctgtgcagttgcatatgcattagttcgcggacttcgcgatgcatttgcgctatgggtgagtcatcgtctttgcacggcaaagatggaatatgagcccatatgtattcctggatgacttctggaactgcgtccaggtcagtctgggctacaatgtgtgcgtgtgggccaccacgcccctggaactccatggactctcctgagccaaggat

SEQ ID NO: 4669 - DNA, 2596 bp, Heterodera glycines
ctgatcgccttggaggcgtcttaggtctgacaaatattgtttcgtcagcctgcgcaattggctcttgcggtgcgcaagactccgacaccaaaccaagcgtgtcaacttggttttcaccagccacttgggcctgggtgagaacagtattaactgcttgtccactcgtctgtggttcgataatcattatgtcatcatgctcatcgattttcattggctcagcggccttggatgtcgactgcacctcatccgcatgtcgatagacaattgggcaaggagttggtaccccttccctcggatgatatggcacattgtctgtgccataaagctcgttaatgtgccacaatatgcgccgcttttcataattgatggacaaatctggcagaacaaacgtgcgattgttcatgagccatgattcagcatacaggcacacgaagtacccgcaactatttccatcgtgttgaaccgtcagatttacggcattaaaaatcccggttaaaactgttgacggcaaaatgtcagaaataatctttctaattttatccgtcagttgcggatccaacctgccatatggggtaggcaaagaatcggcaaaatgagtgccaaattgcacatcatggataattagagtccagtgtccagggaaatgtactggcaaaagtatgacttctgccggaacattagggtcatacccaaatgtcatttttttatattgcatgacccggtctatgcccatttgccacacaactggatcaacaacgaccacttttcgttgtgatatacttgccaagtatgccaaatactcgacaacaaaggcatcattgagaaactgtgtcagatcattccaacaggtctcaatgaatcttgggccagatcgtgggccttgtgatgtttcgccatcacgctcgtaaaggccaacatcggcccatctccggattttgcaggccatatttcgcgatgtggcgaaattaattgccactgtgctgaaatttatcttttcaggcacatttggcaaaagggccaccgatgtggtagcttcagagctcagatccattgacgagctctcgctcatggaatcattagctttgctcctgcctgagcctgcatggccgcctctttttttggatggtcgccctccacggttcatttgcgtggaaaccggcgtcaaagcaattgcctcaagagcagacatgggtcgatcaaaattgtcgatcttcccttttttattgcgaggcgatgactcatcattttgagtggccgatgtgctttgtatatcagcagatgaagcactgtgttgcgatgccatgaatggctccgctccggttttcggatgtatactccgtcttttacttccaatggaagagaccggggtgcttaattgcaaagcaccaatattgggcgtggtgttgcccgggtgtgatgccaccccattctcatctgcacttccgtctgggacgggtgagcgatctgggctaacagatagctccatctgccctcggtaccgctcttgtttcttcttcctttgatttttttgttttgaaggcatctgaaaacaaaaatgaatcaatgatgtgtacatgcggcaaagtatttagggaaagcaaccgttaaaccacatgaaatcaaatatttatcaaaaaaattgaaaatgtgaaaaaggatgcatattccttgaatgccaccatgatgccgctgcgaatccataagccagggctcgcatgtccaattttcgcacagtgtgttgcgaagaaagaaaccggctcacacatcccgttaagaatgcagatgaaaattaagcattgattggcgaattcaatcagcttattacgaaccacaatcccgaaggggcaggtaatcggaccaaaatcctcaaagggcaggtccacattttggttgactccgatatcctacgttacctctcaccagtccactggtcttggtaaagtgcgggaccagcttcgcaccggattttggccggtaacgataaggaattcattgtaaacctttcggaccacaatcacccaacggggcaggcccacgaaccacaatcctcaaggggcaggtccgcatttattttggttagcgggtaatcctacgttacctctcaccagtccactggtcttggcaaagtgcgggaccagcttcgcaccggatgttggccagtaacgaaaaggaaacctttgtaaacctttcggaccacaatcacccgacggggcaggtccttttccgaaccacaatccccgaggggcaggtcctagctgaaccacatccctagagggcaggtccacttttgcaatagggtcttagcgtcggccgacatgcacttggtttctcttcaataagaagttgacacactgcaatgcattgcagtggaaaccggaagtgccctaagatgcacatcattttagaataatagtttgttcagcgtaaggcaaatttgcaaaacacatctcaaagaagtggtgcaaaccacaacgcccttgaggggcatgtccttggtaagaaccacaatcccacggaggggcaggtccttgaaacgaccacaatcccccggaggggaaggtccttggccggtgaaccacaataccccggaggggca

SEQ ID NO: 4670 - DNA, 1613 bp, Heterodera glycines
gacaggcgaccgtgccaactgtggcaacagactttgcaacagctgacgcccattatgtccagccatcacagagcaaagtccgtccagtataaacggctcgccaggtttgttgtaagtgtccagcatttggggccacatatttgactcgaccgcgagatagctggtctgaagtgatttgacaattgtgaaacagccatacatgctttgtttgatttgaaaaaaatatatgtacggcatagtggtaagcggcaaacgcttgccccgccgcgacgcgtacggaactgtcggagtcggacagacaaatgcgaatggagccgatgaaggaggaggcgtggttctccacgatttccctgaaacgaacgcattaactgacaacgaacgaaatgggaaaatggaaattgtcaaattgcgaattcagtcattgtcagcggtggacatttccgatgatttcgatcagtgcgagtgcaacaccacgccggtcgttgacgccgccttgtctcagcctgtcttccagcaaaggcaaaacaatttccagaattcgctcgcccattttcttgacaagttcggacaaacatcggacggccatctaacaaaaaatgtgaatgaaaagcatttagaataccaaaattggacacacgcacttgctgacgatcgacgactgcacttgacagacagtgaagcatcagctcaaacattggcttcatcatgtcgcgaagagtgcgcggtgtattggcaacaattacctgtttaatggaaaagtgaaataaattgaaaaatggagagaaaatcaacggagtaatggaagaagtgtaatgaatgattcttttggttttaatgcttttaacatattcaacaaaatgagagaatgattgagtaggtttttctgacaattttgccgtttttatataataaaaatgataaagtgaaaacaatgttggctctgaccttccaaacatgggaagcagcttggcgaacagccagaacaacatcgtaccgggcgaggtaaatccccgccataagttcgtcccgggaacgttgtccaatgctccgcacaatggccttgttcacggcctcggagcccatcgtgtcgtcttctcccgtcgtttctgaggtcattttgccactaacccctgaaaaccaaatttacgaattaaatttccattatcaaaagacctgacacaaagaacagaaaatcgccgagcaatttgaccgatgcttgccgaatccgccagttctcgtggatcagcgcggattggagctgtgggatcagcaactttcgagcgtgcgtggaagaggcggtgatcaaacgtttgcccgcaattaacgccgactcgcggacgtattccgtttcatcagccaaagcctggcaaataacagaaagacagttaaatattgtgctgcaatgaatgaatcaccttcagaatggaaggaatgattttggaaaggaatgggatgaaactgaaaaagtattgaaaagttaatttaggagaagttgaaattggactgaccgatctccgaaagccatgggcaaataaatgtacaattggatgtacccatcgcgaatgtgtggctgagtcgtgggtgactcggtaatgcgaataacgccgggcaaa

SEQ ID NO: 4671 - DNA, 2817 bp, Heterodera glycines
ttatgggcatctgaaaagaaaaataaataaggaaaaaacaatcgactggaaagggaccatcagagccaacgaaggagaatcgacgtaatggacgaatttgttgttcacaattgtctgtagacaagaagttgttttgcccggagggtcgacgagtgcttggattaagtgggaactgatggcgagacattcgggattctgaagagaaacgggggaaggaagcaaatgaatgagtgcaaattgaaatatcaaaatgattccacctggatgactttggcaatttgtttgagtgcgcgttcactcgctttttgcactttgttatgcgtatcggtcaaagtttcgcaaagtttcggaacaatggcgggcaaagaggtggacaattggcgaggggcacagtttgacattgcccctaaaacaaaaacaaaaataaataaataaaagtgcaattaaatggtgcatttacccaacagttcagcagaggcacactttgtcctccacgagtcatcgtccaaccctttgagaagcgacggcaacaaaagtttaacaccgtaggcggaaagaaaacgcctaaatgtttgagtaattggtaaaaaagaaggtgcaaagagtgcgtccgtcacatcatcgctcgtgcggcgtcgtcggcggcccttctgacggcttcgttcgtatcattgaacatattcagcaaatttgggagcaaatggatcaaatagggctcaaacaatttgccaagggtgctgaagcgaaatgtcaaatttggcttttccaatgtttggttttacctgcaaaacatttcaatgcaaagcaacgcgccttcgcggtggagggcattttgcttttgggccaaaagttccttcagacgttcactgacattcatttctttgatggtgacaacgcccagccctttgacaattgccgcaattccataggccgcgccgcgtcgttcgccgtactgttcggcgttggtcaacaatagaaacaaattctccatcaacgctttggcatcggcacgcagagacggcattagcgcaggaagacaggcggcaaccgcttcttggacctaaacaacggcttaattggtcaacaattaacaatttattagcaccggctgagaaggggtggacagcgtttcgatgagtcgtgcgacgattttgcgcacttttgagtcatcgccttgcaaaaactgcgccaatttgccgatgagaacgaccaatccctgtcggagattgtcattctgaaaaggtgctttgaatgttgccaatcgttaactgtcccgtcgtcacccgctcgatttcctccgacggcccttttttcttctcagcgacgcccatttgcgacagttcgttttcgagaataggaaaaagttcgtcgacacaatgcgaaccatgcttaaattggaaaaaaatagaaggcaaagacgacggaattgccttttctatcgcaatggttgccgctgtgcgcataatgtcgcgacacttttccgaacggtcagccaatccttcgctgacaatcaaacggacgagtcgcaccacttcggcagaggagcaaacgcaatcggccagggaagccaagcctaactgaggtgaccaataaacatggaagcacaagaaccccctcgacattcagttttaggaaaaaaagatataaaaaccgcgctaactgtctcaaaccgttcgcaattcccgagcgcacttcccacgggtcacgttcggctcgaatcaaacgtccaacgttgtcgaattcggctggttcgaactgtttcgacgaagaaaattaatcgttttaccaaaatgaaaatacttttttgagttcaatgaatcgctttccaattaaatccaacgcatcgacgcatttttgcgggtatttggtaagcaaagttttcactgatttggctgcttcatccctagtcaaatccaactcgtcatgcaaatcggtaacaattttgtcgaataacccaaacgaagtctcgaaattgaattcatcccataaatttttggcgacttttaggcattcctcgcttgggtcatgaattgccaagaaaaggccatgccgaaaattctccttcaaattaacgtcccttttaaattgcactgcaagtaaactgctgatcagtgacaaaagcttaaatagtaaataaaaaagcagaaatttaatggtaaaaccttcaaaatatataagcgtttaatggcatcggcggttttcattttgaaaaggcaatgatgcaaaaactcgaccaagccgtcagaggagaaagactccttagttgttccgttttcatttagtaatttcatgaaatttgaaagtgaataaaagagttcgtcgacgtaatcgaaggaagcgtccacaaaaagacaatcgacgagaaaatgggccaatttgagcataggcatttcagcagtttcagttgcctttgtgaaaaagaaatgaaatggaaagggaggaacgaattatcactttgagaaatgtgggggagacggcagttttaaggaaattgcaaattttaattcgcagctcaacatcgaagtcattcggacagtgcagaaaaatttgctccaggaaagggaccataaatgccaatttcgcagtcgttacggggtattcctcggccaaagcatctttctgaaaagcattttttggccaatcaaataattccacttgcttcgtctgctgatttttcatccgtttcgtcctccaattcatcgtccgataatggcgaatacaaaaagcaggcggacgaaagcgaatgaaatgtttggttcaactgctcactgagtggcacttcgagcctttgttcgggaataaaatgtgcgcccaaaa

SEQ ID NO: 4672 - DNA, 5296 bp, Heterodera glycines
  misc_feature (2614)..(2614): n is a, c, g, or t
aattaatcttttcaagagcgaagtccattttattcagtgaagtccggtcacagcggtactggtggcacttccaatgtgttggcagttgcggatagtaaccaacaagttagtgctcaacagacaacggcgccagtcgagtcggaagaatagtcaggcccattttgaaaatgattttcccctttttggtttctttcattgcatttttgttctttgaagatacaatatatcattggaattcattaattgtaaattttcaatttggtcttaatattttagcactccattattattgaatatttggaaagttctatataatagtaatacccgattacttttaatatattttttacgcgtcccaacaacattttcatccaaattggtttatttacaaattataaaaatatgaaaagaaatgggttctagtcggttttacgcgtcccatggcattttacgcgtcccatcacatttttgtgtccatgtcagggatggcattccgatgccccaaggaattccgtgccatccctggtctcatggtattatagttgtcctaataactgagaaaaacttttttttgtcaggtattcagtaaagtttttaactaaaaatttcgttgttaaacctaaggttatcatgacaacttatacacaggcaactcgaacaatggcttaaaaagtatacaatcaattcggaaggtataaaatttcgattgacggttcgaaaaaaactgtttttgtgacgcgtaaaaccgactagaaccaagttttttttgttttctaatcatgaaacaagtctcttttgtgatttttcggggtcgttgatcacgaatccggcatccatttcgaacaagggataggtgaccacgatcggagaataacaaaattaacctaatcaataaaattttatcacaagtcaatgataagtttaagacaggacaaataagaactgatcacagcatattatgtataatgacgagcaattatgatcagacaggcacagtaatatgtacaatggcgagcaaatacgatcagaccagggccgggctcatccttgcgtgttgttttttcctcctccgccttctttcgtgttatccttcttcctcctcgctgcctcactctgcgcttgtgccatcgcgttgcgccttcccacttcccagtcgtacgggtgctccggaacacggcttcgggtgaggtgctcacgcagcatcgtctcaatcatctcgtaattgggccggtcttccaactggagtccatcctgcgaaaaatgtaattgttaaaacgcaaaaaaaaaaaccgtaaaaactcacaatatgcgcaagtatctgggtgaattccggcggacaccctccaatgagttctgtgatggcctgttgtcgaatttcgtccggttgcccttccatgcggcgacatttcatccttccgatctgtagatggatttgttaatttaatcatatttccccaagaacccacctccttgacgtcattcgcaaatttccaggggacagcacctttgtagaatttgaccatgacatagaaccacgattcgacgtcatctttgcggctgtagtcacgcttgatatgtgcagagatcggtgcgtaaattggcgtccctcggaaattcgcggaggctcgcggacgtcgctgcgtaccctgtaaaatggggaggttgggcttatttggcaattcatcaagctgtctgcaactcacatcgggccgaagaaattgacgggccatcccgaagtcgataaggtagagaagtcgatgttcgttggtctccgcccgtccaatcgctgtgtttgctggtttgatgtcgcgatgaagaaaaccgacattgtgaagagccttgatggcactcagcaattggattgacatgccgattgcggttcccggactgaagcgatcgcccgcgtctcgaataagtttgtccaacggagtgccaaccacagtcatgctaaaagtggaaaacatgttagaacccgatttgtaatcagagcaaagactcacacaacgtagttgaacaccgtatctccagacgtagcattccgttgttcactacgtccaaggtccaacagacggcagaagtgttgaccatcagcattcttaagttttttgcccagggtgtccaaaacggtggcctaaaacaaaaacaaaaatttttgattaaaacatccattattctacctccataacaagaagcggttgacgtgtgtcgattggctccgttttcagtgctgccactgttcccttgccatctttgcacaaatagacggctccaaatgctccggcgccaagcttctttaggatggtccatcggcctgagacacgcgttcctggtgcaagcgccacaagctcatccgccatgtgtcgctgtcgctctgtggggtaagttggcgctgctgttgaatgaagagaggcgatgttgtaagtgagcgcattgaaaaaactccttcccttttatacactaaatttgaacaaaaaattgtttctgatagaaatgagtgcgtgtagtgagttttcatttatatatttaagaagggcaaccggcatttttttgatcagttttttgaaaaagcgcgaatacatatttaccaaaaattgcaaatttgtaaatgtgaggngttgaaacatagaaaactcgggtcttctaattggagaaatacggtatatattttataaggcccaaaagatgtacacagctcatttatgctttgcttgctttacatacctatacttgttttaaaacttttagcacgaaatttgttaattgtttgataaataattgcacaacgtcaatgcctccattatttcccgaagttgttctcatttaaatttaatagataattttgactgtacatttaatcatttagaaggtagagagcattcgtcacttgtccacaaaatcttgggaggcgacatttacgaaggattatctctccaatgaaggccaactccgttttctttcgcgcatgtgttacctcgcaatggcacattaccttttgtaccgtggagtgctccccaaaggagttttcaaacgccgaaagctcgaaggtttatgttaataattattgcattcaaacgtgaataagctcggcgctacttgcaaagagtactcttgattttatcaaaaagtaaaaacaaaaaggggggacccttttggtttgcaaaattttttaatatatagtcatgaaaattattcactggtgttcttggggtccataacctcgaataggtgtcagattcgtgatcagcgacctctaaaaccccggatatcaaattttcatgttttatcacaaaaaaattttgcaaaacaaaagggtccccccttttgtttttgataaaattcaaaagagggcttctttaaactagcgcaaaaaagtgtatttaaagtaatgatgtaatataaaagaacgaactcacgtagattgtcatctgcgatctcaaaaaaggcattgcgataagagagataaccctggacagcagtttttgacacaaacggagatttgagcagagggacgacgacgtcgaagaagaaagcgatgttgggataagcaagctaaagagaaacaacattaaagattgacggaaatgacagcaattagtgataccttcggctcctttttacacgcaatgaaaagcgatttaattgtctcttcgaatgaatcgtgcaatttcttaagccttgatctaatctcctaaaattgagacattgtcatcaactatcaaaagatcatatttaattttgaacaattttccccaaaatttcgataatttcggcataccctttctattttcaattcctgttcaacagcctttttctgtttttcgctgagaattcccttttctctgttctttttcgcacgttcgttaagtgcctccagggcttcaatctgttctttaaatgttcggtaacttggatctcgtcggacatttttcgtatcataaaattccatatttctgtgaagggatgggttatatatatataaaaacagagaataaaatacctctcaatcacttcctcattgtaaagtttcccgtctggcgtttcaaatattttgatttcatgttcactaatattcagataatcatttacattaattttggccaaattctgaacacatttatcccaaagagatgcagggacagaatttgcttggtttcgtgaagacatttttaaagggttgaaacaaaaccacgggcagctgaaaaaaaagagtaggaaaattctattatgagaaaatgagcactaagacggataaacgctttcaaatcaaacagcaagaaaaaatatggtaatagttcagtttgtcccccccccccttttttcgaattgttttttatgttttcaagtcataaaaacactttttatggggttttcgaagtggctcaaatgatcttttattgaagcaatgttgaatttcagttcgtttccgtgtatttaaacaaagtttgaaccaaaaatgtgaaaatcgaaaatttgaattttcgactttttgttcgaattcgggtccgggattaggaagtggtctaaatgggcgccggattcgtgatcagcgacccgaaaaccccataaagtgtttttatgacttttgaaaacacaaaaaaaatttcgaaaaggggggggggcaaactgaactaattaccccaaatattcgtccgataaccgacagtttcggctctggctggcttttaagcatttgataatttcttaatttttttaatggcattctatcttgcacaaagaacagagtggccaagtgtgcttatttctaagatttgtgcttattttgaggggtcgaatcttagaaagctaaaatgcttatttctgagatttgtgcttatttcagcattacgtgcttattttgtgcttgtttttggatttgaaaaaaatgcactttgaatggctgttttggcttatagtttttattcacggcgattcaattttgggctccaagtacaattaagttggattttttgtcttagtggtctgtgagttagtcatcaaaaagggggtctcacaaaggaggggtcggcaagtgaccgtgaaatttcaaaatgaaacttggtgggtgggtaaatcacccctagtttctattgtgaaattttaaccatttttgccaaatgagcttctatgccgagatatgacgtgctaaagtttttgacattttataattagaaaagatataattatttcctcctcaacaagaagccattggtgtagaggtagtgcgttagtcagatctttttaagtcacatgttcggatccgctacgtgcatatatattttataattttcatttttaa

SEQ ID NO: 4673 - DNA, 4487 bp, Heterodera glycines
aattcggtcatgtaccaaattgttgatcgcgaacctacgtttcaaacaaattgtgctaaattagtgtcggtcggttaaatcggcgatttgctttgaatttggcatttcacttttcccaggaagtactcattgaaccaatcgtcaaagagtctgaagaaggtgcgatttgctggcgtttgttggctctgatcgaagaggaggccgaccttcggcgtctgttgctccgatctctcattttcctgcacaaagataagagtttgccgcctcggctggtccctcgtctgttgagccgctgttccgcaaatcccgagctcacttttccctgttggatgcttttgagtgaactcagcaaatttctcgacgtattccgtggagatagttttttcattgtttgtccattttcatttttcaggtgtctcccaacgaagctgtcagttattggtccgattatctcacgctcactcaccaaaatcgtctgatcggatacatggctgatctgatcgccaaccgagcaaaagttctcagttttcagcagcgccgttttctcagggagagtgttagcggagcattgcagcaattcaagtggactttcctctggtagcgcttctgcacaaatcccgcttttcctgttgaaggatccatcccacttacatttcctctgtgtatcatttgttcgcccgaattgtcaatggaattggccaagacgcatccggaaaagcggaacttaccaagttcaaccagcaatggtttagcaagtgtctggtggagttggacttgttggtctatgccaatgcaccgcccgaggtggacgatgccgaatcggtgaacagtcagggcagcaacagcaccgaactgccgggcagtcaaaggcgagcgagtcaaatgtgacgaacggagtgaaaaatggaatttaagtgacaattgcgagaaaatcattcggctgatcacttccatcggcgagtgccttcagtacacgcccgcactgatcaacaaacaaatagtgaaccttctccaagtgatcatcgcgtcggatgtgctaaatcggatttaccaagcgcacaacgacaatgaacacggcggtgagcacttttaacgcatgttttgttcatttctctcctcgttaagacaaattgggagtcccctccccgcagcgtctcttctctcccaacacttcgttccacacggaactgcccgcggacggccccggcggcactcagtccaacgcggcgagtgaagcaggcggtgtcgctgccagtgaccaaaaccagcgacactttcacatgcgcatcaaaaaacgcattttccgcggagaattgatgagccgagaagttcgcgccagtggggtgctcgccattggcaaactgtgccttttggacgaacagttggccaagaagtgcatccccgtgtttgtgcgacaattgcgagaaaacccggaccattttgtgcgcaacaatatcgtcgttgtcatctgcgacctttgcattcggtgggtattttcccaatttaatactgcataattaacgcattaatcggaatccctctcatcattgtagttacacttccgaagtcgaccggtacagcaccattctcgcctcgtgcctttgggacagttccattctcatacgccgccaaacgttgctgctgctcaccaatctgatcaaagaacagtacctcaaatgggaagggacggttcgtctcgctgtttctttattcggagaattgcattttgattcgatttaggtcatttaccgttttgtgaccactcttttggacccagagcagtgcattgaagaatatgccaatttttgtttggtattttattatttcgttcgttttttatgtttcattttacagacggacattttgttgccccaatttcgtgagcggatgttcttccatcactttttggaatgcatgttcaatttcaacggagttcggcatgtctcttggatccccagcggttgggtgaattcatcggtgcctttctaattcattttgtgccatcattctcagctggctatgaactgagtgaagaggtacaaaagcgttgttccctcgaaggtcgcgaattgttcgactcgcgaatgcgcctttacaaatatatggttttgctccgtgctttatactttacagcaaactgtttcagctgaacactttcgaagaccaacaaaaggtgtacattttggagaagatcggtttggagatatttgtgccgatcgttgagggtcgactgaaactttcggatgtgaaagtgcgcaatttgttatttgatgcttttaaggtgaacagacgcaatttgtctatttgttagccaaagaatcggaattaagattatgggcactgaagagataaagttgaaaatgcaattgggcaaaatggacgcggattacgagggggacgacgacgaaccgcccgaattggttaaggtgaacgagaatttttgaaaaaagaagggggatctgataaagaaagtgacggtttacaccaaggggaatttttgaaaatttaggtttaattgttaagaaagcaaattgaaagaaactttagactgctgctaaaaaattcatcgcgacgacatttcgcaaaagcattgcggagacggtgatgccccacttattcctgctgaagtcctttctatgcgagaagcgaagtccgttggccaaaaattgttattcggtcattttgtgagtgaagtgaagcgcaatttacaaaactttaacaaattggacagggatttctgtcgggagcacgaggagcagttggacgcctttttggctgctgacccacagctgagagcggagatcaaatgcgacatgagaaggggcgtaagacggaagaacggatgaaaagaggaggaggaggggaagaaacggacggaagagggaaaaagacggaggaagcaattccaacggagaggggagaagagagacccgccttaggaaacgaatggcattgtgttgcatctgatttccttttttctttttgcaatgggtgatttttgtttcttacgcttttggatatccgcaaaatttaaaaaacaaattaatgggatacgaaggcgttaatttgtttgtgtttctgtataaattatgaattaaatgcacttgaaaatattgagcattgtgctgtttttctaccggtattccgctttgaaattcttggccatcactccgtgttggttgttggccacacatgcgtaaatgcccttaattcaattgttccgttttttcgcccttgtggtcagttaatgtgccgaaatgaaatgtcactcggtgaaggtgcatccattcccagccaaattggtcattattggctaattacccctccctccccatccttgcctggtctcccattgtggccggatcgatctccaatttgctctaaacaaaacttgcaaatcagtcctaatctggcgaatgtatggacaaacccaaatttcatcctttcccagcggcttttcgtagtaatgggcgtttcgcttcggttgcatttccattccctctttaaaccatttgattttgggccgagggtccccgcgagctttgcaaatcaatctgaaaaatgggggaattaattcacagaaatcggaagggcggaaggacctcagtttgaaaccgagtcggaacacttggctgaagtgggagccggtgacaatgtgggcactctgccaacaaaagcatttgcttaattagaccatcgacggcacttcccaagggacgggcgaaaattcaacaaaacaatcggcggagcacagaagcgaaaccacgggtttcgagacggaatgccattggactacggtagtgaaaattcgattcgaattcattccgaggaaaagttaaatgtaatgttaaaatcagcatattatcctaatctttgattaaacaaatctctttacgattgacttccccctcattagggcagcgttttgtacagactttcattctgcccattggcactctcaaaatggcatttccaatggcaatctgtccttctgtcttcccctcttttcattttcttttgctttgtgtgtctttctctcctccctttcgctatttctcggtctctgcttctctcctcctgcactttttctgttctcttcgctctcttcctttcactcttagccaagagaaggaaaagaacgacgaacaaaaggaggggaaggggaagagaagagcaatgcggggagagagttgaattggggaagtcgcccccggcgcggggagtcgtccttttcagccccccgccttttctcccttttctctgtccgtccgtcgctcatttccttccttaacattttctgctgcttttcccccattagccctccaattacaaattaattccttctcaaagttcatagaattcgtccaaaactcaagaggattttccccacaaaattcacgccaaaagaaaggctcacgcgattgtccgtcaaagtctgttggatgagcgaaaactcggccacctgcgcgaactgcagcccgcttttg

SEQ ID NO: 4674 - DNA, 1297 bp, Heterodera glycines
cgtccgtccgttgttccgaatgctcgcggtcctccacctttctcgccccgtcccctcgggcgccctgcgtccattgaaagcactgcgatggctaagcgccgcgtcgcacttcgacttcgtcggcgatactttcgcttcgttccgttacctcgccttccgccgtttcaatgtccaaagtgcgctttgctcacccgacggccccaaacgatgctcaaccacatttgtgccaagaaacccgcagaattcaaaaacggtgggccgaaccgtacccaaaagataattataattagaattgtggtagtgacttttgcagtcaatcaaactgtcgaattgagctttcgcttgcgggtcagagacgccatgtcagtgatggaacggattccgaaccctcaagcgatgcaatttcgaacatgcagtgaacctttgcgtgattccgatcacttttcgcttcagcaaccgttgaagttgaggtaaggttcatttttcataatgtttttctttattttttaattccaagtgacgttgtgctaaagcatctgcagaaattgaacgttgtgcaaattgtacaaacacaaaaagtgcctttctgtcaatttgtgccgtgccattcgctttcgagaacgacggagaaagaacaaagcacaacaacaaatcaaagggatgcgtttgcctcaacttcaactggctttttctgctccatttgcgcgcgtctgttctcccgatacgccgattgggacgcgcatttaccggacgaagagggcactgccggcagttgcccctccgacggaagacacccaatgccaattgaggcaaacactgctttgactgggggtggggggggggtaacaaaagcgaacggccgaccgcttttgatcttctgagtgcttttcttttcagtgtccttcgggtgaaatgattccgcgcgacggattgccaattaattgcgcgtcgtcgtctcttttggcagatgaaagcgacaaaagcattggtcagcagcaaagcagttggcgttgttctgcctgtgccctgcagcaatttgccacccgtgccgaattccatgcccatcttttaaaatgcgcattggcaaacaccatcttttgactgatgtctttcgaaggaaagagaatgcctcaaatttttgtttctttttttcaatactttccatttgattaatatttatacaaaatgtttttaagttttgtcaacgaatgacaagaataaattcattaaacatttaatttattaaaaaataaactgctgctggacagatcaaatgccacatgaaatttccatatcg

SEQ ID NO: 4675 - DNA, 1116 bp, Heterodera glycines
  misc_feature (1094)..(1094): n is a, c, g, or t
gtatttgctctttttatcccccatgggggttaatttttcaacctcagaggctgggggataattggagactggtggattaagatagagggattatttttcaaacgcctcgtagactggaggataattggagattgggggattaatggatatgggggataaaaagagcaaatacggtatctgcatttatttattttttcaattttattttggtttgttttgttttggctgtccatccattggtttccctttctcctttaggagcgtgccctcttctttgagttggaagcggtccttcagtttgcccagcgttccgccgattgtttggccatttacggcgctggtgctagtgccgaagttcgtgcagcactgcaaaattgtgatgatgctgacatacaaaatgcttctttcgccatcgtccgtcaattcgtccgtcgcattcgcaaatattttgaaacggcgcaacgaattgaaaaggtccgttttttcctattgaaacggacaaaacaaactcaattgataggttcgttttctaatttaggtggtccctgagctgttgtgggagctctgttccggccctttgcctcccgttgagcagctcgactcggcccaggccctctgcaaacaactcgcccgactcatcgatttcgtctttcattttgacacaatgaaaatgaacacacccgcgatgcagaacgacttcagttttttcaggtgctctcgctcttccaattgctcttttttgactccttttccttaaggcgagtgatttcgcggagcgaagcggcggcgcgcgaagcggagaccgactgttccctcgagttggccaacaccatttcgctgttcctcgcctcgcccactccgatgctaaacgcactgacaaacgcaacagccggtgaggagaaaagaaaatgggagaagcggcctttaatgtctgcgtaattgcattgtgttttgtttaaggttttgtccgagaccatcccgatttgccggtgtctaacacaacagaaactcttaccgccattgtttacgtatgtcaattttaacaaaagatagccaaaccttacaattaaatcggtccgacccctccccacgancgctacctttgttttttttgtg

SEQ ID NO: 4676 - DNA, 2499 bp, Heterodera glycines
tagtatttttcaaaatcactccaattaaacacaatattaaagggacttttttatataaaaacaaaacaaaaaattaacaaaattaagatcaaatttgaacccgaattggacaagatgtgattaagtattatttgtctagttataatcacaactctttcaaatggacatgccaggatgcctattcttcacatgggatttcaaatggtccgaacgagcaaatcgcatttcactggaacaataggcgcattggaagggtcgataaccggtgtgtcttcggtaatgcctgaaaatgacaattttacttgtgacagatacattttaagacgagaaaaattttaaaaataatgattctccgtcctttataaactaaggcattttgagcattattctgaatttgccaatggttttcttgaggcgcaatgaccttgtaagttcatcgctgcgtgcaaagcaccacccgcagtctttccagtcgcatctgaacggcttttcgccgctgtgggttcgcaagtgcgctttgagatgggacgacttgctgtacgcctttccgcatcccggatgggcacatcggtgctgatgccgtgccagcaaatggggcagtgtcttgcgcggcttatgccgctcattcgcttcattttggacttgcacttcactccgtcttctttcctcaatcagtgtccattttaggctgctttccttttgctgctccatgttttcaaattggtcttcgcttggctctctccattcttccctttcttcgttcttgctgttttttgccattccctttgttccctcatcaaattccattttgacagcactttcgttgttttttaatgcgtcatcctcatttgatgccaaattgcgcctttttcttggggtgggtggtgagccgagtcgaattggtggcgggggcactgcgagggagtgattggagagggaaagggaggaggcgggagacgggcattccaatggcgaatggtcggcgagttgctgtttatagcttaagaggcagttttcaattttggcatgacgtttttggctcagccacacctttccgagatggaccattcccattgatggaattggctgtttttggtttgcgccgattgtgctgccatttcgagcgttttgctgctgttcatcatgagcatttgttggacgagcggcgattggagcaattgttgctgctggtgagcagtgttcagtgcttcgatcagcaatggcgaatggagcagaagcggcggaagaagcggaggagagagagtggcggacgatgaaaaaggggcagacgaaacgggcgggggaccatcggccgaatttgagcaaaggtaagcggcggaggaacagtgggaggacggtgacgcaatggcatggatggaattggacaacgacgaaatggcacaaggcatttcgttttgaagggaaggcacaaagggcgacgacgttcggcaactgacagctgcacaactgctaattgactacaaaattgccttcctttccaacctgtcgcgttcatttgctgttgctgaagcagcaacagctgctgatggtacgactgacaatgactgttgtgttgctgctgctggtggtggtgaattagcatcggtgtctccaaaggttggactgagcctgcggcactgagaagcgagcggtcgaagggcgaaagagttgaggcgactccgcccagcacaaattcgagcagatcttgtcggatctgaaaactgcattcttaggcagcacataaattgccattcgttcgattggaggaggcggcggcattttgaagatttggggagggaagaggggttactcattctcactgatcactcaacgatcaattgcttccattcccttttacaagccaataattaatcatataatacgttttggttaaaaatacaagttgacaataatttttatttataacacaaaaaagcacctaccctagagcaaaatcataattgaagtttaaaaaggaagacattttttcctttggaatgcaatgggtccaatggtctccccccccccccctttactcctctctctttctctatcggaaacagaaaagatgatgtttagtaaatcttttcaattaaaaagtgactgtagctaaagagccaaagggactgaaattacccagatgaacaaatcctctaaatgtatgggagggagggacatttgccattgcgcttataaatcagttaagtgcttctttctttggttccgccggtgggaatcggccgccgtttcatccttttatgagtgttttctttataaaaatgccaatgttcctccatttgtcttattattatatacttcgttgtttgctatgctcgccgccgttggattttgtgataaagcgatttttggctgggcattattcaaaaagatcggctcattgctgacgatcgccggcggtaggggagagggagaaacggtggaaaacattgacagggccaattcttaagaggggcagaaacgaactttaaaaatgaactg

SEQ ID NO: 4677 - DNA, 1160 bp, Heterodera glycines
tcctcggcggttgctgctgctgtttttgctgttgctgtactatgcacggcgcattcactaaacataaaaaaagatttaccaagattagtccgggacaaatttcacattcattttccccggcaatggctagggatttcattttttcaatttttcctttaaaaatttccgtttttccaaaaaaattttgttttgaaatttacagaaagaaatttcgaagggaggggcgagctgttcctgcaactcgagctagcttttcctttggcttgtcgtacttcctcaacctcgcttactcacaatcaaaatttcaaattgccatttcgtgaaaaatttttttttttaaatccggcatttccgggcccttcaatttcccctattttatttttttcagtattatatgaattgcttgcatttttccaccttggattcgcagttggcgtattttgcgccgccgtttcatctcccggtccggcacctcaaaactgtcgtcctcctccaacccctcggcaccggcacaatcggccaacaagccgctggtccggatgaacatgaacaccttggcgtgaggtgtcactggtcagtagcgaaagtaaaagtcttggcgctttgttttatttagaaaaaatttttaaaaaaaaatttccatggccggcgccttttggcactgccaaagccttccccaatttaaaaacatttgaaaatcttggcataatacaaagtcaccatccgtgtcacattagctgctaccttttccattttgcccggcactttgcacccctcgaagtgagcaaccgccgttttgctgagtgccaccgccgaaaaaaccaatcgcctctctctgttttaattgggagaaaatgaagttacaaaaaaaaaaacagtttttttaacccacgcccaatttcccaattttcacggttttttgaaaagcctaaccatccccgttttaccggtccaattcgacaccaaaatttgaaaaaccatttttgcacactttgcgttcaacgcgtcgcacaccgtcgcgccgccgcagcgacattttgcgctggccaagtcagtaccgcctcctctgccaccaccattttcggcaccgtcctcctctctcccatttttgtgcctgtaatcattgtcatcatcaatcggcttcgttggccaacgctttt

SEQ ID NO: 4678 - DNA, 2610 bp, Heterodera glycines
  misc_feature (5)..(5): n is a, c, g, or t
taggncggggaattatatggaaatccatattttttttcctggactgtgggggacttgaaatgcaagaaaaacatgtttttagcttggtttgaagcttctaggatggagttccatatccatatttttccatatttcgcgatttatgtccatatttccatattttggcattttaatacatattttatgtccatattttggaatgtttccaaaaaacctctattagaacggcccccagcagctaaattggcctttttgagcccaaaaaccggaaaattttccaaaaaaatcattttttcgccaaattttctcgggaatattgaataaatttaaattttcttaaaaattaataagtttatgtcaaaaataagcaaaaaagataaaatttcacttttctggttgatttttcgctaaaaatgagtaaatttcagctttatcgtgtttttttcttctaaaatcatttttaataccatattttgcgatttttggtccatattttatggccatattttgcgattctatatccatataattcaccgccctagtcataaacattttaaaaagggtgggaaaataaagagatttgtatttgggggtcaaaggtcaaaacagacaaacaaataacaaaaacaaacaaaaaacgaacagaggcaaagtgacggccagcaacgcctcccagcggaggttaatgagagaaaaatgggaaaagtcgggggacggagacgcaacgccgccccatccattctccaccaacaattttcccaaccaaaaaacaacattcgtttatttgttcactttttgtcatccatcaccctattttcttttgttttttaaattatttttgatgctgaaattttcgcgaggacggaaaatcagggaaagaaaaaatagggaaaattcgattttctcttggttttcacaacatattttgaatgaaataaataaataaatattgctggcaatctcattaatctttttcagggacgacaatattataacaaattggtgataaacaaaaatatataatcgcgataatgaaaaggatgacaacaaatcggcagaagagacagagacagaagtggtgaaataacaacaacaacaacaacaattttctaattttttttttaattacacatgatattattccatggctgaattgatcctcaatgaatgaatgaatgaacggattgcccccccccctcccgatcaatacacagtgatcagtgtgagagtggggatgatcagaattgtgtgtgcgcgtgtctgtgtccgctccgcttctcatctcttctcgctgccgcctgcgcctgtaacttttgctgtcccgcttccgcctcctccgccggcacccttcagtttggcaatgaatgcctccatttcggccaacttctgtctgtttctctgtgcctcctcctcgctcattgtctctcgtcttttcactctccctgctccgccctctgtttgacatccgttctgcgactttctgccgttttcgccggcggcactgtgccgtcgattggtgccgttttcgctctgccttcgcttccgccgatcactgttgttgagcggaccgctgttatgtccatcattattgccattgtcgtcatcatggtccgtgtgttcgtcgtcgctcagctcgacgagttcaatgtccgtgccgccgatgttgtcatcatttttgtccaaccgtgcgatgccgtccagcgcgccctggtggtcggggcacagtgccaacagttggccaaacttggcacgagcgtccgccaatttcccatcacgttcaagcctaaaatgcaaaattaataaaaaaaaggcgtaatggaaaaaaatactacttttacaccagatttaagcaaaaaacggttcgtttttcattgaaaaaaccggaacaggacaagatttcgcggacaacatttttttagggaaaatttcggcgaaaatttggaggtgcagcaaaaaaaaaaaattttttttcatattgtcggaggtgtggaatcaatcagaaagattaaactatgcaataaaattaaggagaaaacgtactaaaagttgagtttcaattttcattacgttataactcaagtcataaactgctgatttcaatcaaaacgctaaactatcatgaaatgcggtcataatcgccacccaagaagaaatatcttaacaagactttatggtcaacgacaacagagcaccatcatcaacaatacgaaattgacgcatgaaaacatcaaaatcaacggtcacttctttttcgtgatgcgcgatttctttgctcatccgttcttctttttcttcggtgcgaccaccttcttccctccactgtctttggttttgccaccttcctttgctccaccaacttgtgccgacgaagtgcttgctccaccaacttgtgccgacgaagtgctgggacgacggaaacaacctgcgagatcattgtagttcaaagagcggagacgtaagtctaaaggaaaaagtaagaaaaaggtgtattcggcagagttcgtggatttgagtgaccgaagcaaatattgggtatagtttggtttgtccactccccccccccttttttaatggaaaattttcaaaaaatcgtgtaaacaagtttttatg

SEQ ID NO: 4679 - DNA, 2371 bp, Heterodera glycines
gggttgtcgcgcacgatttggatgtgctcgctgtgttcaaatgtggtccgatcgaagtccctgaacggcgaggggtgaaataattgcgttgaaattttaattttttgcctatttttttaataatttttcgattcgaatttggaagaaagttattttatattataaaaaaatcatagccaaaaatggcttcaaaaagtcattaaatacgtagaaaaacaagtatttttgaaagtgtcactaaaattgggaaaatctctcctccatgaaaaatatataaaattgaatattcataaaatcagaaaaacaacagtttggaacggctaaatggttgtcatatttttaaatgtactacaggaatggcacatttagtgttaataatcgaaatgcaaaaacctgcaatacgccgggatgccttgctgtgtaaggattgcctcaatttgtaaaaaggggaaatgaatcgtctcgtcacaatgaatgtcaaaaaaatgcaccaagaagcaccgtggtattgtcagtagaagaaaatggccgaggggtgacgggggttggcaatttaaagggttatgaaagagaaatcccatttttcatttaaaacacgtcatttgttcgaattcctcgcccctcaatcaagaaaatggtactgaatcggccacgttaacgctttttcgttgtagctaccgttttgaattgcatgaatcggaaagttgggcccaaatgtccgtccccgtccacccacgtacctcgttctcgtcaatttccaactccaactcttcgctggcgggcgcaatggacacgacggtggctcaaacgggtgggggaaacgaaattttggggcccaaccgcaccggcgcacagaaaggagagaggaaagagaccaccaaacacttactgcttatgtagtcgctgatgttgtaaaagcgcttggtccggtcaaatgggacggggacctaaagaaatttgtgaaaaacaaaatcaaaaatggaattaaaaagggaatcatttgccgcccattttccgttaaaaatattcgaaattcgggcattttgttttgtttgaaaagctaatgttcgcaattttttggtctggtttaccagttcgctcgtgtatttgttatattttttgaccaaaagccaaaaaatgagctattttaaaatggattgcttctcttccttcaaaattacttcggctttcgattagaaaaaaaagtttctttcaattattttctcgacacaaaaaccaaatatagcgaaaaacaaccaatcaaatgggttgtcagatttgcaattatcttcgtagttagaacaaatgtgcaggaattccccaaaaattcgcagaaatgcgaaaaaaagagagagaaaaacgcgcccaccaatcggcccttcataaaggtgagtaaagtgcgtcgaaagcggctcaacatgcacaccaactccacgtggagcacggcaacacccggacgcacgacccgtgccaaaattcggtccaacgggcgaaggtcggcaaataatttgcgacattgcaccgcgggcggaagcgcgacggatgccaacaaatcgaacgggggcaacacgtcgttgtcgctgtttgaggtggagaaaaaatcggcagtggcatccagatggggcggtggcaatgtcgcggaatacgactgcggcaactcgctctaaatttgttttgctccgttaacaaacaaatgcaaaatttgcattttgcagtgattttttgcgaaaattccaaggatttccccgtgtccatttccgtcccatttctgctgacctccgtcactgccgctgcttttgcgttgggttccgtgccaagcacatgcgactgaccgacgatagcgaacagtcgcaagtcgtaatcgccattatttccgtctttgtgcaccattgacgaacgtctcccactgccggaatacatttttaggctgtcgatgtaaacaaaaagcttttgagattttgctgattctaaatggccttaaaatgacctaaaaagtgttctagaattttttaaagattcaaaaatgctttttgacttttttataccttttggaaccgggtgaactatagtgaacgccccgtgaaaaaatgggtcaaatgatataccaatcgattcgtctcgaggagataagcatggaaaaatatgtcccgagttgcggaaatgccagaaaaccggtttttgaatcggttcaaaaatcggtttatacatacttgtcggtttctatatggcgcggttcaacttcatataattgtttttagacttagctcgtcaagagctttcgaatggtaccaaatttatggggatacgatcgtttaaaaaagttatagtgcgaaatctctcaatttttcgagttttgaatcggttcaaaagc

SEQ ID NO: 4680 - DNA, 5422 bp, Heterodera glycines
  misc_feature (44)..(44): n is a, c, g, or t
  misc_feature (104)..(104): n is a, c, g, or t
tcacgcatggtactgaaaggggaaacagcagatgagagataggnaagatttaaagaaatttttaaatgcccgaattaatctaaaaatggacttacttttaattntaattttaataaaaaaaatgtaaaaaaataatttaaacattttcaagaaaaatgagaaaaagccaactcgctgaggtcaattggaggaaaatctggtgagaagacgcgacgatacattggctcaatcatttgttggacaaattgctgagaaataattaaaaaattttcgcataatttctttaatcagagttactattatttaattaatttttttttctcccaaatccataataaaaaatattattatgtttttcatttaaaattttgaaattttactcgaaaaattccaatttttggatgatttcgtaacagtagaagcacaagctgtgcatggttattgaatacgaggaatggcaaataactgtgctcgttcggcaagtactcggccatgcgcaacaccaatgagaaggacagaccaccggcacgcgcaattgtgaaagtgtcctccaaaagtcttgcacgggtggccatcgaaaatgaaaaagcagtccaatggcacaattaatgcacaaatggtctaataaataaatcacttcaatttgcgtgtgattgttcaaaagggtgcagatcagttcccgataagtaccgttgtcgtattggatacggtaataaccgtgcgcattcgcgtcgattagaacgccacggggaacattcactacaaatcattgctgttaagctatttgaagtttttactttggggttcaaatggaatttatcaaactgaatgactaatcactttaaccgacctgagccattctcgagaagccacattgtccgtttgtgctcctttgtgtccaagaaaagtggcactttccaccgggaaggattcggcattgagggctccaagtagaagaactgctcctgatcagcgaccagcaaactgctattcctcgtcgacttcaagctgatcagtggaaacccgttttgataggtccacgagtccataaactgagcagaaaattagggaaaagtgatcggagattcaaaatgaaaggccaatcgaacaaaggcacaatgaaaacagagggatctcaactgacaaaactccactaattagtaattacctctcccagtgaaaaattgacaatggataaagcggcttgatcactgcgattattgctctcaattgtcgtgctaataattgggaaattaaatttggcaacaaattccgattttgggacctcaatgctcggagaaggtcggcggaacgcgcatttctgtaggcgaacaagcggagaaatgaacgaagtccgcgcttgaacatctgctcgcccacctgtgccgttgtgaatgattgattggcttacggcacttttacgcattttgatttgtttacccaattgattaatgtaatccctaattaatctataaccctttagccgttaaaatgttcaccgtcttttccaccattcgcagaaccgcggccgccttcagataagtgatgcggtcaaagcgatgtgcaacttcgcgcacggaagcaattttgtagctgagcgcgtgcgcttggtgcgcaatttggtcaaagcgaaacgctttcactgtgtgttcatagaacaattggctcttcaaaagcgaaacatgccataaattaattataaagcctaatagtgaccaaaactaagcttcttctacagtttaaaaagtgcccagaagtaactttttttattctatgggtttttttgaattcccatggaatcaaaaaaggacatctcttttaaaagcgccgtttaactgttctcgacgttgaattttcggcataatcggccgctttcatgcccataattgtggcaaagccttcgttgagccacaaatcgtcccaccattccatggtcaccaaatcgccaaaccactgacaaaaaatatcatttattattagagactgggttttgttgcatttgctgaaatttttgctaacttggagcgtgctaataagcatgaaaacgcatttctaacttggtttgaggcttctaagttcaattttttcttgctgatttttgcttaaattggtattttcgtgcttaatgatgagcatgtaatttttgtgctgaatttagcattttagtgcttatttttgtgcttaattgaaaaattttctctcaattcatcccccaaaatttttttccttgacaaactttttgatttcaaaatgtcaatttttgctaagaaaatattagaattgtcagtgggaaaagaaaaatggagaattattgttaactgataaaatttttgcctaaaaagcaccaaatttttatgctttttttcgatttttgtgcttattttgccattttcatgcttatttcgtgcttaatttagcattttttgatgctgaaaaatccggtctctattattatataacgctgaaattaattttaaagatattcaaattaggcacttgtttttcatttcccacaagttaaatgtccttttttacatgaaaagcattcaatatccaaaatgaagcatttctaaaaattttaattcgtatttcttttccttatttgatacgtctctcactttttcattttgtgcccttttttcttttctttttttgattgtttctctttaccatatgcgctatttcatgtgccaatacatcggtgacaaattgtctctctctttttgcctgcactccgtccgtatacactaaattctgttggcgtgccataatcagtccccaattttccattgctgccacacgcaaaaatgggacgccaaaaatgtctaaaaggaaaaaaaagaacaaatattaaaagcattgcattttaataccataccaagctttttcaacgggtacggtatgtcaaaatattcctcaaggaattccaatgatcggacagaaacttccaacgcatgttccgtgtgcgcaagcttcgatggttgcacccaaactcgaatcttttaaaccgtttcatttccattcagtcgattgtttttagtgtttggcattatgcccaagccaaatctcactttggcataccgtaacatccttatagttggtttctttgtgcttaaagtcgctgacagtaagtgccaaaagataagtggccattttaggagttcgttcgaacagactcaagctccaacccctggaaatttaaatttagggcgaaaataattcccggggcgacctttccattctccgaaaatgggaaagtggcgcatttgacagtacggtagtgccctcaggatgttggaccgaaatggagaagtccgccttgaagctgggttcgtcgaagcatggcaaaaggcgacgcgcgtccagcggttgcatttgggtggcggccaacaatcttgatcagcatttgtgatcaatctcagcgggataagcaatcaaacccatatcaatcgtaatgcgagtttccaaatttttaggattttgccctttaaattcaaatttcggcccgttaccgtatctctccgtcttcgctggtgtaactgccccagaacagtccgccttcgtgtgcttttccaatttttgctttgtaatcgatttccagcaaatacttccgaccgggcaaaagtgccttaaatgagaaataattattaaaattgcttaaaaaggcatttaaatattgtaattgcaatatttttccgattccgttacagcttttctttttaatcattactaattaattggatataatccgaattgccatcatttcttattcatttgctgctaattgccttgtccaacttcaactccaccaaatcgtttcccccggcaagttctctccactcggacactcttggccccgtcaattgacgcatttcgtccggccaagtgcccattttgacgtgctctaagcttagcgcttttgcgtgtagcatcagcacatcggttggcgctcgacacaaaagcaacagacgcaaattgccgtccaccgacaaatttttggtgccaaaatctaacagagaagggcgaaagggcagatacacctaacattttgagaagcaattaacctcaaacataatgccattgatagaaaattggcgaaaatattctgtaccttaagatggagttcataatgaatgggcacaacatcggtgggcaatcgaaccaaagggtcctccagaaggggccttttgtgatgacaaatgtttttattttgactagaaaatggaattgagacttctaagttcaccaaaactaattctctctcctcattattttcggtaaaaaacactaaaatgtgaagctaagaacagtcaagggttggggaatattcaaacggagctttcatgaatccgaaatcagtgattagctcaaaacatgaacccggtcttgatcagttttaaattgagtgcggtcccgatcagttaatccaaaacggatcaacaaattcagtctgttctcctgggttttaaatttgacccgattgactgtgcccacaacatacttgtcctgctgtccaatcattctttctgatcgatcattcggagaagggagcaacaaataggagagcagcaacacggcgatgggcaacagcggcattagcaaaacgacggcaaagcgaagggagcaacaacagtgccaagggcatgggcagggacaggtacaacccctgcggccgattgggcgcgggtccggcgccgtttctctctctaattgtaagcgatcatttttggaacaatgtgaacagtgacttgacaatacactactttgtcatcacagcccctagtaatattaatgtctatttcaatttactaatttttattagccgtctttttaaaaaactctccctccagcggaatccgttgcggcgggagaataatggcgaaaaacggtaattgcttgtagtaaagtactgtagcacctgtcatcactgatgtcgtggtgcactcttcgctttgacggcgtacaatcatcacggcacattcattgaccgttgaggaggcgatggagcaattgaaagtggccgcgctggcacgcctttccgcagcggagaaagtgccttgaggggatttcaaaaataaaaaacacaatcccatataatcacaaatataattactgtcacttaaactttattgaacaccgcagtcactctcaactaatttgtaagtgatcgcctaagccgaaaatacacaaattaggggccaaatgtttacaccttttttcataaaaaattattttaaaacaaaagttagtgttaatttgtaaaatgttttttaataatctcaaataagcgtcaatttcttagaagaaaatggtcaatgtttcgcaagggtcaaaaagtatgtgccaaaaaatgagtttggcaatgccaactttacccgtatgaggcgaactgagtgaatctgctttttgtgctgtgcatgtc

SEQ ID NO: 4681 - DNA, 3690 bp, Heterodera glycines
  misc_feature (19)..(19): n is a, c, g, or t
gagtccgtgggacggcaanttgaaacatgggggatggtggcaaaaaaatatattattttttttgggaatgagtgccaaaatgaaagtggccgaaaaagcgggggaaagggaaaaaagggaaaggggaggggaaccaatttgcattccaacgtccccgggggagaggaaacattttctgaatgaggtgaagggagggtgtggacccctttatatgaataattcaacggtggaagaagacacatccccgcggcacggcaatgatataattagcatacaatttggacaaaagtgggccgatgggtaaacaaattttgccaatgccaacggctacgagcccattttggtaatagtaaagatggttgcccccttttttggagaaattttttttattttcaaaagtcatgaaaacatgtttccaagggttttcgggatcgctgatcacgaatcgagcatctatttcgcccaattccgaactaatggcccgatttcgaacaaaaagtcaaaaattcaattttttcgatttttaatttttagtctaaaaatgttttaagtgatattttatcgaagcagagatgacttttatttcgtttccgtgtattcaaataaagttttgaacagaactgtgaaaatcgaaaaaattggatttttaatcgaaatcactaagaaatttgctaaaatatgccaatttaaattagaaattcgtttcgaaatcactaagaaatttgctaaaatatgccaatttaaattagaaattcgttaattcgctttaaaataatttttatcaattttatgattttcaaaaattttttgccaaaaagaatgtaaatattaatattaaaaagtgtgtgcaaataattcaaaaattgtgcaacgcaaatcaaaggataggctttttgaatcggagatgatttttagagcatcggagaacaaacaccgatcgcggaacaaagtcggatcatctgcgaaaagcctacaccaaaaagccaattcgttttaattaaactattaaatgttaatgtcacctcaaaagtttggccatttgtttgttggcatttgccgttccgatttcggcgtttgccaaccgatcgatcagtgaaatcacttcaaactttgcgcccgaataattccctgttttttcttcccatttttcatggctttcatttgcacagaaaacgcagcgccatttgtggtgttgtgttttattttgacagttttcaactgctgaagaagaacactgcttttcctcactgttctccaaagagattttttaaaaatgaatccaatttttgaattgtttaggaaatgccatactccgaaaatggtgcaaaaattcggtatgaaaatgccatttcgcccctttccatttgccgccgacgttttcatttgaatttccgcggaatttttactgctgttgctggttttcgcgttgcctgcgttcgtgtcgtattcattgatttcgcccgctttcactaaaaatcttcggtaggcaatcagtgcgccgtgctaataaaaaaaatacagtaatgagcaattaaaatacaataattagcacattactgtacctccttttcggacataaactgttcttcgtcgcttccatttcccgtggctttgcaattttccacgttctttggcatttcccgatgatacaataactcatcgatgacggccgaagtgtacgcgattgcttaaccaaattgtaggattactgtaaccgtaattggatttttaaaattgcattatttttcaatttgttcacttttcctcgatgaaattgattcggcccatcgttcactgctcacaatcggtgggatttgttctcccaaatgaagttggtcaaatgacttttgtctggcacggacaaatgacttcaatttgagtttattcgcctgcgaatacgacggaaaatcactcagagaaacggagcggaaaattctttaaaaatctttaaaatattattataatattttaaaagttgttaaatattgttaccaacctggggaaatttcttggctttttgcaattgttttgcggaaattccgtgcgaattctttgccgatgttccaattgtttgtcattgggtatttggcatttgataaattcattgaaatagcggttgctttggtcaaccaacaatttccctgtgccgtcccatttcgccattttcgtgccattctttaaaatattttcatacggcgaataaccaacggaattttcggcattttcgccgcactgccaaccaaaggcagtgagagtttcagcaactaataaataacaggcaattaaggaatgtttgtttaattgatttctcattattttccactcgcctcgtccgtttccgtttgccgcaatattcgccgcccaaagagcgaatccgcggacacaaagtgaccgctgctggcgcacacaatcgcaaagcaagcggaccaattgagcaattggaaagcgacaaacggcggaagaggaagcggcgagatcaaaggaaaaaagatgggcatggaaatggtcggaattggccaacaaatgggccaaggcgaagagcgaagctgaaacaagaagagcaaaaatgaaagctaattgaaaggaacgaacatttgatttgtttttggcaaatttctttgccaatcaaaaagcttctcaatgttttgatgatgtcatcgacggcgcattcggattggagaagtgattggcccgcttgtgtcctaattaattgcccatacaaatgctcgggactgaaaaggcagggccgacatttgccaccttcgctaaacaattaatttgttgaaaatgataaagaatggatagacaaggatttatggaatagtaaggacaggctagaccggtttttaaaccttttttatttccaaaaaaaaattaggggtacaaaacctgattgggacacttactaattagatgatactctcgcaaaatggccatccattgagcgtttattttggaaggtttcggcgttgttcaaaaacaacgactttctgatgcgttcctccacaatgtgcgcgtaacgcaaattgaactgcttaaatataagaagcaactgaacatcggttcattgctccttcgaaacgcacctttttccatctccgaagcgtttccctggccaattgttcactttcgcaaagtgacaattcgtcccaatcgccgtacaaaaacacccaaaaatgacgaattattaatttactcaattaagtatctctctgtttaatcacctccaaaagcgtgcccaaattgccaagcgtactaaaattggatgtccttagcaaaagtagggccgttttacgcgcctccggcggacatttctataaaaaaatagttaaatgtcctaattaatggataatgggcaaatctcgcatattcactcccgaaaagcggtaaaacagaccgggaaccaatcaagcaacaatttggcggcacagcgaacaattttcagcgaaggattggacagttgccgaaaagccaacgaaagtgcccaatgccaacaggggaaggtgggcaaatggccaagctgttcgagagagatgaacacatccaggaaacgggtggcccatttttggatggactgtaataatacagacaaaataattggccgtattatcattaaaaggattatgaaggcgcaaaaaacccaagaaagagtaaaagatatgcataataataagccatgccaaagagcca

SEQ ID NO: 4682 - DNA, 2113 bp, Heterodera glycines
  misc_feature (86)..(86): n is a, c, g, or t
aaaaaatattcggttagaatacgagaaataatttgaaacgaaacactggttactatctgcatatatctctgcgaaaattccagatnctaaaaaatcagctatcccatcgagagctgctatcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccaga

SEQ ID NO: 4683 - DNA, 632 bp, Heterodera glycines
atgattttgcggaataaatttaaattctttaaaaaaaattcttaaaaaaacattcttcaactttttattacaggaatttcatttcttgtttcttttttttatgtattttatttaaaaatttaagttgaaaggaaaatttgagtgtcgaacattggcatttcactcatttttgtacattctgcttagttcaatccattttcttaacatgtctttggcatattagttaaatacgttcgtattggagactaattagcaaataacaaatttgttaattaggtttctctgtctgagactaattagtcaaccaaataaaagtatatttacatttcttttataataattgaagtttctaaatacacaatatagtcatattgagattttataatcaatttaaatcaaatttggtagaaaattttgagtgttcctaaacatatgaccatgactgtacgacaaacgacaaaattttttaattctgattgatgataaacgacaaacggcgtatactaacgacaaatatattgtttgtcgtttgtctctgtcgtttgtcgttcgtaattctgaaaggcccctgacgcattctccgggagccacctgcgaggtaccgggcgcctttccgacactaatctatctaa

SEQ ID NO: 4684 - DNA, 6796 bp, Heterodera glycines
  misc_feature (6658)..(6658): n is a, c, g, or t
  misc_feature (6687)..(6687): n is a, c, g, or t
  misc_feature (6737)..(6737): n is a, c, g, or t
  misc_feature (6767)..(6767): n is a, c, g, or t
aaaagtgggtttatatccaaaaacaattttgttattttcttttttttttaggtgatcaaacgataaaagaagtatcgcgacgtcgacgcacggattctccgactcgtccaccgttataacgacatcaataacaatcacttcccccaaaatgatcacaattatgcaaatgtcaatgtgaatcccgaaaacgttaacaattttctcactggtgtttcccgaaactatgaaatgcgaccttagtttgtctgaaatttgatattttttgttatactatttatgtgtttttataaaattttaattattttttccgtttgacgcacatccgaccaaactgacaaattattgtagaagatactagccgcaagaaataaaaaagttaagaaatttgtccgaattcgggttcgggattcgaaacatggatgttttgcacaaatccgaccaatttcagtcataaacaggtactcccgcgaaaacgtaccccacgcgaaaacggccacgcgaaaacgtaccccagccacgcgaaaacgtccccacgcgaaaacggccacgcgaaaatggccacgcgaaaagagtcggggtcgttttggcgcccacgttttggcgccgacgttttggcgccaaggtcgttttggcgccgacgttttggcgcccacgttttggcgccagggtcaggtttttaaattttgtctatgtttgaataaatgaaaatatgtattcgtcagttttctgagtcgctaatcacgaatattgtattcattttgacaattgcgaagcccggactcgatttaaatgaaatacaatttttgaacatattagatcaggccttctatctgttttgttttatcaaatgttttaatatggtgggtccaaatctgagaaaatgatttaccagattctgatttagggatagtgactattatttattaaatataccgttaaggttacctatgtttataatcactaactcttttgaaatttcaaccgaaaaaatttaagagtttaaaaatattcaaaatgttttgacattttttgaagcatagcgaagagaaaaatttgaaaaagttcttgctaagtcaatttttcatgttgaccaacaaaatgttcacagcaagttgatcatatcactccttcatgttgatctacactagagatcaacattttgaaaaaaccgtagttctacctgtttcaaaaaatggcctgtacctatttttttctgtacataagtacaggaaaataaatgtacaggaaaaatccaggttgccgaaaaatggcctgtgcctgtacctggatccaggaaaaatacagggctggatccaggtacatgttgatctctaatctacacccataaaacacagtcaaaatcgggaagtttcaaaaaaaaattctagggggttgtgaattttttgaaaatttgaaaaacccattggaaggtaaaagtttttcacttttttttgtaaaatttttgatcaaatttttaccttttttaatttttggcttcgcgccaaaacgtgggcgccaaaacgatcctggcgccaaaacgtcggcgccaaatcgtcggcgccaaaacgtcggcgccaaaacgacccagtcccgttcacaacatcgctattcactttggcattttccttgacatatttcaccatttcgtccggcggtgtgccactacgatgacggacggccacatagcaatcgaattcttggaaaaaattaagaatatgagaaatcattttaaattttgtgacaacgagaaattcgggaagagagtgtatgttcataattaatggggtgcggatttttaggagcgaaaaagcctaaaatagaggcccaatttaaaaaaaatgtcttttttttgtcttcaaaaaacacaccagcaggtccaaaagggtggtggaataatcatgtgtaaaaacgacataggatttgtttttgaattttaaaacatggatggatgataacaattcgactccttccccgtcgatcggcggcaaccctgggctactgtatgtttgcttacgataattaaattttaaaaaaatttcagaatttccatactgtcaaaactggtggtgatgccgcattgcagaaacacaagcagcaaaagcaaaacgtttcctacaaaggcagagcaagacgtgtggtgatgcgtaattattaattcattaattagttaattaatgggctaatttactaaaaaaaaaaaaattcaatttcgttttttaaaattgtaaagttgttgttctaaaaaagagtgatccccactcctatgttccaagtctggcacgtaaccctaaaatccgttaattgacaattaaattttttgcaggaaaaatatccgagagctttaaaaacaaaaaaaaagatttttcgttatataataaacagtgggggaaaagcaaaaacattaacacagcgctcaaaatgatgctttttaattaattcaattttctctcttttttccaaatgccataaaatggtgaatcatcccattcattttttattttgctcggaattttctgttttttttcatagtattaaaaaatgtgatgatttgtccacttttctctgctgattgtgccttaaatcaaatggttagcttttctaatagctttccaagcaaatttctgtggtcggaaatgggcaaaaaaaaaaaaaactcatcagcaattcaataaaaaatgaaaatggaaaatatgtaaaatgatcatgttgaaatttgtaaataaaaataattaaatacgatttagttaaatttttttaatttaattctgggaaaaaataaatttgaatgaattggcagcacactaattgactttcacaactttcacaattgggtgctaaagtagagaccggaaatttcaaacttgcagatccagagctgcgggatagaattcaatttttttgtgggatgtgatcccgcgggattaatcccgtaaaccccattcagatcagtttaagatgagttatggttgataaaattaaaaaattaatgcaaaaatggaatattgaaacaatactttccactttccataaggccaaaaattcgaagtatcctgcaaaatttggtgcgattctgatcacattaatgatttttcaaaaataaaaattaatgcaattagtggaaaactcaaacactgttttccttgaggccaaaaattctatattccactgcaaaattttgaaaacgattctgatcaatttaaatttaaaaacaaaaaataattgatgcaaaaatatgaaaattcaaatatattttcgtttaaagcagaaaattttaagagttccccttcaaattcaggtccgattttttttaatcactttaatttaaaaaataataattaatgcaaaaatgtgaatatttttttgggttatttaattttttttatttaatgaataaatttaaataaaattatttttgcgcataaatatttatcactttttcacatacactgatcaaatacaaattgttttatttgtcatttttttttgctcatttgatcaaattcaaatcacgagatttcttttcttcttctcttccgtatgttcctcttcttcatccttctcatcccttcttcgctttccttgtcatcattgtgccgtctcacttcttttcctcctcggaagaggaggatgaggcaatgataaagcccataaaagagtcaggagtggcacttttttcgtcccattttgccgcctcatcattctcgtcctcctccttggcactgtcctccccctcctcctcctcctcctccgtcatgccacttttctccaccttcttggccccgttgtcgtcctccgtaatggctaggggggtgggaaaattcataggtttttaagtatttttaggcccctaaattgttttttttgcacccctaaaaatcccctccctaggccccaaaattggttttcccctaaaaatccccgccctaggcccctaaaaatccctaccctaggcccctaaattggggttttttctcccctaaaaaatccccgccgtagacccctaattgagtttttctctccactaaaaattcccgcccgaatcatggcaccactatttttatcggttgttgcgtcaccaccatttccgttcgcgtccgttgtggcactgtttccgtcgtccgtcgtgtctccgccggtctcgcccgttttggcacttttcgtgccattctccaccaccgccgtgccaatggtgccgttgatgtccagccccatcacattttgcagctcaatgttcgcctcattgcacatgccattctcgcaaatggcacatttcgatttgcccccctccatggcgcaaagttcttccaattcagggtgagagcagtgaccagtgttgttctctccggaagcagcagccgaagaagcacataagttgaacacaaaaacggggttcccttttgctgtaaaattaaaacaaaaaaattgggtaattaaattaataattgaaaatggataattaaaattaactaataaaatcatatggtagcgggtagaggaatactgtaataaatttatttcatatggaatttaaaaacgctccttaatttccctaattaaaaccatcatcaaaaaatacgaaacattaaatccttaattatcctaatgaaaatcgcaaaaaaaaaattaattttaaaatcttaaatccttaattatcctaactaaaattgccaaaaaatttaatttaaaagtcttacatccttaattaccctaattaaagtcattaattaaagaaaatttcgcaccatcaatgcacgcgtgggtctggcacccatagaatgagcccgaacaatccttggagatccgacggtcgctcacattttgcacatcctcaatctcccaatatttgactttttcatggaattggtcggacacattgccatggtagcgggccgcgtaaaaacagttgtccgctgaaatttttaaaaattttttataagtttttttggcattttgccttaccgcgcgagtcccacaaattagcgaaaaagtctccgacggccgacagattgatgaatgattcagcgctgggcacagcaatgtgcaggatgatgaaggtgatcaacacgagcacaattgttgggtatttgaacattttgttgcaagcggagggttcgaattgttggcgtagtgttttggaattggattttctttaaaaatgaaaaaaaaatttttattttgaaaaacaaaaattaaattaattaggaaaagcaaaaacaatttgcaaatatttcctcccaattaagacgagaaaaacatttagtttttgagcatcgtttttcctaacccaatttgtgatgaaaattactgtattcccgaaaatagagcccaggggctttatttttcaacgcactaagaagagggctttcttttttcagaggggctctaatttggggtggggggctgtattttcggaaatatcaaaatttagttaaaaaaaagttttttcagtttggataagtgataagccacccccattgaaataatccccaaaaaaacccacattttttgtctaagacaatctaacccataatttttggtatatttcgattaaaaaaactaaaaaactttttattcgaaacctaaaccattcaaaaaataacttttaaataaaacattttttgagccataaaaaatgagcgaatgaacgcgtttttatattgacggctgatggtagcggaaaacggaaaaacgctgccgaaggggcgggccgaaacaaaaaaaaacggagaatccgccgccgtcgatgaaccaaaacaacaaaacgtcaaaaagtgaatcatccgtttggccaaccgaacaacaaacagcaaaaacggattgaataatggacacaaaaaaatgttgaaaatagggaaaaaacacggaatgatgatgatgaagcagaagcaaaaacaaatgattcatcaacacaaaccatcgaaaaacgttaacgatgatggacggggacgacgcatcccaacttgggacaaaaagggtgaataataaatgcatttttacacagaatttgattgagcagaaaattgtttcgaaagattttttttaatgttgggatttagccggagggacggcatgaaattagggaacaaaaccgggatatgcaggaaataaatcgcaggaaccgagaccaggacaaaaaaaaagcggggataacctgtgccagtcgaggcgtcgccgattagatccacagggtgattgtgatcaggattagaaaaaacaggcgtgatttattagggacagggaattagggtcgagaccaagatacatactaaaaagtctggaatttactcgtaatagacaagaaaatgtttggaaagctaattcgaacgtaggttgccattttttaattttgagagaattatgggctcccaaattttattaaaaatttatgagcctttttagaagagttactggtagccaaattttgcggaaaattattcgttaattaattacttaaaaattaaaattcaaaattaataattatttgcaacattttttaaattaattactttaaggcatattatatctatattctttttttaaaaattagcacgatatttttttcttttttaaatttttttgatgaaattttgtacgtctctgattaaccgaattttgtttttttttaataaaatttttgaaaaatccaatgatttattanaccaaaaaagtgatcaaaatttttgtttnaagcaaaaaattattgttttcagtcattctttcgctatcacattcattcntgtgcttcagcttcctcatctcccacattnggtgtccactgggtcttcacttcttggac

SEQ ID NO: 4685 - DNA, 2478 bp, Heterodera glycines
acaaataggctgaataataaatcactttaacacagaacatgaatgaacagaaaaattgtttcgaaagcattgattaatgttgggaattagccggagggacgtcatgtaattagggaacaaaaccgggatatgcaggaaataaatcgcaggaaccgagacccaggacaaaaaaaaaagtggggataacctgtgccagtcgaggcgtcgccgattagatccacagggtgattgtgatcaggattagaaaaaacaggcgtgatttattagggacagggaattagggtcgagaccaagatacatactaaaaagtctggaatttactcgtaatagacaagaaaatgtttggaattttattaattttttattcatatttttgttcagtaatttttagaaacattaatacctaataattaccttctaaagaaaattctcagaagcgaaccgaactttacaaaaataattctgaaaaaggcaaccttcatacatttctacgttttcggcattgtgataaaaataaaaggcttatctgtttcaatttaaccctctaaatcagcagagcatccaattttaccagcaggagattagctaattcgaacgtaggttgccattttttaattttgagagaattatgggctcccaaattttattaaaaatttatgagcctttttggaagagttactggtagccaaattttgcggaaaattattcgttaattaattacttaaaaattaaaattcaaaattaataattatttgcaacattttttaaattaattactttaaggcatattatatctatattctttttttaaaaattagcgcgataattttttctttttttaatttttttgatgaaattttgtacgtctctgattaaccgaattttgttttttttaataaaatttttgaaaaatccaatgatttattaaaccaaaaaagtgttcaaaatttttgcttaaagcaaaaaaattattgttttcagtcattctttcgctatcacattcattctgttgcttcagcttcctcatctccaacattggtgttccactgggtcttcacttcttggaccttaagcaaatttaggatgtttttcacaaaatttcaatttaactcttcgccaaaccatattcctcctactcctccacccagccacctcacgaaattcgaaaatttgccacctttttattgtcagtcagcctcgctctcgtcatgtttttttttccgagaaattgaacctcaattctacccttgccatgttttttttaaatttttcaccttagctctcctcgtctttatttttttcgaaaaacttaaccattactctctccccttgccatgttttttttaaatttttcagcttagctctcctcgtctttatttttttcgagaatttttcaccttatttaaaaaaattttcattttcacattagctctccacttgtcaaatttttcgaaaacttttcacattctcttgtcatgttttttcgaaaattttcaccttagcccccctcgtcagtgtgccattgttaattgtctccaaaaattcttcggaatggctttcctcccatgcctgactgtcgtccaacatgttctcgtccgtgctatttttaagcatttgcgcaaaagaaaaaacggttgacgccgaaatatttggtccaattgttgtgccactttggacttaaaattaaattggggaaatttcaaaaaattatatacgaattagcaaataaatttatatatttttttctatttttttatgatgccaaagtaccgaaagcataaaattattagcgaattgaagagaaagaaaataaatctatatcataattaatattattaagattttgaaaaatatttttattaaaaatatgcacttgaattcaaaatttccatttttgtgccattctgaacagaagtgttcagtaaagctggcgatgaaacagcggcatttgttgttgagctctgtggtattaaatttattttcaaataatcacatttaactcaaaattcatgatcaaataagtcattcccgagaaagtctctttggccaaaaaaaaattggtaccaaaatttaaaaaatttggaaaaattgtgcctgtatcaaaatttttttatttttatatttgtggccccaatgttcggcactccctcctccatttcccaaaacgaacgacaattttttggggccatacaagtgcagtagtatatatatgtaaataaataattgtgtgtttctaccataatcatcatgagaagaagggcaaaagtgggtacggtggaagacaacatttttaaatggtaaaattgaaaaatttatcaaattttaaaaaataattaatgtgtggaaaataaaaaataatagcaaaaatgtgtgggttttaagggaaaagtgagcgcgagcggcgattattagtaagcttttgtaagtgtgctgctggtgctgcgcgacagaacaacaaatatgtacgtataatccgca

SEQ ID NO: 4686 - DNA, 5674 bp, Heterodera glycines
  misc_feature (27)..(27): n is a, c, g, or t
tcactccttctacaccccgaccccgancctgtcaaactggaaaaatgccgtcaactggagggctcaatttgatcgcgtcgtcaaggaaattcgctcgatggaaatgcagatggacagtctacgagattcatccaatgcttggatcgaacttctcggtcgtctgatcggagacgacaaagacaacggcgaaaaagaatacgttaaattcgacaagaatgaaaaaatcgccgaccgatacgacgcagcaacaaccaaacttcgggatttgcgagatctcgaagcaacgctcagtgccgcagccaaactgcacagaggcagagccgacagagaagcaaaggcggatcaattggccaatccgcagcaacaagcgcccatgctaccagcgatggcagcaccaatgacagtgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactccgcaatctgctgggtggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgaaggtcctcaagtgttcctcatgctggagaagaagctgactccaccattcctacgaagcatcctcacaaagaaaggagaggatccggcaaactggacgacaaccaaattccgagatgtgctaaccgaagcagtccggaaagaagtccaaatccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggtcacaaacatcaagggtatgtaagccaacagcacacacaacaagcaaagaaacactgccaacaaatgcgaaaccaagtacaaagcctcaaaaagggtccgccatacccctgtattttctgcaacagcaatcattggcatgacgaatgccaaaacgtcgacacactcaaccaacggatcagcatcgtcagagaaaagaagctgtgcttcaagtgcatgaagccaaaccaccgcgcatcaaattgcgctcgaccatctaagtgctatcactgcaaacgtcggcatcccacggcactctgccgagatcagtacaaagccaagaatggcatcaacacgcctagcacctcttgcagtgaagagaagccaaatgccaacgatggcaagcgatcaacagtgatcgaacaacaacaaatgtgtaatgccatccaaagcaaggaaaccagagcgttgctaatgacgacaaaggcaacgatcttcaatccgtcacggccatccctcagcatgatgggaaccatcttcattgacccgggaagccaccgatcattcatctcgagcagtgcagctgaacaattggatctgaacgtcctcagcacggaagaatgctacttgtccagcttcggtgaacgagaaccgaagcgatacataagcgaccgcgtcgcaatcggcattttatgccccgaccaggacaggttcattttcaacctgaacgctttgaagttcctgctgaatgatttgccggtactacaactaaacgcattggataatgacgaacttcaacaaaagaagctttccctgccgaatgagtcacggcaaccggacattctcctcggaatggacgtttggcaccagctgaatgttcaaccaattgaacaactgccaagtggatttacgatttgccaatcgaaaatcggcaatatcatcagtggaacagggcgaatcgagctcaagcaaccgtccaacatctctttcgtgctaatggtcaacaacgatgaatcgccacaaagcagtaaagcggctcagaggcagaaaaacattcaacaaaaagaaaaggacgaactgagacggcatcaacgcaacaaactcttgtccagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacaccaacaaggaagagttcatcagttgccaagcgaccagcattttcttccagcaaacaaccaaaaggaaaagtagcgaatcccgcacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcccaaacatgagctcggcaacaatcagtaagacaccatgccaacagcactcgtccgagaagacgttaaactaagctaatcaccaacaatcgtccgcaatgacgttaaactagtctaagccatcaacaactgtccgaaacgctaatcacccggctgccacgagtccggaatgacgttaaactagcaaagcatcggccaacccacacaacaattgtccgcaatgacattaaactaaagaaccaaccaaacaacaaatgtccgcaaagacattaaactagaaaagcaaacaacacatgtcctcaatgacgttaaactagagaaacaaaccacccaaagtccgcaatgacgttaaactagcaaagcatcaattgtccgcaatgacgttaaactagcaaagcaccggccaccaaacaaccattgtccgaaaagacgctaaactagcaatccatccgacggtcagggtccgaaatgacgtcaaacaagcaacgacaattggtccataaggacgttaaactacgtcaccaattcaagcaaaagcactcgagcatgcagctgacagcacgtttccggaagcaaaattcacatgtcctcaacgattgaggaggttcagcagcgaatgaaccacaacagaccgcaaccgcggaggtcacaacagaggggactaaggccaactcaagcgcctaaaatatgccaatccgggatggcacagtacaagcagggtcgagggatccgccttcaccctgcgtcttctgcaatggcactcactggaccacgacgacgactcagcgaacaacccttgcaacgagagcaaggacacgaatccagtacgtcaccaggacgagaacgcagaccacgaaagagccaacgacacgccccagatcgcgtaagcacgatttggaaactcaagagcacggaaaattcacctttttgccgtcccccgccatcactcactgctcaatggctcaacctggcaattgagctcttcgcaaaaaatcatcaagcccgagcagatcacctttgcatggcattgctccttcgtcaccatcgagaaggaatttccaccggtcaacaagcggatctgcaaacaaatggccattcaccaggaatgcccattcgtcaagtctgaaatgacgaatcacgaagcacaattgtggtcaacgaacgacgaattggaagtcaacttccctggaccaatcgccggacttttcaaaggcgaacaaatcagcacggcgacaaactgctttgctcaaccagcaacacttttcgtaaaacggcacaatctgcagatgttttcgccagtccaccaagttcagaactgtcaatacgccaccgaattctgccaactgcccgacaactcaactctgatttggaaatcaacctgcaatggcaacgaatgccaaacatgcgactacgagaaggcggaagtcatcaacggaaaattcactgcggcctacggagaatcaatggccacttggatctccgaagatcaccaaaaggcattaactttcgccaaaaatgcgccagaactcatcgcctgcgatggcacacgcatcgtcatgtccgaacagaacttcggaattgccaaggagcaatacgacgacattgtcaccaccacgacaagatggaaaagaggcatccgaccagaacagctcgcatcacagctctcggcatcccaagtggcaaatagaaggattcaccatgcgctggctaaaaagcctgatcgacgaagcaatcacgtggtggattcgagtcgcctgcgtttattcaaccttcctcatgctgcgcgacattgttctcccatgcactctggcgtatttactcaatcccatccgagtgactcttctcagcctcgttggagtacgcccgcagtcgacattccgacccaccgttagcaaaccactcgggatcgaagagggaatgccgctgcgtgaactgccacgaacccccaaaccaccagcgcgcagggcagagcaccgatccatgtcaccaatcaaattggacatgattgccagaacggctcggtaccaacaaccacgaacacagtgccatctcgacctcacagaagactcgccctttgggaggccgagacgaaaagaattctgacgggccccatcctttttcgcgccggaatgtcggaattttttattcctatcgccgatcaatgatcggcggaattaagagggaggaggcccttcaccaatcccccgcccgccgcgcgacatgttttcgccgttccatccctctgtccccctttccttcaaattgtcaattgtttttgtgtgttcctcccccgccccgcgcacaaattaatgaccaatttgtcaaaccgcaacttttcgccgccgtccccaattcggcgaatgagactccaaagaacgatgaacccccaatttcccgttttcctcccaatttgttcattcgttcatttttgtgccctctttttcaattcatgcccaattttcggcccattttcgttctgctcaatttcgccactttttgttcaattttgctcgtatttaatgcgacaaatccccaccaattcctacaatcagaagcaccagcaaaggcaagcaatgcctcttccgtccctctctcagtccccctcatttcattgtcctttcccccggcccaattgtccgttccatttctgtcattcacccggtcccttcattcaatgatcagtgattggcccttcactcctgtcccatttcgctgtgattttccccaattgtgataatttccagacccccggttttggtctttgttctgtggccccggtgcccttcaattctttcccatcccggtccccaattcatttgtgattaatcccccggagatggccttttttcctgtgatcaatttgtgataattttgttcaccatttcaaatattggtttaattacccaagtttgaggctttttcccggaataaattttgcttaatcaattctcggcatttgatttggccggtcctcgtccctgcctgctcctgacccccgcaccgtggaattcatttggcccgaccccagagcaagtcgggacaaa

SEQ ID NO: 4687 - DNA, 2158 bp, Heterodera glycines
tttaagaaaaagacaaaatcaattttgcgcgaattggaccaaagaatgggcgacaatcaaagtgccgacgaagtcgaaacgcgccattctgccatggaatcgactgaccacaacacggaaagcacaatagccgaaatggtgggcgttatttaggcactataatgagattatcacaaaattgagattctaaccgattgtgaccggataaatcatcccccatagttccttccccgaaaatcttttttaaaacttttcaaacttacacttattgttagaagaaaagctcataagtttgtaacgcggcgttttcagtctgtggatttggcactctttctgttggaccgtcagccttcatcaaaggaggacccgcgctggtcgtacgccgctaatgcgcaaatttcaaatggcattttcccccttttcgtgcttataaatgttttttttgaacagaacagaaaggacaactccgtgaattgtcttcgacgaaaaagttcactttgattctgcggctccttggcgataaacacgcccattacaaggcatttttggcgtttcattccctccccactttttaaactttctttgttagatggctatccttttcctgcgcactttcaaccttgtcgaaagggtgcgttcttttcgtcaatttgtttttcaatggctttttatggtccttccatgaaaatgaagatgattggctcggtttaaagcaaactttagggtttaacaacataaaaataataaggaattattgttcctcgttagcccattggtataactgctagcatatttcgaggttcagttccgtcccgtcgatcgaacaaaaattcccttttccgtcgttcaaaaggcctcgtcccgctggagactccgtttcccaaagagtgtcttgatttgaacgaggccaaatcgaattgagccataagacgtcccactgtgccgttttcgttgcctttgggatgaatttgcgtttcatacatttttattggattcctgaatcggttgaattttttgtgtttcttctactgtcttttttcagcttgaccatccgctggaagccttccaaaatcgtaacggaaaagcagtgattgccgagttaggcgagaaattgtccgctgccattttctgcttccattggcttgccgaaaacggtgaggagtggttttgccgtgatcggatttgcattcgctttaactccaggcgaatcgctgtgccttgtgaattcggccctcaacgaattggccaagaaatacgtcacgcgctttggctttccgaagggcaacccttttctgagtgcggttgactttgtcttctgcaaagtgccccccttttgcctttgtctttcgcttttcacatggatccgtcctttttgcctctcaggtttcctcttttcacgaattggtccctgcggttgtccaactcagcgaacaatccatggaggaacgggcggatcggaccaatctgttggctgaggtggacactcctttgaatggcatttgctaatcattccatccgaaggtcggcgactttctcgtcaccctcgtccacggagtgaaagaggcgcgtcgcgagaaatgggctctgcaagttgaggacgaccactcgacatggttgaaccagcccgacttccttacccatttcataacgcatgtcagtcagagcattgggaataatcaattcccttttcggtggagtgaaaaatgaaagccccgactgcgaagtggccttatggtcaaagttaaagccattttttaacggggcgacaaaaaaggggacgattaaggggcggtggcaaatgtcaccgtgttggaggaccccgttcaaaactataaatgtcgatttgtaaacgaaatgggtgagcgggagggagggggtgtgtgtttatgacaatttcaatagagaaattacagacccacctgggcctggatcaaggcctggatttttcctggatccagatcagacctgtgcaaggggggtcagccaagaggtcttacgatcgactttgaccccccccccccatgggcgggttagagcccatttccattacgatcgaccattttcaaatttttttctagtgagacttttttttttttttgcttttaagctacaaaaactgacgccgcgatgaaaaataggccgagtgtttcaataaatt

SEQ ID NO: 4688 - DNA, 699 bp, Heterodera glycines
agattttaataaatttgggctatggactcttcgtctccacacgccaatgccgtcacaaaaatttcagcggatgtcctcaaaatgaacgtgtgttccattaaaatctcccaaacaaaaaaaatttgggtttcttaacggaaaaacattttagtttatgaagaagacgatcactcgcattgagcgtcaaaaaaaacagaatgaaagggaacggacgaaggagcaaatttcggcagggaaattggaagtgttgccgcctcggcattatccgacagtcgaacacatcgacgacgacccgaacatgtgagcgattttcattccctccaatgtcttaaattctgaatttcagcacattgggcggagtgatgaccgaatggcgttactccgttctcatggacaacctccgctttggccgcttctcatttaaaggacaaaaccccgaagttgaggtgaattatgccggtaataataaagctggtgccccccctttttttaaaaaatattttttgttttcaaaagtcatgaaaacatgttttaggggtcgctgaacacgaatccggtatccatttcgacttttttcttcaaatattgtttaaatactcagaaacgaactaaaagtcatcacttcttcaataaaatggtaatttaaaccatttttagactaaagtgaaattcgaaaattttgaatcttcgactttttgt

SEQ ID NO: 4689 - DNA, 4144 bp, Heterodera glycines
ggattcgtgttcagcgacctctaaaacccttgaaaacatgttttcatgacttttgaaaacaacaaattttttttcaaaaaaagtggggggcacttgctttactcttaccattatgccttttgaaagggcaaaatttctctattcgattgcttttcacaattagaaatggatgcaatttcacgaacgaagacgcaatggaatagaggacgaagaggaggaggaggaagaagaacgggaagaggaaggagaaaagcgaaggttggcaaaactgaaaaatgggggaaaggggaccaattaattggcaataacaaacggacgatgttttgctccaggagtcgagaagaaggcgaactcagtgacgaggaaggggacggaagcatagtcaaattggtggaggaagtgagaaataaaggccgaaaaagaagggacggacgcaaaaggcaaacgcaaaagatgggaaaacgaacggacattaaaaggagaaggaggggcaattgagaggctaatgcaattgttattatgctgtttatggtattttattataaataaaagtgaattgttattcctttcggtgtcagcagcagaaaacgccaattgtttcttttttcatgcccaaataaaaaggaaaatgaaattctaaacggcgatgggacgataaaatttgcaatttcagtaaacagctaaatttatttccgactgtgttccaaatcggttataaaacaaacagttatgaccacaatcgataacaaaaagagtgcttttgccctgtccttggccggtttacaaagttcctcgtacacttcgtccgaattgtacactctgtccacatttggcaacgaaaagcgtccgcgcggtgcggcgcgcaattggcgctccaacgcttccctttcacgcgcgtctttttgctgctttggcaattggaaattgttccctttagcgaatgcctaaaaataaccgaattgtgagctgtttttaacgtccttttgttgcctgattctgctgatgacatttattatcaatgctaatattacgctgacaatgaacgctgaaaataaagaaatattggaattttaataaaaatttacgaattattacattgaaaatgcggatgagacggactgaggaagaattcggagagacgaataaatgtataaaaaattggccatccactgcaatgaaaaataaagcttatagaaacatgcgctaattaatttaaaaagtgctcccattagtagggccgggacttttagtgactaaaaatctcaaaatagttaactaaaatagtgagtaaaaatgccaaaatagtgagaaaatagtgccaaaaagtccaaaatagtgacgaatagtgacataattttcagccaaaaattgagcaaaaataatttttattcactatttgcagttgcaaatgagtaggactgggatttttaagggcaaaaaatccaaaataggtacctaaaaaataatttttagaattaaaaatttttgcaaagaaagtgaattttgtgaaaaatttttcatttcttaggagtgatttttgaaaatttttatgtcgattcttaggggtgtattttttgaaaaaaaattttaggtcgattcttaggggtgtattttttgaaaaaaaattttaggtcgattcttaggggtgtattttttggttttattgcgtttttgttaaggaattttccaaaaaataaaaatagtgacaaaacgccaaaatagtgatttctagtgactgataatgacatcagaatcgaaaaattttaacgcagaaatgcgttttttgagctcctttcttcaaaacaattaagcaaaaaaaaagttttttcactagaaatcccggccctagttattagtgccattttttgtttttattttttagaactggggtaaacccaactcatccaaacccaactcatccatacccaactcatccatacccaactcatccatatacccaactcatccatacccaactcatccatagcacgatacgagtcgtcgccgtggcatttaatgccacgactaagaccgtacaaccaaaaaatactacgactaagaccgtacaaccaaaaaatactacgactaagaccgtacaaccaaaaaatactacgactaagaccgtacaaccaaaaaatgccacgactgagaccgcataaccaaaaatgtccacggtcaagaccacataagcagaaaatgccatgccacgaccacataagcagacatgccacgacgatgactcgcagcgttatggatgagttgggtatggatgagttgggtctatggatgtgtcgccaatcttttatttgcgccgcgcgcttggggttggggtgggccaagctgaggcgggattggttcccgctcctcttcaccgctctcgtcccttttttctctgctcactccgctcgctgtgccgtaaagggaatggcccccttttttcaccgttcgctctgatgggtctgatgctgctgaccgatccgatcagcgccaaagggggacgagaatgggaggggggaggggtgacaaatttggattggtgcttgagggaattgtgcagcaaatcgctgcttgcttaacggcaccaccgacaaggtttggggaagggcttgtcggacccctttgactcgacgaccacgggtttcgactcccgttccctgcggcggacactccggctggtgggagtccgctttgatcgatgcgcgcttctccggctggtgggagttgcgttgacgaacggccctgtcctttcgtcggacgatttggcaccgctcggctcttccttccttcactgccctgcttggacttgacgacgacgggagttcacacccgtctcttcagctgctcctactggtgggagactgaactgctcgaatttgccgctacttcgggtcactcccgaatttttcccaatggctgattggaggggaatttgggatccgggagggttgagggaaaagacgtaggcgaatgtgatggagtgaggagggtctttttccctccttaccgtgtcccccgaaaacgaattcgagacttcgattccgacacaaaatttattaaagaagcgatcgacgaattaaaaatgcgtaaatggtgaaaaattgatcgaaaagtccagcaaaacgaataaaagcgaatgatccgtgggggaaggaagcgaagagagcgaccccttgggcagggccgcttaaatagacattcgaaaaaaatgggcggagtgacagacggcccaataatgcgatgagaaaaatgggacaaaaaaatgggcagaaattgtgatgtgaaaaatgtgaacaaagaaatggcgcataaaaataaaatgtaaattggcagatgtgaaaagttaaagaaattgaaaagaaagaactttgtgcaaaattattttgcacaaagcttgggccggagattagccagccgatgagaaatgaatttgtaaagaagtgaaaatgggacaaaaaataggtgaaatgataatggctggtacgattaaatggagaggaaagtgatcaaaatcagcgattgaggaattgatgaatcgggagttcgcccgaacgtctcgtcccctttttgctctttttcttccggtatttcttcgtctttgacggtctggcccatgtgctcgtgcttggtcccgagaaaacggactccccgtaacggtcctcctcgtctgtgtcaagctctctcccgattctcggtccctcggcatccctgttgaacgcgagcactcgcgcacgccgtggcgggttggcacccgccttctcgttgccaatgagaaaattggcgacaaagtgatcgttgacgacaaggccacgatgcttttttatatgattttataaaaatatgaatttaaaattatttatataaattttttatcataattgagattgtaatatttatagtttttggtattaaaagtattggctacctttttgaatttaagactaaatatttaaaaatatattttttatttatttaaatttttaggtatttggttttttaactttttattatgaggtgtgtatggttttgccttagtgcaaaaagcaatttaaatttaaagcctatttttattcaggattcataatttttttgaaactctgtgttattggaaggatgtgagaattttctgcttattttttctgaagat

SEQ ID NO: 4690 - DNA, 989 bp, Heterodera glycines
  misc_feature (983)..(983): n is a, c, g, or t
tgctttttaaagtttaaaaagtttcccatttttcttttttatatttaacccccaaaatgcaggaactgactgacgtggaaattctgcacgaaagtgaggatggtgcgaagctgttggtggacgaactgatcaaaggccatgttgtggaaacactggtgcagcagccgctggtgaaactgaacgagcaaatccaagacgaagcggacgccgtttacaacgcgatgaatgtggtggaaaatgcgagtgattcgtttttggcatttaaacggggaaaacaattttcaaaaaggacatggactaatatttccccaatttgaaatttccccctctttttatttgccttttgtttcagttgctcgacttccatccccaggccaatgatttgtgcgtctcccagggcctcttcgattggctgatggtccgcgcgacaaagcgaaaagtgttcgacgccaacaaattgttcgccagccaattgttcgctatgctccttcagtcgtgcgagtcggcacggaaaaggctgacggagaaaagggatggcattgacatgacattgcgagtgggtaataccaacggaatgccatagtttaatttgtataggcacttgccgtgtacaaacgacacaacccgggcagtccggacgaacacgagcacatggaaaatttgttcgacgctctctgtgccgcgcttatgtacgtgccgaaccggcaggtgttcctcgacggggaaggacttcaactgatgattcttatgctaaagtgaggcggggagaacaatttgaattgaatttggcattgtttaagggagaagaaaatgtcgcgggagggcgccctgaaagtgttgagtcatgcgactgccatccccgacggtggccccaactgcgacaaattcgtcgaaatttacggtgctttttctccgtcctcattttcttcgctcatatgcttcaccatttttaaacaaaggtctttctacgctttttccgctgntttatg

SEQ ID NO: 4691 - DNA, 3845 bp, Heterodera glycines
  misc_feature (3825)..(3825): n is a, c, g, or t
aggcagatcagcggcttgttcaggcagatcagcggactgttcaggcagatcagcgggattctcaggcagaaaggcggactgctcaggcagaaaggcggactgctcaggctgaggaggataaccggcaaatgaggcgcgaacttgagcaacaagagctggaattgtttatgttgtgttcccgtttagttcgacaattttgtgaggttggttttacagtgtattttatctatgatatatcaaataggagggggggggcgggggttgggaaaatgagtggttcggcggtgttataggcgccgcggttacttttttataatgtttaattcaatttgcaagattttgtccaaaatgactaggttttgggccaattttttaaaaaatatttagaactaaggacacttgggaactctgtcaaaatatgatgattttcagattgaccacaaaatcagcgccgaggacagaaaaaattttttcggaagatactgtgaggttacgacatggatggagcataatgcaggtgcaccagctgtggaagtgactcaacaaaaagaggcgttcgaacatctgtaccaatcaatcattgacggagcgtcgggcaacgactatgtcgcgacaacgggttgtgtggctgggacgtcatccgccaacgaagtggcggtcaccggatgtttgcctggaaattcgaagaaggatgaaaaaggcaatgtcgaaacaaagaaaaggaagagagaaagcgacgaaaatgaagaatgaatggtgtttatgcttttttaaaattggtaaaaagtgtttaattttttaatgtttaattcacttcaaataaatttttgactctaattcgaatgttttttgatatgccactgctgatcagttgatcatcaaaaaatgggcgaaatagccataagcagacattagtcacaatagtgatcaaaacagaccgatagagaagggtctctgtgattaattcgtatttggaaattgtgatcagagaatgcgatggcattgcccccctccttttgtgccacagatcgccgccacaatttccaacagcattcgctcgctgctgccgtcaatggtggtcatcggagtgagcgccttcatttctatcgctgtctatttattcaacaatattcaaaccccgaccgatggagcagaagacatcaatgtaaggaaacaacaaaacctgcccgttccccggtcacgaatttatttgcagagaattttttacctttttaaaaataatactgtcatccattatgagttcgttcggttatttgactaaattgttcaaagcgccaaaaataactatttacatttaaaaattaaaattaaaaatagtttttttttgcaacaattatatttttcaattcgtttaccaaaaaacagtcagctaaaatgttgttcaaaattgaaaaatatcttaaaggggtaaaacaccaaaaaatctcgattgaaaatgtgccaaacatttagccggtcaatgaggcattgttgagggatgtcgtcgaagcagcggagaatcggattgctgatgcgaatacgcgggccaatcgggtaagctattgagcacgttgctcaggcagatcagcggactgttcaggcagatcagcggactgttcaggcagatcagcggactgttcaggcagatcagcggaatgctcaggcagaaaggcggactgctcaggcagaaaggcggactgctcaggctgaggaggaaaaccggcaaatgaggcgcgaacttgagcaacaagagctggaattgtttatgttgtgttcccgtttagttcgacaattttgtgaggttggttttacagtgtattttatctatgatatatcaaataggaggggggggggggcgggggttgggaaaatgagtggttcggcggtgttataggcgccgcggttacttttttataatgtttaattcaatttgcaagattttgtccaaaatgactaggttttgggccaattttttaaaaaatatttagaactaaggacacttgggaactctgtcaaaataatgatgattttcagattgaccacaaaatcagcgccgaggacagaaaaattttttcgaaaaatactgaggttacgacatggatggagcataaccagctgagcaagtgactcaacaaaatgaggcgttcgaacatctgtaccaatcaatcattgacggagcgtcgggcaacgactatgtcgcgacaacgggttgtgtggctgggacgtcatccgccaacgaagtggcggtcaccggatgtttgcctggaaattcgaagaaggatgaaaaaggcaatgtcgaaacaaagaaaaggaagagagaaatcgacgaaaaggaagaatgaacggtgtttatgcttttttaaaattggcaaaaagtgtttaattttttaatgtttaattcacttcaaataaatttttgactccaattcgaatattttttgatatgtatgttgattttcatgataatgatatccctaaaaacaactaaagttcagttggtaattttttcctttaactcttaagttacatgacaaaaagtccgattgtggtcgcaggtggtggattggttggtctgtcagtggcctacggcttggccaagcgtggtaagactcttgcatcaccaaagtacaaaaatgtacagattgaaatggatgtttattttcaaggtgcgaaggaagtctttctttttgaacgccattggtacttttgcatttttaaaataattgttttcttggcaaatgcagcatcggtgctcacaattcgacacgcatcagcacgggaatgatcagtgagtgattgttggattggtaacactggggaatattggctccacaaaacaaacgttttttgaaaatagtaacccggggttttcgaggcttattttcacgaatataatattatttgcaaaaagatatgatattcgtgattataagtcacgaaaatcgccgggttggtctttaacaaaaagaaaatgattttttttgtggggtccatattttccattataaccgttggatttggtttcatttattgggggagtgtcggtcgaatttaacttgtgagctttccaacattaaaccctttagacaatccatgcttttacacggatcgctctctccaatccgtcgtacgcaaatcgcacgaattatacgcagaattggacaaccgcgggacattaggtaatccgtcaacaatgatataagagtctcaaaacgatgagactttgaaaaacttgacgacccctttaattccgacttcttcccctgttgttagggttcactcgctgcggtcgcgtctatttggcgtccagcgacgacactgccatccaagcgcggcgtatgttcagccgactcagcgccgacccggccaattcggcagccgaactggtcgactgtcccagcgaaatgctcagccgttggccaatggtggccacggaagacgtcaaagtcagtgggcgacatcgccgcaaaatttttgtgattttgaaccccaaaagggtggcgactgacaaccggcaaaaaaaaaaaaatttttttttaaattctttttcataaacgaggcgagaatttcgccagagaccattcaaaagtcgtaagttttcattgttttgttcagttggccctcttttcccccctcgatgccaccattgacgtgcagtccctttgccgtctgttgagtgaccgttgccgcgagatgggcgtgcacatccacgaaactgtgggcgtaaagcgagtgttgctcaacgagcggagaacgacttatgcagtggacacggacgaaggtgacagaccaacttcaaaaaaaccaaaaaattaagaaaaccanaaaattttctgtttttaata

SEQ ID NO: 4692 - DNA, 868 bp, Heterodera glycines
ggtggacgtggaggtcgagtacagtctcaggcattgtggctattacggtgggtttttgccaattcggcttgtgttggattgagcaaatcgcccattattccaaatgatggcatacacaattaataaacgcatagtattttgtgttttagcacttcgacacttgcgaatcgagaaattctacgtttattggggtcagtacacttttgaaacgcctttccttgccattttgaattgctttatttacacaaaaaacaggacaagacattgacagcatgacgacgcctgtcgaatgcggccgggttttcagggtggactttgaagtaagtcgaatcaaatgaaatgaagaattttatttaaagtattttttaaaattatcaaaataaaatatttcagaaagaatttatcggcaaagaggcgctgaacaggcaattggaacgcggggtcagcaaacggtttgtccaactgttggtggacgggcatgacatggacagggacccttggccgcacggggacgagcccatctacagagatgggacattggccgggtggacaacgacggccgcgtacggattcacactgggatgtcaggtgaaggcattttttacatggaaaatacgggcaaaatgaatatcgaagggattaaatcagataaaatggcacttcataaaaattgaaaactgacggagagtggggaaggaagggttagttggtatcggcacttttcatcattcatttgccaggtttgcttgggctacgtgcagaacgagcagttcggcgtctcctccgattacctcctgcgcggctcgtacgaagtggagttggccggcaaacgattcccgtgccggatcaatttgcactcgccctcatt

SEQ ID NO: 4693 - DNA, 741 bp, Heterodera glycines
caaaaagatcatcaatgacatctttcggctgcgtggaagacaacaaaggctgatcaacggagacattagtttttgatgactgttgctgttgcttttcctctccactcacaacagactgttttggttctccaagtataatgtcaaggacatctttcgactccgtggccggtggagacatcaatggacgaccaacggaaacattagtttttggtggctgctgctgcttcttctcctctccactcacaacagactgttttgatcctccaagcataatgtcaaggacatcgactcctgctgcattttcattaaattctttatgcacaactggggaggctttagcagctttagttgttgctgttgctggtgcaaccggtggcgatggtgaaggtgtcggttttgcagttgctgttgctttttttactgttacagttgctgaagttgctgctgcttgttgcgactgtgttactttgggatttattgctgctattgcatgttgcgactgtgttactttaagtgttgctgatgttgttgcagatggcggcggtggtggtgcgggtgctttcgttgaagtaactttgttatttgtattggactgattatttgctatagtgttcttatggggccaagctgatgaaacaggtgttaaaccgattgtatcagtcttttttccactgtttactgctttcactaccttctcagctgtaggaactgtactaccaatgctgggctttgttaccactg

SEQ ID NO: 4694 - DNA, 7351 bp, Heterodera glycines
caagcatttcgttgagaaacagttgtgcgcgattttttccacctgttttgggaacaattccaaaaagatcatcaatgacatctttcggctgcgtggaagacaacaaaggctgatcaacggagacattagtttttgatgactgttgctgttgcttttcctctccactcacaacagactgttttggtcctccaagcataatgtcaaggacatctttcgactccgtggccggtggagacatcaatggacgaccaacggaaacattagtttttggtggctgctgctgcttcttctcctctccactcacaacagactgttttgatcctccaagcataatgtcaaggacatcgactcctgctgcattttcattaaattctttatgcacaactggggaggctttagcagctttagttgttgctgttgctggtgcaaccggtggcgatggtgaaggtgtcggttttgccgttgctgttgctttttttactgttatagttgctgaagttgctgctgcttgttgcgactgtgttactttgggatttattgctgctattgcatgttgcgactgtgttactttaagtgttgctgatgttgttgcagatggcggcggtggtggtgcgggtgctttcgttgaagtaacattgttatttgtattggactgattatttgctatagtgttcttatggggcaaagctgatgaaacaggtgttaaaccgattgtatcagtcttttttccactgtttactgctttcactaccttctcagctgtagaaactgtactaccaatgctgggcttgtttaccactggttttagaacttgtggcgttggtggtgatgatgaatttggcgtttgtgctgcgctgctattactattactgttatttttcggtaattgttcttcgattttttgcttttttgtgctaatttctgaatcaatctgaagattctgtctgtcctggtccgctcttgggggagacgtagccaccacaactttctcatgcgttggtggtgaggttaatgtttcacctagagacctcttcctgcgctcactcggtggtgagggtgggcttaacagtctgggcctctcaatgaacgtattggtgttgctgctgctgctgcttgtttgggtgtcgttttttagctgttcaatggtgttgctctgatggcgtaatgttgcaacaataaagtctctcagctgttccacctttttatgggaacccttgggcaccggaaccctgatcactcgctgtctctcaacagcatcactttctgtgtcctcaaagtgaatgttgatccattgatcatccaaagtcccaatcgtggagtgccatgaatacggatagctgatgctgtgcagcccacacacccaggaaccattaaaataaattggttttggtaggcggaccctaaatttattgggctggttgtccgggtagtcagttacgttgcttggcaaaaacacaaagaaactatttgatgacatcacttattttcacatgaacgattaatatgtacattatgataagaaatactgatttttatacaatttgtgactcatgaatccactccctctccgggtaacctatgaatttgacgagcatctctgttgacccatcagcacgttttcgtttccgaaccaccttctcaattcgatagctcgtttcggcgtcctttcgaacacgtgccaactcttggtcataaaagctacccttgaactgttctcctttttcatcacgaagtttataacgcacagggttaacatggtgcagcacatcgtcaatttcgagaatttcatctccataatttggtaaataacctttctcaaactgccccttctctcgactcatgcgcacgtaatcattctctttgaatctcgtccttttctcgagctttctcatcggcgaatacatatcaccgtatattgtgtgccaaactttctgagcattgctaaaattcacgtcaatagggcgcattccgtgcacacggctcggcgctctgttgatcccatcaacaatacgttgcaccacatcaatccaatttagtgtttctttctgtgcaaagtacctgtacaaacgttgtttcacgtttcttatggctctttcagctaccgatgccttcacagcagaatggacgggttcgtgttttgcaatatcatgttcttcaaagaactccttgagcattcggttacgaaactctgtgcccttatctgtgaacacacgatgaggcgtcattggcatttgctcaaccagttgtttgaatgctagcagcatctcatctgcacgcttgctgcgcaacggcaccacaaataatcgcttggagagcacatcaacagctacaagcagatagcgatagcctttgttgtgacgtgaaagtgattgtaaatcggccaaatcaacttgaacatcagtcataaaacctgcggccacagtttttgacctcgggaaatgaactcgtctagggcgcagcagtgtatatgtgcggtgcccttccaaataattcacaacatctgaccggtgtatatcacttattcttttctttgcctcttctagtaatctactgacaccagcaaatgctgcaggtgaagaagggtcattgtataactgatcaagtgttttattgatcagctccacctttctggacggaatggcttcttgtaggtcggcggcttcggttttgtttgtggctgcggtttctttaatggagctgtccatgagtacaaaattggatccaatttaagcttctcctccaactgctttgatcttggtggaattttggtagcattacctgctcgtttgtctattatatactttatgatcatggacacattgctacgcgggtatggttttccagtttcttcattaataagagaatttccactaacacccattcgttcaccgtaatggttgcattttattaatattcgttctacgcgctgtttcatggttagtttatttggtggaatagaaaacagctttccatattttttactgtcatccttttgtgccgatgttgatgggacattgtagaactttggtgttggtgaatactctactcttgctcgccccttgcgtctttcaggtctcacacggcgtttgccacttttcttaccttggtgtttaattccatttctttttgttcgtggaagagtgggagcttcatctgcttcctcctcttctccctcaaatggctgatttgatgttgattgttcttgttgttgtagttgctgttgctgctgctgctgttgttgtggttctttttttggttctctttccgggatagataacttacttgaggtcgaagcttgttgcgatagctcttgttttggttcccttttgattatctgaggcggcggaggatacggcggaaactcatgcacttgttcatatttgggttcccttttgatctgagccggagcaggaggaggtggtggtggtggtgaatcatgtacttgttcatattttggctctcttttaccttgtggaggaggagcaggaggaatgatctgtcttaatgtcggtgtctgctgctgctggttcaattcctgctttgattctcgtttcggtgtagggcgaggcggaggcggaggaccagtacgttcatatgttaataggggttgtcgccttctggtttgttcccatttgggagatgaaggtggagagtaatatattttatttttttttttggttttttcaccatcaccattttcttctgtcatttttcttctgctcgcaaaactaaatcgggcagtgtccatttcatcaatttcatcctcatagtccggcagcatcggttcgccataatattgtgaaggagcaggtagcgtgtacccgtcttcaagcatgtaatcatcatcatcattatcatataacggtgctgcagctgcttcaacaagaagattccgtcctagttgtgcttgttgctgttgctgctctggttggggatgctgcagatgttgttcctgcaaatttcgctgtcttagcctccattggtgtacaggcatgtgtctccgcgttttccttgtttttggtggccggggtgggcgaggaggtctattattaggcggagaatgcccaccatccggcggtgagggtgggcgtagtgaagggcgagggtgctgatcgggtggaggggggcccggcgggtattgtggagcgtctgcaacacccatatcttcatcaccatcgtcccgcttaaatagtacacttaacccttttgacagttacacctttgttggtctgtctgaatgttccttcctcatgtgtaagtagcgtcttagttgctggttatactgaacatttttagcattcgcattcaccttcttcatctttgttcggtcgagttcctgtcgtacagcatcgagagtgatgtccccagtactggaagctgaagtgagcccccggtatagaacctcgggaattattaaaaatttattcgccattttttttgaaaatgagtacatgatatcaattgttcaactccttttattcttctcctccgcgactgattgctgatttggccatcgaaacgagtactggtgtgagaagcgctgcaaacagtccgccgactcctgctcctttctgtacaagtgtacgcttcgcaccctgttcacttctcgtcctgctcatgcagcgtacaaaatctgcgtacggcatcatacgttttctctgccgtgttgtcagctgaaagcatgatgtgactatattcaaacatatttcaaccacagccaacaattcatcgctctccgcattccgtatcattcgtctgagcttgttaggtgactttgttcgtgctaagcgacacaaaaaatgggcattttcatgtaccaacttactgattttggattgctgcttttgctgttgttgttgttgttgttgttgtacgcttctattgccttccatttttaggaatgaaaagcaccatttcatcgtcgtctttaaatatctttgtacgtagacgtaatacagggtctgaatgagcactcatgtcgatcagaatatagccgtatggttgatcagtagcttgacggtacgcgtccaaaaagtagtccaactgtcggggaaacagttgcacaccaaggttccgtactgcaagggttgaattcggtgaacgcataagaacaatatattgggcattttggcgagcaacctttatttttcgttcgaacaaattttgagtcacaaatataacggcaaagttctgatgatgagactttttggtgaacaattctgacagatacttctcatctatagacgtcaacagatcgtcaaggatgagcagaagcggctttgattggcgacgaataaattcttctggtgggactccagcatacacggatatgcctgccttttgcaacaccgggacagtagaactcatttcaccaaagcagtagagaatctcaaccggtgatggatcaattaagtctttggattccgcaataagttttaagagaaaggtgctttttcccgatgatgagggacccgaaattatcataccaaaaggcagttttaattgcaagtctttatctgtgaatgctgtagaagtgttcatttttacggttacaaataacggaaaattactactttatatacactcgtgcacacaaatattatctaatcagtttaatgtttcattattgactctattgcttcatcttcctcctttacgtcaaagtttgcttttacggtggacacatcatcatctgtttgatgctgttgctcctttgttttctcaccttccgatggtagaaagctgacagctgccgacaaaacatcaaccaaagtttctgactgctgagattttggaactggggccgagttggttgtagactgggagggaagaaatgtcgtcattgcagacattgtgtcaacaaagtccatgggttgagtatccattgtttgtgcaataatgggaggatgctgttcgggttgagaagggagcaatgttgacgctacagtcaaagaatcaatcagttcttggtagtcgttgtgctgctgttgcttttttggttttgcactgttaatattggaagaaacatttttggatgctgtactgtcaacagacgacacttgagaaacattcacagcagcagtgtgtgatcgttggacattgcctgtattttgtttctctatgtatggtgtagcagtagacattggctgctgctgtccgtgctccacattaaacacacgccccttgttcttgattttgaaaaaggtatacccaggcaaatcgtaaacacagtcaaacggcacgaaggcggtgccattgatacgcgtgcaccagaccgtcacaccctcctttgtgaccatgtaatccatttccgcctcggtggacttacagtgacggcatttgctcggaatgtcaaacggaatgactcttggtgttgacagccgttcgctcgacacagttataccattggaactcagggtaaaattaactgacgggatcatagcattaaaaagagaccttttgtcatcaatgttcaaagccattgttgggaagtgctaatttttagtatagagtgaaagataaaagaaaattaaccgctatttataccccttaaacccattgaggtctaatgtttgcataacctaatttctgtgaaattatgtgaaaaaacaatttattacgtaattatttgtaaaagttttgttagttccattttaaaaatatgaacgatacgatttttcaaaagctgtcggtgcatcaccatctttcatccttcaattcttggttcagcattcattctcaacaattgagtggaaactctcgttgtcggacacgctcgagcgctcactgtccttaaaaattaatacgttaagtcttaaaatttatgagaactaaactgaccactcggtcatggtgctgctgctgctgctgttcagcattcggttgtgcaggaggacgaacatcaatgatcagtggctgcggcctgcactgttgctgcagaggagggaaccgtgccaggcgatgagctcctatattctctgcaccattttgaaaaggtgctcggctacggatccgtcttctcgacatggttctcggacgatggttcatgagcagacacaattgcatcagctgtacacaacaaaattatttgttaaaaaactacaaaaaaatccgacctgtaggaccaacacaccaatgacgaacagaagcagaactgattgcaattcggacgtttgttgctttggctgctgtactccttcagcaagaaattgggtgaaattgaggacacttttatgtatacataaaagtggtttgagatagttaagtgtgcgaagacagtagagattttggggacaagtacagatatctgcagcgatccactgcatcactataatttttttaaaaaataaac

SEQ ID NO: 4695 - DNA, 3507 bp, Heterodera glycines
accttcgaagctctcaaatatgcgccccgtttgtccatctttacgccgatttcttgcagtgcggtggccaaataagctgggacgagcaaaaaacggagagagttcgtcggaagttcttcgacggaatcattggcactgaacaacgaaaggccatcgattgttttggccacggattggagagattggatacaatctctcaagacgttctgaaacaatacgaacggaaatgtaaggatgaaaatgccaactcacattcctttgcgcaaattgcgaatcgccaagacggcccttcagcaaatcatcgacgacgcactcacaacaatcgaactgctggtcgagcgatttctcggactgactatgagacattgcacaaaaaatgaatacccctatgtaatttgtttaaaaattaagtgaaccaaacaaaaatagtgggaaaataaaattattattttttactctctcattttttacgtacaatttttttattcggtagagataaaaataaataatgaaatataaaatttggtttaaattggaaggaaaaatttgtatggttctacacaacatttggactgaaaatgcctagaaatatttttttggtgccttttgcccttttaaaaaacgctttacacaccccttgaacattgtttattaaaatgcactttaccaaagtaataaattaaatcagtaataagcaaaataaaagtgatccaccagtgttgccagtcaatttgaagcaaaaatgttttgtgggaaaaacaattgatacccttcaaactcgtaagcttggagaggggaaaggaacaaatttttcgcacaaaactgtgcaatttcgggaatgaatatcaatcaaaaatttcgagtggtagtgagtcaaaaatgccataatttcaaagaagcggtgtgtttttgattttcacgcggaccaaatatttcagacgaatttgcgattcatcgtagacaatgaacctacaaaaagttgaagattagatttatcaaactacctaattatctcactcattgtatagcaaagaatgaccctccgcgcctgatttgattgcttttccacatggaactgttgctccgtccaattgctcgaattcggatggatttggcactgttccaccaactccttaaaaacaatgacatagacttacatcagaataatattaatgaaatttaattacctttcacgctgtgtttccctcttttcggttttctcaattccttggcatctttttcttcctgaatttcgcccaatgcgacttcacacaaaagcagcagtccctcgccattaatcacataacaataattggctgattttgacacctaaacgccttcctttttgttattattcacaatcgaatttctattcaaaccatgtccgccaggtaaattccttttccaaacatatatccagtctaaagccacaaaaaaatggtgagaaaaattaatgcaaggactgaccactggcgcttcggagggcgcaatgcgaagcccctggctgagaatgcccacgtaatttgagagacggcctaaattggcaaaaatgttatttttctgaatttggaagtaattaataactcactcccatgccaaagcaaatgcaaattcccaatgtcccttttgaagcgtttcatttccaattcgcgttcaattttaagaacctaaagataaaatgggttttaaattatcacagaaaaggaacaacaacattgatgatttccaattggaccccgtgagtgggcgcatgaccaacttcgacgtatttctttatcagcgaaaactctcgcgaattttgctcaagaatcttaagagaatgttgttgttctgtgatttttttaacggagtacgtacttccattttgcagttgagcttttcatagtgtaaatcaaatgcgtctttgtcctttggttccttttcctctgacttgagcaaattgtaggcaatttcaatctcaagcaaattgtccaacatgccacacttctccttcaagacgttcaaattatcgagaattggcggggacttcagcccagtggcgtgaggaatgagcgtgtaaaatcggttggtgaagtccacaaagactccccgagaagtgggctgcgctttgccatcctctttcctctccagaatttgttgcaattcggtcaaaactttgtacgccttgagaacgtgggaacggctgaggcgaccaagtggcattttagtaaggtcaatctgaaaaaaagcaaataaaacccaatagaaaagatactgtcacacatctaactcccgcaaagtattcgtgaatgcgttgacatcgaatatcatcgaaagaagttctttcaccggacgagacaaacgtgacttggaggcatcaatgtccaacttttgggtttggttctcctgccaaaaagcgggtcgaaaaatgtttcatttctcattgcaccattgtacctttttatcggcaaaatccacttccacaatgtccattccgctcggatttttcttaaaattgccagcgatgtacgactcccacgtgttcagtgatttctcctcaaaaagccttaaagcatttgagtaaatagcataggattgtaaatgttttgttctccttaccttttaaactcatcggtgcactcttctatatcagtcccataatccatcccgtttttgttcctccaattaccgtcccaactcttccccaagcgcggaacaaataaaaactgacaaagcaacaaaaaaaacaggctaaaatcacagggaagcaaacttcgatccgaaatcttctttgacaatttgaagtttataataggaatttttcccccgtgaaatgtcaacgacggacaaattggcttgccaagggcgttctgatgcaagggtttcggcatataagaacgacaaattccaacataaacccactggtttttgggtcgagatagacatgacattcatccgcaacttcgcatctcggatctggttgtgagatgataaatttaaagagaaagtgaaaattcacgaaccaacaacaaatccatgcttttcaaccaacttcttactgccagacgcaccactctttgctatatgtttaaacaaattttaaggacaaatgacaaaataattctatttgacttacggtttgttgctcgctctgccgtgttcaaacttttaaatgccttcggtttcacaatgatttcttcggtcagtgctgcagcagggtaaagtctggcaggaagcagctgaaaatgttcatttcaggaatatgaattcgggtgacgatgaactagaagaaatcatggagaaaggaacccctgattttgcagtttttatttcaggaaaatcattatctgggggggaggggggggggggggggtctcgtgacactgagcacgaatatctaccgtcaggtttttatcaaatctatgactttctcatcagaggccgaaacttttttatgatcgttcaattgcttaggggcccctatgcccactgtttcatgattgtcgataaacgcaccgctgtcttcaa

SEQ ID NO: 4696 - DNA, 1703 bp, Heterodera glycines
aaatccatgcttttcaccaacttcttactgccagacgcatcactctttgctgtatgtttaaacaaattttaagggcaaatgacaaaataattctatttgacttacggtttgttgctcgctctgccgcgttcaaacttttaaatgccttcggtttcacaatgatttcttcggtcagtgctgcagcagggtaaagtctggcaggaagcagctgaaaatgttcatttcaggaatatgaattcgggtgacgatgaactagaagaaatcatggagaaaggaacccctgattttgcagtttttatttcaggaaaatcattatctgggggggagggggtctcgtgacactgagcacgaatatctaccgtcaggtttttatcaaatctatgcctttctcatcagaggccgaaactttttatgggcgttcaattgcttaggggcccctatgcccccttttccatgattgccgataaacgcaccgctgtcttcaatgttttcaagaacttattgccagatttcatttgttttggaatgaaaaaaggccttctttcgggagtccttgtggtgtaaaggcatctggtatattccgacaaagttccatagcatttgtaagaatgggtggtcgtgctaaaaattaattgacatggaaaataaatataaatgtgacaacacctgtaattcaatggtccgttgcactgtggacatggctgagggacaccgaacaccacaaagtcgaccaacttatccaacatcgcttccgcaccgcccttcttcggtttgaaatttccgttcgcttgcagtaattcctcctaaaacacttttatttttgaattaaagttaattgtgagataaaaatttaaacattatgatatttgaaattctttaggtttcccatgccccctttttgagttattcttaaaaaatagaaatgtattagaacgaaccatttcgctgctgtccaaattttctcgtaatgcaattcgagtattccataacagttcggattgtttctgaaaggcaaatttagacttgtcgggttgatttaactaaaagaattaacaatttattaatgtgtgtccgtccacctttagtgcctctgtttgttccttattttctccatcacttttcatccttttgctcgtcggtgtctccgtctcactgatttcattctttcgtttaattctaatacaaattgttattttagggaagacataaaaagcgtatacccttcctcagcgggcgtttgtgttgcttttggaaataactcatccaaccgcttttgctcatccgcgtttaagtcattgtatccatttaagctataaaaaactgggattaataaacgataatatgattttagctagaaatgactcactcttccgcacttttttgaaaaattccaagtgaatgaaaacattcgaggtggtagaaggatgctttgcttgaaacacgaaggtccccttttgcaatgctgtttttgcatttgtaacacttcgatgaccctgaatttcgcgtgctcaattgtcattacggcggctttgggtgtgtaagcagaatcatcggactctgaataatattgtagttcctgtaaaaaccagtgtaacctttgagctccgtaattcgcgcccgaattctctcttggtcctcccatttaagccattccattccacgaattgaggcttcattgatatcatttttacgagcttttttcc

SEQ ID NO: 4697 - DNA, 1659 bp, Heterodera glycines
gattactttttgatattctgctccatagggcggctcttttggcgtttcatcttcattctccatgttgaatcgaagttgtaaaaagtatgcaaaaatcaaaaaaatgcgatttacaaggaaaaagagaaaatatgtcagtataagtagcaaacaaatgcctaatcctaattagtaattacctaatttcgtttttataaaaaataatagtttcgccataacaacaatgccaaaatttaagtttttaactaacggcactgagatcttggattttcactcaaacgtttttttctgtttaagtattcaacaacagttcattaaaaatggattctatagaattaagccggtctattttatatacataaatcatagcctacaatacatactgagatgttggcacattatacacatatgaatttttcttacaactcatggaatgaaatacgtatgtggatagaaaatgaatgattaaggtagaacttcagttgaatggtaattgaacaaacatcatatgagatatataatattcttaaacatctcgcaccaccattttctcaggtagtcccgtccaagaacacatgagactcaactccgccatgcccgtagctaaaattaaaagcaattataaaatggctatttcttggttgttacccgcgaggtccaaacaatgcgccgtagcatcgctcacaatatggctttccgtcgtgctaaatcaattcaaaatcgttttgtagtccacaaatttcttgaattaaatgaataacttcgcaatgcttcccaacggtgagcgtcttcttacaggcagaattatgacactctaaaaagaagattttctgttgtagtaacagcacaaataacacagaagcaacgtacggagacaaggacggtgccaatcttttccaatggaagtgacgcgctcagctgtaaaaacaaacaaaaattaattaattgtagacatttatatgaacggaccaaaataaacaggccgctgacatttgggacaaagaggcattttgggaggacagagtttccaaactcacaaccacaattagatagttctccaaatacgcaaataaattcttcaaaatggcctataaaaaagaaaatcaaattgaaatatcggaatgcattgattttgacgaattaaaagtaaattgttaagagttaaatgaaaaagaatgtccgcataacaatggcaaagacgagaatgaattttgataaaaaaaagagagagagaaaggatgattatttgagggggttttatgatgttatgtaaaacacaaaggacataatcaaattgtgtaaaagtgaacagatgagtaaacaaacacgaagttacatatttaatgtgtgtgtgcttttaattagtaattacataaattccaagtgactgctttttgtattattttttataaatttttgtttcacatatttcttacggatgcatgctccttaaggtaataaggtcttccttgttttgctacccccccccccccccaaaaatttaaaaaatcacagatattttgtccagtctatgaccaggtatcagcagatgtcaaaacaaataccatattgatgataatcagtgaccttaaaaagcccaaaaatagtaatttttaaaatttttcgaggggggggggtgtagcaaaacaaggaagtacc

SEQ ID NO: 4698 - DNA, 1773 bp, Heterodera glycines
cctcccattccattccaaccgacaaaaaagtggatggatagcagcgaggtgcgttttgttgcacaatgatggacggaattgtgccctgctaggcggatgggtggggtcggtgaagcaaagcaaaggaaagggacccatccccgtgaaaagacccccccccccctaactctgcacaactcatcattctcttaagcaacaacaacgcgtctgttgtaactcctttctttcatcctcttgtcagcgtcaaaagtgtttctacttatcagcgagcactttggttttgcgccattgactcaaaaaccagtcagtccttaggggaaataagccgatttttgtatccactcaaggccaatccttaaagagacgactttttgtacaaacaacagaaaagtgtttactcatacatataaataagtgaaagatgaggagagaagttggaattaataaagtgaccagcacaaattattacgattaaagaagaaaagcattaaatgaaaagacaattaatttaacacgccgtactttaatttgctgccaatgttcggaattgaactcaatgattgttggcaaagacaaataaatgtttgagggctttttacataggatgtaagttaagttcgcgcacaatttgttattggtataaaaattcagtaaaacgtaatcataaaaaaattaaacaatttcattaatttatttggatgaaatttaatttttaatcattttaaattttttatttatttaagaaatgtaacaacactccaataatttatcccccccccccttctcctcgccacttttcgtcgtttggtgtccgttccaatcgaatggtataatttatgtgttcgtttgtcgttcgttgtcccatcctttccatccaattcttctttcttcacttttttcttttgtcagtgtctttttataatcggtgtttttttgtcgtttcttctaaaatggaaaagtaatttcagtttcttttgtgatgtgtgaaagtgtgcaaaaggataaaataaaacggaaaaggaatttaacgtcgacaggtcagaaggggatcgtttctttttgtatttcattttggcacgaaacacgaaattttattcacttgtaagtatggggggtgtgtgttctgatgagagaaaaattgttatttggagattgggagaaaatcaaaaattttattgaaaaaataattaagcattaacttttaatttatgtataaatatttggaaaattcaaaatttaattatttttaattttactacttaaaaatagtaaaatttgggttttctttgcttttaaaacccgggctaaaaattcaccattgttctttttaggtgaaaaaactgatcaattttggacaaatctgttaacaaattgtactcaaattttcaaaatttttcctcggcggcgactttcggcaccgccggtcctcctccacaaaagatttttaggaaaataatgcgtcaagaaagctgaaaaactcgttcgtagattatattttaattaaggaattttggagaacttacaaatttcaaagtaattaattgatttttaaaaagagtgaaaataattaatttgagtttttttttgattgattaaattttgagaatgcctcaaaaattttttaaatttttcagtaaaatttttttttcgtagttcatgtgtggttaaattcaataaaaattaaactacctaattattaaagaaaagtacgttgacaattgcacaacatcgatggctttccaagaaaatcagatacatttataaaagcgtagc

SEQ ID NO: 4699 - DNA, 3367 bp, Heterodera glycines
  misc_feature (50)..(50): n is a, c, g, or t
  misc_feature (57)..(57): n is a, c, g, or t
attcattcattccattcatcaccaaatgcattttgcccgatcgccgttcncaccacncaagtgaaacccccttcttccccccccccgcttttctcattttctcactttcccccgccaatttgtctctcttcccatctccaaccaattttctccatttgttctctctcaagcaaacattttaattttaaacaacaacttattgttgcagagaaacacaatttttctctatctctctccctttctctctctctctctctctccaacactctcttttctttgtctctgtttcttttcattacgcctattatttgacttattttcatttcgagagtctcgcatcggctgtggtattaacttgaaaaagcaaaaactcacttcattaaaagaggaagtgccattgcctccccccccctcgccaaaatgccacaactcaattgcacagcttcggcaacgatcacttcctcagcacattcccgccatcacatcgatgtccccccagagccgaaggctaaacacgacaagcggaaaacatcaaacgggtaaatatatttaaataattttaaatttaaaaacaatttgacgctaaaggaaaaaaaggaattacccaacgggggaagggctctttcttatcacttaccaatttatcattgaatttcctccgttttttctccccccctttctttgaactttatttacaaaattggcttaatgagagcagaaatgtaataaaatgcatttttaaatggtttttaatttccattgtttttaagtgtgtgctatcaacagacgccgaccgacgaaacttttggcgcctcgcaattggaaaaattggcggaattacgcaaagaattgggtgatgagctgctccaagagaccacattgctaaatgacaatttgtcactaattcgttggctaacgggatggaacaacaaaattggtggctaattaatattaccaacgataagtcctactaattagtcaatgttatgatgccactttcaattacttttccaattaaaatggttcgcttttcgtttcgcagatgaaatcgtcccgcgtttccgtcgtgccgcttctgtgttccgctgtttgaacctcaaccaatttgtgattgaggacatcgacgatttgaacgacttctcgcggggtgtctcagccggctccgaatattaccccgggggcgtattgggctacgaccgcgagggaaacgtcgtgtcgctgcaatgcatgggactgtcccatccgaaacagttggccaaatgcgggcgcgtcagcgacgtgtatcggttgagcatttacgagaccacactgatttatcaggcaaagaattgacaaatgccaaaagaaagaatttggggggggggacgaaatggaaatggacgagaaaaacaaagaatgaaaatgatggcatggggtcaagtcgagaatttcagcttatcaaaatacaagagcggaaactcggtcgcaaactcggcctgaaagtgatcatcgacttggacggcttcaacaccgaccatttgagtacaatcgcattgaaagtgtacggaaatgtgctggtcacaatgcaggtaatgctcaccgaatttctttctcaaaacaggatttaaataaattaattgtgccctctttaaaggaattgtttcccgatttgttgcggcaaggtgaaaattcacaaaaaaactaattaattaagtaattattttatatttaagtgttcgtgatcaatgcacattatttggtgaaaacggcgtacaacagtaattaattaacaaattgaccaattagtcccctaattgccctcccccctcttctttttcagtcattaaacccgttctgtcggagcaaagtcgtgagaaggttgtcttcttgggcagtgatttccacggtgtgttggcacgcgacattgggcccgagaatttgttcatccgttggggagggacgcgaacgccgacgcgcgggcacaccgaaggagggacacttcggatgggaggagtgccaccggaaagtttaaggtggaaatggaaaagtgaagcgaagaaagagggggggggggagaaagagagaacgatgatcagagaaacaaaagagcgatcagtgaaaaaacgaaaaaaggggaagagaaaatgaaaacggaaattaaagaaaaaaagagaaggaagagagtggataagcctgtgacaagggaatcctgttcagatattgtgccaaaaacaatcccgatcacattgacgacgaagagctaatcaaattgaatgtgcccgccagacagagacgcgaagtggaggtggaagtgccggaaccgggcccacactccatccattggcttttccacacaaatggcgatttggccttcggcatccatcgaagtgacgaccaaatggaggtgggattggcaaaaacaacttttttcaaatggattatttattcattcaaaggtgtggccaactttccatttgctgacggattacgtgccggagtacggtaaagtgcgggtggagggcggagtacggtacaagctggtgttcgacaactccggtggcactttcttcagtcgagaagtgaaatacgggcttagagtgaagaaggttgaggagagtgaggaggaggagagagagcacggagcaaaagaagcagagaaaacgaacggagtgacagcacggggagaagagagacaaagcgtggccagagacaccgaggaagagaaagagaacacgatcagagatggagagggaaaagcgaaaaattaatgggaagacaagcagagacgacagcagcagattctttcccttccctaccgtaacccatcaacacacatacagtaactatttatacgcaaaattttatacagaaattaagccacttttacatgttgtgatatttgaatatcagtccgtgattggccgaataaagcttctctccgttttctcccttatgttttgccccctctccgtctcactcaccgtctcatggacaatccgccgcccttgccaaagtctttgccctccccgccacaaatccccccccccccgggggccattagtgtgaccactgctaatcgaccgacttggaagaggaaaagcgggagggactcacttcggattctttcgcggacgggcggcgccagcggtagaatttaacggacggagagagggggaggaggggggggggagaagagaggaggtgccatgccctggggggtgcctttgtgcctttgtctcggcacaaatgcaattgccttggaaaagttcgtcgcttttcaactcaaatgggcgaaaccctctcaattcggcccagggcgaaaagagagagcgaaggagggaaaatggcggagagtgaccgacccaaaacggacgaagaaagaaaggat

SEQ ID NO: 4700 - DNA, 3131 bp, Heterodera glycines
cagtttggggacgctgtccactcttgtgaaaaatgaaaatccaaaattccactaaattctgtattaaggcttttggtgtttgctcgatcttcgacttcacaatggacctatattatgaaaaatgtgtacgcagacggcactttcagtcggcgccacctttttcaggtaaatttatgtcctcgcaaagtaaaagcctaatttctttcatattttttttggtttttaaggcgaattaattggattttgattacgtactgccttctcacttcaagtgtgaagcattgaacacgtatgcctcaactgattgtcaaagatggccgaatttttcgcctgaaacttttcgttggacttcgaggtggtgatatcgccgatgcgagaattcttcgactcttacgggcatgccaatgtcaatgttaatcccgatatcatcagcgattttctcgttggtacattattcgaatttatgaaatgtgcccgtaatgatttttcaatgttttgttttttttattggaaatacattgataaatatgttttagtattaaattaaacatttttcgaaaaaaaaatcagattagaatccatatggcacaaaatcagcttgccagactaaaacgaccccctgactaaaacgtcacctcagactaaaccgacccctcccgacctttggcggtttttagaaacgacccagcacgagcaaaatatacaacgcaaatcgccaaaaaattaatcgcgtaaaaaaaacattttttattgcatttttgttaaatgccaaaatatttacaaaaataaaacttttatttttcctaaaaccccaaaaatatttttttttattgactaaaatgacttttaaatgaaaacatttaagcgcaggaatgcttttttgagctccttactttaatgcaattaggcaaaaaaatatttaaataaattacttctcagcactaatgattaattaagacagcaagtcgttaagtgacttaggtgttaattgacttagccgcagcagatgtctcagcggagaaaggtccaaattcaacccattcagaagacaaagtgacaacaaaaaaatgattctaattacctaatgttttttctgcctaaaaatccctacaacaagcaatatttgttagttgtctaaaatttacattcaaaatgtaaaatataatttacaatttttgcattttatttttgtgtataataaatgtgcaaatttattggaccttatgattgattattctctgcttctctctttattagcaataaatgtttgataattctttctctaaaaagatttttcttgaagaaatgctttatgaataaaaatgcaaaacatttaacgattaaccatgttttagcgtacataataattgttttatttaaaaaaaattattcacattttattattagcttttattattattattatattcacttttttttagaaatgcgaattttcatttgcttttccgcactttttctgtcaatctgcgcattttttggtgtgttcttttcattatttctgcttttgtagtaattaattaaacaaaattttagactttaagccaatctttgcgtatgatccgttggaattttttgattatctcatcgaatgcgatccaaaggccaaaatattgaccaaagtgcgaaatgatttttcagaaggggtcgaagtcagtcaaaacgatgcgaaagaattggcaaaatatttgagcagtgaaaagggaaataaaacatttggcgaagtgattttaagtgaggcgagtaaatacgacaagaaaagggagcaaatggacagcgaaagtgcacaaaatgccaaaacacccggaaaagcaactgaaaatgccaaaaaagaccaaaaggcacaagcaaagatgaagacggcacaaaaatcatcgcgtagaacaaacagattagaaacatccctgatgggatcaccgaaaagaattggaaatgccataaaggagcacgtgaaaaaatttttatcacaaggagacgacatttgggctttaatggtcaaagtgagtaaaatgtatgaacaatatgaagagatgtgcaaagaaatagcagaagaaacgattaagaatttaattaaacagcaaaaagttagggagaaatgctttagacaacacccactaattatgctaattgacctattcaaaccgcacttggaaattgcacatgatttgagcagcaaaattatgagaaaacgaacccaagtaataaataattaaaccatttaagagcaattagctaaaaattggtgagctgtttaattaagatgagaaagtcactgcaaattattgccaaaatattttcggaatattatgaagaagaatgggaaaagttgaagaatgaaattgccaacatcagattggaagaactgaaaatgctttcggaaaagatggacgaattcggaaagaaattttgggaagaaattcaaaaagccgaaaagagaaaggaatgaaacggaggaaaagaaagagagacaggcgaaagagaggaggaaaaaaagagagagaggcggaaagagaggaggaaaagaaagagagaaaggcgaaagagggaggaaaaaagagagagaggcggaaagagaggaggaaaagaaagagagacaggcggaaagagaggaggaaaagaaagagagataggcgaaagagaggaggaaaaaaagagagagaggcgggaagagaggaggaaaagaaagagagataggcgaaagagaggaggaaaaaagagagagaggcggaaagagaggaggaaaagaaagagagacaggcggaaagagaggaggaaaagaaagaaagataggcgaaagggaggaaaaaagagagagaggcggaaagagaggaggaaaagaaagagagaaaggcgaaagagggaggaaaagaaagagagaaaggcgaaagagggaggaaaagaaagagagaaaggcgaaagagggaggaaaagaaagagagataggcgaaagagaggaggaaaagaaagagagataggcgaaagaaaggaggaaaagtggcgaaagagaagaggaaaagcatgggaagataaagacaattttctgtctcactttccattcttccgatttcatgcaagcattttatactttttctattggttcttaaacttttgta

SEQ ID NO: 4701 - DNA, 3727 bp, Heterodera glycines
aatttcagggtgctttagtgggacacagtattttgtgtacaatttgtcaattgtttcgttcagtttcattgtcgttttcgaagagtgcctaatgtcccgtcgccgccgggtacgccttcgatttgttggatggccagcaagtggaccttttcattgcgccgccgtgcaccgacagtgcgcaagttgcacttttcgtgtccacattttacaacatcccttccatcacatggggccagaattcggactcctctttcaattaagaaaattgctaattaggccatttctcattagcacgtcgttcgtttagttcgcagagcaattaccccactttgctgagtgcgcttcccaattacgccgagtgagtcactcactccgttttcctcccttttcaattccgccgatggcattttactccttttgagctttggccaaattatcatttcgctgtgcatcttcttcaagtggtccgtcatggcactgatttatcagctcagcgagacgggtcaatgcgcgtcgttccagcaagacttgcagatcgcgatcaattccaacgacaaatgcgatatcagctacagagaggaagtcgactttttagtgggataaaagtgccaaaaatattgattgattaattaattaagacaagggataaaaagaaaaagataacacaaaactaagtgtcttaaggttaagatcagttctgcgggcaccagcgacgcccaatacaccataagtcaaattcagagcagggcgagaagtgagcaaatggggggggggggggggcaaaaggacaaaatgaatgaaaaatggaatgtttaatgagcaattaaaattatttataaaattaaaaccaatttttcttctgctgcagtcgtcattctttgcttcgacgagtttgttcagctgcgcaactttgccgccaaacttcaggagggtggcttggactccgctgactacggtatttggctttgctttgcttgcctttttatacccctccacttttcccattcatttttcgttttgctttcagtttatctcatccccggactcaccatggatgatagtattgaaagtgttaattgtgtcttttataaaatttaaatttgcgtttgctttttctctgtttttaatttactttttgttttgggtggctccaaggccaccgcgtggtgggtcgacccgaacccgaccatccaatcagcggcctacagaattgctcagcgcagtctttatctgatgttggacatcttcaacaaaggtttgtatgctgtaatgggatgagatacggtagattgtttttgccatttttgcgaatggatgcgctgcaccttaatgagtcttttgtagtcgcaacttcaggtcaagtgggcaacggcacttcgtttgatcaggaagtgatcagacaggtcacccaatggcccttcttctgtaccgattgcgatcagtcgttgcaggtggcattcatcttcatgctaattagttaattaattaatccgctctctccccttcattaggcttcttcttacgcccctttgctccacgacagtttctatttgtatgccatggccctttccaaagcggcaaaaattgccggcgcattgtcaccttccgtttaccgaaatggccaattgattcgctcccaaaccgccaatttgtcttttgaaggtgaccaataatttttaaacgaattaaattaacaaataatattaaaggaatgacggggtcaaacaaatttggatctgatggacttcgtaatttcatttaccttgtctccatgtattcgagcttgaacggtgacttgacttcgtatgtgtggctccaaatgaacgatgccggagtggtacaaacggatgcttagaaaatattttactgaccaattaccgtaaagaattcttcatggattaatgccacggccgagaagctgatttggtcgagccgaaacggcgttaagccattggccgtgccgttgtgcggatttgacggcaacggctgtcacatggacttcttcacggagtaccgtgggtatgtgatcgctgccggctgtctgttgctgctcattttgggctcgttcgccttcggcatttactggctgttccaatccaaggcgcgcgagatggaacggcaaaatcgcctctggcaaatcgcctacagtactctgacgccggcgggcaccaaagcatggcaaaaaaggaccaatttgatatgatggagggaaattaagaagaaaatgatggaaagtgtgcgctctctccagtcgagcacttcttctcagttcacgcgcgactcctcccattcccacgtttccatcaaacacaacttcaatggcatcgtgtacattatgaacggcgagcgggtgatcggcattcagcattcgggtgaccattttgtgccgaaagcggatcatttttgaaaatttaattgttcactttttaagttggcattcgactcagtccacaggacatggccgagctgagaactgtgcgtgcacaaatataattgaaatttcgcgtgttggtctcagatgcgccttttggatggagacaatgtgaaccgattcatcggcctttccatcgatggcgccgcgcttctctccctgtggcgctactgctcgcgtggccccctttcggtccttttttggcactttttcttgacatattgtcaaaatgttttctaatgctaatgacttcttttccaatttggaaattcctcacaattccttttcattttgcaggacgtgatctcgggctcttcctctctgaccatggacggcttcttcatttattcgttggtccgcgacgttgccgaaggattgcgcttccttcacgcgtcctcaattggtcggaaataaaattgatcattttgctggtgataaaactcgaatcaactctctctaggatggcatggcaatttgcgttccaccaactgtttgatcgacgaccgttggcaaataaaactgtccgagtttggtctccgcttctttcgtgcacacgaaaaacgggaggcaaaaggtcctatcaataagctgtaaaatatttgtgaacttcgatattgaacactggggaattcatcctcgagaacaacatcattagcataattggggccatttgtgatattcgttcgcagatttggtttggacagcgccagaattgctgcgcgataatgacatcgttggcaacaaatttggcgatgtttacagcttttccattgtttcttccgaagtaaaacgttcttttaaatgattgttttcttttgctttctccatttttgattgtgaatatgaagccaatttgggagcaggacgaagcgaagggaaatgttgaaggtaaaagcaaaataaatcaaaataaattgaaatgttttattaaagagtttgtgtatatggtccgaaccggggggaagagggcatttcgtcccaaattggagccgagcagccaggacttgtccccggcactgctgcatctgatcaaggactgctgggacgaaagccctgcagaacggccaaaaatggagacggtgaccgcacttttgcagtcaatgaacacgggaaggtgccgaaatgaacaaataatgccaaaaaacaattaataaagataaatgagcaatcagtgtgaatgaacttttggcaaatgccgtttttctgctgacatggaatggcaaataacacaaaaagcgttattaagcatttagtgcctttttcttttttttacttttttggagtttacgcatttta

SEQ ID NO: 4702 - DNA, 2570 bp, Heterodera glycines
ttaccgtattcttctcggtcggtttaattaaatactgtcattcattctttttaattattttattttaaggacgtcgtctcattcacaacaatcgcttcaaaatgctcacctttgcaggctaaaatttgaattcacataaacaaattaaaacggtttaaaggtggtcaatttgctgaacaatctgtacactctgttggactcaatcatcgccgaatttgacgtgtacaaagttgagacaattggtatactgtagggctcttttctgtatttgtattattcttgaatggtgtaaaaatcatctatttgcatgaattaattacaataattaaccatcccaaattggccaccattttccaggcgatggttatttgtgcgtgtcgggccttccccaccgcaatgggcatgaacacgcgcaacacatcgccaaaatgtcgttggcattcatgcgcaacttgggcagcttcaccattccccacttgcccactgaacggcttcgtctccgcattggcattcacaccggctccaccgtggcgggcgttgtcggtcagttcaatccattgaaattgaccttttctcgtttaaatgcttaatgataattggataggtctttccatgccccgttattgtctgttcggcgacacaattaacacagcggcacggctggaaagcagctcaaagcgtaattgggcattttgtttttaagcacctttttcatgctttaagcgatgcgaattcacatttccacgacgacgaatcactttttggtcaatgttctcggaggttttgtcacccaagcgcgtggagaaattttagtgaaggcaatgcttttcccttgccttttataattttcagggatccatctcccctcgaatatttattgtttgggttattactctttatagtacactaccgtaaattgtccccccccccccgctttagggaaagggcgttctcgaaaccttttggttgcttggcctcgaaggcgacccggcggtgatgcgaatgttgcacagttcggacggtaataatgcgacgatggaatgaacaaaaacaaattggaaagaaattgaacacaaaaggagcagaaaaaccaaaagaatgaatgaatgaatgatttgtcatttgtaaaaattaaaatgtcggataaaaaaaaatcgaaaggaaccaattaattaacaaatgaagtaattaattaacacagagagagatagagagagatcaacgctaattaaggcgtctttcttccaccgattggtttatctctccgattccaattaaaagcctttcctcttccgctgaaatttatttaaaaattgaacttccgaatcattttttaaaatgccttcccattttaattaacaactgaaaaattttcaacaaaaatctcttttcacaatatgcgctcttacagtactcacctccattttgtacggtcgctccacaaattgttttttgtcgttttccaacaatttcttcagttttctcattttggccttcactttgtcgctttttcccgtgtttttctccaattctttgattgctttttccatttcttccgccgttttacaaattttctctttttttggcgtgtccattgtcagcacaatttccatcgctttgcttccaatttctttgattttgtccactcttttctccaatttttcactcaattcctctgagttttctttgtcgtcaattaggctaatgagtttgctaatttcgggttccaaccgtttaatcagttcttccatttgttcgcctgcgattttcttcaacggttttatcaattcatttgctaaccgaaacaattcttccgctttttgcagatagtccttctgtaatatattacgtggatttatttcctaattgtgcttattatgctttaccataatttggtccgattcatttgcccaatatgaatttgtttgccccgcctggcttaattcggcatggaaatcgggcataaatatggccaattcgatgtctccaattttggcattttcaaacatttcccttttggtgggcaattctttggccaaaatgcttaattttgtgtccattatgcgattttgcaaaatctgcttgatccttatccccttatccccgtcttttccctttttcacggcttccaattcttttgttgccatttccaaatatttcacctcacaaaatgtttcatttttctttataaattcgatgagattgcccaatgtttgctcaatttcatttttatttttcacggacatttgatcaaccaaatgcgcctcaacttcaaccaccaaagtgccaaattgccttccaaactcattaatgattgcccgcatggacgacagcaattcggcattactaaagacgggaaaaggtcaaatttggcatcgctttccgccggcgttaggccgtggaaaattttaacgcagaaatcctacaaaataagaatgccaacattaggaaaaaagaacaaactatgccagtttttgatttattccttttttgtgtcttaaacgaggatgggtccagcagaagaattacgttaagttttatacgttaataagcccctttaactgaactgt

SEQ ID NO: 4703 - DNA, 2382 bp, Heterodera glycines
tttttcatgttccccgttggctatgctttcgcttctttctttgatcttctcgacctccctttccaacttcaccccgtctcagtgttttctcatcctctttttacaaatcgtgcgaattattctgtcgaagtgccggaaaaggaagcatcggataaagcggaaaaactgaagcaattgcaaaggaatggcaaaatttgtgccgtcgaagaaacaaacggaaaaggcgaccgttgtggggaaaaacagcaaaactttgtcgacccacttaacgcatcggcaattgacgaaaggacaaacgaacactcagcaaatgcaaaaacggtcgaattaccaaacaatcgaaaagcattttaaaacaaaatataaaatattatttcttttgaaaaatgggatattttcagtcaccaatcgacctataattgtgtctgttttagcttccatctgtgccacatcagaatggggtctcatccgacggttttggccctggtcaaatggctattttagccaccgaacgtcttgacaacactttggctgagcgtgagtccgagcaatggccgttggaggggttggacccccaattggtgggccatcggccgtggagagtgttgcgccagcgcattttggacacattttcaagtgcaacggacagactttcattggagagcagttttttgaggggaaacgaaccgacggaaacgccaaattcggaggagaggcgaaagttacgaaagacaaccagcggagaagcggaaaagatgagacaaaggtgaaaatcatcggcaaaaaagcaaaattataatttaaaattcagaaaaaactttgccattgaaaaacacgtgcaaacggtcgcaaaattccacgaacttacgcaggacgaatggacgcgcaaattgaaggaattgaggcgcattttgctaattaaatgggaagaggaaaagcgattggaatgcataaaggtaattgagaaagaattccatttattcaatggggtttaaacaaattcctaacattttctcattatatcagctgacttctgaagtggcaatgctaatttccaccaatatttcgtctgcccaattttatccctcccaatttgtccatgtcaccgactttttggatctttttggccatttggtgtacaaaaggtgataatataatgatggaaaattattattttagcaaataaacttcatttcgttccgattttcttcagacttttgctccgagcggcggaggaacgccgcggggttggacttggcgcattgccttctcatttcgacactaacgacgttttggaggagacgcggatcaaagcgcgcaattggtttggcaaagtgaacgaaaccgtcgctttgctggcgccacgcatttatcgtaagcggaaaacagcggcaaaaaatgtgatttatttcccgaaaagttttgaccgctttgctgccgtgccaacgtttcatggaccctttggctgccattcaggaaaatgttttggaactgtgccaatccgtcaaacaggcaaatggcacatgtccaagcaatcaaaattaacaatttgaggtgcaacatccgctcatctcctcctatctccgctgttacatttgtcgcattgcgatgcgactgaatgccgccgatagggcgccccattggaaatgtctgaacgattggctccaaacctacgctcaacaaccggtaaacccggtgacccatcaaagactcaatgcgttttcttccgacctttttgcttggccccgccatggaatgggtcgtccaatgcgtcgcgttcaacgccgtcttctactcggatttgcacccgttgtgggagtattgccgtttgcccgaacggcgtgccgttgtgctgctgccaatgctcaacgcattgccccgcctttatttgggtgaacacgcattggaggcttgcagaattgtaatgacaaattgacaaaacgaaaccagcacccgtcctttaggtcaccggttcagagatggtttcgggtgagcatttaatttaaaaagcgcatgctttattccccttccccctctgatttcgcttccctttgggtgaggagctgtgtgcgttcggtgccaatttgctggagacggaagtgcccgtgcacagtcgcaagtccattttgaaggcggtgtggaagtgcgtgatgcgtttggcctctctgaagcattacatggattgttgcgagtgttgggttgagtttgcggcacggcacttcggcatcaacgaagtcaatgtgatgctggacaatatgctgaccaaactgaaccagcagcaacagcagaaggacaaagtcagtcggccgacagccaaaaaatggctaaaaggcggagaaaggccgactaaactcaccgagctttgctttagtacatcttcta

SEQ ID NO: 4704 - DNA, 3424 bp, Heterodera glycines
tttctttcagtgaatttgctggggttgccctaattctcttaggtttttcatttcgggtcgattccttcgtcgccttctttttggacactttcgacggactttccctctcaaccactcttttcactcacattttgcaactcggcactgatttcttggccactttggtgcatattccgctcgaacaacaacatcaaagtgaggaggaggacgaagagaccgacgaaagtcggcgattgccattgaaacacttccgccgctttttgcacttcgtcctcagcttttggcacagtgtctcgccgtcgttcgccccctcccctccactctctcatcactctctcaatcttcccctttcgactcaatttgactttgtccgtctgcttgtccgttgtctccaatatttgtgcatcatttggccaactgtccatcgcactttccttccctctgccgccgatcagtcgccgctgattgaagacgaagagattgtgcagcaattgatggagcagcaacagaaccaactgcaacttgacgaagacaaggccgagcaaagccaattcaatgtcacacttttacggaacgtttgcactcaatgcgcggaaaaaattgcggacgctctgaagccctttttggtgaacgaaaacgcatcgggtgaatttaaaaaataggaaatgtgcggaaacttcttggaatttgtgaaattgcagatgagatgggtttggctggtgttgaactgcttgaactcctcgcccaattcggtccagccgatgtcgaggaaggaaacggagacgcttctgctgttgtccttccgggcgttctcctcacattggccaaaacaatttacaaacagtgcaaacggaagccggaattgagaaggcgaatccaacgaatggccaaacgataaaacgatgctaatcactgaactttcgcttattttcatctcatcggcgcttggattgtttcgatttttctcctcccaaaatttttgcggtgtttaatttcttaaattcctttcggatttacttcaaactttccatttgatatgggtttgcctttgtttcattgcgttttcttggccatacatatccttaattattgcgcttttcaaaatttgttaaattattcgcttgttttcctctgtgattttatgtattttcaaatttaaatgttaaataaaattatttcactttgaatgattttttgatggaagggttagccaaaaagagagtgaatgaactgataatgtttttctttttttcaatttgttcattccgaaggcttcaatcaaatggccattctcagtttcgatgccctccgggcgattgacagtttctcccatttttgatatggccaatctgtagaatctgtctgtcatcatttgcttctttctccgttataaaagggaaagcgaaatggcacttttttaatctgttcgagaacaaataaaattagatttgtgataaaattacagtaaacttttttaactcccacaattagaatttaattgtctgatttcttcccagcagaaagtaacggaacttcgaggcaatccgtcccattggctacggtgttatttccttttgtgccgctttccccctaaagcgttgtcccaagagtgccgttctccacccaaatgcgtctgcttctctttctgacggtgttcgttttgtgtggccattcgtccgaatacgatgacaaattcgatgatgaaaacattttgtggtccgaccaaagagtcgatgcatttgacaagcgcaacacaaagcccatcaaaagcttccagcccggctttgtgtttcaatttcgctacgactctcagatcacttctggtcagtttaactttctctttgcttctttctttctttctttctgtcagtttcgttatttgcttttcgtgccttgccccactaattggctaattagcccctttccccttccccaggctatgccccgtgggtgtccgtccagcgggcgatgggccgtttccaggctttggtcagcttcgaaatggttcagccaggcgaagcgaagatgcagctgagcgagtgtttggtcggccatttgaatggccatcctccaagtgacgtggcatggaacccggcacatttactgcccgtcggcgagttcgagtccgtcacgcaattcagccaagtccatctcgagcggcccatccgcttcaccttttcccgggagggcgtccacaacgttttctttgagccaatggaacccccgtggtccaggaacctaaaaaaggtgagcaaaaatgaagctgatcactgatcacaaaagccgatcagaaatgaattctttgtgaaggctattctgagcactgcccaattccgtacggagaaggaggaggaggggaaagagaaagaggaggacaaagagaaaatgcgactacaacaaaagccgagcgaatgggaaaaggaagaggaggagaaacggcgtatggaatggcaatggaagcggagttacacagtgcacgaagtgcgtccttctgtggaacccaaattagtttgaaaaagccaaaagagcaattcagacgagcattgaaggcacctgtgatgccgattataccgtggtgccgttgtcccacgagcagatcagcgtcacgaagtcgatcaattacgaacggtgcactcggctggcagacatcgtttatgggatgcaagcggacgaggaggccaaacagcgtggggagcagcggcagaagtggaacaaagcgcaaaagcgggaggaggaggagccaacggacgcgtcgggggcgagtccgatgatcggtgagcgaagcggcaccatttttgaacgttaattgggcgcttttccaatttttagcccgccgttttttggatcggtccaccaccgtccgctttttgttctctgctaatgcgcagaacagcagcaacagtttggggttggacctcaattggccatttgcccattctgtggagatggtgtcccaatacgcactgaaagggtcggaggcggaacaaagccaagcgatgcaaacggtggcagtggcgaagataaagcacattgggacgaagctgaagcagaacaacaagctgagacagcacggggaggagggggagggagaaaagttggggatggacaaggaacagctgatgtacaacggagagatggagcagcaagtgagagacagacgagagagagagggaaagggataaagaagggaaggaacagagacaggggcgtacagacaaagagagacaatgtgagaagagagaaagacagagagcgataatgaaagcgtagggaatgagtgatgccaattatgcccatttgctctccaaccggaaaaggtctcggctttcaggagaagtgcttcttcatgttcggtgacgaacagtcggagactttgcgttgctaccgacgggcaaaagccttcacaaatgacgaattgcgtggt

SEQ ID NO: 4705 - DNA, 1586 bp, Heterodera glycines
cagcagggcctttgctgctcaactctttcggtctgtcattttcagtttcggtgccatcgttggcgaattaatgcaattgaagcgccttctgcgcatttcaccggttggcactccgttgggcgaaaaggtgagaaattaaggacaatcggttgacggtatctgctgaatggaccaaaccggaacagattgagcagtgtccggaccacaaaatggagctgtacacgaaggctctgttggaacagttcacttccattgctgacgataaccttgtggagaaaacaattgctctgaaagtgggccaaaatgccacccacttgaaattcgagacaatttttctgaaatttgaaggccattggaaatgccgcattagacgaagtgccaaaactgttggtcgatttgattaatccaaatgggacggaagaaccgaaagcggaggaccaaaaaagggccatgggcgaaatcttacggcaaaacgcaatcgaagcattgcgacgcattccctcccaaagtgtgcaccaactgttgctgccagtgttcaccaaccgacaggagtggcctcaggcaatgaatgctacggcaaattagaattgggcccctggcatcaattaaagacatttaaaatccgaactttcgcttattggaccctaaaatggctgaacattcatccaaatccatttctgttcattaaaatgctcctttttttgatctttcagacgcgcatttccgcgcttgacgttctgatgcaatcgcaactttcgccttcaaactccgtcattgaccaaattgcctttgcgatggcaaaagagaactgctcgcaattgttagcttatgctcactcaatgctaaaggcactttcccaatcgccggcaaaaaaacaccaaaaaatgtaataattaggggaaaggcaaattttaattgcttttaattgattggacagtgcccaacggatcaaagaagcactgcttatggcgggagtggacactttggaattggagcagcgaatccgacgcaatgacattgtcgggatcagccgcttctcccagacaaacgcacttttcagcgaggaagaggggcagggcattttgttgcaggcgtcgagagtgagttggggattggcagtgattgcatgttaattagtgtctgatcagtgctaattcaatccatttggaggggggggggggtgacttcattttgtattactttaaaaaaattgtaaggtattcaccgacaaaacaagcgcattgccaaatcatgcatttgtgtcgctgtcctcccttttcaatggcgaaatgtccgaggaaaatttgaaaatgacaataagccaacggaacatcgaacgccttttcaccgaagcgggaatcatcgaattgttgcggaatgagcaggaaacggaggaacaaagcaatgccaacgagcagaaaaaagtgggaattagagggggaaaagatagtagcatttgcaaggaaaagggataaggacatttggaaggacaaagccaagggcaaagggcatttaaggaccggcaaggacaggaaaaagggcagcagcagaacaggcactcagcagaagccattctccactgatga

SEQ ID NO: 4706 - DNA, 1167 bp, Heterodera glycines
gggcagcagctgcacattcagcagaagtcgttcgcatttggcacaataaaagcgaaggcgcaaagacttggcctttcacaaattggccttcagttgcacccttcggcaacatttggccgcattcaaaagatgaaagtgtgtctgcctttgccttccctctcccttttgaccccccccccccttcgctcccccaaaggcttgggcctcacccgtccattctttgggcgtcaaacacattggcgccatcgaggcgaacttgccattgtacgcacaactgaacacactatcccagcagaagcaagtcacactgaatgtgcaagtgccgaaaacaccggtgagtcgtcactctctaaaatgcccatttaaacgcgtttctttggcatttgtgtctccttttggcattccccccatttagacacgtctcttctctttgcacactttgccaatgactttcgttggcacagagaatgttcaaaatgctcgtcctcagcagcggtcagcttttcttcatttcggcgagcagtgcaaagccgtgcagaatcagcagctgctctccatggccatggcattcgacaaacactccgacacggaacagtccctcctccaactccctttccatgtcagaggcattctgcacagaccgcgacgaatggacaaactgaaggaatgggtcaaggtggaacttgcattttgggaggttatcattggccagttaatcgttaaaaatttgcatgccaatgtttaaatgtgaggggacggcacttttgaaaggcttcccattaattagcccattactctcccgtaatgacattgttaagttaagattgtttaggtgcttctctcgacagaaaatcacttccaactgtctctcgtgtcaacatcaagcctttccccgcacgaaatcgctttttccatcggctgggatttgtcccgcccccaaccgaccattagcgaggctttatcccatatcggattcaaagaatggccaaaggcattcacttctaccgcttcggacattgagcggaaagacaatgaaaacgaagagactgaagaggacgacggacagtgggggactgaagcgacggcggcgagcagttcagaggaggaaaaaacgacacaaagaacgaagaaccgacaaatcggagaatatctcaaaaaatgggagcg

SEQ ID NO: 4707 - DNA, 1347 bp, Heterodera glycines
  misc_feature (45)..(45): n is a, c, g, or t
  misc_feature (53)..(53): n is a, c, g, or t
tcattttgtcgaaagaatggagaggacagtgagaagtccgaccgnaaagatgnggagaaaggaaaggaccgaccgcgggcagaaactttggccacgctgagcatcgatccgctgacccaccgccatttggacgcgtccgtccgcacctccgctcagctgacctttttccgcatggtcccagtcgcctctccgcttcgtccgtttccgctcgtccgtccctctcataggcctttctcccgcgcttcgtccgcttctcttccccaattcttccataacatcgcccatccgttgcgttcccgcgctgtctgtcgcgtggattccccggctcgccaactccgaactttcgacggggctcagttggacgtgcacttttccccctgttggactgtgctggccaaagattgttcggccgagggacgcgcgcaatttgcggtgctggtcaaagcgaaagcgaacagtgaacaaatggtgaaaataaagtcaaaagggaattggggagcatttgaaagaagccgacttttagaaactcaaaatgataagccacgaaattggcattttggtggtcgaaccgcacgcgcaacagcccgactcaaaactccaagtgcaaatcagcgggaaagaccaacagaaaaggacagttttgtcggatacggtagtgtgtaacatatacaagtacaatcaaccatttttctgacccttttagcctttgtcggacattccgaatggcatacaatttgatcggtcattacccaccaaaaaggaggctttaatcgtcgaatggaccacgtcaaatgctaactctgagggttctgtcggtgccaccggcgcaatttcagtgcattttgacggccaaaaagtacaaattttactcgacggtcagcagaatcgtcatcattcgtgtggtagtaactttgtttaattaattaattaattaattattattattattaatccaaccaattactttaaggactgtgcggagattggaatggaaatgccggggacgaatttcgaatgccaaacggaggacagacggaaaatgccaaagagtttcaccaagcctattcgctggtggacggagagggggaggaggacggagaatgcgaagacagcgcaattttggacaaattccattcagaaaagacggaggaaaacgaaacgaatgagccgaaacagcagaaggacagcgaggaaaagccgaaaatggagcaaatcggtgaggaaaagcaacgaaaaacaaagcgaaagaccgaaaaaagccgcattttatagcagccgtacggaagaccatcgtgattgagcatccgaatgagttgtgcttttcggtgcatccgacgaaacaatgtc

SEQ ID NO: 4708 - DNA, 3906 bp, Heterodera glycines
tgcctttgtacgagttgcctttgtacgagttgcctttgtaccggttgccattgaccccatttcatacagggtgttccaaaagtctttgcacaacttttaattcgttataacttttttcgactataaccacatgaagtagctttatactcattttgaagctctttgtgttctctataaagtccaatagaaattattccaaaatttctaggttaagataatgaaaaaaattattaaaaatattcactcattttttggcccaaaaatgcatgctttttttgacaaggcaaaaattctggtttttttttattcgttataaaattcctaaaagttttatattatttgaaagcactaagtctttaaatatattttatagaataagtttttaaatttgatcaattttaagaaaaatatgacctaaaatgtctgaacagtgggtgcggcgcgctgggtaaaaattttttctctcataaattattcaaggccaaaccgattcttttgagtgtttacagattattaacctttctggtagatatttaaaaaacttaaaagttctaagttttattagttctaagaaaagttatgcccgaaaacagttctgctggaaccgaaatttgagatttggcacctttgcgcgaatgatcatattctttgagtttgatatgtaaaattattcttttaatgctattttgaagataaggggttgcactaattcttagaaaaaaagtggacccttccgataagatcttagccatataatataaaaaatacccaaaaaaagctgcggcaaaatgccgaaaatttttccaagcgtttgcgtctctgaatcaaagctaaaggcgggcacattaaaaacattcgatttttatcattcgctaatatgttctcttttagattttttttttgttttatttctctatgtctgttgtgaataaagttatgagtaaatatctgtgtgcaatgacttttggaacaataaaataaaaaacaaatgcgggaatgcggactgggatcccactgaaaatacagcgtgggacttcggcctgcgccggtctctacaaaaaatttttttttaaaacttcaaaggttttaagctttttctcaccgagtacacgttggccggatcgaaaaccatcattttgttggccgtatcttggctggccagtcgagttcggacaccaaccggcacaccaccgcccagcgggcccaagccatctgcatagtcggaactgtgcgaagacgtactactgcctgaattgtaaaatgccatttgttccatttttaagtctgatacggtggtgataccgtatgaaaataaaatttaaacagaaatcactccaaaataaaaaaaatatattaacacagtgagaaaaaaggggaaaaattttatcatcaataattacttccattttcctcgcataaaaagaagatgcattcttttcatataatgattttgtttagaattctgccaaatcttatataattagtatcattcgatagcatgaaatgattagttttttagcaagcaaaatttcaaatttggacaaaatacaaagaacttgtggcgccaaaaaattctagaaaagcgagaatttttaatttttcaggccttaatacggttgccaaatttttaaaatttttctgtctaataaaaaaaaataggtctatcaaaataccaaaaaatataagtttagtttgcttctgaaaaaaaaagttattataatttttgtcgaaatttttttaagtaacagaaaataaaaacaaaaggtgctttctccatctgaagtattttttgggactattagcttgacccctgaatattattttacacatgcctgatgatgtatgacgtgccagctcgctgagcattcgccatctcgaaattcgccagccaacctataaaaaaaaatgattattttaattattcgtttttaagaaaaaaagaaatatattttttaaatttgttaccaaaaagccgaatagcgtgccaaccaaaacgacaagtgccaacaccgacaatccaccggctgttgaataaacggaatcaattccgctgtacaagggatgatcagcagcaccgccgcttgggtcatcattaattgcatttgaatagccttaaaaataaaaaaaaaacaaataagccaaactttttattcattgtttcaaatacgccaaatatttgtttcaataaaattaatttttttcataaattgaacaaaaaaatatttgtttttttgaagttatcaacaactttataaaaatttttattttatatatttaaaaaaattgcaaatatattttaaaacgttagaaaaaattaattctttccataaaaatttttggaatttggtaaaaaaaatatttaaaatttcaaattttctattgtaaatatttgaattttattttatttttcaaacaaaattaaaaacatatatatataaaaaataattctttctatataaaaatagttggatcttttaaaataaaatatttttaaatttttcaaatttatttttgtaaatattttaagattttgtatttttttcgcattctatttttattaccaattttttatatgcatttttacacaaatttgaaaattttgcaattaaaatatttaaatttgccatttttgcacggcactttcgtatcccatcagtggattcggatgctcttaacaataatcacacaccaattggctgaaccgcgacgccgccaccgtttgccgcgtcccatccgccaaatgagtccgatgccgagtcctcgtcaattatatacgccgcaccgccctcagcgccaagcagtttggccgatcccgggcactgctcggaaacgccgaacagaacattttgcacataagaaccactggtccagtcccttaatttacccatcattaggcaaaaaacaagtttttaaattgggtttagaacggaatatttttcgtttacatctatagtaaaagcgtgttaaaaaaataaaaaaattttcaaagattaatttatttttgtcggaaatattatttaaacatttttttacttagtttaattttaacaaaaacgaaaaaaatttgataatttgaatattttttgaaaaattaatttattatgtgagatttatcgtatagaatattttaaaataatatagattatcattttttaaatttattaaaacaaaatttaatgtttttgctccgtcaaaatcattttttaatgtcaataaataatgtgtcgtcaccttttgctgacacatcgtcgtatttcaatatcccatgcgcaatgctaaataaaaaaataaataaatgtaataataaataaataaaaatatgtaaaatcgtgccggatcacgcagtgccacacatcgcgcacagttgtccggcagtgcacagtgctgaagtgggacgcgcgcaaattgcacaagcgttgtgaccgcaagcgcgggcggttcagcaccatcaatcacacgaataccgacaatgccggcggcatggtgatggctggtgccgctgttggccgggactgaattgtcggcaaacactcggaccgattcgacgagtacggcactgccattcaacgaagtttcgaccagctggtcaaaacaattaattttatatatttaaattaagaaattgtgaagttgtaccaactaattcaacccttctactggaaaatggaaaaaaaataaattttatgaacttctgaaatatggaaaaatatgcaaatttatattataataaaaattcgtcaacattttaaaaatacgcaaatagaaaaatttactgaggccacaattctcaatttttttaccccctagcttgaaaaatacctaatccttattatgtaaatgaaatatttctgttttacttttaaaacggttccgtctctctttccaacaaagatcacattgtactgc

SEQ ID NO: 4709 - DNA, 4372 bp, Heterodera glycines
  misc_feature (4358)..(4359): n is a, c, g, or t
ggactaaaaaagcccgaaatatggactaaaaagccctcctatggccaaatatggaccaaaatatggactaaaaactgccaaaatatatcttttaaaccataaaaaattcagaaaaatgtatttatattcagtatttgccaaaacagacttaaaaatacgctaaaaactgccaaaaaatggttttaaatttaaaaataccaattttcttaaattctagcttcacaattgcaagtcaaatacaacccaaaatttttgtaataacctcattctgtttcagcgaaaatttttggaagtggacaaaatacctaaaaaaatttccgaaatttcgaaaaatgctctttttatgagtgtattttttaaaaatttccaaaaaaatctatctttaggggtgtatttttcgcttttttgcatttttcttgtgaaaatttgccgaaaaatggccgaaatatggactaaaaaggcaaaaatggcgaaatatggatttattcccgaaaaccccaaaaatatggatttatatggactaaaaactttcacaaaaccaaaaaattttaacgtagaaatgctatttttgagcccctttcttcgtagcatatgcgcaggaaaaatatgttaatccatataatttataaccctagtaataataaataacaaaatatattttatgaatatataaaaaaaatttacaaattaggccttcttattccgtttattaatcttttatggatatctttttactagaaaatacaaaaaactttttaattttaaaaaagaaaaaattaattaaattggtaaaaagtatttgaatcctttttatgcgtgctgggttcgtttcacaaaaatgccaataagctatggtaaaagatcttttagttagatcaaatcattttttgaacatattagtcataactatttgaaactgaataaattttctgaaattttcatgctaatagagcaatccaagagagctgcgtatgataccaagagcatttaatttggttgtttttctcgaaaaatctataaaatttgcagtttttgcgacccgacttagcaccctttttatgtgcaagtcatttaaaacatttacatatttaaaatataaaattgaccaattaaagacattaaaaataataaaaaccaaaatttgactctcttttttaataaaaattgaatatataaataatagttttacgaatttcgttgaaataaaatggggacgtgtcgcccgggatggagcagttcaggcgcgctttcaagaagcttgaccagcggtcctgtgctggcgatggaccgcccgggtcatccgcgcacacgcgtcccacacgcgcgtaaaattgcgtctcgcggttattgtcttgcgcgtctgcggcccgctctcgataccaaaagtacacataggcgcggtagacgaacgagcccacaaaatggggatctgatgatgataaaattgattaatataacctgtatgttaatatgtatgtattttattccattaaacatggattttttcaaattattttaatttaagaataggcgtataattgctataaaattctggcacataaaaattataaaaccaataataaaagaaataataaaacaaaattgaaaattaaaaaaatttttttcagaatgcaaaaaaaaagataaataaaaaaattcagaaagaattgttatgaaaaaaaacttaaatatttttttaattgaaaaacgcacgaaaattaatgataattatcagcaatcatatccctgatgtaattcaagaaatataggggtacagtatttgcgtaaaacataattgtttttaagtataattagtaaattaattattttattaattagtctattaatcaaatgaccatctagcactcgatcgtccttctgggttcgcattgtttccccattagacaattttcgtcgataaatcaacgggtcggtggcactaaaatcggagatggcaccgataaaaatggcgttcaattcattggaataggcgaatgtggcattttgtcgtggatcatacggtgaaattcccttaataaatgtatttaaaaccagagatgtttaaaataaattataatattcatttaattttaaggttttaaattaaattacaaataattatttaaattataagttgtgaaaattaatatagtaagtaaattaattttaatcaaaaattataatattttaattagaaattggtaataaaataaattaataatattaatttatatttgaagatgttaaaataagttattgaaattttatcattatttgatataaattaaatttgatgtaaaatatttaatattaataaaaaaattttccataaaattttttaaattaattaaaaattattggttctaaagcccacttgtccattgaattgggacctttccacaaaacgactctcagattggctgaattcatattggcgacattgtggcgaaaaggcatgtgttccacagaccaacacttggccatttgcaagttgaatggccactctacaaaaaaaaataaataaaatttttaggttaattcgaaaaattttaaattatttattttaaatttaaatttaaaataaaatgcttgcctgataaagttacgacattctgtcttaaaaataaacaaaattatttattttttagtataaaatggcatttttacttccgatttgcctttcatatggcattcctcaatggtctgtcccggtgctttccagtgaatactctacaaaaatgataattgcccattgattaattaaagtaatcaagaaaattaattaatgaaaatgattactgtaagttgagaattaaaaataattaactaattataatgactgtcaattgataacttaaaagtaattaactaattaataataattacatttctggattccaaattggagtagctcaaattgaataatgcatctcttagaagtaaaaaacaattattatttaaatgttcattacaattatttcttctaccttgctccgatcagaatgaaatttttggttgcatcgatcaacaaaaattggtcttgacttttgcttgggctgtgaaagcgtggagtgctcccaactgaatattcaaaaaataaataattattattggaataatttaaataaattaattatttttaaattactattttagaaaattaagataattatttcaagcaaatttaatttattttttaattatttagaaaattaagaaaattattacttaacagaattattacaaactttattaatgcaaaagtttaatgatttaaaagtaatttttatttattattatataaattaatttaattaataaaaataaataaatctcattttttggagttaatataaacttttgatcaccttcattgacaatttgtcgaggtctcggatttaaattatcaacagcaaccaattgggcatggaaagatgagatcataaacagcaaaaacatttgttggaagaggtggttggcaaaaagcattggcattctatctctgattttgttatgagcttggctttgcgttgtcaatccttttaaaaggcaaacaattagctcactaattaattaattataccattcaaaaaaaagtttttaatttatttttatttttttggcaaaatcaaagtaatttttaaaaatttgatttaatgatttttatcattttctgtccccatattagtcactgctccataaaacaggtgaaattttacaatttttaaagaatttactgggttaaaatattaaaatttcagattttgtggcactttttggtgccgtaaaccctgataaacctctaactgacgaaaaagtaaaaatatattttttctgttatctctatttttcaccttcattgttaatgtcaatgttatggtggtgtcatgatcttatgagaaatccggattttctttgtacaaagatgagtgaggggcattatccattttcatataaatcaatagagaagggtcaaatttccaattttttgcatgtttttatattattttttttattaaaggagttgttcctaattggtaattaaaataaattacgattgaagaaaatgaactcgaaaaaactttgaaaaattttgggtatgaaattaaatcacgaggcatgaaaattatgctcaaatttttttaaattttggaatgaaattaatcccatgtaagaaaattaattcacaaaaaattttggtaaattggtatatgaaatccaaatcccaatgcaagaaattaatgcacaaattttttttaatttggcaataaaactaaaccccgaggcatgaaaattatgcaaacaaaaaaatttttttgaaaaaactcatcagagacacctgacaattaataatgcannataatcccctact

SEQ ID NO: 4710 - DNA, 3216 bp, Heterodera glycines
  misc_feature (112)..(112): n is a, c, g, or t
  misc_feature (147)..(147): n is a, c, g, or t
  misc_feature (282)..(282): n is a, c, g, or t
  misc_feature (316)..(316): n is a, c, g, or t
taaaaacattaaataggattaataattatactttttttaaattcctaatttattttattaaattgctaattgatgaacaatctggggttttctttaccataattcatttttntggtgttttattatcaagatttatcaaaataaatntaatctcaaatcagtaaaaaaaaagaatattcgttaaaatacgaccaatttataattacatcgctgaaaatgatctatattttgctaattattaaattatattatatgaatatttgtttattaaaggtacaaatntaataattattatgataataaattcacataaatnttgggaaaacggactcccgaaatcacaaatacccggtttaccaccatgaagctaaactttgataaattggcgtttggtttctcgttgttgctcttctgttgttgaatgtggcacttcttgaatttctttttgctgccgcttttcgggttgaagatgtcgatttgcttcttgttgacttttcttcaccattcgttgttcatgctcgatctgttcatgtcgtggtgccttctgcacttctcggctttcctcgatggcctttgtggtggccttgctgcttccttgttggtccgagatggcttgaaataacttgcgtaagcctgagtcttgtagttgcttgcggcgtttgtgttgtccttgtaatggactttgctgctgaccgatgggtcgtaacagtgctgagcgtcgtttcggaattttgaacttcttctttggacgtggttgttgactttcgtcgtcgctgccggcaagagaaactgagtcttccatgacagatgcgatgaagctgtgcactgcttgaattggttgctctggaatatcaacgattggtggcttttccacttctttgaattcatctctgggtcggtagatgacgttggattctggccatttgtctgcttttgaaagccaaatcgggccaaagcgccaaagcagtgatgttcgaaggcattggggatctgcgcctctggatgccatatccgccgggtttgagtcggttctgacgtgtctgacttgaaaattcgcttctcggattttttgtaatcgatttgccacaaatcgatcttggcgcttgttttctcgaagtcgttcgactgagcattgactgtctgtccacatgatgacttgatgatcggcgaatttgatttgagcttggatgaatttgactgcttttactccgagagtcagtgcttgaagttccaactttggaattgtgtcgtcgtgcgctgccactttgattggtttgacaaggctttttgcgtagatgaggttgcattcatcctttctgattattgttttggccttttggtacacggcaattcccatgccgtatttgctggcgtcgcagaagcagtggaattccactgagtcgatggcttggatgtgccgtggaaattcgattgtgattgcttcgcctctgtcgagccactgtgccatcaatttgaaccagtccttgttgatgtttgctggcaattcgtcgtcccattttgggttcaagttttgcacttcttgaagaatgagcttggctggcagtagtacgggtgacatgagtccgagcgggtcgtagactttggcaatttgcgacagaattgtccgttttgtgatttttccttcgaagattggtaatttgaagatgagccgattgtgttttggtttccatcgaatgccgagcactttgttatcttcgaggtcctttgtcaagtcgtctggttgcagcttttttagctcttcgatgttgcttccgtagaattctcggagtttcatgcccgctgcttcgaagattgtcttggcttgcgtcaccaaatcttgaagcttttccgttggcttggcgtcgaacatgatgttgtcgacgtacagattctcttcgatccgccttgctaggtcggagtcgaatagcgcgaggtgttcccgtaatgtggtattgagcaggaatggtgacaccgtcaaaccgaaactgacacggcagaatcggtagatgcgcaattcggagtggctgattggattgagctctgctgtctcgggattgttgagccaaatgaatctgcaggcatctctgtcgcgtgtcgaatgccaagttgcagaaatgccttttcgatgtcggcgaggatcacatgttccatgcgtctgaagcgcaggaggatgccggtgagatccttcagcagttgtggtcctgtgtacaagcagtcgttcaaggatggtgctgatgggcaattctttggctttgctgacgcatccatgacgattcggattttggttgttgctttatccgctctgatgactgctctgtgtggcagaaaatgcacaggccatgcacttgatggagactcgggtggaccgatgtattcgatgactgagttttgaacttgttcgtccaaaattgcctgatatttgtcaatcaggttgaggctgcgcagtcttttgatcaatgagacgagcctggctttggcttgatggatgttgcttggaagagcatcaactcggtcgttccagggcaaagcgacttggtatcggttgttgacaaacgtgaggttctttttgaagtggatcatcacatgatcctgatcgattggtgttgatgagtcgtccatgccaatcagatttaatccgaagaagttgttgagttgttcgtcctttttgaaatcaccttcggttgtgaagacttccgtctcttctttggttgattcgaacgtgactgattgattggcttcttcttgctcagtgccgtggactgacatgacaaatgtcacgtttggcgtttgatgcatttcgatgcgtcctgatccactgaggattttgccgattttggatcggcacagtgtgaagccgcttggcaacttttcgattggttgaacctgcagttcgtgccagacatcaattccgagcatgatgtcaggttgtcgttgttcatgcggaggattgagcttttgttgcctcaactctgacttgtccagctctgacagttgaatcattggcatgtcgttgaccaagaatttcatggcgttgaggttgaagatgagtttttccccgctcgtgcagagaaatccgagcttgaccaggtcgctgatgtatctctttggttcgcgctctccgaagctggtcaagtggcattcttcagtgtggaccaccggaagatccagtagctgtgcaagttgacgaaatgaatgatctgtggctgcctggatcga

SEQ ID NO: 4711 - DNA, 5977 bp, Heterodera glycines
gaatggtgacaccgtcaaaccgaaactgacacggcagaatcggtagaggcgcaattcggagtggctgattggattgagctctgctgtctcgggattgttaagccaaatgaatctgcaggcatctctgtccgtgtgtcgaatgctaagttgcagaaatgccttttcgatgtcggcgaggatcacatgttccatgcgtctgaagcgcaggaggatgccggtgagattcttcagcagttgtggtcctgtgtacaagcagtcgttcaaggatggtgctgatggacaattctttggctttgctgacgcatccatgacgattcggattttggttgttgctttatccgctctgatgactgctctgtgtggcagaaaatgcacaggccatgcacttgatggagactcgggtggaccgatgtattcgatgactgagttttgaacttgttcatccaaaattgcctgatatttgtcaatcaggttgaggctgcgcagtcttttgatcaatgagacgagcctggctttggcttgatggatgttgcttggaagagcatcaactcggtcgttccagggcaaagcgacttggtatcggttgttgacgaacgtgaggttctttttgaagtggatcatcacatgatcctgatcgattggtgttgatgtgtcatccatgccaatcagatttaatccgaagaagttgttgagttgttcgtcctttttgaaatcatcttcgattgtgaaaacttccgtctcttctttggttgattcgaacgtgactgattgattggcttcttcttgctcagtgccgtggactgacatgacaaatgtcacgtttggcgtttgatgcatttcgatgcgtcttgatccactgaggattttgccgattttggatcggcacagtgtgaaaccgcttggcaacttttcgattggttgaacctgcagttcgtgccagacatcaattccgagcatgatgtcaggttgtcgttgttcatgcggaggattgagcttttgttgcctcaaaactgtcttgtccagctctgacagttgaatcattggcatgtcgttgaccaaaaatttcatgacgttgaggttgaagatgagtttttccccgctcgtgcagagaaatccgagcttgaccaggtcgctgatgtatctttttggttcgcgttctccgaaactggtcaagtggcattcttcggtgtggaccaccggaagatccagtagctgtgctgcctttgacgaaatgaatgatctgtggctgcctggatcgatgaaaattgccgcagtcatgctgagatgcggttgtgctggattgaagaccgttgaagttgcggtcatgaggagtgcgcgggtgtcgcttccgtttacggcattgcacatttgcgatgtcgatgccgtttgttcgttgcttccgtcttgagttgtgattgacacattttgttgtgtttgccccaacattgctgatgtgatttggttcggtggtttttcgtctgcataacataatgccgttggatgaggttgtttgcatttgaagcatttcttcggttgcgggcagttgcttgcttgatgattgcttttgaggcatttgaagcataatgcctttgtgcgtagtacttctcttcgctgttgaattgtactgtatttccggcattctttattccagtgatcgttgtcacagaagatgcatggacttggaggcttgcgttgattaaatgtcgcattggcatgttgagttggaaattgcctttgattgttgatcgcattggcacgttgagttggaaattgtcgttgattgttggtcgcatttgcacgttgagttggaaattgcctttgattgttgatcgcattggcacgttgagttggaaattgtcgttgattgttggtcgcatttgcacgttgagttggaaattgcctttgattgttgaaagtgcgcaagtttctttgttgcggttgtggtgcgcgaggcctttgttgctgtgtcttatattgaggctgtctgttgatcagccttttgtgattgtcatccaccgctgaggtgatgaatgtgcgttcccgttgctgtgggattggtgcacggtctcggaatttcgatgccgagaaattgggcctttgaggttgtggccgttgttgcggatgctgctgcgagtgtccgtactcgcccatgacttcttgaatttgggtttcttttcgaacagcttcgttgagtacgtctcggaactttgtcgtgttccagcgtgccgggtcttctccctttttggtgaggattgtgcgcagaaatccgggagtgagcttcttttcaagcatgaggaaggttggcggaccttcaatgtcttctcctgtattgttgagttcgcgtgtgagtcgatcgagttgcaggaggaattctttggtgtcgcgcaggtttttgcagggcttgaggtttgccaattcgaagtgaagtgccctgatgtgttcgtccggtgcgccatatgtgtccttcagcaattggagggccgtgtcgtaattgttgtcctcgagtcgaaagccggccacgagttcacgggcctctcctccgagcaggttgcgcagtagattgaatttcttcgctttgctgagtgcgtgtgtgccgattgctgatttgaacgattcgtagaactccggccatttgcgtttgttgccgaagaacttgtccagctgaatgggttggaattggtagaacggaggagtgaaggacggcgtctttgttgtttgttgctgtgcggtatgttgtgttgcttgtgcataggctgcttgagcgtcccgttcttctttgtccgccttgctgcggaagagtcgggcttgaaacgtgagtgtgccgattaagtcgcgcaagtcgcgcagtttcagtgctgcttcgtcgactttgtcgttgattcgctcttttttctcgaatttgttgaaatctgcttctgccggatcgcgttccagtgcaggcagtttgcgcagtaaatctgcccatgcagtgagtgcttcgcgcacatcgtcgaggaagatgtccatcgttttggcatctttttgaactttctccaattgaatttcgaagttgagggcattttcgagatttgatgccgcttggtcggcttggatgttcagctccgccgcagttcggctgcgggagagaactttgagtgcagcgccgagtttctgttgaattggtgcggccattgattgttggtttgctgttgctgtactgcttgatcagctcgtgtgcggctgctgcttgtttgtcgttgcttgctgcttttgtttttgccgcttgttgtgcttctcgtttgccgctttgccttttgttgctttgctgcgcttgctgcacttgcgtggttgtactgctgacacggaggtcaagcagtacaccttggggttcccgtcgtttgacttgtttgtttgtgttgattgtgcaactgttgccacggagagcaaacagttcacaccgatcccccttgtgttggcttggattgggtactgctaccacgaagagcgagcagtacttgaattactgacggcacagagaccgatcagtaattttaccgattacttatggcacaaagaccaataagtgatttgaaagtgaaatactaatggcacgaagaccaaagtagtaagtcactgtttcccctgtgaaactactgctggcacggagaccaagcagtattccacaatttccacttttgctcccccctttttgatgtattcaagtttggctacggagagctcaaacttgatacttttttggaattttttctcaaaaatttcccaccagttgcagttccaatactgcttgaagtcgctcagttgtgctggtgctgtcgagggtttgtccctgcccaggtcgccacttgtccgatcaccacccgttgattgattgattgattgagttgagctccgttgagctgcttggagttggccgtgtgcgcttgacgttgagtgcggtgcaggtcgccgcggtggtgtcgacaaggcccgaggagttcgggcgttgaaattgccaggagaggaagcaaaaagtgggacgggaaatgtgccgggggtcaaacgggggcaagtgcagaggaaaattcacaccaaattttatctcaaacttgggtaattaaaccgaaaaagtggacaatgggcggacaaatgggggaggaaaatccggccaaaggccacaaaataaaatgtgaatgcaaaatggccctattggctgatcacacaaaaaatcgcaattgaaatggtgaaaatgggccaaaattggaggacatgaagttggagcagtacaacaaggggatatgagcgagggcaattgggacaggacaaatgagcgcatggaaatgggggaggtgcgcatggaaatgaattggccagagggggccaaaaaatgggacaattggggcggtgaatggggccaaagagttggagctgttcagctcccaaaaagtggtcgattggggaaatgaagtgctgtttgtgagcacacatttaaagggaacagaaaaatggggagagaatttttgggtgataaggaacggaatttgcgggggggagtgacagccgctgataaggcggaaattgcacatcggaccattttaaattgaattgatttttggtttttgtccgatgtgcattttggcacaaatcaaataatttgattttcgaaacccgtgtttcgacactcccaagcggcaagaaaaaggggctcatccgttcttccttcttctctctttcttcttccctcttggttccttgttttgggcccatcagtcgtccgccagtttcatcggtcgtaagcgtccgaagagcgtgtcttctgtcgcgctatgcgctctcgctcgtgttcggaatgatgccgttcctgtcgtcgtgtccagtcggattggtggagtcgattgctctggcaattgtcgtcgtttccgccggatcggagtgcttggcatctcccgcaatggcatgtcctcgtattgtggttggatttgaggcgttggctgattttttggccgaaatccaatcagggtcatgagtgtgatgcggattgggtttaggaagtatgcgattaagcatggtaggatgacatctcggcaaagcaagaatgtggagtatgccgaggcgagacttatccaccattggatggcttcctgtagccgttcttggagccatttgatggtccatccttcgattccgccgggtaaggcgccgagtgcttccgctcgttgcgtcgtttgctcttccagcttgtttttgaattcttccgaatcttcgaattcgtcgatgtgcggaaggctggcgaagtcggtgtcgttgtcgagctgccactgatggaagatcagtgggtggagatccaaatcgttgtccgttttgttgaggatcgtgtcgtaaagctcatggatgactgtttgtgccagtcgttggacgtttccatttcttgagtcgattcgcacccacaagttggggttttgttgcacttgaaggtgatggtagcgaaatggtgagcaacttgcgatttttgagatgagtgagagaatgcgcatctccgggtcgaggaatgcgtctcttgttgcgtttggcaaatgtattgtgaccggaatgaacttgtagcagtcctttgttgttcggtagctgatgttggagagggagattggaacacagggaaacacttcgattgttgtttcgctgatccatcgagcttgcagattctcgcgctttaggagtttccgtgcctgaagcgttggattgctgactcgcacattgcgttgacattccttcaagtagagctgtgagagtgccattgttgtggctagttgagcagctgaaagctgcgaagcgagttgctcgggttgcacgttgcgtctctctcttgtgtggttgctcatgatgatttcatattgctcttttggaatgccgaagttctgctccgataggacgatttgtctcccgtcgcatgcttggactgcatgtgtctcggtgaaggtcagtgccttttgtcggtcttccgaga

SEQ ID NO: 4712 - DNA, 1331 bp, Heterodera glycines
agattaattaaatgggatgcaaaaattaaggttgcccttctttcccattaattaatgccatttttcttgctagtacttttacccagagctattagtagtgccaactgtgaggtactggattgcctcattttattgttttttgggaggccgataaggctcaatttttagaaagtctttttactgatttctaagttttctgaggtttttggttttatggaaaaaatcttcaataatttgtcttttttgtctaaatcatttaacaaatcgcataaaaattaggaaaattttcctggcagtacatccatgcccaggtcttttttcaaaatgtcgaacactaataattaaaaatattttggataaaactttttaaaaaattaaaattttaaaaaatttgcctttggaatatttaaaaattgttgtttttgacgacaattagacttttttcagtcaaattatgttttttgacaatttcagttagcagcactaatttttagctcttcctattgccactacctattttttataaattgccattgttggttttaaccaattaattacaaaaaatgaccatttttggtggtcaattttttcaacaaaatgtgctaacattttcatttcttcttctgtccgggggtcccatgaaaaacctgaaagtactgctccacctctatgtagttcactggtcttcgcaggttaagcgctgtccgctcgtccaaatattgtgctttaattttcaacaagtgctcttcaccaatgattaatcgcatcaaatcattgcgcaaatcagcttcactagcagcagctgacattgcgggcattcctgctgcttgatttggtttttcaattttttaaaaccaattttcttaaaacctaattaattaaataagcttgtctgtttcgatagaaccaatttaagcatttcttttaaaaggacaaaattttaaaaaatgcacgactccaaaaaaaattatgagccaggccgctgaccggttttaaaaacggcacaatttggaattttgttttaataatgatacctttgaaagccccctgaaacaaagtcaacttgccttaaaaaggccctaaaagagtggcatttctttttttgcaactttttcataaatttattataatgcaattttgagtaattttgatgagaataatcgagtgctaccagcatgtgcatatttggatttggctgtctatgaaaatacttaacggtcgatccgttagtgacccgttccggcaaaaatcacctgccatgttttttggttttacgtttgtgccggtgttccgtctcagggagctaactccttccattcggccatcaacaa

SEQ ID NO: 4713 - DNA, 975 bp, Heterodera glycines
attatatgggataaaaaattgcaaatatggacttcatatgggcaaaaatagggatataaatttttcctaattgaaggtaaatttcaaaaatttcttaaaattcattaaattttaatttaaaaaaataagtagtctacaacccacaaaaaaattgaaaaaaaatttataaagccatagcaggtgaaaaaggtcagaacaagtgttaaaacatgtgaaaaggtcataaaagagttgaaaagtgaaggttggttttttgtcacattttgtgtctttttcactcctgccagtcaaaaacccttgccagctaaaaaaatccgccgtacgaaattaattttaaacctattaatcaaaattttggtcgctcgcaaatattcaaattctttctctcttcgtgctgtgctatttccctttttcctgtcaactaacgggttttcgaccaaatattcaaattcatccctttctgcgtaactttcctctcagctgtcaatcaaattttggtcgaaaagcaaaataactcgagcctcacacccggattaatctttccacggatgttggcaactcaagctcctccaacccgaagcctaattcctcaccggatgtgggcaactcaagcctcacacccggcattaatcttctcgcggatggtggcaactcaagcctccaacccggagcttaatccctcaccgggtgtgggcaaatcaagctgcacaccctgcaatcttacgagtgggtgcaactcatgcatcccaaccacttcctaatcctccaacttgatgttggaaacccaaacctcacatcctgccaaagggatggggaaagcatgccctcccccctcactgctcatccttcatcggatgttggaaccttaagctacactgcggctttaatcctttcgtggttggggcaagtcaagcctctcaaccacgacttaatccctcatcggacatgggcaacccaatcctcacatccggccta

SEQ ID NO: 4714 - DNA, 2286 bp, Heterodera glycines
aaaaataagtagtctacaacccacaaaaaaattgaaaaaaaatttataaagccatagcaggtgaaaaaggtcagaacaagtgttaaaacatgtgaaaaggtcataaaagagttgaaaagtgaaggttggttttttgtcacattttgtgtctttttcactcctgccagtcaaaacccttgccagctaaaaaaatccgccgtacgaaattaattttaaacctattaatcaaaattttggtcgctcgcaaatattcaaattctttctctcttcgtgctgtgctattccccttttccctgtcaagcccgggggagaaccgctataggagttctgcctaccattatggaggagaattaatttaatttcattggttggacagataaaacccatcaaatatgccttaaaaacccgaaaatgtccaaatatgaattaaaacatgccttaaaacatttaaaaaaaatggctttaatgctaaatccaaaaaaaataatgttttaggagcaggctcgcttgagcaaaaaaaaaaaacaaaaaacaattttgaaaacaaataaattcaaacatattgggaacagacaaaaacctacataatttatagagattttttgaaaatatttaaatgaggacaaaaaatgctttgagataatcgaaatattaattcaaacttttcaagtgaccattatttttaataaatttgcgtaatctctgcggagattctgcctgagcaagggagcaaaaaaggcggaggaaaaattcaaagattgtgagatcaaatgtccccttgtgttgttggaaatttgggaggaaggacaattaggaagcaaatgagagaaggggacaaaaaagggaaggattcgggaaaggcgaggttgaaacaaaaaaatgagagaaagattcattaacgaatcagtagtttgttaaaaaaaagacacttaaattatataaaacagttttaatttcggttcttgcaactaaaagtcccgatttttatacacaaacacaaaaaagaaagtgtttttcctactatttatagcatggagaagccaggaaaaaaaaatgcatttgcatatttttggcagccctgattataagcaacagttaaaataatatttataaatgaaaaattgaagtaaaattttatttccgaaaaaataaactagtaaatttaaagcaaaaaaaagctaaataaattttgaaaagaaacatgaaaatttattatggaaattgacacaatatgtataatttctgaagatttaaaaaattcatatgaaaattctagagaaattaattttttaagggtcatcgggttaaatttcatcagataaaataaaagtttaatgtggacataaatttctgagataaaatgcaaaatacttggagaaaaaataatattcgctttaattaattgaacagaagcatggcctgcgcgggacaggggggagtgggtggaaggcattaacaaatcgatggaaatttaggcgggggagggggtgatcaaaagatcataagaagcgcggggggtcgttcgaagaaagaaaggagtgagaaagggcttggttcaaaaaaggaagtgaagcaaagcagcgccggtgtggaggaattatctgttaaatattaaaaaaaaattttgtcataaaaaacccattggtaaggtaaataaatgccgaaaatataatgaaagagaaaacccccacaaaaaaagaatcaataagcagcatttaatttacggaaataatatatcgaaaacataaacaattcaattttaaaatggaaattttggttacaaataaatatttgaaaaaaatgaacattttatgggaaaaatgacaaaaagtgaaaaagcctttaatgtatacaaagaaacatttgaaaaaatcatttttattcatctttaatcaatttgcgcaagcgttgcgcagaagagtggtgggaggggggggggggaatccaagaatgtacttggcatccaaatacgaatccgagccctgttctagtgctttttttcatttttttagtgcctcctaaaacgtacctaggtatttggctgcttttagagcctaaaaaatcgtatccctatttatgagtgtttttttaagtccttttgttttttatttttataaattttagttttattattaaatctcctgaatatcacacataaatgtgaattttcttttacagtgaattttaaatttctgctttcattgtccgaatattcgccaacatttgatgaactgattaaaatggcgaatttctttgacaatattgacgatgatggacacattttgg

SEQ ID NO: 4715 - DNA, 2735 bp, Heterodera glycines
gggttatttgaacccaaatataatacgaaagatttttgaattgaaacttttatttgccatttatttgcccattcgaataaattatgcaatgctttatgcataatttccgtgtcggctcttgctttataacaaatatataatttaacatcagtcagcatataattttattttcactcctgatggcaaggcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtttgccctttataccaattttttccaatttgtataaaagtaaattatggggcactgagtcaaatgctttttgaaaatcaatataaatacagtcaacattttttccatttataattgcctcgtaccaatcttccacaactgttattagttgacttgtcgtagacctatttctaacaaaaccaaattggtattccgaaattttattgttttttaggagaacaaaaaaggttttatagcaaccattaaatttgagtaccttgaataaatgattcattcatcattaatctgtttgtgaactcattgcgcagaaacgcggaggggggggggggtgggaaggaaaattggcgaatcgatttaactcctcggttgaacggaaagggaagggagggaccaaaaaaaggcagcagaagagcggagaggggcatatatcaggcttcgatttcaaaattttgaaaatcctcatttcagtcataaaaaatcctcatttgccactaaaatacctcaaaaaatcctcattttttaaaacgtccataaaattgcgaacaaaatcagttaactttcatatttttcgtttcaaacaatcacggcaccaatcagcggcgccggaccccaataattcttatttttttttaattggtcaaaaatcgcaaaattggtaatttttggtaaaaatctatctataactaacctccaaaaatttttaaattcaatttctattctttaaaaaaattgacaatctcataattttttgattttaaattgctttattcgtgccgcggtttttcaaaaaaactttttgggaacattggggggagggggtccggcagtgccgataggcgctgccggaaaaaatttgagattttgagtgcgatttgtcaacagattttttcaaaaaaaatgattttgaccccctctaccgaagccctgtttgtttttttgtataaaattataaaaggaaattaattaaaatttattgcaaaatgaggatttttcgaaaaaatgtttaagatttgaagaaaaagttcaaacattttgccaaatatacctaatttttcaaaaaatcatgcgtttttgtcactttttattaaaagaccacaaaaatacttaaacttctcaaaagaccacaaaaatccgcaaactctttgaccctctaaaagaccacaaaatgaggaaaattcctcagatatcgaagccctgggataaataaataagcaacgtttatttaagaatttttcagattaaataaaaaatatattacggtaggataacaaattagcttaaataaaattttttgtcatcactaggtttgtcaaaaatatgtacataaagtggtcataatatttaactggcggacgtaggagggcacgtttccattcttccttttcggctttggccttctctttggcattcccttccgcgtcttttcgtctggcttcggacttcgcttccatttgctcaatttcctttttctcctttcacgtttgacattatccgaacgtggcctacgttcctttatctgttcctcctcttcctcttcattttcaatttgtgcctttgactgttgcatcaactgaatttgatcaaggcacattctctccaattaaaaagcgacatcgaagtcaaagggccaatgctggcctcctcttcctccttggattctgggcagttcggccgtggagtcgtccatcggctacaccttcattagcaccattctttccaatatcgcttctcgctctccagctgtgcaaacatttgttgcagttgctgcacctgcacactaagacgctaaaatttattgaaattaaaaatgatttaaaagtaaatgaaaatttttaagtaaattacattgatcatgggtgtggcggggttcggacgtacaaaacttttattgcgtttgtagattgtaaaaattttttaggtgaatttttgttgcagatttcgtaaactcattttaatcgaaattaaacaaaattattaataattaataaattaaagaaacccaaatgcatttaaattatacatattactaatgtttattaatgttttgaccaaattaggtttttataattactaaaatgaaccaacagcaagtaattaaaacaaaacgaaacaatgagaagttggagtatgatggtgcactatacgtgctccataaattcagtgacgaccgactaaagaagttttggcgctgtgagtttcacggaccatcagacaaatgcaagggtatgttaatatatcactttgaattttgagaatcttaaaattcaggacggttgcacactgatttaaacaacgttgtgcagaaggtggtcggcgtccattcgtgcgacatgaacgctgcgcatgtggaatgtcagcgccttgtaactggactcaagcgacgtgctgctg

SEQ ID NO: 4716 - DNA, 938 bp, Heterodera glycines
tccatatttgtccatattttggcatttaagtccatattttatgtccatattttggccttttccaaaaaatcccctaatagaactgcccccatcaggtaaattggcctttttgacccctaaagactaaaaaaatttccaaaaaaaacatttttgtagcaaaatattgtcaaaaatattgacataccgtattttctctaattatatgcccgggtatattatttttcaaccccctcagaaggggggagataattagagacgggcagattaatggagacagggagattatttttcgacagatttatttagtggaaaatttttgaaatttattttgaatatttctccaaaaaatattatcgcgtcaaaaaaaagcatttttattgcatttttgttaaaaagtttctgaattttacttgaaaaattcgaaaaatgccaaaatatttacaaaaaattgataaaaccacccaaaatattgaactagaaatatgaaccttacctattttgcttttcagaaatttggaattttttttaatttgaaaattttttctttttttgagcccgagaaatttatgaaatttttggaaattcaaaactcacttcagggttggacaatgtttgtggaatacagtagagtgccacgggaccgggaatttttgcaaaaaccgggaccgggacttgccgggacctgagaagccgggaccgggacctcgatttttttcgggaccgggaccgggaaccgggaccaaccgggaattcttaaaaattcaaaaaaattcaaaaattttttaaaaaattcaaattaaaattttttttcaactgaaaataatacaaaattaaatttttattttgttttttatttaataaaatccaaagttaaagctaaattaaattaataaaaattttcaaacaaatttctttaattatttcaaacaattaatatt

SEQ ID NO: 4717 - DNA, 5779 bp, Heterodera glycines
accttaaggaaaaactccctgaatattgttgcaacgacgtacaaatactcacccacgccctcgtcgaattacgccgggaattcaaacaactgacacaacggaacggaaaacacggaggaattgacatcctgtggcaagccatgaccatcgccagcgcctgcgtcaagaactttgcactcaaccatctgaaacccaactcgctcgccatcgtcccggaaaaaggctatacaccacaacagaatcaaagtgcactggccatcaaatatctcgattggtactcacacattaacaacgtcaacattcaaacagcacactcccgctatggtgaatatgtctttaaacgtgagggtcaggtgtatcaagtggatggttatataaaaggggaaaatgggaagagggataaaataatcgaggtaaatggttgtctgtggcacgggtgcgaggaatgttttgaggacttggacgacgaaacgaaaatgccgaacggaaagacgctaggacaattaagagagagggaggtaaggaagcacgagattcttagccggtacgtagacttggatgtgatctgggaacacgaaatcaatgagcagctgaagaaggacaagcaaatgagggagtttttcgacaactggaaggaccactcaccaataaaaatcagagacgcatttcatggaggacggactgggccaatgaagctactccacacagctaagccgggacaaaaaatcagctacaaggacttcaccagcctctacccatggaccaatttctctacagactatcccctcggtcacccaaaaattatcagctttagattaaatgagcaaactgtcaactggcgagctccatccgacaatccatacaagggacttttaaaagttttacttttacccccaaacaggaatatcaatgtgaccgtaatgcccataaaatttgatgagcgactcctctttccactctgcgaaaaatgtgccaaacacatcaccaatgaacacccgaatggcctcaaagacaacgactattcgtgtccccacttcaatcctaatgaccgtgcctttgtctctacctgcactcaccttgaattgaatgctgccttggaggtcggctacaccgtcagaaaactcttccatgtcctgcaatacgaccaatggagcgacaacatcttcaaatcttacgttagcgaaatgatggccctgaagatccacgcaaccggcttcccttcatggtgcagcagcgaagaggagaagaaggaatacattgaggagaaccgtcatcgatttggaattttgttagacaacgaaaagatgaaggctgaaccagggaagcggtacatcgccaagctctgcctcaactcactttggggccgcttctccatgaggaacctcctctccaaagcaataatcaacaacgacgaaagcctgattcgccaatataccgacgacaagaaaattgaattagtggacttggaaatgatcgacgacgacaacgacgtattcatgctcacctacaagccgaaagaggagtttgtcgacgaaaataaatactccaatgttgtcatctccctcttcacgacatctgcagctcgcctctacctctacgatgccctcaaaaaagtagccgacacccccgactgtgaaattctctacttcgacaccgacagcgtaatctacgtgcaccccgaggacaacgacccactaccaacaggaaagggacaccttggagaactcactgacgaaaagccggaccacaacattttggaattcatcagtgctggctgcaagaattatgggatgaagctgcaacgcaaggacaccggtgaaatagaacatgatttgaaaataagagggttcacccttgatgcacaaactgttcaaaaaattcattacgatactgttaaggaccaaatcttacgctatggctccgaagacccccctgaccctatcattgtaacttacccccattttattcgccctaatctaatccaaggcaaagtgtatacccattccctcacaaaacattatcaacccatattcacaaaaggtattattaatgattcattccaagtcctcgaatttggttatcgcaaatgataagtatgcattctcaattaaattttctgtatattagttttcttatggttcccttcttttctttctctctgtttatatcactcatgtgggacggaatgacccctggttgatcctctccaacactccaggccatccatctgagatgaaggtggacgagctgttcattattgtaatgcgcagcctggtgcgtgagtgtttggattggggaccgaagggtgaagccgttccctgggtgtgtttactcacttttaagggaactctaagaattctgatatgccttcaaatctatcaaaagagttgcatactttctttttataatttcctttattctctattttacacttgtatttttcatttgaatgtttattcagaaataaaattgaaaaatgtgtcattactaatattaaaaggtataaattaaaaaggtatttaacgagaaaaatagtcagggttttgtaacacaatttgtaaattattaaggaatagaagatacaattttaaaaaatacacgaacttgtcgtttttaggtagaaaagtgcataattaaacacattaacatgtatgcagaattaagcaatggaagataaatttgaaaattattaagcaattgggaatgtcgtttttaggtagaaatatgcaaaattaagagaaataagttacaatttgtaaattattaaggaatagaagatacaattttgattatgtgcacgaacttgtcgtttttaggtagaaaaatgcataattaaacacattaacatgtatgcagaattaagcaatggaagatacaatttgtaaattatttagcatttgggaacgtcatttttaggtagaaaagtgcagaattaagcgaaagaagttacaatttgtaaattattaaggagtggaagatacaattttattatgtgcacgaacttgtcatttttaggtagaaaagtgtataattaaacacattaacatgtatgcagaattaagcaacggaagacacaatttgaaaattattaagcatttgggaacgtcatttttaggtagaaatatgcagaattaagagaaagaagttacaatttgtaaattattaaggaatagaagatacaattttaaaaaatacacgaacttgtcgttttttaggtaaaagtgcataattaaacacattaacatgtatgcagaattaagcaatggaagatacaatttgaaaattattaagcaattgggaacgtcatttttaggtagaaaaatgcataattaagagcaagaagacacaatttgtaaattattaaggagtggaagatacaatttttattatgtgcacgaacctgtcatttttaggtagaaaagtgcataattaaacacattaacatgtatgcagaattaaacaacggaagacacaatttgaaaattattaaacatttgggaacatcgttttttaggtagaaaagtgcagaattaagcgaaagaagttacaatttgtaaattattaaggaatagaagatacaatttagcaaaaattaagaaaaataatgattaaatgaaggaattactcaaaaatgtgtaaaaattacacacatggggtgtgtgtgtatgcgtatgtatgcatgtgcgtgtgtatgcgtgcgtatgtatgcatgtgcgcgtgtgtgcgtgtctatgcgtgttcgtatgtgtgtattgtatgtttttttgagggtgaggataaaatgtgtttgaaagttttgcataatatttattaacttatataaaacttgttaattttaatcataaacacaaacaatgctccttgcctaattcaacgtaaaataattctaattataataacgaacatttacaattccattgaataagtaatattcaaaggaaacaagagaaatagacaattttgaatctaagattgaaccgagaatagaaagtaggtttgacaaacagctgactgactgtatgttagaaacggtagactaatggctaaatatatattgaagaaaggacttgtaaaacgaataaatgaagagtgaagagaacatatgaggatattgtagtgcgtcattgaatggacggatgattaattgtggaagtaagaaatagtgaaaaaaatgtcagaaaaggatagaggaatggtataaaaatcagagatagttgaagagagacaattttagatagagagaatttagtgtaaggagtgattgagaatagaagatttggttggaaggtggacattagaaatgagttaacgaaaaatgatatttagacatatagaagacggtttgggataatagagaacaacagtgagaaataaccagatatagaaagagtagaaaaatacattacggagaaaaggaaaataattcaaataaacttaaccctgataaatatgccaaaagctaaatactagattttgtaacgaaaaccaaggaaggtagctttcttcctatgttacctttcaaaggaatcgatttataggataagggatgccgtgacctcacccccctctctccttctcaaattatttggttacactcttcctcatctttgcccttcctctccaacatattctcattcttactccttaccagcgcaaactcactctacccgttcccgttttcagcttcttcctttaacaattcaatgggaaatgtgtttttactaaaaactctatgaaaaaatcgaattgtttgccagcacaaccataccttgtgggacattggttagtttggctaccaaaaaaccacacgttatatatatgtttctgttttttatgcatatctatgactattataatgaattaattaatttaataaaaaaagtttacacccccccccaaaatctgcattctttttctgataatttagaattaattgtcatgttcatcattcataccgtaacggagttaaatctgtaaacaaatgtcataatcatttattattcgtcacttccttttgtcttattcactctacaatatttttgctagttattttttatgacttatacactcccttccttaattaatcataatttataaatttcactctactgaaacatatgtaaatctgttgaagttgatgactatattctcagattccaatattatgcttcatagatataatttcattataacccttctttctgcataaaatcttcaattggtaaaaaattaaggaataattaggtctaaaattacaattaatacagataccatacatacactaccagaaaatcttagtaatttatcataatacttaaccatactaaataattgtaaaagcatctcaccaaacattgttccgcctttgaaatgattaattgatttttagctatattacacaaaataattcacactcattattaattaaaattcttttacaactaataaaaatattacaagtcattctcggtaatttgaaataattaatcacataagttttaaaaacatcacacatactataaaaaaatccctatataaaacacttcaatcaaaaataattggttcataaattgtcacaacaattagcccccatatcatacatcactacaaacattttttgtaatttgtcataattaattaataagatttctaaccctcgtcataaaattcctctgtaaaaacatattggtcaaagaattgtcattttcctacatttagtgattattgtttcttaattaacagtacacaaaaaactttcaataattagacatacagatat

SEQ ID NO: 4718 - DNA, 884 bp, Heterodera glycines
aaacgaatcaaaaagctcatgtttggtcttaatcggtccagaaattcctcacaaattttttatttgcgcaaatcacccgttaaaggatttgttgagtcaatcaatggcgtaagacgtctcaaaaattgggcaacagtttcgttctcacgttgccggcaaactgaaagggtccgcttcgccacttctcgtctttgaggcgagtccaatttggccctcagtgcttccaaagcgctggtgaatgtcgtgatttggttagacttgagttctttgaatagttccctcggcgtgtccttgagcgctagtttatggcgagtgaccttttcttcttcggtccaatttttccctgttagtgacagatagtccttaaatcggtcagcccaatcatcaaaagcgtggactgactcttctccaaataattccaagttcgaattcaggtggctcagcatgtttatgcgccacacaggtcgattgatcactacactttgatcctcacttttcacctttaaatctgtattttgcccgcaggcggggttgctccaatcaaattctgtattttgcccgcaggcagagttggtgctgaccccccgagggttgtcggcatacatttagaaatcggtgaatttatgcgaatttttattattttttatgctgaaaataaaaccaaaatattgccaaatcagcgcattattcactgaatcacataaaagtaatggacttaagcttattttcttcggaatgaattgctagtgctcaagtaaatgtccataaaaaaattacattagtgtcgcttctctcaaatgaatgtgcgataatgtccgctaatgttcacataaaatgtaaatgatcgaatctccgataaatgaaaaatgtcgccgcggcttccg

SEQ ID NO: 4719 - DNA, 7808 bp, Heterodera glycines
gtatttttccacaaccattgctttttccattgctctcaattttttggaagtttttcattgctggtagactgatgccatcgcagaaaattttcgaactgccctaatatgccggctacaaatattttctgcaacatctacttcatttgcactcttctgccaaaaaagtcttgccgaaataaggacttatcggctctctcagatccgttagcaaattgtccaacatgtctatgcgcggcattggccataagtgttggcacgatggcacggcattcatccagctttttgattggaattttctccttgtccatgaccaccatcagcagccctcgcatcgcttcatcatatgggtcagtgttgtcatatgagccgcagttggccaacagcttgtgcattttcccgaatttctggctccactcgtcaatcagataagttgccgcattggacgggtcttcggcgagtaccaaattgtgaagaagcgcccaaatttccctctccattaccatcgccccttcccgttccaaaaccccccccccccttcccttaccaaaatcccctccccccccccttcccttaccaaaacccaccacccccctgaaaaattccggcccaaatttggtcccaagatccccccaccctccctttcatctgacccccctaccgcgattcgctccccgcatattttgatcagataagattattcaattgcgtttttttaattttcgtttgttgcgaaatttttgtgcggggcgcaccaaaaatggtgccatccgcgctccaaggtcaaaatagtttttatgttcacaatctgtcaatcaaagttcttgggcgagaaaatttaaagcgctgcggagatgcaaaaatatttgcggccactttaccgcagtttttatacacgggaactgtcaatcatataaagaagggaacgccgaagcgacttcatttcaattccatttcggttgaggcggggggtcggggccattctttgcctctcggggcgcttgcccacaaatattcaaatttttccatcaatcatctttatctgccaccgcggcactgcagcacggcatgccagtgggtggagtcagcagccgcaccatccgcaagtttacttcatttgccactttcgtccgctttcaattttgtcagcagcagaaccatccccaattcaattctcattgtttgtcagtttcgaccactttccattgccaacatgtcttttattgcccccggcactttcgcgttcctttcaaaagactatggggaattttcgactgggcattttgacccaaacagagcatacgacccaaattcacttgcagaaccgtgccacaattcctccaccctccgccaaatgcgccggtaatcttgagtctcgttttcggttgcttttttaaattcccgaatgcttttttcaggccgttcgtgtccaaccagttcaacaactgataccactgatagacgtgccgctatttgtcaacccaccaccaaatgtgccggtaattttggctcgctttttttactttttttttcaagatcccgaatgcattttttcaggtaattcgtgtccaaccgatgcctcaaccgttgccgctgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgccgccaaacttgccgtatcatccaccagaaaacgttccggtagttgggtcttgtttttcgtgcgttttctcatattttcggatgcttattcaggcaatccaaccacggcaacgaccgcgccagctgagagacgtgccactattcgaccacccactgccaaacggacaggtaatttcagaccctgtcttctacctaacaccgaaacatcttttctaagcaaatacatcccaaccccccgagagtgctggaagtgatccgacggctgggcgagtggagaggaagaccaagggacccaagatgtccgcctcaatgaatgaatggaatttggattttgataaaatttgttgttttaattttttgaattgataagggttaaatcccgttacctaaattgtttgaaaattattaaaattttaagaatttagatgctaaacctaacctttgacaaagattatgaaaaaatgaaaagaaatgacgaaatttttggaatgttccttctttttattatctatggattttttttcatgtgcattattttggtgctagtaagatattgccgaatgaattaattggttttttctcttcattttaaaacatttcacgtccccatgccctgcccacttcccgcggaattgatcaaggaaataattgacgctcttccccctccaaaaacacatcggcttttgcgcttaaattttgttttggcatactttgttaaatgtcggtttcattccatgatgagaagattgtttcgcccagatcatatttcaataccaatggcccgaagaaccggaatttatttctttttcgatgttcgtactccccctatttattttccactctaccaataataacatttaaataaaattataattttttatttcttatttgattaatttcgatcaatattttttgataattaaacaaattgtatttttcaaaaaagacctttctcgcagtagcaactcatcggcttttttttactcccttcataaaatgtctcgcttttgcccgctcgcccaaatcaatgaatcgggtcggcttaacacaccaaaggggaaatttagtgagttccaaacctatcaaattaaaaaagaattttgatattcgttttaggtcttttttacgctttggaaattgctcgaagctaccagctcatagggaaaagtataacggaaaacaaattccgttatctgatgaagacggagaagaaacaaagggaaatggccattgaattgatggaaaaggcagggataagcacggatgacaaagcttttggtacccaacaccttgaggctgtacaaaaatactgggacagggaattcccggatatgtttcgcattgtggcttttgaaatggtaacaaaattcgcttgaaaaatataaagttacatatttttagaagaccgggcttaggccaattttcaagggagagggtgttcgtaagcacgaagtttgcgtgataagagaaggcaatcactgggaagggatcaaatcggtgtcctggttttttggtgttcgcaacttttgcgtgggttgtgaagtgacgtacgatcgacctgaaagacacagaatggagtgtaaggaaagatgcaagaagtgctgtagaatggggttcgggtttccatgtgcaaatgtgtgcgaggaaatgcactgcggtgaatgtaatcttaagttctacaacccggaatgttttgaagcgcataagaaggcggcttgtaatgagtacaaaaagtgtgaaaaatgcggagaagtctaccaaacacgttcgaaacacgtgtgcggggaaaaattttgcaaactgtgcaaagtttgccacccagggcggcaatgtttcatcaaaaaaattcaagtgcgaccgcagaaagcctacagaattgtggcctacgatctggagacgactgtagatgggggagaacaccggcctaatcttgttagtgctgcacgtacttgtaacatttgtgcgggagaagagcgggaatgtgagatttgtgaaggccccagtaaaatcacatggtcagtagcggatggttttgacccaatgagcgagtttgtcgtttggataatgggttttcaacgatttgaaacgattgcttacgcgcattatgctgggagattcgattcccactttgtcttgtccgagctaacaaagaaggaaatcgcgacggaactgatgatggcagatttgaaaatttatcaaataaaggcgggaagagtgtactttcgggacttttggatgctcagtcagaataaattggcggaccttccaaaaaccttgggcttaaaaactgcagctaaattgtattttccacacaaatacaataagaatgagaattttgggaagagattatccaacctgccacctttggaagactattgccccgacagcatgaaagaggaggaagcggcaaaattggaatcgtggcacaatgagaattttcaaaaggaatttgaactaggtagggaaaatagcattttttctttgaaaataaaatttaaggggaacaactcaagacgtattgcgaaaatgatgttgaaattttgatggaatcaattttgaagttccggcggttatttttggggataacaggagatttggatgtaataaaggacagcgtcaccattgccggggtcgttatgaagatcttcagggcaaaatttttgaaggacaggcatattccaatcatgccagagggagggtatgagagagcagagaaccagagcaaaatcgcagtgaaatattttgagtggttagcccaaaaaaagggagtaaaagtgcggcatgcgtgtaacggaggagaagtggaatttggtgggctgaaggtggactgtgtgattggggcagagaaaaaaataattgagtttcaggtaaaagaaaaaatattttctttttaaacaatacttaaggggtgtgcatttcacgggtgtccgagatgttttttaccttggaccatagcaccaaacggacggacaatggaagagaatcaaagtagaaccgaaattcgcatggaaattttgagggaaaagtgcaaaaatttttcaatcggagaagtttgggtagaataaaacatttagaaatatttattaattgttagttttaggagtgtgacgtcagagaggaattgaagaaaaataaggagatgaaaaagttctttgaaagtgtgccggacaagggaccgatcaatccgagggatgcttatgccgggggaagaacgatgccattttgtttgtacgcaaaggctaccgaagaaattgagatatcaatgttcgacatcattagtttgtacccctttgttaattatggtaaaaatctgcttaatttttgttagtttcctttcgcttaagacaccccataccccgttggagtcccgaaaattgtagtgagcaggaattttaatgtgaattggacagcacctgacgacgtaccctatgatggacttttgaaagtaaaagtgatcccgccgaaaaatcttttgtatcctctcctccccgtgcacatcgatgaaatgctcctcttccctaattgttggtcttgtgcgagaagggccaagaatgaatttatgatgacaaaagatgtgaaaaaatgtaaccatcgtcccacgcagagagcatttttggggacattcacatcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtacaaggcaaagtatgacatcagtttggattatgataagattgggtttaatcccggactaagaatgatcgcaaaattggtgagaaattataaaaaatcttgaaaaattgttcaatttaagggtttaaacagtttatggggcaaattttcgatgcgcaatactctttcaaatacggaaattgtgggcagcatggaacgttggatggaattgggaagagataatacaattgatttgggcgcccggtaaaaataagcgaagagatagcacggtggtgtaccggaaaaaggaggcgttcataaaggagcataaagtgtcaaatattgtttttcattgtggaccacgagtgctgcgataataaaactgtatgagaaccttgaacaggtctataggaaggaggggtgtaaaccgctgtattgtgacacaggtgtttcattagaaaaaataacgcataaaagttagattctctggcgcttgatcatccgaagggtcggtgtacattgaaggaggggaaatttttggggtaaaacataatttttgaaacacatttaaattgtagttttaagggagatgacgcgagaatatgcggacaacgaaattttggagtatgtgtacgcgcgtccaaaacagcatgccttaaaactcagaagaaagaaggatggggtgatttggcacaaaacaaagatcagagggatgacattagacagacgaaacgcttttaaatacgaattgttcaaagagatggtgctggactgcaagaaaggggtcaaaaaagtttttcactaccctgagaaaatcggttcaacaaacgacttccgggttctctcaaaagatgtgcgaaaagaatatacgccggtgcagaaaaaaggaattattgacgatcactttaatgttttgccctttggatattattaataatttttgttttgataattttgtctcatgtttataacatttaatattttaaattaatcaaatttgtttcattttttagaatgtcaaagaaaaatttccaagaaacttcaaaagaaatccgccgctcgaaaaatacaaaaaattatttcaaaaacagtcctaatttggaaaaatgtttcgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatgagccgagaagctgagccgggctggaaaattgagaaaatttcagtggacctttattgcagtgctctgtcagacccagtgatcatccctgcccgccccttccaacaatcgaatccagacattgttttcaaggagttcatgcacaggcagcaatcatttggggaagtgaatttgttagaccagagaatttcaataattattgccacttattctttccctgttaaataaaatttttttcatttttccatttcattattttttgttcattccattattatttattcgagtttttttctttattaatttttcagttaaaatgtactcgtttcaaaaatattttgaggaggctctcgaaaaagaagattttttctggcagaaaaacagagcagaagtggaggcattgttaattgaggcttcaaattataaaattataatacacagggacaacgaaagccgctattctgattatattgccacctatcgccgcaccccactcttctgtttctgcatgattgagagaaatttaagatttttttacgacacaggaaccgggacgcccataggaagggttacaaccgtgctacatgttaccgttgaggcgagctatacaggagagggattcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgaatagataggttggaacatggaaaaaagcaattaaaaaaaatttgtttagagatttggtcggatcatggtcattgttctatagactcccaccctcactttttgacacttcccgccgggtggttgctgagaataaactggaagaatttttaaaattaccatcattttttcgcatgcttttttataataaatattaaatgttcatgttgtt

SEQ ID NO: 4720 - DNA, 6131 bp, Heterodera glycines
ttgtccgcccatattatttttattcctttatttctctcccctttatctctcctctctctctctcttcccttctgtcccccataaataccccgcgtcctctgacctccccgtcattcagttgtcaaccatttattttgcttatattgtttcaatcaatattcgccctttgtcctccgtccctcttctcttcatttatttatttgtgtcttcccaacttgaataaaataattgtttattcacttcgccggtttgggatttgacggcacaacattggcgacgccctaccaactgcgaactcaactcaacttttgttttggttgtgcaacaaaacaattttgattgttcaattttcagctgttgctcttccactgctcaatcttcttgagcagtgaacaaccaaaatggccgaagcagcaattcgccaactgtccgacgtgttccagcagttcttgactgctcagcaagcaaatgcggcagcaccagcacaaccgattccaatgccaaatttggcaaatttcgactgttttggtcttggtgaccatggcgaaagcgacatcgagggttggctggaacgcttcgcccttgcgcttgactgctcaacaccgaaccttcaggacgatttgaaggttaagctcttgctgacaaagctgagtgagacggcctacgccgagtatagcaaacactgtttgccgaaaaagccaacagagtttgactttgctaagacttcggaaatgctgttaagcttattcgcgaagcaaaatcagtgtggatcggcagatatgagtgcttacgggctgaaaagcaagacgaggaggaatttcgcggcttcatcaaccgccacaaaaggctgttaagcgattttgagtttaaaaagctcaacgaagagcagtttaactgcttgatgctcctcgtggcgctcaaatcgccgaaggatgctgaattgcgaaagcgcatactgtcaaagttagcggccgatggtgacagagcaacttatgaaaatgttgtgaacgacttacaaatgtttctgtcgaccatttcggaagcgaaagcgatggagagaccaccgaactccaacattttggctgtaaagcgcaggcagcaaccgaagaaggacaattttggagaaaagggctataagcagcaaccatgttggcgttgtggcagagagcacactccgttgcactgtccgcatttgaagacaatatgtcgaaaatgctcgaaagttgggcatgtgcagagtatgtgcgccgcgcaccatgaatggctgacaaagcaaaaaggaccaaagctaggcaagaagatgaatgccctgcgaattggtggcctcatggtgaacatcctgaatggatcaacacgactgatggaagtcacgatttgggtgaatgacattccgatcaaatttgtgcttgactgggtgccgatttgactgtgctggacgaagtcgcacacaaggctattggaaagcctcggctgacccactgcaatgagcaagccgtgtaccacgacggtacaagctgtaagcttttgggaaaaggcacagcacgtttttcatttggaggaaaaacaattaatgggcaatattatgtgacgaagaaaggatcactcaatcttttgggaattgatatgttggatgcctttggcctattggacgctttcagaagggaagttgaaaaggcatgaatggcaatttggtgaagaaggaagcgaaaaagtcgccgattcttcaacaggagaccactttggctgcgcttcaaacaaaatttccgcttgtttttgcggagggacttggacactgcacgaaagcaaaggctcatttggaattgaggcctgaggctgtgcccgtctattgtcgtccccggccagtgccttacaacacacgtttggttgtagaggaagaactggaccgattgttggagcagaaggtgatcaaatctgttgatcacactcattgggccgccccaattgttgtggtgaagaaggccaatgggtcagcgcgtatttgtgccgatttttctaccggtttgaacaatgcgttgctgcttcatcagcatccacttccattgcccgatgatatttttgcgaagctgaacggtggaggattttctctcaaatcgacttaaaggatgcttatttgcaagtcgaattggatgagaaatccaaggaagtgtgcacgattgccacccaccgaggaaattaccagtttcagcgactgccgtttggagttaagtccgcgccaggcatatttcagtcaattatggactcaatgctggcagactgtccatttgctacggcatatttggatgatgtgatcgtcgtaagccgatcatccgaagatcatcagaagcaccttgaagaggtcttcaaacgttttgaaaagtttgggttccgtgtcaagccagagaagtgcttcttctgtcaggaccagatcaaatatcttggatttattattgatcaggacgggagacgaccggaccaaacaaaaattcaggcgatttctgaaatgcctgttccgacaaacgtgtccgaggttcgatcatttttgggaatgatcaaccattaccaacaattcgtgaagaacatgaggttcatccgacagccgttggacgaattgttgaaacaggacaaagtgtggcaatggtcggaagattgtcaaaatgcctttgagaaggtaatcaaaattttgaaatctgatcaattgctgacacactacgatccggcacaagagatcattgtatcggctgatgcttctgagcatggaataggagccgtgatctctcatcgcttttcggatggaagtctaaaagccatagcacatgcatcatcgtccctgtcagcagcagaaaagaattattctcaaattgagaaggaaggcttagcgattgtctttgccgttcaaaaattccacaagtatctcttcgggagacacttcgttctgcagacggaccacaagccgttgttgtccatttttggcaacaaaaagggaattaaggcttgcacagcgaatcgattgcagagatgggcaatcactttgctcggctatgacttcgaaatcgaataccaaaatactgctgattttggtcaagcggatgttttgtctcgcctaattgcgaagacaccagtgccggacaacgaagtgatcattgcaaacattcgtgagagcaatgaaacgggagtgttgaattttgttacgaaaactcttcctctcgatcaccgtgatttggctaatgccgcgaaaagtgatcaggtgatcaaaaatgtgaagaaatttgtctgctcacattggccaacaaagaacaaaatggccgcagacattgttccgttccatcgacgacgacacgctttgaccatcgaggatgaatgtctgctttatgcggacagagttgtgattccggcatcgcttcaaaaagatgtcctacaactcctgcacagaggccatccagggatgaaacgaatgaaagctctcgccaggcagtacgtttactggcctgggatggacgaacaaattgagaattttgtcaaaatgtgcaacgaatgcacaatggaagcaaagatgccggtgaagagtgagcttcactcgtggccgaaagctgacggaccgtggaaacgcgttcatttggactacgccggaccgtttatgggaaaaatgtttctcataattgttgacgcgtactagaagtggcccgaggtcttcgaaatgcgttcatcgaattccgcggctacaatcgacaaattgcgatcactctgtgccagttatggccttcccgaaattttagtcacggacaacggcacacaattcgcttcaaaagaatttaaggaatttgtgaccgaaaatggcatcaaccatctgttctccgctccgtacaatcccatgtcgaacggacaagccgagcgttttgtcgatacgttcaagaggacatgtaggaagatcaagggagaaggagcatcggaaatgttgaccacatttttggcaacataccggaccacgccttgtgaggctttgccggagtgcaaatgtccggccgaaatgtttctaagaaggaaaccgcgcacgactttggacttgttgaggccaaagccaaaggcacagataattcgagacgagaccatggagaagcaattcaataggcgccatggagccaaaccgagatcttttgccgtgggcgataaggttctcgctcggcatcgtctttctcagccttggcgccccggaaaaatcaccaaatgtaaaggtgtcatttacgacgtcgaattttttgacggaaaattcggacggttccatgccaatcagttgcttgtgagaagcactgacgaaaacggcacaaacgcattgaacgtgttcaatgatgcgtttgatttgccattggcaccaccgctggttcagcatggtggacaagcgcaattgcctgtagtggcacccgctgctgtcatcgcacaagccgtggccgaagaacccgtcgtggaggaagctgatcgagcgcccgaagtgcctgctcaacgacgatcgcaacgcaatcggcgaccgcctgagcgctactccccataagaacggacgaatcaaacggacgtgtcagacggacgaatcacggaagaaccgagggaaaagatttttttttaagggggaagatgttgggaccggtactctattgtccgcccatattattttcattcctttatttctctccccttattctctcctctatctctcttcccttctgtcccccataaataccctgcggtcctctgacctccccgtcattcatttgtcacccatttattttgcttatattgttcaatcaatattcgccctttgtcctccgtccctcttctcttcattatttatttgtgtcttcccaacttgaataaatcctttatttattcacttcgccggtttgggatttgacggcacaacaatgttgtattatatgttataagaattttaggcagacaatttatttatttttggtttaattataaattaatttaaaaaaataataattatttttaaagatatgctttgggattaaaaatgccaattcacaaatttaattttttaatatgtcacggaaacattagcagcaaatttaattgcgacaatttgccatttataacaattgagagcgtgagaaataattaatttttttaaagtaactgaattatgaaaaaagttgtttagatattaaagataaatttcaaaaaaaatttaattactaatgctatatatttcaaaataattcataggattgctaaattaagacacagaaaatattgagaaataaaaataatgaagaaaaaaacaataaaagcatatatatttttacaatgaaaaggatcagaaaattttaaaagtaagaacttcctttgtcagaatttatttctcaactcatcatgaatgttgtattcattcccatgtaaaagtacaacatcaaaaatgtggagcaatttcaaagtccaaaagcccagtgcattctgtcgggaagaggaaattaatccaaatttggcgcgggaaaagttctattttgttgtcgacttatcggggcggaggatggcacgaaaaatcggatgatggcaccaattgcctcgaggccattctgccgattttttgttcaaagctttagagtattttacaaaaaaaataaaaaacatttggactaaaaataaccaatttgttggcaaaaattgaaaaaattcagagatccaactgaattttcctgcattgtccatagtcgtagctgagaatgaattattaaattgttcattaaaaaattagtaaaaataaaaaaatcctttctttgttttaatttaattaattttattttcccatgcagaatgagtttttattctgaaaaatggaggaaataatttttttcaccgcgcggaaatgaaaattggggcgggggccgcacggctcagcgcccttgcacctccggcgggaacattttttgtcacagcttaattaaacgggcaaaaatcgcgtttaattattcataaattggggtcctaaagatttgcatgttcgaaaaatgcttggtttcattatgcatattagtaaagtacgaccatatatcgcaacagcgactgtgcacaattaatgaattatttaattatttttttgattacgacaacttccgcat

SEQ ID NO: 4721 - DNA, 1659 bp, Heterodera glycines
tttctgttcctcttcctctttctgttcctcttccactttctcttcctctttctgttcctcttccactttctcttcctctttctgttcctcttctgtccctcttcctgttcccctttctgttcctcttccactttctcttcctcttccaatttctgttcccctttctgttcctcttccgctttctctttctgatcctcttccactttctgttcctgttctatttctttttctgttcctcttcctctttctgttcctcttccactttctcttccactttctgttcctcttccactttcctctttctgttcctcttctgtccctcttcctgttcccctttctgttcctcttccactttctcttcctcttccaatttctgttcccctttctgttcctcttccgctttctctttctgatcctcttccactttctgttcctgttctatttctttttctgttcctcttcctctttctgttcctcttccactttctcttccactttctgttcctcttccactttctcttcctctttctgttcctcttctgtccctcttcctgttcccctttctgttcctcttccactttctcttcctcttccaatttctgttcccctttctgttcctcttccgctttctctttctgatccttttccactttctgttcctcttctatttctttttctgttcctctttttgtttctcttccacttcctcttcccctttctattcctcttcctctttctgttcctcttctgtccctctttcatattttttagttttaaattttgtttgttttatttaaatttttatctatttttaattttccgtaagccatgaatcaaaatttattctgttagattggatcagaaactttttttaaaacatattatttcactctttatgtaaattttttatttttatttcctaaacgtaattatcaaaaaaaaaattaaaaagtttgataatcagaattaatgggaatcgaaccctatacactacaccaacaaagaaaggcatactaaccacttgttcaccggattgcttgtcttgtactcgtaaatacttatttatcttaaatattatttagatttatttattatattattttttaaattattatttacctattttattgattaatattaaattcatttttaaatttggttttaaataaatcttatttcattaatttaaaataactaatattttatttccataaagttaattaaataaaaaaacaaaacaaaaagtagaattatatataatatttttttaaattactctgaagcagtaggacccgaacccactataaaaggcaggcacactaaccacttgaccactgggccgcttgccaccatgcattttaatgcccttttcccttcctttcttttattgcaaaaagctcgaccaaaagtgcataattttatttttctttataaaatatttagattttattttattttaatgttatttttgtatttatttaatattcaagttattttaaatttaatttaaaaaaattattattttataaattaaaaaaaattattattttattttaataaatttaattaatttaaaaaacaaaaaaataaatctaaaaagaaaaaaagatgaagtattcaaactaaatattgaatagaaaacaaacatcagcaatggga

SEQ ID NO: 4722 - DNA, 1724 bp, Heterodera glycines
atatataaagttagctattgcaaaaattagctcaaattactcatttaactgcttaaagaaagcagtgccctttccgctggggttttcccgcatttcactttctccgccccttcgtcccccgcagcgatttccaacgacgacgacacgtgcattgaccggttggaattctggaagtgcgatgagttcctttatgtgtgccgttattaccgcgagacgtacgccttcgaaatgtgccgcaaaacatgcaatctgtgcgacttcaatcggaaggcgaaagtgaagctgatgatggcacaaccgtactattattaccacccttattggatgggaggcaaaaaatgatgacgaaaaaattgaagtggaaagaatatttggacaagaaagaattgcaaattatcaggacaaggacacgaaaaatgctaaacgagtcaccaaattagagatcggcacaatcgatcttttttcgcttttgtaccgaaaaaattattaaaaaaaacatttgaaaaagaaccaaaaatatccaaactctaaaatgtcaaaaaaaaaaaaaattaattttgcgttttctgtgtctttaatgtacagttaacatgattttgcaatgatcttatctagtttcgcctttaaacatccatttcgtggatttagccctagaaatcccatcccgactaatcataagataaatttcgatgcaaattaacattcaattccatcgtattggcaaagaatagatgggtgattgtggggcgctgtcactcggcccattttgtagcgggtgccgtcggcatcaatttgccaggcacaatgaaaattttcgaaatagttcagtgtcgaaaatttatctgtgccgaaaatactcagtgtcgaaattaccagccacgcattttcatttgaaaaaatattattaatcatttttttattaaaaattctcagtcattgttgagaattgctgtgctcccggtcctttcttattaacttaataatacaatacataaataaaatccatgaaaaattattggtctttttcaattccgacttttctgttcttttatcgaaaaaacgaccgaaaaactgattcaattcaattcaattcaatttatacgcaaaagcgtgacaccgacattaaaacaaaataaataaaataaaattggtcactgaatgagatggggcggtttcaaaagtaaaacatcaatatcataggtgtcaagaagtttagcaaactcagtagaattaagtaacctcgcctctttaggcaaactcctatagaggcgagaggtacgaataaaaaacgaatgaaaccgaacattggttgaacaataagcggtttttataatataatcgtttttcagtcctgaatatatttttgaaaaagaatcattatgctgaatatggatctttcccaaaattatatcatggaagagttttaaatctatttttattctgcgttttaagagggattcttgtttaaagagttggaggagttcgttatacccgggtatatcatccttattattattacgtctaaaaacaatacgtaaaaatgttttttgaacattttcaagagcatcgatgtcttttttcatatatggattaaaaaccggagaaccaaattccaaaatggaccgacaataaatattaaatatatttataagaatttttgggtttttcgttttaagtgacgagagtaaagcaaaagatgtttcttattgcttttttggtaataa

SEQ ID NO: 4723 - DNA, 3059 bp, Heterodera glycines
caatttgaatttgaattttgatttcatttccaattcctcccttccttttaccctttccgttcccttttccttccgcgtttttctctcaattattgccactgttcccatcaccgcgacaaagtaagtgcactgaaacagcaaattgatgctcaacgcggccatgttggccaagcacagcaaagtgatttcgagcgacccaatgaaacagccgatggcatcggccaagatgttggccaatgccgagacgagaatggacgggcccgtgtccatcagcacctgcggggggagggagggaaaggcattagtggcattaattactgtggtatttcatttgcattttgttttccattttgcatttcgattgttttccatttcgttttgagtgttattcaacattcattgacctttgccattgtgtccgccactttttcctcaatttcgtcgtcactttgtcccgcctttgtcgtccttttgtccccctcctcctcctcccccttttcctttgttattctgttccacgcgtgagtcatcaaaaaggcggcgtccacgccgatggccaaaaccaaaaaaggacaaacgcacagaatggaggagaagcgcattccgcacaacagcagaaggccaagtgcagtcccggtggccataaaggggcaaacgcaagcgacgagggccaaggaaacctggggaaaatgggaggggggggacgaatgggaaaagtgggaaatggggctgggattggaaaatcttctatctgattcgaagaaagtcaactttttcccaattgctgaaatttactggtcagttaaactaatgagtgaatgccttgtggacggtcgcctgttgaaaatacgcggcggacaaaggaatgctaatggccgtacagaaagccatgacggcgaatccgaagccaaggtacggcagcatggacaagctggcacggacgaactccgcctcgacataactttggcttatgctcatcacatggatcaaatcactgcgaaattcgctgaaagttaaaaatgatcaaaacaattatagtaattgattgaacgaacttctcgaagaacttggacactctgatcagatactgcttcatctcgtcgctgctcagccccaacagtgtccgttcggctcggtattgaagggcgaccatctccacagaagcgatgttggtgatttttgtggtcaaattgtttttggcaaagttaacgccgtggaaatggggctgaaattaaaaggtgatttaaaatttaaacccgccgatggcctttgtttgcctgaatattagcttttcgcccccacacattgatgttcggatagttcagacttatctccgctgcttttcctccttcttccgtttgggtgacgaatcctttctgaaatttttaaaaagtaattttaagatctaattgatgcaaatcaattaatttttgactttttacttgcccaaaaaagtcgcaagggttcgttaatgtcgcaaaagttgtagcaaaactcggcaaatgcttccgacttattcgtggcatggttttggagagtgatgttccaatttatcaggtcatcgacctgaagacaaaccaatgttttgtgccttgtgccattttggatattaatttgcccattaattacccccgctcgccctaattatctttcctcccccttttattttttattttcctattgatttatttggctgcttttctcctcactctgatcacttcctccagcattttgctctgcagcatatttgtgccgatcactttcggtttgatcagcacgaaaatggcgaaattgctgcctgtgccggtgtcgttgaaaaattcgttccatgcgtccgattcggccaaagaacgcgcgccgtaaggggtccatccgttgagatcattcacaaagctgacaaatgagcactcatttttaactttttattatttaattaattttcatttacggcgttttgaatattttcactgcgcccaaagtcgaaagaattgagcaaattgccattattaaagtgcgatgtttcaccacaaaaagagcccatttttggtaaaagacgtgcaaatgggcaataacagcagttttattatttcgtttcactgaaatttataatttcaattattatttaataattatttcaatcattttttgtttaattattaatttgtaccaattgcatcctttgggggaacaacgatggcatttgttcgtttctcctctttaaaattcggagtcactttgtccattttgcttaaattcagaaatgcacattaatagcgaataaataattaaataatattgattaaattattaaaaagtattttcggtgtaaatatttatgttaaaaaaacatttacacaaaataattgcgcattaaaataggaaggaaaggaaaagagaacatttatttatttatttatttattcgttccgagaaagtggccaaaacgagtaattaataaatgaccatttttctttgctcatattttgttatttgttcgcatttcgcccgccgtttttccattttccctcttttttttatttccaaaatttgtaatttcccaattttcctctcatccccttacaaaaagttaccaaatttaaatacttttgtggcatttattcagtcgtaaaaaattgcaatttcctccgtttgaccttccttctgcttttttttgtttgttttgtcgaaattcgacttttggacggcccaaagtgatcacttcccacgtcactgtgagaagagaagaaaatggaagagaagggaagggaagagcaactttctccggtttaattttacaacaaatggaaattcagcgaacggatgggaaaaagggaaaaaatgggaaaaaagaggggggacgaaataggggacggcggaccaaggcccatttcaaatctattagtgttttcgatcacatgtgtgtacaattaatttgttgaacacaaattgtgaaagaaaaatgccactggggaggccaaaggcctttttggggcaaagatttgcgaaatgagcgaaaaagttcctttgaatggaattcgaattgtcagattaagaacgga

SEQ ID NO: 4724 - DNA, 1612 bp, Heterodera glycines
  misc_feature (48)..(48): n is a, c, g, or t
ttgtgaatttttaatattagcggtgtgagatgaaaaaaaaaaagttancggggcctcaaaaatcgaaattttggctgtgttttcacttaaaattggtggctcagttagttaaattcgcatttttggagctcgggttcgaatccaacataaaaataaataaatttccattttttgactaacagttcgcgaggttcccttgtaagttttcgatgagaaaatccctactcaaatcattacttcctattaaactcacaaataagatcaattacttttactcgcttaattaattcgaaattcattttcagcaagtccacggcgaagccggataaacactttccctgacattttgccaaacagcacatgaacacctgtggagaaaagggccacaaattaatatttatttcttattaattagcatttattttattgggacattccattgattattgaatatttttttgtttcttgaattttattttttgcattttatttaatgaaagcgttggtttttaaataaattatttttcattaagccgctttgtcttcgctttttaatttattactcccattatctcagctttttccgatggatgaacacttgtcagtcggctaactcaacaaaagcttttatcacattttgcctttagtccgatcgatcgctcaaaaaatacgcaaaagcgaacaaactcaaaaacatttagctattttatgttcaaatatttgttacaattaatgtataaaattactcacaaatggcattattagtgacttatttatgggaaacggaaagtccaaaatgccgtttcaaaatgatttctcccatttttttgtaataatttccgttgaaaaagcgaagctgactcatcatcactcgtaattatttgtaatttgtacatttattattcattcattcgttgggttatttttgttttctctttgaattcgttgtcaacaaaacccccgccgctctttcgccggccaattcaattgatcaatcatcgatgattagtggtgatttcaccaaaaacctgttcaaccaaccaaccacacacatcagagaaatgaaatttagttgaggaggaaagcacaattcaacactttgaaccaaataattaatgcacagactttgagttaaaagcaaaataattgcacaaattattaaattaaaaacgcagaaaacatcgaattttatcaattcattttacacaattatccattttcagagaagaacattcacattttcatatttaatttcatctttaaatctgccattaataaagcatctcaaataatccgccactggtaattcaaaagacaaataatatgttaataattaaatagataatatttagcatattatttcctactctttctcacaaaattttcccggggatacgaaaacaaattttaatttttgtccaacctacgattttcatagtgaatcaaatacaacaaagttggtagtgtgttaagaagctatcattattaagcttcgagaaacgatgggacaactttaccttgtccgtttatgcctgtttaaaaatggacatgcgacaaaaaacaatgaaaaataaattaacaattttggccatctatcgtgccattaccatcc

SEQ ID NO: 4725 - DNA, 3898 bp, Heterodera glycines
  misc_feature (27)..(27): n is a, c, g, or t
gcttggctcgtcctttcttctcccctnatgtactcccttttcttctcctcctccgctcctaaatcaatatatttttgttgcacataaattatagcccatgtctcagcaaatgcatttaccaatttcattcaattatttgtatttttatttttaattttaaaattattaaaattaattaaaatgacatttatttctcattttgataatttcccaaaaatattatttaaaaatgataaattattttcagacaaattgctcgcctcgcctctcccacacattttttggagtgtgaggagccgaggccgcaatttccaaacttttttccaatcaccgcccccgccccgtaaatcgtcgtcccaaatggcgggaattttgtccattttctcgagttttctcgaagcaaatggacttggcggacccgacttttggggacgatcgattctcgtgatgcaggtggacttaaaaatttcgtgccaaccaaaactgttttatattatctttaaaaatcttattctgaaattaaatttttgacaaaagaatcatcactagggcggggacaaatattttattataaatcccaaaatatttaaataaatattttcaaaaaaatgctgaaatgttgaccaaaatattgagcaaatatttaagaaaaatgaaaaactttgtggaaaaaaataattaactgctcataacactacaaaaatttattcattgattacagctgcaaataatatatttttcgagtttgaatgcattttctaaaataagtaaaattataaaaatcaaaaattttggtcaataaagaaaaaaacaaaaatttggttaagaaaaaaaaaaaacaggattttcttggaaaaatttttgaaaatttttgttatcgcgttaaaaaatcttttagcatttttgttaaataatttcttagttttacattaaaagtttgaaaaatatcaaaatatttataaaaatattgacaaaatccctaatattaaaataaatttttattttataaaaattcaaaatatttttttatgactaaaactgacgttcaaatgcaaaaatttaagcgcagaaatgcgttttttatctcctattcattgcaataagcaaaaaaaaaaaaaaaaattcaaataaatgtttgccccagccctaatgatcatctctgattttaaaacatattttaaagaacaattaattaaagtttgaaaaattattttcggagtttctcatcgaccaactgagtccccccccccaggcgttccatctgctgatcaactcttatctcgagctgcgctttttcctcccgcttctcctctccgtcttcgcttcgccccccggcgctttgcttttgtcgcgccttctcaccatttgccagtccctttactttgtactgctccaatttgtcgcctttgttctgctgctctgccgtttggtgctcaattcgatgattctcccattggtccggatttttttcctttttttaatgaaatgatttgaagatcactgtccatttggtgctgatcgcctcaattctgctccaacttgtccaaatgcttttcgtcggccaagcgggcaccgaattcttcatttggtgttggtatttgagtgcgtgtgtcacttttacgctgtaccaggcaatgtcagtgttcagtgttatttgtctgttcacatcggagccaatgttttggacgacattcaacttgtttttggccaattcatttttgaatcgactcgttttttaattgttccaactctttttcttgattgaaacggtgctgattgtgagccgttataaaaaaaagccaacaaaaagggcgttataaaaaaaaccatcaaatgaaaaatttcaacaaaaaactacccataactttgctcaaacccaatgaaaattttaaatctttaaacaattctattttagcctccaaaatttcaaaaaatttggttatgtttcaaaaaagctatggccaaaagtacatcaggaaccaggttttctgacatttttggcaataacttttttgaaattttgcaggctagtagagaattgttaaggctatcgaatgatattaagaattaaatttagttaagtttgagcaaaagttataatttaaaaatttctgctctatttaaactcaggaatgctttttaagctagttttcacagtttttcactatttttggtcaattttcaaaatttaaataacgaacaataataattagagctagaaatttaggtaagaaaaatcgcgaaataggtattaaaaaaagctcaaaatagttattaaatagatacaaaaatcccgaaatagctagaaaaataggtaaataaaattttttttattacgattttttagtggaaaaaagcaaacaaagagtgaaattttggttatatttctttgtaaacgaataatttaaatatttttaatatttaaaatagacattttaaattaaaaaattatgtcaataaaaaaataaataaattttggggataatttttcaatttttgtatcgaaccgacaaaaaagattcctgttgaattcaaatagaccaaaaaatctttttttactttcaagccaaaaaactcttggaataataaaataaaatgaagtttttactaatattttttttaccggaaaaaggattcagtaaataaatcctttttccaatttaaatttacatttttttaaactttgtctgttttaatatatatattttcgataggcttttttccaccgaacgttctcccaaactttgtgccacaattgcgcccgctcggacgacgcgcgtccgccgcttttggctggctccccacccgccgccgcttggccaccgtttggccgaggcgcgtgggctgcgtttgttggaggacgccgtggtggcctaatgaaacgaatgatgaccaaaaacccacaaatttattgtgccaaattgtgaatattttttatgttattaatttaatttattaattaaataaaaaattaattaataaaccaatttagaaagggccaaattttcccacataatttgcttaaaattttgattttacaaaataatgatttattcttctttttttattttgactttttgcatttattcttctcttatttgttaaagaaaaatggtaccgaattctcatgggaataaattaaaaacatttaaagtattttcgttggggctaaattaatatgtctggactatgctgcccaactaaataggacatcattttcaccaaaaaatcaggctttccgtgttttactcgccccccccccactctaaaaattttaaaaatctatcattttttgaaattgttaaaaaatgaacaattcaaataaatcattaaatgagtcagacaggtggcataaaggcaatgatattgcgcaaaatctcatcaaaatcgtcaaggtttcgtcgcttaacatcatcaattgggagtgtggaagaatcaagccaagtatctgttcggataccattggttaatttacaacaatttggtacagcgccaaattgcaattactttaccacggttactgtatgtggaccggcacattgctgacccacattagctttgccgagcccgatgaagaacctcggcattctgaaaaatcagcagcgtccaattcattggagcagagcgggaaaagtgatttgaaattgtacggcatgactcatttcatgatttaattgaatttttcatttttaacattttcaaaaaatcataaatattattaatctatgaccagcagagatatcaaaacaaacatcatattcgtgaccttgaaaaccccaatttttctttgtatgtcaaattttataaatttggcatcattcgaaagctctacatgtttagaagctgttgataagataatgctaagcgatagaacaacttctaaaaaagttgcaacatg

SEQ ID NO: 4726 - DNA, 2761 bp, Heterodera glycines
taattactagtgatgctcgagactctcggtctcgactcgagaaaagtctcggtttttttggtctcggtctcgggttttcagtctcggtctcggtcttcgagactttcgagactcgagactgagacttttttacacccctagttcttcgttttttcgttggatcagttccccttgaaaattggacataaaatatggactaaaaaagcacgaaatatggactaaaaagctcaaaaatggccaaatttggacctatatggactaaaaactgccaaaatatggatttatatggactaaaaaccttcatcagatcaaaaaattttatttaataaatggggctaaaatttagcccttttcaccctcaatcagaaaagacacctaaaaccatcaattttttcttaaaaaattagctcaaaatgccaaatttggtaactttttgatgaaaatcttttaacaaatcacacttaaattttctaaattttccccggcggcgcctaacggcaccgccgtacccctattcccgaaaagttcttttaaaaaagagcgccgcaaaaaaatgatgtaaaaagtcattcatatgaaaaggaaaaacggactatagcttaattaaataaggaaaaaagcaaaaaatgttataaaaacctccaaagattgttttttaaaattttttatatgttttaatcgatttttaagtgaaccagaaaaattttttggaaaaagtctcgagtctcgactcgagaaaagtctcgggttttttgggtctcggcctcggtatcgagtctcggggtctagtctcggaatcggtctcgagtctcggggtcaagtctcggtctcgagtctcgggaaatttttggtctcgagcatcactacaaaatcggtcatttttatcctccaaggcttattggtcacttcgccaatatggtaatgaaggtttgaatgcaattcacaatttttaaaaacaatcccaaagtcctaaattcagaaaatggccaaattccaaatcgcaactccattttgcttcttttctcacattttttcctcctttctttttttaaattgttatgaagtgtaattaatattttttaataggaaatgtaatgcctcggaataaaccaaaagggaaaagcacaaagaaagaaatttccttctttttaaattaattttgactctattattcttttgtttcgtattgcaatatgtaaatgctctttttatctgacattttgcgacgatctctcctaataggcatttgtaaaattggagtttatttgggtttagcttagcaattattttgttattaatttttcttaagaattagctaatgagttagttgtaattatagtacaaaaataataattcataattacattgtccgttttaaatgaaaaacattgtttgtgattaagtgtatactatttaagtgtaattgcttacatattcataaaatggctcagctcagtttcctttatcaaaaatataaataattctttttttctgttttttaatccatttttgtccgtttctccatcatttattaaagaacccaaacctcattaagccctaatttctgtctttttttttctttttttggattgagaaaatggagctgtatttgttccgtcccactgattaccaacgactttacaattgttcctcgtacaaaattgacgacattccgcttgttaaccgtacccataccgtactcggcatctccttcatcatgcagttcgtgctgttccaattgtgctacatcccttggtacgtttagtttgtgcttgttcccctaattatgtgctaacatttagcatgttctccatttggaaacaccgtgaccaggcttgctacaagttcatgttcttcatcggtctcatcgacattctctgtttattcatcaactgcttaatgcacggctatttcgccatcacaggcgttgtgttctgttcctatcccgacttgatctacttgtccggcattgtcggattttgtaagcggcctacggctgttcactaaaaatacaaagaaaaagcgaatatggatcggtagctcaatggtagtctgcccattaaagggttggcgtcggctcaattcaaaccctatgcctaattttggctcatttattattttattggccgtccctttttgctttggtatgtattatggctttcttattttgtgctaattagtgtcacttttggcatttcaattctatgctaattaccatcccatttgcccttccgttttcatccttttcttttctcagtcttttgggtggccgaatcatcggcggacattcttcttgcggtaaaccgatgtgttgagatgatctcgcccgtttggggggaacggctttaccacggcgggcgtgcctggctttggctcattccgcccctcctctacgccacttacatcgccatcacgcaaatgccggttcttttcagcggcatttacttttcctggttctttaaccctcatggtatatgtcatttgtacattggcatttggcttttccttttttagcatttgctttaccctttttcatttttagtcggatacatcgacgactttggcacaattgtgagaaatgcatttttatattataattcttgcaagtccaagtggtgttttattttggtctttattatggtgctgggacgttagtcaaaaaaccatcaaatggaaaattattgacagaaaataacgcaataacttcgcacaaaatgaaccagatttcaaaatcttaatatttcgatagccctaagtgttt

SEQ ID NO: 4727 - DNA, 1599 bp, Heterodera glycines
caatgcggcaggaggcattacgaactcaaacattggcatgacaaaacagcagagcaattgcgatttcaaaatgattgaactccattaattaattgaaaatggcaattaatttggcaattcgtatatatacagcgaaataaccttatagtaaactgcgatcacaaacaatccaatcgcttcacaatgtcatttttgtacacaatgattgatttttcgattaattttcactttgaaagaagaattaattgataggtttaatttaataattttcacgcttttttaagggcctaaattttttctataaaatgacagtttataatatgccattatataagtaattctaaaagtcaaatcgtaataaacagttccgctgggaaattttaaaatttttttcgtgcttttttgaagtcaaatttgaaatctttgggtgccaccatgaaaaattgttgctagaaaatcgttgtaaaatttgtatgaaaattttcaaaatttctccttattgagaaaattaaacgtttagagtgtgcctgttttttttttttgttcaatttaaaacattcattcaattttctctcgttccatttgatcaaaattaattaaaacataaagaaagaaaaaaagagacacaatatttttattatttttcgtaaaaagaaagtgcgacccaatcgtatgaccgattaattaataacaaattttgttgaaagaagaagattttctgaaagttcgttaaatgttttttttattataattcaaatttcttattaatctaatgatgttattttaaaaatattaaataatttagaagatctttataattttaaattaatcttatcatcaaccattcccgaaataggttaattgcgccaatttaaacgccacgaaatgaatgaaatgggaaaataatttaaggattcgaataaaaaaaagtataataaattaaagaagcaatgaacccaattccaccaactcatatttaagcagccaaaaagtaattgcaaacacttcaatagaaagtgtaaaatggcacaaattcatttcaaaattttccttatcttttctctcattactttttcacaatgccgaatcaattcagaaccgagtgaaaaaggtgagaaaaagaaattaaaaagtttaatttgcttggtcattatgagggcactttattggacaataaaataagcgcaaaatattcatatcagtagaaatctctgatattggaataacaacattttttgctcttatttctgaatttcgcacaattgtcttaattttcattaatttcattaaaattcccttcttcaaaattttcgagaatatttttaaacaaaattaattaacgataatccattaaatttacctaactgatgacatgaaatcatttccaataatttgctcattagtaaattgatgagttttcaagatgtaactctgttttagaaggcccttcttcaattggtggaattcaaaatgcaacaagcgatcatcggtctgctgctgctgcttctgatcaccatgcttcttcatgcgatggttttggttggacactgaacaagggaaaataatgtaaagtgatcgaaggactgatggattggaagt

SEQ ID NO: 4728 - DNA, 685 bp, Heterodera glycines
tatagcatgaataaaatatgaattttttttttgccttcgcgcggcagggggcgagagagcgcggttttggtggggacggcgagcagcgatttttgaagggagagggggcgagcgacgactgtctgtccggcagacggaagagtttcctaccgctgctaatgcccgcgccacgctgggagttttcttccttcctaatgctcgccccaatctcccccggcggaaggcttatgtctataatgcttgcccaccccgcactcgctggaaatggggggcgtctcttcccacgctttaacactcgccgctccaaatctcgcccggggctacttactaaaaataccccccccccttcccccagctggtcccataatgacataatgttggtccatcccacccccccccctgcccccatcccgcgggggaggaggggggagggcttttcctttcaatgctcgcttcccccccccgcccccgccggcggtggaccctttcccccaaatgctcgacctttccgctcgcaaaggcgactacatatgtgcccacatttgtgtgtgagtgcgtagttttgagtgcacttcatcaattttgctgctagctcttagcagacaagatgtggaggtgaatgtctgtcctccgtccgggcccgagggcgggcgctcagatgacgcgtgcggcaacaaagcgccag

SEQ ID NO: 4729 - DNA, 3185 bp, Heterodera glycines
gccgcccgaaaccggaaaaatgaattttttatatctactttttttcgatgctcgtttcgtttcttaaaaattgccaacattggcgtttcgtaaaaacgtccatcagggagttttataactaaaactgtaacccatggacattggacaatggttaatctcacagtagatggacaattggacaatggttaatccgacaatggacaatttgacagtcgttaatccgacagtggacattccgaacaattggacagtggttaatccgacaatggacaattggacactggttaatccaacggttaatccgacagtggacattccgataatggacaattagacagtcgttaatccgacaatggaggacctgccggcagtggttaatccgacagtgaggacaatgggcagagttggacgatcggacagtggacaattctacagttaatttaagaattaaaaaaaaatttgtagtcaaaaaaaatgcgaatgcaatctccaattattaatcgtggcagaagaaaaacgaaattggcttttaaatcacttgtgccatcatccttcgttacttatcgcacatttatatcgttttgcatttttaggtcattcccaaaaaaatattaatttaatagcctatttttatttatttttcttgttacttagcacgattgtccctttcggcgatcggcgttttcttatctttttgtgtattactacaggatttccactgtcggactgtccactgtcaaattgtccagtcagggattatcgaccaaagcttatgcaattgtctgtatgaaagtggtgattgttttttaacaaagtctgtatttactcgtgtttttaagagttaattatgtttaggatttgtaatttcgacattttatggcacttttataaaatttctaagtgggcaattttacaaaaggaccgaactcgcttttttcaaaaaaaaattgaaatttttgaatctttttatacaatattgcttttaatacaatcatataaataacaattttttatcttacaataaaattgtttaaaatatttttttttggcttaaaaaatatggtactttcctgttatgtgtccgcaaaataaatttttaaaaaaagcaacaaagggcacgcaaattggaaaggcagcgcaccgaaattatgaaggaggcataaaagccacaatttgctccaaaatgttttcaaatggatcaacttcacggtttttaacagcctcgcgccaaagaaactcgcacaaataggagtcaagcatttgccggtgagaggcgacattttaccctttaatattttggtccttcataatttcggcgcgctgcctttgcaatttgcgtgccctgcggacacataacaggaaagtgccaatgaggactgaaattttttaatatttccatttcaaaacacgggcaataaatattacggaatgcaaaaaatgtttaaattaatattccaaataaaaatggaataattcgaacctttcatttcaaattcaagataaaaaataataattttttatagaaatatgtgtgttgtatacataaacccggcccgacgaatttcgaatttttttaatcgctttataatttagccaaaattttttaaaaaaacagcagaattgagtcatttttggacagacaaaatctactaagaaaacgggttaaattttcaaaaaaaaaaaaatgtacccggcggcgtctatcgatagtgccgattcggcaccgcctgccccttactataatcaagaaattttttttacaaagtcaaccgcgcttaaacaagtcgagaaaaaaaatgttgtttaatcaaaattacttcataaatttttagaatgcgagatttgcgagattaattccgcggaattccatcccgaaaaaaacgaaattttagttttttatttgtgcctcaattttatccaattaaatttcgcaattctttctttccacatacatacctaaataaatttgctaaatactttctcttcttctcccacgaaaacataactaaaaatagcataaaataacggtacaaccaaaccaaccaatcaataaatcaagataatcgttactctttgatctttggtcaatgttctttgtaaaacatgtttttaaacaacatcttaaccaaattatgttcgtggtgttccttcttgtggtggtggtgttcatgctgtttcttctgttggtggtggggctggtgcggcggcttttcctcctcttcctccacaacaatttgcatttgttcaatggcattgttggcttccaacaatggcactttcggtgccgtttcgatcagcgccaacgcctccgtttcaatatcagtactaaagcctcggtcatcgtccaaaagtttgatgtatgtctggatatattaaagaaagggtcctcagcaaattttccctcttgttcaatgctgaacaatggcatttccaaattttcaaaaccaaatattggcaataaaatctttaaacgttggtccatttccttcactttggtactgatttggttgatgatttgttgggctagtagcccgcgctgagctgacccaccaattttggcatttttaattctgtacaattccttcaatgggtccatgtaaaaatgcgcgtacattttttctgactcggagaaaattggttgaaaatgaaaatccttaattttgttttttttaattatcataattataatttattaaattaaatgtggcaaaaaataatatataaaattatttttattatttttttccaaaataaatattatcaaattttctcgaattttacctttttgttcagctaattaatttttaatgcaatttaatcaattaaatgtgataaataaaataattaataaataagattttttggagataatcttttattaatttttaatcgggttttagtttttatatcaaaaaacaattttcatattttaccaaaaatggttttgactcaacgttacagaatggacaacgaatttccttctttttttcaaacctttaaaattaaaaaaatattttttttattatagttttgatgccttagagcaagataactaaacacaaaccattctttgacgcatttgtagtgagaaagtgactgaaaaaaaattaaattaatttttataatattttaatggactgttttttccaggtacataataaaaaaatgcaaatctatcatttttt

SEQ ID NO: 4730 - DNA, 3136 bp, Heterodera glycines
  misc_feature (2481)..(2481): n is a, c, g, or t
  misc_feature (2551)..(2551): n is a, c, g, or t
ggatggcatttcgaggctccaaaattttcggaaatcggaattccgagggtcaaaatttttcggaaatcggaattccgaggcttaaaaattttccgaagtcgcaaatcggaactcataccccaaaaacgttggaaatcggaattccgtgccatccctggtatctttcgtttgatagccctgctggcaaattaatgtcccctccagcgtaaatgcccgcgcgtgtctttgattttacctcgtgttcatgaacttgaatttgttcctcattaactttcatttcattgaagcaaattggacaatcatcctcatccttgtccttatctttatcctcatctttatcatcgttcttgtctttgtccttgtccttttctttattcgcataaactgccgttttaacaacttttttgacagtgaatttgcacttaaaatgagaaaaaaatataattaaaattaatgaggcaaaagcattttctgggccggagggtgtgtggagacggactgctgctctgtttttatgttgtgaaaattccagagaaaacagaatttttttcaatttaggatgttttcctaaaaattacttaattggggcaattaagcaattatgggaacaaaggagcaaattataaagataataatttgtagaaaaaaaacaagacgcattagcggtgtttattaggtaccgcctttacttttcaagtaaaaaatttcaaaaaatagttcgatttgtaaaacaacaatttaatcaaaaataaccaaattttcctgtttttgagtcaaattttttgaaaaatttcttaagtacaccgcaaatgtatgcgaaacattcaaaattttaattagatttacaatcataggcgatggacaaaaagtgcaaaatttgctaaatttttgattaaatcaattcataacttttctcagacgcaatcaaattgcacaaccttggtatcatacgatagcccttgaattgggttattagtttgctaaattaaaaaaaaatcttattatgttcttttaaagttatgacaatttttccacttttttgcttgaagttttgaaaaacttaataagatttttttaaatttagcaaactaataatgcaattcaagggccatcgaatgataccaagattgtgcaatttggttgcgtctgagaaaagttatgagttgatttagtccaaaatttcgcaaattttgcactttttgtctgacatagcacctggtaaaatcgcaaatccctccagccctggtgttaatttactgaaataaacattgatcttacctcgccatcataatgaaaaatggacagttcaagccgttcaattttgtggcgatataaatgcgtcaaattcacaggaatatttagttcgtattcattgaacacataaaataaaattaattttatttggtttttaatgaaaatcctcaaggttcccgaattagtttcgacaagccaactatgaatttggcgtttggttacaatgcttaattcatttaaaattttttttctaattttactccaacttaaaatccctttcccgagtttgatcgatcagctcagaagtgattaataaaaattatggatttaatccaatgaactcagctattataaatatggtttaaatggtgcctttttctgctgcccggatgttgttccagtgccatcatcaccaacattcggcaccgcttctgccatatcttctttatctttgatcagcggggaatagcccaacaattcgcgcttctcagcggcagccaaatcattacggtcattagcattagcgttgttctgctggtctccaccattaccaccgctttgaccattaccgccaccgccaccgttttgttgtggtgccctcctattttctcgcacaattgcgtacagaagggcgtgataattaccaccggtgccctcatttgtcgtctcgactaacacgcgtcggtgccaaaacagaccactgggcttgatgctgaatggcattgtattattttatgcgatgatgaaatattctcggcaggatttatattttggtgcggaatgcgcgacatttacagccttttaggggtccgtgccgcattttttgctgcttttgtgcttttttgtctcttttttttgggggttttcactcaaattctggctaatttcttaaaaatttcattaaaagattacaaatttccccccaaagacgcgctgccggatcatttttgaaaaaaacgaatcttaaaactggaatttgccatttttggacaaaaatctatcaaaaaattacgattaatttcaaaattttcccagcggcctatcgacatcgcctgactattatttgtttttccattaatgactaatttagtaacaaattttagattaaattatttcatatattattttataaaaaatttataataattttataaaatatgtgaaaaatggggtgatatagagcccgaaaagttcaaacttgctggtctcgctgccccgcggcattgngattcaaaattttttcgggacgaaatccctcgagtaatcccgcaaatctcgcattctcgaaatcccgctntttccaaaaaaggtgcgggattcggactggaaattcccgcaaatcccgcgcgggatatggccccgctccgatctctagctttttgattttttacgcaaatttacaattttttaagtggctaagtttcgctgcgttttttgccatttttgaaatttttgccgcttttttgaactcgtgcgccgctcctttggtgtttggtgggacggtcgaagctttacttactggatttaaaaaacccctctattagaacggcccgtttggctcttttaacgtctaaagatggaaaattttcttcatttaaggaaaaatttcacaaaaacattaaataaaaatttaaatttcgaaaaattgataaaatttgacgaaaataaacataaaaatgtggaaaatgttttatttcacgcgattttattttttaaaattttttgtgtcttctcaaaaacattttgaatcctattttataagaaaataggatttaagtaaaaaaaatttggcgattttgctcaagccgactccagccgaatgcaagcgccggcgccgccacatggtccagtcagagcgacttctcatgcgggcgagggcaca

SEQ ID NO: 4731 - DNA, 1242 bp, Heterodera glycines
  misc_feature (19)..(19): n is a, c, g, or t
  misc_feature (27)..(27): n is a, c, g, or t
gcataaatatgacagaaanatatgacnataaagcgcgaaatgaaaaattcaaatattatatgcttaaaaatccgaaaattttttatactttatgcttgaaaaaaacgcgcaatgaaaaaaaaaatgagtgcgagcatttgtacataaaaaattaaattgaatttgtgcctatatttctttcttcgtctataggtgccgccgtgaaaattttgaaattttaattgtaatttttttgttagattttgtctgaaaagcccaaatttctaatttaagattatttttttttcaaaaatctgccgtcaggcaccgccgcgggaaattttggaatttgaaatttatcaagaaaatctgaatgaatttggatgataaaagtaaaactcggccacaacccaagaaatcaaggcaaaaatattaaaaatagcaaaaaatgcgtcactaacccccaaaaggcggaaaatgccgtgtttccgggccaaaatagaaatcctctcggaaacatttacccggtcactaattgcaacgcgcaactatttttttattgttgccagttttaaaatataatctcataaaaatctaaaagctagaagcttaagcaggatcagatcccttgcgtagttttgttggatcccccaaattctcaaccccgaattgtacctatatttttccttcttggagaaataaaattattaaagtatgtgtagatctataaatttatttataaaaaaaaaattgaaatttgttaccaaatttgcccattaatgtaaagacaaataaataaagtgacgcctggaaaattttgaaaaaattattgtaatttttgatagattttgttcaaaaaggccatatcaattttgagtgagaatgttaaaaattcggctaaaacccatgaaaagaaggtaaaaagctaaaaacgtcgctaaaaatgaatcaattcgatactgatcacccattcgagatcgaatttttgatacatgttgtttcaattgtttttggttcataaactcgatcagagaattagacaccggatcatttatttgttttaccttatttttatcgcatcaaatgtttgggatgttaaaatccccacagtatataatattttcagaatcgctttggtccgaaatgaatttgagtagctttttagtattctgaactgtacaattcggtggacgatatatatttataatttgtgttggtttttttaaaagtaatttaatgtgtataatttcactttggaatttt

SEQ ID NO: 4732 - DNA, 1810 bp, Heterodera glycines
ttttgcgaaggggtctccggccatgtaaattaatgtaaatcaatgaccttttttgctttcaacaccgcttttttcgcggcacgtttttctcaagacttttgggggacaaggagggccggcggtgccgataggcgccgccgggaaaaattttgtattttttaatgcgatttgttaacagaatttgtaaaaaaagaccaattgattaatttttgggtttttacgatgcttaaaatgaaagaaaaaaagttggaatatttttttaaattaaaatttcaattaaaataatggtaaagaaaatatgaagaatattctatcccagtggggaattgaacccaagcgagaaataataaaatcagaaggtttagccaattaaatgaaaataaataatttaatttttttttttcaaaaaatttctccttcttcaccattccctactcttttctcacccagacccccattcttaccagtgcaaatttttaccggcggtaccggtactagacaaaccggtaccgatactttgatttttgaaaaaaccggtaccggtaccaaaaaaaccggtaattaccggtcggtaccggtaccggtaccgctcaaccctagtttttagcaactataaatgtgagccctagcctgtatcgtttcggcgccgtcgttgcggcaccagcccaagttttcggacaataacttttttttctttgttaaccaaatccagacaaaaatcttggtatcattcgaaagcttaacgtgtgtagaaggctatttctaacctattataaaaggttgattgatctccgatgaaacaatttttgttcatcatacataagaaaatatgttgttttgcctttctgtaaatttatttaactgacaaagatataaaggtacttttccgtttttggcaaattttgaatttttttaaatcaaaagcgggcgcgtagaattgctaaagctacgcaccaaaattattttgaaggcatatatgccacaattagtgttaagagttcttcgaatgatgggtctgcgctagagaccggcgcgggacgggatcccaagcgggattttgcgggctcccagtccgcaatcctgcattttttggaaaatacgggattaatcccgtgggatcccggaaatttttcgaattttctaaaatccagcaatcccgcgcgggatcccgaaattttaaatgcgggatttgcgggattaatccccatgggatcctgtcccgtaaaaaattttggattccaatcccgcagcgggatccgcaaatttgaaatttccggtctctagtctgcgccacgggttttgacattttcgcgccagaggaattcgcacaaatacgagtcaagttctactcatccacttttgattcaacctttggccccaaaacggaaaagtaccagcaacagcttctaaaagttgtcttagataatacatttggccaccttctgatcctgccccacaaaattttgagtttcaatcccgcagcgggacccacaaacttgaaatttccggccaccgagttgaaattctgcaatttccaaataaatctcttttaaaaaaattagatttaaaaacgatttcgccgaattaactcttttttcaaatgttgttagtggcgaccggaccgggatgggccgaattgaaaagagaaaaagcgaagatgcgaaaagcgagagaaaatactctgtgattttcctggttaaatctttttctcggatcacgaataaatgacgaaattcgtaccccattttggggttaaaatttgaaaaatcagaggtaaaaatgccgggtcccggtggcgccgaccagggac

SEQ ID NO: 4733 - DNA, 1790 bp, Heterodera glycines
agggaccagagcgtttgggcccccctttttgggccccggggtcgtttgggccccaacccaaaaatacaaaaatgtgctgtttttaaaaattaagattctaaaaactaagcctgagggatccctcgccacttggcataagttaggtttaattaacattcgctcattttttacaattttacttattccaaatcctattattttttaatagttaaccaatttgatttacattctgatttggacatttttcagaaatggctaacccaattgcaaccaaaaaacaaaaagtaaaattgtcttacgaaagccacctttacaccttcgctaaaatgagatctgatgggatgacaaaattttggagatgcgagttcaaaaaatcaatttcacattattttggagtttctccggggaatttctcgcaactatcgaatgaacccgtgaatttctgataatttttacatttctattgttaaaattattgttgaatttattttaaaaatgcgtatctgccatattattaattttctttcggtggttttttttctctcgctatttctttttttaaattttcatttcaattctttagtcggaatattacaaaataaaaatattttcatttttaaattctttgtaaaaccgatttgatcaaattaaatacaaatatgaagcataacaattgcaaatatttattcatcttctcttcaaagtgtggtcgcccaattacaattcgttgtgcctaaaataaaaattgccaaaaaacttaagacatatttttttggatttacagagtttcggcacgcagaatttcgacgacttcagtatgaccctttttttgagcataatcaattgccatgtcaccttaattttaaatcagtgattttttgttttcagaaaaatattgaaaaaattgtgtttctttatagaaaaaaattctacatattatttctttattaaaaaattttaaattgaagaatttctcggtcggcactgccagaccttttcccagaaatattttgaacaacgggtaatccacaaggcctggttaaagccgttgcggattaatggatacggcctggagcccagaggagaaaatccatcgggtcgaatctaagccctccatcatcgtgcctgattctagatgccctggggaaaaattctaatttttattagaattggccaaaattttaaaattttctgcccctctcctcttgcgatcaacgaattattcgaccactaccattttcatccttccaatcggtgcgtgcttttttcgacaccaaatattgcacaatgtccgcttgtccttcaaaggcggcgcccattaacgccgtcctccccgaggcgtcgcgaatttccaagtcggcgccagctttttccacaagaaatttgacttaaaaattaagaaaatttgaatttactgagcgcgtcaaaagttttggggcatacattttgctaattaattcattttttgattttcctttagccgtaccattttgtgatgtcactctctcattttcggggggggggggaccgaaccgaagaccttttttttgcacttaaattgaagactttttttgctattcacctttgccgctgttgggtaaaaactgcatttttcactaaaaacaacccaattttggccgttttaaagcaaaaaatagtgtaaaatggaggtccggcggtgccgataggcgccgccgggaaaatttttgaaaattttagtgttatttgttacgaaaattgactgtaaaattcaaaaatgtacccatttaaaattttcatttcgggggggg

SEQ ID NO: 4734 - DNA, 2132 bp, Heterodera glycines
atcatcgaatattaatagaaattcagatttgcttttcacatcacttttcttcggacccctcctttcccaaaagttttttgaaaaagcgctccgaaaaaaagtgatgtgaaaagcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgaatttttttttaaatttttaaaatttttttgaatttttaaaatttcccggttggtcccggttcccggtcccggacaaaaaccgaggtcccggtcccggcttctcaggtcccggcaagtcccggtcccggttttgcccaaaattcccggtcccgctctactctagtttttttaaatatgttttctttagtaaaaaaaactgttatttcataaaattgtcttttcttaagaaatttcgttaaatagcaaaaaaaaaattgtatcaaaaaatcataatttttaaaatcaatttaataaaaggatatcccaattaaatcctatcttttactgatccatcgaattgatcaggcaatttttgccactttccacaattaaaaaaaattggcagcagaaaaagaggaacaaaataatggtgaaaaaagttgctcattaattaattaattaccggcaatgtccgtcccattgatcagcgcaccgtgtgacagcaaatagcgcacaaaatccaattggccagagaatgcggcgtatgtcagcgcggtgtgtccgcttgagctcgcaaattccatgtccgcaccgcctttctccaccaggcatttggctaatgagaaaatatgaaaagcaaattaattaatgaagaattaagtgtgtgaagaagacaaggcacgacaaagggtccgacggcgccgaataggcgacggcgggggaaaagtcgctaatgaaaaaagattttcaaaaaattttgcaaattaaaaaacaaagcttaccgtgaaaattttaaatggagacgtttttagctcttatgcgttttaagtgagttacgtaaaattttctgaccagcaaactactgtattgtcgtcggtaatagtgtgctttgtcccccgcccctttttcgaaaaataataatttaaaaaaagtcatgtaaacgccttcctgctgggagttttcgaagtcgctgatcagtgatcacgaatctgacatccatttctattaattccaaccccgaacgcgaattagaacaaaaagatgaaaactatatcttttcaaaatttttgactactgctctaaaattgattggattcgtgttcagtggataaaatgccgtagaaaaaattattttaaaaaaaattaggagtgtcacaaaagggataagtacccaattttaagcctgtgtaataagcctaaaaaagtcataattttttatgtttttcaattaacactgagaagccatgctgtactcactgaccaacgttcaaatgctttcttaagcttgcttccatcaacggcgttgtgccgtcgggctgccgctgattgacatcggcaccggcttcaagcaacaattcacacacttccgagttgccaccaacggcggcggaatgcaatgccgaaaagccttgaaggatattaaaaatgaatttttttttgtttttttttaataggttcaatgatggaaaggaaacaaattagtttagttgcttcgtaaaaatatcaaattaatttccctttaaaaatcacagcccaaatccgtccgcctccgggccaattaggaagcggcggtggaaattgatagcgttatataatcggagcttcgtatttgcaaaaaaaaagtatgccctggttctgaattcacagttggatctgcattttctggacaaaaagccaggaaaatccaggtccaagaaaatccaggcttttcaaggcctaagagtctaaaattgctcaggaaaaactaaaggtatctttctattaataataattttgaattaatctatagaatcagcagctggctgattctcgagggtatgcttctttttaaattaggaccgcagtcgggcgagacgaggaagagggggaggggggggggg

SEQ ID NO: 4735 - DNA, 2317 bp, Heterodera glycines
tggttccggggtctggttttcggtctccagggggcaaagacggctgattggtcgcgtgacggtttgcctatttggcattcgcaactggacgcttctcacgttagggagtgagccgtttagtgcaacgacgatgcccatcggccataaattccgggggcgaaggtcctcttcgacgatgagggggcaaagacggctgattggtcgcgtgacggtttgcctatttggcattcgcaactggacgcttctcacgttagggagtgagccgtttagtgcaacgacgatgcccatcggccataaattccgggggcggaggtcctcttcgacgatgaccacttggccgatgtggggggcggtgggagttcgaaggcggggacctttatgagtccatccggcgcgctctctgatggcgaggaggtactcatgactccatttgagccagaaatggtcggcggcctcccggtaagctttccaaagtgctgcgagacgcgcgggaccggagaggcaatcgtcgtagtcgagatcagagtcgacgatttccaagtcgttggggaggccgggctggataaggtctttcggagtgaggggcttcgatgagtccggttgatctgacacccatgtgatcgggcggctgttgacgctggcctcaatttcggcaaggaatgcgctcaaatcgtcgtagtcgagaattcgtcgaccgatcgtccttttgatgcaggatttgacgaggccgattagtcgctcgtagcaagcccccatccatggactataggcgggaatgaagtcccactgaatgcctcggcgcgcggcaaaggtgacggcgtcggtttcggacggagggccggtcagaatgtcgagagccttgctcgtttgaacgaatgtcggggcgttgtcactcagaattcgctttggtcggccgcgacgactgatgaatcgtcgtaagacattgatgaagctcggggctgacagatcggtggttgcctctagatatactgcccgggtgacaaaacaggtgacgatgaccaagtaggtcttggtgagcgatccgtcgcttagtcgagaggaggtgggcccagcaaagtcgagaccgacgaattcaaagggattagccggtttgacgcgcatagagggcaaaggggggcattgttggcctcgcaaaagggggtgccgtgattcgccggcaggacgggcagcctcggaggataccacgaatggttcgtcgtgcttgaggcatccaataacggctaaggaactcagtcagagtccagtcaacgccggcgtgtctgaggtcggcgtggatttcttggacaattagccgagtcagagatgaatggcggtcgagaaggacgggagaggcgagagtgggcggaccattcgcgtgcaggagccgggttttgaggcacaaaaggccatcctcattgaaaacagtggggtgtttgtcgtagccgtcgggcgagcttcgttggtcttgtcggatgaggaaagtcctggctgctctgaacgaatcgcccgtcggagggccactccgtgggattgacgaggtgccgcttctgagccattttggtcgacgacgcccgatgaattggaggacgagaatggtcgttccgagaagggtcagcatagtgctgaaacgagccggatcaatgaggggagggggcagcggactttgtttggccatgagggtcttggtctccgattcttcaaacgggggatcggcggaaggggagtcggctggcgttgcgaacgttaactcgtcgggccattccgtttccggactcgtgagccactcaggccttttccaccaaatgtggcgagttcggagctccgcaggtgtgcagcctctcgtggctacgtcggcgggattttggtcggttctgacgaaatggaaaatggtgggcggcccttgtcggatctcgacgagccttcgttgttcgaactgggctttgggttcgtcggacttcacccatgagagggcaatttgggagtcggaccataagtgccgctcgtcgatcggacgtaggagctctttctcggcgaagcgcatggcgcgaattccgacgagaatggcgaggagttcgagtcgagggatggtgaagcgctggttcgcggttcgtggccggaggcggtttttggcgaagattaggttcgcttcagagccatcggcagtctcgcttcgaatgtagacggcggcggcgaatgtgtgttccgacgcgtcgcaaaacacgtggagttgcaggcggctttgcttgccgaaatggaatgccgcgggaccacaatcgtttggttttgccatagggacagggtttgattccaagtttcc

SEQ ID NO: 4736 - DNA, 2992 bp, Heterodera glycines
cggtaaatgatttaaaccaaaatcctattttaattatatttggaattagtccatgttagcataaaaaatattttttaattttataaaaatgaatttcattttttattccatggcaaaaataaacatttttttttttcctttttttttaaaaggaaaaatattttcggtaatataggagaaatataacatttaatttttaatttaaaatattgtaagcatcattttatttcgacctttttttcttgcctcaatattaatttataaaattctgtttattaatcttaatacaattattaagggatataaaattttagctaacaaatttttcttaattgtcttttgttgtaattttttaagaatggtcgttatattaattttttaatttaaattattatttttcttaaatttacactaaatattttgtcttcgtttcattcgtgattttactctttattgttttaaagaattatattattcacaaactaattaatttatttttcgtgtaaatttaaaattataaattaattatttgatttaggtttttaaatagtttctagtttctataaactggcttttttctaatccgttattattttattaatattaaattatggaatttgtattcttatatttgttaaatataagttttatttacttttgatgaatagcggcttttaattcttcgtaattgatttatatctgtttaatataaacttatacatctttataaagatcagataatatatgctcttttaataaacattaagatttatcgagggtcataaatcattaaagtattagtatgataatgtttcactaaatcttattagcaaggaataaatataattattatataaatatattaaagttgttattgtaataaggttttaatatttttgctctattcaaacttttattgtcaaattaatttttacatttttatttagatttgaattctaattttcatttttaatacatataaattaccaattttcaatttatgcacttttcaaatgcaatgaatgtaatttgaactctatcctttctacaaattaacctttaattaatgttcaaattttgctttttattttttattttgtaattaatgctcatttgcctgccactgctgtcgaaatgttccaagttcagcaatgcgactgatgatctgtcatttacgtcacctgctggattctcctcattataaaataacattatttttaaacaaaattagcaaaataaataaatatttcaatggaataaattttttgtttcataaatgttaaaatatttgtttcaaagcgtaataatgattaataaattaattttgttgcacactaattacataattaattaatgaataatgaatgcaattttaacaaagttgtttgtctttcaattaaaaattgttaatttttttagcaatgaatttttaacataaattttttgtccataaatgttaaaattatttatttgtttcagtaataaggataattaattaatatgttgaacattaattaccaatttagttaattacgagataatgaaaaaatagtcaaagaaatttttaacaagaatttttttgttcatcaatttaattatttatttctttactttgttgcaaactaatcacaagtgctcagaattttatgaacataaaatcgcaaatatacgcataaaaagtgaaaatatgcacttaatatttccaaattgaaggcaaaataaatttattaattttgacaaaaactgagaaaaacccgaaaattttcctgtttaagactttttttggcataaattttcattttttccatctttttgagaaaatacacaaaaaatgaagattttgaaaactttcaatccttagaggttaaaagggccgctttaatagagggaccgtcttatagcgaatttttggaaagaatgctcaaattttgccataaaggtgaattttctgagcttatttaattatgaaaaggtctcaaaaatagcatttctaggtattttttttgatttgctgaaggtttttagtccatataaatcacatattttggatggtttcggaaataaacttatatttggccattttactctttaatccatatctttttaatttatttatttgcgatttactatttcatcatcattattttttaattaagtagtattttttattttacaggaatgagtataaagatgatttttacatcaataaaaacgcaaaatattaaataaaaattacatttttacaagaaaaataaatattaaatttatattgaaaaatattataaaataaaagaaaaaataaagaaaaaaggaataaaatattcagcaaaagaatggaggaaaattgatggaaaaatagcgaaaaaattgggtcaaatcgcacatatattcaaaaatggattaaagaattcggtattcaaaaactcaaatattacaaaaaaaaagtgatgtgtgttattatttaaattagtgcgtaattgcttggcgttttgaccatttattgatgtttgttttattcattctcattttcatgcaattattctccccccttaaagtttttgtcatgttttgctgttctccgtcattttggatttgattgattgttttgttccccctcgtcttctgaatttgtttgtgtttgattttaataaagtgaaagcttatttggtcattgggttgtgagtgttcttcgagtgcggtggaccaaaataatattacgtggcgctcctgacgttttgggtaagctcactgcagtttttcttgggttttgaattttgtgagatcaaatcggctttggtttttcgaccgcgactttcataattcggcgttgtttgagcccgaagaccgggaataacgctgtggacgactttgcaaattgctcaaagactgagaaattgcataaacttgctcacaatactgagaaatttgccgaaaattttttgattgttgaacatttgttgaagattgctcaaagactgaggcttattactct

SEQ ID NO: 4737 - DNA, 2085 bp, Heterodera glycines
gatcaaatgattaattcattgaagttaataatgtagagcgaaattcggtgcacatcatttatcaggcgaccataccatctcacaacgaaaatttcgtttattcggccggacaaatgaaatttgagaataacgctacggcagtttttccaaattcgggcaccgcaagtgaagcgaaaaatgagcgtgcgtcggaattttcccaaaaaggaaaattttctgaaaccaaaaggagccattggacagattctgatcaaaagtcgatgactaaggaaaagtggaagaaagttgaaagggcaccaaggaacatcgcgcccaaagtggacttccgaattaaaagaaattgtgatgagaaaaatcacaactttggcccaaaagaacaagtgggaaagaattttgaagtaaaaaaaggcagtggtgaaaattcgggaaaaagtggaaggattttttcgtgcaaaaattctgaagttcaattagggacaattgaaattttggaaggtcggaaggagtttgagagaaaaagattgaagttgggcagaaactctcaacgagaaaagattggacgaaatgtctcacttgatggaaatggcccacgaacgaattatggcacaaatttgaattcgtttcgacaaaactgtgttttctggccaaggagagcgaatgcagaccagatgagccgtgaaactttgccatttgatcggggttgggtcgagttgaccgcctcgtgtccggattcaacttcgacttatgctgatcgacaaccaatgatgtgcggacttcggtgcaatggcagtgagctgatcccaaacggacctcacctttcgacagccggatgcgggatgtgcagctgatcggcagggacgcctctcgtcagcggccggggatgtgttattatttaaattagtgcgtaattgcttggcgttttgaccatttattgatgtttgttttattcattctcattttcatgcaattattctccccccttaaagtttttgtcatgttttgctgttctccgtcattttggatttgattgattgttttgttccccctcgtcttctgaatttgtttgtgtttgattttaataaagtgaaagcctatttggtcatttggttgtgagtgttcttcgagtgcggtggaccaaaataatattacgtggcgctcctgacgttttgggtaagctcactgcaggttttcttgaattttaaatttgggaggagaccaaatttggcttttgtttttcgacttcgactttcatatctgcggcgttgttagagcccgaagaccgggaataaacgcagcagacggcattgcaaatcgctcaaagattgagaaattgcataaaaaattttgctcaaagactgagatagtgccgaaatttttaaattgttgaaatttgtccaaagttgctcagagactgagaagattgtctaattgattttggaattgaaccaagacggttaaatgagaatgtttgtgagaacgccaccactaacgcggcaagaaaattttggcggtgagcagcaactgataaacagattgttgccagcgacaatgaacaatagcaactcagtggttattgtgatggatgaaatggcacaaaacgcgacgaatacaccgatggtgaactaaggtttacgtgtaaacaacagaaatgtgggagaaaatggtttgggagagttaaatgaaagacttgtcaaatcggttggaaaacggattgggagaaagcaatttgaacactgcgggattagtgcctatctatccccccgtccatgaatcaactccagtgagtgtattgcatggtgtggaccgaaattttagtaattcaatgggaaatcaaggacatgggaatgctattaggtcggcgagaaatgatgttcagtatacgcagccgagattggacggcgcccatccagtttttgtgcggcatatggttgttcactcccaaatgacagctatgcgccaggccaacgatcagccgtgcatggcaacgaattcttccgagcacattgctcgcgacgctcgaacggagaactttctttgcatcaacaacccgcagcaacaaattggaaatttttagcagaatttgcc

SEQ ID NO: 4738 - DNA, 4355 bp, Heterodera glycines
gaaccaagacggttaaagagaaatggcgaatttgagaacgccaccgctaacgcggcaacgcgcccttaactttggaattgcattggacaataccggaaaccaaatttcggcacaatttaacccgaatttaggacaaaaccgttcttttagccctgaattgggtcatgtagaaatggttggtaatgatggcgtttcagaatacggcgaagactttgacgacgagcagaatttgagaagcagacttttggcaatgacaatgaacatcagcaatccagcggtgaatgtaccggacgagaatgcacaaaaccagcgaatggccatgaatgcaccgcttgtgaattcgggtattttacgtgtcaacaacagaaatgtgggagtaaatggcttgggagaaacaagagaaagatttttgtcaaacaatttcgaattgggtgtaagcaatttgaacaatgcgggattagttcctacatatccccctgaccatgaatcaacgccagtgagtgccttgcgtggcgaaattcgagcttttggtaatttggttgaaaatcgccgacatgaaaatgaacttttggcggcgcgaaatgacgcacaatacactcagccgcgagtggacggagttcatccagtttttgtacgtcaaatggctgtccactcccaactgacagctttgcgcctttcggctaaccaccaagctcatgttgcaacgagttcaatcgaaccccttgctcgaaacgcgcaagtagacaacattggttgcaataacaatccgcagcgacaaatggaaaatttgcaacaaaatttacaccggcaaatggttcgtaatggtgaaaattttgaacccggaaatcacaactacggttgtgaggagcgaaacccaaacgcagaacagaatataaacccgcgcccaaatagccaacattttcatgttgcaaatcaaaatcatccgtatgttaacgacataccggacacccaaaggaatgaaatgcatgatatgattttagcgcaggcaataaaaagcctgaacaatttttcatactcaatggcattgaattcgttgcctgagctgaaagggagctccggagcagatggcgtccgatcattttttcgacattttgatgtcgcaaccgatgaatggcctgaagcgaagcgcttaagcgcactccgatcgaaatgtttggggcgtgccgaacgcgccttcaatgttgcggttgcaaacaacccgttcagctatgacagcgtaaagagggcgatgataaatctgcttgaagagacagatgccagacaaatgtcggcatttgaagagcttatgtccggtgtctatcgccgaaacaatgagagaattaacgatttggcagatcgagtttcttcgctagttagaaaagcctaccctgggcttctcgagcatctttatgatgattattcaatccgacacttcataagggcgctccaaaatcctgagttagcattgactcttgagttagcccgtcgtccttcaatgatttttgatgaatttgttgcattagcggcgagagccgaagcaacccaaaaggcatcaaagctcgcaatgcaaaggcccaactattttgctagatttaacagcaatttccaaacgcctcaatacaaccaacggccaatgcagcattttcgtcaagaaaattttccgcaaccctacaaccagcaacaaaaccggcctaattgttataattgtggaaaattcggacattttgccaggcaatgtactgaaccacaacgaaaccaaggcacgccgaataacaacagctcggcatcaaatttcgttggtcaaaattttcttgttgaacaacagaaaaaacctccacaacagaatcaaaatctttttgttggtggcatttcgatgagtcctgctgatgtggaaaaactgtttggaaaggatgggaccgaaaacgagacgaaaaatttgaataaggtttcgatcgggagaataatggccttaaaggtatcggtttgtggtttgacggcaaaagctatgttggacggaggtgcccaaatttcgatgttttcttccaaattctttgcaaaattattagctgagaaaagaatcggtaccgaacagcttcgcccatctcgtcacaacactcgcgtgatcgacataaatggaaatgcagttgagtgtattggaattgtgtctctcccaattgtcaggaaaggcaaatgtgtgtggattcgtttccacgtctcacacgcatcttttggctatgaatttgtttttgagacaaatgcattagctcgactaagttttaaacttttcgacgaggcaaatgacgaattggtcagtttttcggaagttaataatgtggaacgcaattctgtgcacgtcatttatcatacgaccataccatctcgtaacaaaaatttggttcactcggcccagcaaatgaaatttaagagtaacgctacggcaatttttacaaattcgggcaccaaaagtgaagtggaaaacaaacggacgtcggaattttgtgccaccaaaagcggccatcggccaagttttcgtcaaaagtggaagaaggttgaatggacaccaaagaacatcccgcccaaagtggaaaaccgaattatcagaaattgtgatgagaaagggcacaaaaagttcagcccaaaggaacaactgggaaagaattttgaagtgagaaagggtggtggtgaaaattcggaaaaatgtggacgaatttttcttggcaaaaaatcggaagttcaattagggacaattgaaattttggaaggcggggaggagtgaaagagaaaaaggatgaatttggacagaaagaatcagcaagaaaaagtcagactaaatgtctccagtggcggatctcaatcgaattttggggaaaatggcaaaaatttgaattcgtttcgacgaaaatgtgttttctggccaatgagagcggaagcggaccagatgagccgagaaactttgccatttgatcggggttgggtcaagctgaccgcctcgtgtccgggttcgacttcgccttctgctgatggacaacacatgatgcgcggacttcaacgcaatggcagtgagctgatcccaaacggacctcacctttcgacagccggatgcgggatgtgcagctgatcggcagggacgccactcgtcagcggccggggatgtgatattatttaaattagtgcgtaattgtttggcattttgaccttttattgatgtttgttttattcattctcattttcatgcaattattctccccccttaaaagttttgtcatgttttgctgtgctccgtcaattttggatttgattgattgtctgttttcccacctcgtcctccgacttggtttgatttgttgtgtgtttggattttaataaagtgaaagcctatttggttgtgtgttcgcgagtgttcttcaagtgcggaggaccaaaattatattacgtggcgctcctgacgttttgggtaagctcactgcaggttttcttggattttaaatttgggaaaagaccaaatttcggcttttgtttttcgacttcgagttttcatattttcggcgtagttagagcccgaagaccgggaataaacgcaacagacggcattgcaaattactcaaagattgagaaattgcacaaaatttttgctcaaagactgagaaagtgccgaaatttttaaattgttgaaagttgtcgaaaattgctcagagactgagaagattgtcgaatttgattttggaattgaaccaagacggttaaacgagaatgtttgtgagaacgccaccagtaacgcggcaagaaaattttggcggggaacagcaattgagaaacagattgttgccagcgacaaggaacaccggcaactcagtggtgattgtggtggatgaaattgaacaaaacgagcgaacggcgatgaatgcaccggttgtgagttctagttcaagcgtgaacaacagaaatgtgagagaaaatggtttgggagagacaaacgaaagatttttgtcaaacaatttcaatttgggtgtcagtaatttgaacactgcgggattagtgcctacctattcccccgcccatgaatcaaatccaatgagtttattgcatggtattggccgaagagttggcggacatggaaatgctattaggtcggcgagaaatgatgttcagtatacgcagccgagattggacggcgcccatccagtttttgtgcggcaaatggttgttcactcccaaatgacagctctgcgccaggccaacgatcatccgcgcatggcaacgaattcttccgagcacattgctcgcgacgctcgaacggagaacattctttgcatcaacaacccgcagcaacaaattggaaattttcagcagaattt

SEQ ID NO: 4739 - DNA, 1971 bp, Heterodera glycines
tgtggcaatggtcactctgtgagtgattattctgctcatccgccgatgcgtccatttcgccttccgcgccatttaccacaaaatcattttcttcgctgttattttccatcgaatcaagtaatccgaaatgactgtcatcaatggcgacatattttttcattaaaaggtccaaaaggaaagatattttctaaaaaatttgttacattaaagattaaactatttatttgaaaaagctatttagggatacgatttttaggctctaaaaaaaaaccaaaaataggcactaaaatggaaaatagggactaaaaagtctcaaatttggaaaatgacaaaatctattcaaaaataataaaataagctaattaatattgagataaataatttaaaaccaaaattcttgtcaataaaaaaatataaattttgaagatgaatttttctgaaatttccatttcttaggggtgtatttttgaaaattttcggcttggttcttggggggtttatttttcttttttattactagggttgtaaattatatggattaacatattttttctgcgcatatgctatgaagaaaggggttcaaaatagcatttatgcgttaaaattttttgatttggtgaaggtttttagtccatacatataaatccatattttcgggaataaatccatatttcgccatttttgccattttagtccaaatttcggccatttttggcaaattttcacaagaaaaatgcaaaaaaagcgaaaaacattggtgccttttttaggattttcggaaaaattcttaacaaaaatgcattaaaaacgaaaaatacacccctaagaatcgacccgaaaattttcagaaaatactagagcccggagcaggaccggatcctgtgcaggattttgcaggatcccagtccgcaatcctgcattttttggaaaatgcagaatttgcaggattaatccggccggatccggtcctgcaaaaatttttgaattccaatcctgcaacgatccgcaaatttgaaatttccgggctctaaaaaatacacccctaatttgtaagtaataaatgttgggcaaaacgccaaaataggtcaaataggctttttcaaaatttttttagggttttaggctcgaaaaataaaaacctagaaaataggcactaataactcgaagcggggcgttcactgatctcatgcaactaacaaatataaaatttgttatgttcggtgcagaatttttctcttttgttgtgcaaaatttgaagcggagctcctcccttcaaaaccaacacatccatactttttttgtattaaccaagaaatagtacgtcaaaatgagagatgtatttttctctgcattctctatttattggttcgtctcttgattttcggatgatgtgctgttaagaatgataaaaaattttccgggactcttggtctgggtcccaaaattttgatcggttctatttagactatctggtaataaaatattaaaaatgtggtaatagtttagatggtacccccccccccccccttttttaaaattttttttcaactttcaaaaaatcataaaaacatgtttctaggggttttcggggtcgctgatcacgaatccgacatccatttcgaccgattccgaacccctgacccggattcgaacaaaataaaaaaattgattttttaacaaaattcatatttattgctaaaaatcgattcaaatgcacgaaaaagaaaataatcaatgttcgcatggataaaactcagagacatgcaaccaaaaattgtaaaacgcattttcacggtctccaaaacgctgacgccaaataaattctgggaaataggtgtcgtatgtttcagtcttgttcccaagctgctgtttgaaattccttttcaatttcttccacatcgattctacattctgggtatgggcaaggagattggctggagttccaaaattttgtgaatggttcactgtcca

SEQ ID NO: 4740 - DNA, 3896 bp, Heterodera glycines
ttgttcgaatccgggtcaggggttcggaatcggtcgaaatggatgtcggattcgtgatcagcgaccccgaaaacccctagaaacatgtttttatgattttttgaaagttgaaaaaaaattttaaaaaagggggggggtaccatctaaactattaccaaaaatgtaagcatttttttattgttttttcttacaaatattcaacaggatgccaacttcatacaaatacaataattagtgattgtttgaatttcgattgctatgtagattcgggtcacattgttcaacaattagtggagcgttggaatgggagaaatcgccgggggttatgggaagggatcgacgggggggggggaaagatgggatgagatgagtgagatgcttcgttgtgctgccttagccttttgaccacgcaaattcattttgagagatttcctcgccgctttttcaatccgcacggacactgcaaatttcatcaacgccctttctctgatcgaataattaagagtaattaattaacccaattgtttttcgactccccccctcccttccccaactactttcatgcccagaaatattatttaattcgattattccaattgacgtttttcctgagttttgcctatcttcttcaaatcccattatctctccctctgtccttccgttttgtgccgttctttgcccgtcgtccctcgcccatccgccgaagaccattcatttattcgctaccttctcgtccgtttcttcctcaacgcaccaaacagatgaaaccaaccggttttgtccatctttcgttttcccgccagcccaaccgaatcgcctaaagtccgcatttatcgccgtaggagatcatccaaatcgattgtggagcgtgaaagggggaaaggcttagatggaaattggatggattaggagggattggtgggcaggagagggcggggggaagcgccggtgcacggaacaaaggcacagacaatgggaggaaagtgatggcacccgccggttgccctttgctcctcccttttccgtcatcagtttgtctgttgtctgtcgtcccctcctccatttccgctgaactctctcctccctcttttccttctctccccctgtcaatccatcggctgtcccatccgccgccgatcagagtcatcgaccttgaggggcacaaaacagtcccaacacaaaaaggggaaagtgtgggatggatgggaccggctgactgaccaatcgaacgaatggcaaaggaaaggcgaaagaatgggagaaagtcaccgcccatttggagaataaatcatttacagcaccaaacgataggcacaataaaatctctaagtgttttaaatgtccctttttaagctgaatgttagcgatcaaataaatttgcgtttgtaactttaaacggccgtaaaatcggcgatggaccctttgagacattcgccagcccacgaaaaacgggtggaacagatcgaaatcatcgagagaacggtggaggaaagtcggaggtaatcttaggaaagtgcccaagatgatcatgcctttggcttcgtttttcgattatttattttaattttggcatttttctccctttttttgtccttttcccttttaatttttgcctttcccttttcaggcccctcacttcccaaggtcttttcgtctgtttaattcgtaattcgaatttcttacttctcttcagagttagtcaatttccagccccaaagttcggtgcgtacttccagcgaacggattcttttcccggacccggaaaagaggtttcagctgaccagcgaaagggacgccgggagggactcgtcgctgctgtacagcccctcaggcaatcgttttggaatttaaaattgcaattttcttttatttaaggccaaaactcattcattgtgcgtgaggcgccgttgcaacagtcgacgcctgaacggaatcaacagacgcacaaaaatggactcacaatcagtcggcacgggtacgacgctgacgaagtgttgactttaggtaggttaaatttaaatttaaatttacaatttaaaattcagaaacgagcgaaagagtgacggaaacgcatggacaaaagggacatccgacgaaggacagaagcgtgggggagacgagcggtgccatcgtacggcgaacgccgccccggcgggaggataccgcgacgaagtccattcttaagacagtgccgccgatggcatcccccgaggggaccgtaggggaaaattcgtggaggaaaagccccgcgtcggtggaagggtaagccgaggggagggagagaaaaggaacggattacaacaacagatcagtgcagcggaaggacagctatcggagaatgcaggtaaagcaggaggaagagagtgatgttcagcagccaacatcattttacggagtgagtgaacggacgaaaaaagggggaagggaaggagacggacggacggaggaggcgaattggcattttaatgggggacaaagttggcatttcatataaaaggggatggagttggctaaagaattagattttattttttgactattttttctaatgacttttcctccgatttcttcccaaaaaccatgatttccatttgtctcttttcagcagtctcccaatgcgacgattctgtcaaagagttcaaaacaactttggcctgaaatgtttagcgcggagaatcgcggaaagaattcattagcacggataaaagggtcaattgccgaaatgagccgacaaatgaggtggagagtcagttgagttagcaaaaaaactaatccgttttcccccgcagcgacggcgaatggaccccccgcctcgtctctctgctgtgcctcgtcctgcttctgctgctgctcgtcctgctcctcctttggctgcttgtctcttcgcttctcctccatcgctccaccttcgccttttggctttaccctccgccgtgcgaagagtgccaacgacggaacggcggtggaacttcggacactcagcagccgagtcggcttttcgtccatttgaacagcccggcacaggcgcacttcgaactgatcggaaaccccccgttcaagtcgaactcattcactgccgttgatttcgacaccgtttggcaaacaattgcaatgatcaaacaaagcgttgttccgtttttgtaagggatttgtggccatcgcggaccacgcgttgacagatgagcaaggaacacacaccacgtgctttgtgatggagttggacagaagcgcgatgccggacatggatgtgttgcaagacgcactgagcaacacttacagcgaggtgagaaggagggagggggaattagaaatatttggtttggcggagatttggccgattggtgaacgatttgccaatgtttggggaggggaattagcaatatttgggggtggaattggccactttgtgaagatttgccagtgtttggggaggggaattagcaatatttgggggtggaattggccactttgtgaagatttgccagtgtttggttggccaatcccattaatccttgtgccacccttgctcattctctctttcccccgttctctttgccaggtccattctcagttcggctggcaagaatattggtgcgtttcgcaacttcggtgtgcttagctttttccattgaaggcaatacgtagcggaagaggtcgactcatcatttgttcttcagaaatttcgcgatcgaatcgacgactgtcaaaaggcgaccaaatggtaccgcctcaaacacaccgtttacacccgcggtgggcaattaattggacactttgggaatcattagccgaattcaaaccttaaaaagaaattggatcgtttggaatttgttgaaaaaccgtacccctttgtaaatgaggtctcatggcaaaacaatttttatgttttttagttt

SEQ ID NO: 4741 - DNA, 1531 bp, Heterodera glycines
aaagtatcaaaatagctgtctaaaaatcgttagtaatgaaaaaatgtcactaacaaagatatatttaattcattgattggagtgaatttatcgctttttgaactaaagaaaatttatagagctttttcttttttaagtcactttaaaaaaagaaatagactttttgccatagaactaattgaaactttccaaatttggattcttttaagggtatattttaatttttcattcgtttctcatcaaatctgattaaaaatccccactcttttgtcagattctgcctgttacaattgctacgatttttgtctccccgacttcgccgtccttcggcgacaaaaatacgaagacaaaatgtcattgggaattcgaagactgaactgtttccgattgtttgtgcccgaatgggcaaaatacgaagtgcaaacggacccatcgggcggacattggcactacccaaagcatacggcacaaaagacgcaaagggacgcggagggaaattgggtgaattggcaaaagggcgggggaggaggacaaaggcagcggcggaagaggaggagaagcggaggaggggacggattgagaaaacgattggaaattcaatgagaatggttgtgaaagggagagagagagagagcgagggagagacagacagagagagcgagggagagacagacagagagagcgagggagagacagacagagagagcgagggagagacagacagagagagcgagggagagacacaccgatcacttgccaccaaccgatactttcattatgcaaaaagtaaattatataaaatgccaatgccataaatcattatggtaatatttctggtgctgttgataaagtataaatacctcttcggtcttaaaatgtgagtgtcacttaataatagaacttctttggttgcactgtctgtcctttggcttttccttcccatttcttccctcgcttttctctctcttttggcttttcctcgcttttttcctctttcttttccttcacttttccgccgattctttcgtcctcatcctttgtctctgttgcaattccgccatcagttcgctttgtgcctctctcatctcaaaagggttttgttccgccatttgaagccgcgtctcttccgatcgctttggcgggggcggcggcgccaaattccgtgggaaaacgatggaagggagggaaggaggcggaagcattgcgcggaatgggtgactctgatgacaaaagtgattagtaaagagaagagggaattaatgaagggtgacaagtacggtaatcccattagggaggacaaaagacggtaattggcaagtccgtcgctcatgctcaattcccttcccacctcattcgccgtgccaattgtcccatcaatcggcggtggcggtgggaattgttcttcgtccgagtcgctttccatcgccgtgttactgctcgttgttgccgatgtgtcaagcagtgtggcagtgctcgttgttggcattttgccaattggtcgtccaatggacgggctttgttgggactgatt

SEQ ID NO: 4742 - DNA, 1451 bp, Heterodera glycines
  misc_feature (1093)..(1093): n is a, c, g, or t
ggcagtgctcgttgttggattttgccaattggtcgtccaatggacgggctttgttggcactgattcagttgttccgtcactcttacaacaccttccggatgtcgttttatggtgttacattcgtcctggtcgaaaacattgaatgccattgacggcgccggagaagcaatgcgactgatcagtccttcacgggaggagccgccgggggttgaggacgatgcgcgagtggagaaggaggaacaggcgaagtcgccgagatgaagcgcgggacggtgacgcggcgacgccgaagagacggtggcaaaattggagtccaacgcggagaggcgctgtagggacacctgcggcacttccgctcgcgcgggggaggcggggccgacgagcggacactcgcgcgactgagcggcacggaagtccttgtacagcgcgggacagccattcttgaaaaggattaattggaggagagggagcgtaaagcaaaagcaaacgaattatgaatttggaaaagcaattcgaatgaaatttaaatttgatgagaattcggtgtttttcggccccacttttgttattcgaagcgccgtcagccattggcggaaagtgaactcgtcatcacagcaaatgtacttgatgtacttggaggttttcagttggatgcgcggatgtttgattgcaaatccgaattcggtgggcgctttgtactttttgcgccagtccgtgcacatgtacaccttcaaaatgagtgggataaggggtggtaatgggctgctcatctcctacttggttgttgaacacgctcatcagacagttcaaatccctggcgggcccccggggcttccccgccttcggcacgtaatacaaccccgaggaacggagtacaaaaaagtgtcgtcgccatgacttcttgccgtccgccttcagcatcagccacccctccaattcgggcactcgcgttcctccgtcctccctgaggaacgcgttcagcaaccgctgtttctgttccgtatcccattcgccaatgctctccaccggcggaaattcgttgtttcgattccgatcagcgatcagaaagtgctgtggatgcctgaagagggcncacttctgaggctgtcggataaagtgcaatttgttgggcgattccgaagtccaatcctcgagattctcgaccacattttcgtggtcctcgtagaatcgctctgttaaagaaattttttagttgtcaaggatatttaaggaaatggcacatttaagcgtttgcttttctttaaaaccacaaaatgtttttgttttgatttccgagtgtcaatccgtccaatccctttcaattagccagatgaaaggggagggggagggaattcacttaaggggtatggttcgtgtcgtcagaacgaaatccgatcttatctttagccgaaagagccatggctaatccactgctgctggtggtgagtggt

SEQ ID NO: 4743 - DNA, 458 bp, Heterodera glycines
  misc_feature (417)..(417): n is a, c, g, or t
ggggggggagatgaggaattaatgtgggaaaaatcggtgtttgtggtcagcaagcgattagaacagaaattaataattagaaaaaagcaaaattttcaattttagcgatattttttggaaaaataagtaagtgatgtgaaaagagggaaatggagcctctgctgttccataattccatgtaataaataaccagggttcccaactaaaattttatttaattgaatagggttcgccggagggctaattgatttttgattacaatttttgagggttttacccaaaacccaacaaaagggaacaaaaaaacaagaaaaagccttaaagcctcattttggaaattagcctcattggcctctcaaaaacccataaaaataaggctaaagcctcacaattgggaatcgttgtaataagccaaantatttgagcgttcgatcgcttttcgtttcaaataacgccga

SEQ ID NO: 4744 - DNA, 5284 bp, Heterodera glycines
aactcggcctcaatttggcattgctttcagaccgtttcgatgttttggtggacaaacattttgaaggcaaaaaggaattaacgctttggagaccaatcggaattagcaaagacaaaggaccaaaagctagactgtctattctgatcgatggcacttttgtggcatttcctctgccggaccgtccgttgccaaacaaaattcgttttcgtttccttttgattaagtaatttttttcatcttttgtgtatattaaagcattttatgcttcttctggtacattgaccattctgtgctcgcatttctccgttccaacaagccaatttgggacagaatgggcaccaaattgacattgtggccatacagaaccgagaatgttcagccaattgggatgtttttgtccgagaaatttggccaattcttacgacaaaccttcgccatttgagctttgccggtcgcgatcatttggacaatttgcgtcaccgcatttcgccaacaattctcactgatcttgatcatttatgagaatgtgatggtaatagtttagatggtatgactgactgacacctttttcaaaacttttttatagtctaaaaacaattttctatggggttttcaggcacgctgaacacgaagattttcagtttgtttcctatacatgaaatacaatggaaatggacgcatttgcgaacaagcaaaggtcaaatacaaacagataaacaattagacaatacaatattgaatggcaaaatgccaatatatctttcggtcatataatcgcaccaattaattgattaattcattcatttcttctgctgatcactcggcccgggagaagcgtcgtcgagaagaagactgaaaaaacgatgatcattccattgcaaattataattcaatggcattttatgagtcaactcaacgaactatccttgattttttgtaccataattcggctctattatggtttgtcccccataaatttttcgaaaattttttttatgttttcaaaagccatgaagtttaaattcacagaaacgactgaatcattgctttaaacatttttggatacgaattgaaagtacaaaagtctaaacaaaattgtcgacgatcggactcataaaatcattaagcatttttaattttgttcacccgtcgtcatatccgccatctttgacccgaatgtcaattggattcgttcgagcaatcatttcatccctcagatttttccaatttcggttatcccatccaattggacaacggatgagccaaaagtaatttgctgcttgttgaagtgtcaattgctgcccagtcacttcgttgatctgatcaaatggcacaacggagtcaggtggagaagacggcggaaagtgaaaacaaatgcgaaaagcaaccggagaagaagcattggaaaatgcctaaaaatgggacaaaaaatcatagaaaaaccaatgaaatagggataatcaccgctttaaactgttctatcattgacgaccattgctcatccgttgaattaacagagcattgaagcaacttcggcacaccatccgaacgaggcgtgaacttcaattgatcaagatcagtgagaactgttggcgaactgcggtgacgtaaattgttcaaatcattggcatcagaaaagcacaaatggtgaatgcttgtagtaaaaatgtgccaaatttcactgataaaaacatcccaaatcggatggacatcttcggtttcatatgaaggcacaatcaactccaatctggtgcccattctgtcccaaatttgctcgttggcatggagaaatgtgatcacggaatagtcaatgtaactgaagaaatattaaaatgctttaatataaacaaaaaatgtttgaaattactaaatctgaaggtccttaaagcggattttgttgggtaacggatggtccggcaatggaaaatccacaaaattgccatcgatccgtacagagagtttcgattctggtccaatgccctcgcaaattttgattcttctccaaattgtcaattccgtttttccatcaaaatttttgtcaaccaaaacatcgaaacggtcggaaagcaatcattccatgcatttgaatcgattttcggattttggtgaaaaatgaattttcgacttttgttcgagttcaggtccgtcatttgaaactggtcgaaatgatgttatattcgtgatcagcgacccgaaaataataattttctgttgctcatttttctccattatttctcaacgatactagggaaattttcaatctcgagtataaaaaataattaacagcgcctacgatcagcagaaatttgttgtgccatggcatttattgaattgtgctgctatgtaatgaaatccggttaaatcattagcaattttatctacgattactcacaatgaatgaatgaattaattaatacacataaaatacaatggaaatggacgcatttgcgagcaagcaaaggtcaaatacaaacagacaaacaaacaattaggcaatatttaaatgacaaattgccaccaacatcatttcgctcataaatcgcatcaattaattgattaattcattcatttcttctgctgatcactcggcccgggagaagcgtcgtcgagaagactgaaaaaacgatgatcattccattgcaaattataattcaatggcattttatgagtcaactcaacgaactattttttgtaccataattcggctctattatgcatttgaaaacacaaagtctaagcaattggactcaaaaacaaaaaagagaattattaagcatttttaattttttcacccgtcgtcgtatccgccatctttgacccgaatgtcaattggattcgttcgagcaataatttcatccctcagatttttccaatttcggttatcccatccaattggagaacggatgagcagaaaatcatttgctgatgattgtttaagtgtcaatttctcctcagtcacttcgttgatccgatcaaatggcacaatgaagtcaagcggagaagacatcagaaaatgaatgcgaaaagtaaccggagaagaagcattggaaaatgcctaaaaatgggacaaaaaatcatagaaaaaccaatgaaatagggataatcaccgctttaaaatgttccatcgttgacgaccattgctcatccgttgaattaacagagcattgaagcaacttcggcacaccatccgaacgaggcgtgaacaaccatttggtcaccgcttggccatccgacgcattggcactgtcatcgggcggaaattcggggaaaatggagtcttcaaacaacacagtgtgaagtgatggacaatcgttgagcagtgacggggccaattggcgcaaacggcgaaaagcgatggtattcaaaagcataagacgaatggagtcgcggagcattggcaaaacattgagcaaaacaaaatccaaaatgcgaacattttcagtgatgaacaagaatattgaagaaaaggcgaaaaaacggtgaaaaaggcggagaaaagcgatgacattttgatcgatgtaactgaaaaacagaaaatttagacgaaaaattccaatttaatctattttttacaggatcgtaatgcgtttgaatccgatgactttgttgggcaacggattttgcgggattggcaatggatttccatcggaattgacaatttgcatttgctgggtgccattctctccaattttgtggaaaattcgcatttcgcccaatttccatttgcgtgtcttgaagtgttcgtcgacgatgcagttaaagcggcggttgatcagtgcaatttcgaggccgagttgagaaggcgcaagaaaatcgaacaccaaaagccaacaatctccgcagataaagctgaaaaattggggagaattttttcgaaattttcaaattatgattatttattttacatttcttttttgtgagggcgtcgtcgttttttggcattgtccaaaaagaaccaaaaaagaatggtggcacagccgaccaacagaagaagaaacacggcacaccaactgaaaaatgaatttgggaaatgaatgaattaataattgaagagaagggaaaagtaattaaaggatcaaagttagctagtaaatacaaatgtgaagttatagcatccaaaaaaagctaatctttcaaaattggttttgaaatttaaatgcgaaacgttagaaaaaaaaggaaataataaacgtacagaatttctgaagacatttgcagcaaaaaaatgaccgggaaatacaggaagaatacctaatgagagaatggaatgatgcggaggaggagaaaaaaacacatttttatactaaaaatttttagcgtagcgccccgagttgtagcataattttcgtcaaaaagtcacaaatttttgccaatttggggtcacattttcagaaaaggaaaaaatttttgtaaaattttaatgatgtatggtaagaaaatgttctaatttttcagaaaatttgccccattttccttgaagttttcttgattttgcaagacacatagaactcaaatccgtgatcagagcacttttatttacccaaaattcattaataaattttgagaaaccaaatatttgatgaaaaagtcatagacaaaagaaaagacaagaaaaaaaaattttttatttatttttcctcggtcccggaattctgcgagggcacctcgtttcccccccgccgtttcccccccgcatcgtttcccccccgaatcgtttcccccccgccgtttcccccccgccgttcaatgaccaactaaattttttcttaaatggctcaattggcatttttgacatgcaaatttaaaaaaaatgcttaggcttaagctgttcaattaatatcaaatgtgtgttttattcgaatgaaagaaaatcaacaaaagcatttctgagagaataaatgagagaatcaaatcaaatttcaatccgtgagatcgatcatttctcaaatttaattaattcattcatttccacgcaattagacgacattttcaaaaaatcactcattccgctgatccacttggtccgggagtcgtcgagaacatttcatcgttgctttgacccgcttctttttctttttcgtccgttggtggcgacaatggcctaaaattaaacacaatttgaattggtgaatgaattaaattaatcttttacacttacccatatgaacttttgccaccacacaaattaaatttgattttgttcaatttgtcgtcccaattttcgtcgttttcccattgaatcgccaccgttttttcactaattgggcatcgtttcaacagccaa

SEQ ID NO: 4745 - DNA, 1448 bp, Heterodera glycines
ccctcttcctcccttcacccctccccccaactttccctcccctccccgcacctcgtacgatcgactgtctcgaacccttacgatcgactaagagaccccccctgaccgtgacgggaaaatcggtcagtggaaaatgcgtcagtgatacaaatattttaaaataaatttctatggcatttgtattgtaatatagaaataaacttctataagaacatcgttctcaatttccaaccctggacccgaactcgaacaaaaaatcgaaaagtcaaaatttcgaaattagagtttttcttcaaaattggtttaaatacacggaaacaaactaaaagccatcagtctttcaataatagatcatgtatgccgttttgaaccaaaaatgctaaattcgaaaatttggactttcgagtttttgttcgaattcgggtctggggttcggatttggccgaaatggataccggattcatggtctgtgcccccgaaaacgcaaggaacttgttttatgacaataaaacattcactgacgcattttctactgacgcattttccactgacgcattttccgggcgccgaggggacggggtccggcggtgccgataggcgccgccaggaaaaatgtttgtaatttctttctgatttgttaacatattttcatttagttcccatccctactgattactatgaaaatcaaattttgccatcgctttgactttagaaaaagttatatgaaaatatgtattgtttctagggttcgagccccgcccccgctcgcccccgcccccgccggtatttaattcatgaatttagttattttttaatacagcatacactgaaaaaaaatgttcaaacaaatgaaccttttcgttttattttttattttttcatcatattcttttggcactgtggagggatcggcttttacggatttttttactgatttgggcaataaggcttgggtgagttaaagcgtttattcctttgcattttttttgtttctacattaataaaaatatacatttaatgaaggattgacagaagcaggagaagcaatcttggatgggataaatgaagcaacgaaggcgctggttatcccagggtgggaatgtgggccaaatgatccataatacctcgatggaccgtcacacgtacattaattcttcgaatttattcatacatacaactttttaagcttgcaacgcaaacaatggttatgttcacaacctgtgtcttcaaaatgagttaatctatttgaaaattcacaaaaaaaaacaattgaatttaactgaaatccatcaatgttgcaaagacccacgacaagtatgttttgaaaaaataggaaaaattaagcttaattttattgaaatcaaatgaaaattatttgaataacaacttaattatttaatgtttttttgtcccccaaaaacataaacccgaatttaaaattactaaaa

SEQ ID NO: 4746 - DNA, 2072 bp, Heterodera glycines
attaacatttttgataatttgttaagtaacttatgaacttccttaattaaaacagacaaaggagaagaaaatgagagaaaaatacaacagaaccaataaattaaaaacataagcattttgtcgttcttcttccatccaatcatttcaaaaagtgccttaaacgcgtgctaaacaaaacggagtgagcccacccggcataatcgccgtgaagatcaacgaaaaaggcacctttaaattaaaaaaaggaaatcaacgattcggttggaacgggagggcgaaaggaagggaccggcccctcgccatccttacacttccatccaaaaccaaccaatttggccgtagatcgcagtggataatgttttacaacccttcaaaaatgtcggtgtgtaaatctcagtggccaaattgaacacgtgacgatcaaccgggaccacctgatgtttgtccaaggccattaagcaaatgcaatcggcaacctgggaagttttaatgcgttaaaaatagtcgaatttgaatgaaaaccttagggccaacccccggcaatttcataagtgccaatttggcctcatggtatggcaaatttcgcagagaatggagccaaaggtaggcagaatttcccaatttaccatcagctaacatttccaccgttttcacaatgcttttcgcccggtaaccaaaacctgtgaaattttgagtatttaatagctgcggttattaataaattaaatgctgaccggcatctctgagagtttgttccatacaatttaaatgtgcggccatttgagtaactgacggaaagtcgtaaaaacgttgagcgttcacctcgacagaatcgccataaaattgacaaagtttttcgaccatttctgaattacaactaatagaactgctcgaggttctcggcctctttctagaattaatatttttggtaaatataaagtagccaaattttgttggcgactcaatttttttagctacacttttttttatccgatggtaatgaattaaaatttaaatcgcgaacttaattgcagtttgttttacatcttcttcgaaattttttttaccgaattagaacaaaaagtcgaaaattcaattttgactattaccttttttcattaattatttggtttttttttttaaatttggtcaaaatgaatgtacttttcgtgttcagtatcagcgaaattaaaaaccctatgaataaacagagtcaccacaaattgactctttattttatttcactgacttgatattctcggaacattgttgtttgctgagcaaatgaatgcgaaaagcgtctcgacgggttcttgccgcaaaatgcgaatgccctgcaacatttctcgtctttccgtcaagaatctggcaaaatgtttgtctcgagaagaccaagacttgtacaattgctcaagtttaacaccaagctgaaaaacatagattaagcggaactcataataattaatggcacttttgctgtttatcccccccccccccctcccgaaaaaatccaaagggagggacttttgttttgcaattgtttttgtcaaaagttgtgaaattccaaatccctataaaagggtccccccttttggaattttttcgtaaacggcaaaagtgcccaaatagcatttttcatattctgctttttaaaaccctccaccctttaagccagggttacccttgaaaatttcccgaaataagaacatcgctgggcaataataagattttagatcaaaaataaggacattttttaaaacacgcttccaaaactttaaatagcatttttcaacaaaatcaagcattagcaacatatttctcgccgccaactatttttctgagcaattccggcttagaaatgagaaatttatacatttccgaaaatggattttagcaattttgtggaaaacatatgcaatttgtaaattattttcagttcaatcgggatcaaaaaatcagatttttaaggatttttttgcggcgtatttttccgaaaaaattgaggaatgggcaggggatggggtacagcagtcgcgataggcgccgacggaaaaaaattttgtaatttagcg

SEQ ID NO: 4747 - DNA, 4621 bp, Heterodera glycines
  misc_feature (25)..(25): n is a, c, g, or t
ccggcggtgccggtaggcgccgccngggaaaaactttttaatgtaagtgcaattttatcagattttgtcaaaaaaatgtccaaattttgcggtttttagccaattttttaagcaaaatagggttttgggtgccggcggtgccgataggcgcggccggggaaatttttgaaattttagtgcactttgttaatagatttagtccaaaaatgacaatattttatgattttaaatgttaaaattatgaatgaattcccatcgataaaggaataattttgaaaaattagaagaaaaaaaaattgtttggagaggaactaatccaacgataaaatgaagaacataaccaagatcacaacccactggaccatgcatatgtatgagtaactaaaatgaagcaaaaagtaagattttggatattaattcgcttcaaactacatttctttcaaaaattatcatttaaaatctaaatttctctctgaatccaaaaataagaacaaaaagcttaaggataaatcttacaaataagaacatttaaaatttgtaagatttggaccctcaaaataaggacaaagggtaaccctgctttaagcccaggaattaaagcgaagaaaatggagtggggattagaataaattattattaaatttacctgaaaataatcgctcaataattccacatcatttttttcttcgtaaacattgcaaccaaaattatgcaacactttaaagccaatttcattttcatttaagcgccaaatatgccacaatcgatgacaagaaattccaacccatccaacgccgctggtatcttttgtccatctaaatttaaaaattgactcgctataactatgttcaaaataaacaaatacctaaacgtttgaccgttacaaaaaacgacatccaggtttaattcagctgtattgcacaataaagtaaaatgggatggtttgcaagttgcatcaaaagtgtccaaaagaggggaaaaaaggtatatgaacaaatttaagtaaaacaactaaccagtgccattttcaacctttgaaatttcaattattaagttatgtatctttatcaaaataaaaaagcatttgtaattggtagcagggatggcatggaattcagatttccgatatttttagggttggaattccgattccaaaattttttcggaatttttttttattttgccattttctaacacaaaagtaaattttgaaaaatttgaatttccgaatttgggcccgggattagaaattggtcaaaatgaaggtcagattcgtgatcagcgacccagaaaatcccaaggaaaagccttggctcttgtggagtttaggccccatacaaaaaatttacatttatgaataaagctaatctataggccttcggggtcggtgatcacgaatccggcatccgttccgacccatttcgattcacaaaatgcaatcaaaaattcaaatctcccggcggcgcttatcggcaccaacagacagtgtaaatatgtttgttttttattcataatcagaaagccaaaactttaaaaaaacttaaaaaattctgggatttcccttgcaaaaatgcaagagacgatctcgagtttctctaaaaatttttgggcctcgaatttcggtttccgaaaattttaagggcctcggtatgccatccctgctatatatgctgcttatttttagctgtatatcctgccttatttttaaggatttactgtattctcttcgttatttttttaaaattgatcctcgcatatatgtacaccgataaatgacattggttggtttatttttaattaatattaagaaaatatttccatcacatttagtcatttaacgaagctgcttccgttgtaagtcgttcttctgttaatcatttgatgtgtgttaaccttacaaattaataaggtcaaaactttgaggacttcgccctctaatgacgaattgttggagatatacgcattgtataagcaagcgacctgtggcgacaacaacacatgcaaacctggcacttttgatttccgtgggaaggccaagtgggaggcgtggaaaaaaaagcaaggttctcacggaaattattaaaaaatttaaataaaggactttcgtcaggcatctctcaggagaaggctcggattgattatgtgaaaattgtcgaaaaaatggtggccaaatacggtgttaattagaaggagcaccaaaagaggcaatcacttagacccgatgctttaatattgtatttaaaaaacaaatattttataatattttgaatgctattattgaaaatatttgtgaacccgtatacaaaatgatcattgatcacattcattccgatatttttcattgacttttcatggtccaactgtgtcaagtccattgaagaaggacacgtgctttagggtgctgtaagcctaaaattggaaagtccttttggtgaataatattgcatttttttgcctgtaaattttcacgaaagacccgaaacttttctgcagcactgacacaaattttgtctcccgggaaagccttccgcggcaaaaatggctccacacaatgagtggcattttgcttttctgccgtcgttcgacttgtgctgtatttgtcctctcgttgcgcattttgttttctgattgttttgtccgatcactccacaaaatattatttttctttttctttcaccttctctctgttacacaaacatagtcatacacgtccaaattgcgccacacaaagcctgacctgtaaagctttgacaattgtaaactctcttacttgaatttgttcgcctgcatgcgttggcgccaaaagtgtgccgcagggcgaagaagttcatccgggcaaattgctttgccatttcgacatcgttcagaattcgtacgacttttctccgtcttctgctgggcgacactttcacagaactgtcaatgtttttgcattggatttgcgttctctcacattcctttagacttctcttccgtttcgcctttggcattatttttcccttcgcttccggggagacaaatgtggcgaagtccgacgatgtacggctgagaccaccgttcgggacgtaacaatcgctcgcccatttgacattcagtcgaaaaccgagggaataaattaaagcaaaaggaaatagattttgctaactggatcaaaagtggatgagatgtgtacatccgcatcagctaaaatattccattttcaatcatttgtttgtgttttaagcgtcgcccctttcaccgactcaaataaacgtggcgcacagtgacgcgaatgaattggaaatttttcattaaattttgttgtccatttgaatccgatttttgcttattattagtcgccgaagcgaatggctccaaaaatgtaatctgtacataattttgtgagttatgtattcggttttattatttgtcccaaattccccacccattcggtgtcttcgtctgtcaattcgtaataatccgcttgactgatcaattgggagtaataactgtccccgctccgtttcactttatgaaccaaaattgagggctaaataaagacaattttttacagagagtaaaattattattattaaagtcgtaaaacctgggctattcccctgtcaaattgatgtggagttcgaaattcgattgtgtaataattatttgggtcgtcccggtcataagggaccatcaccaaaagccagccgaggctcctaatttacaattagttaataattattagaaaggaaatattttaattaaaaatattttaaaattaattatttaaaatatttgtaaaaataatttatttaattatgcatttgtttgttgttattgtttttttttgttattctctgaatttgcccacttattgtgcggtatgctcagagaagagaggcgaagtgtgaaattttggcggccatctctttgaaaagcaattgcataattttaatttttaaaaacgacaaaaataattttaccttccgaaatacaaaactctgagaaagagttaaatttttgcattagtcgtgaaataactgtaaaagtttgcctgtccattggcagccaacccaaatagtccaaatgtgcaccgtttagaccgggcccattcattccgaagttcgaacggtgctaagaaataatccaaaaaatcatttcccaaataaccccggcgtacgcaaattgggcactgttggcgcgggacgctcttttgtaaaagagtcgaccctttagagtgcccaatttgccggcactttctcccccactttcccaccatataagcattcgctgtgctcattaagtcatatctgtcgtcgtattccccgtcggcggcgtaaggaaaaacctcaaaagtgtttgagatttaatggcatttaacaaaacaaaaaataaaaacttttatttttcggtcgctgtacgaatgtccgatgaaaaatgagtgaaccttcacagggaaataagcgaatcactttagtgggcatttctctcaacaaatttgggagggaccatttcatgagttagcaccgaagagaacatcaatttgggagtcagcagcacgccgttccctttgccataaaccgcggcagtgccagagaattacggtttaaaaggacttaatttgaatttgttgtcgacctgc

SEQ ID NO: 4748 - DNA, 2635 bp, Heterodera glycines
cagtattccacgtgcaattcgtccacttcctcctgtctcgggttcgtattctttctgacccgaattggcgccccgactaaaattagacaaaaatttaaaaaattttaaacttatctttctctgaccgatagtgacaatccttcgcttgaagggaattttgccgtgccgaaacaccgaaggcaatcgttgcgaaaatttctcaggcaaaatggcacaaatgaaactttggccaaaggccaaaggaatgaaagcgcccatcactcgtctcatccatttctgatcagatattaacaaaatttaactgatttgtgcttaatacttgaatgttgtccaaaagggcgggcagaatggcaagtcgcatcagttgttgctctccaaaatgataaacgggcaccaaatcggcgccatttttgatggccaacttcacaaatccctgaaaagtaaaactgtacagaatgaaaggctcactagtcattcactttgcgatttgccaatttgagcttgtgcagtccttcgtccatctgggaaaagcaaatttccgcgacccctcccggcacaatgccaacggcgttccctcccggcgccaaactcaatgaatggccaatcgaagcggcggagcttgagataactcctgaaatataaagataagcataggacgtaatattctgacaacccaatgcgatcagaaaatcacgtcgaaaagggaataaaaaattcatggggagggtggccacgcgccattcgatgccgggaaacagtctttggaagtcggtgccattggtgccaaaggccaacgccgaggaaatgcttaaaacgccgtgggggtgagcactggaaaagattttcgaattggtttctaattaatatcggatgaatttgaatttgtatgaactgacgagaaaatgtaattcctgtccgggggaatttccgccgttttgaccgtttccacagtaaaatattcggccacacttttccacaagtgcaaatttcgaagccaacggaaatgccgtgagccttttttcggtgtgttgaagtcgtaacagtaccaacagaagtacaacagagccaaaggccaaagcgaacgatgcaaaaggaggagaaggaacagagcggtgccgacaaaggcgaaatcgatgaacatccattggaagagccaaacggcgagcacttgaccgatctcggcacaaactccgccggcaaattcgcaattgaacggcattttgagggggggggggcaaatgggaaggacgagaaatggaaaatattcaaagtattggcggtggcgaacgaatcacacatcttttaagtgttcaaattggaaagggaaggcgtgacattgtgagcacgaggcaaaaaaaagggggggggggagagaatcggtggccaaaacattggacagacaaagcatgaagagataagaagttcggagcgaactaaaaccgtgaggagaatcggccaattaaaaggcaattaaaggccaattaaataattggtggggtgtcgtccattgtggtgataataagttcagcacgaacgatcggcgggcaaactcggattttatggctttttctaaggatgagaaggaaaatcaattacaaaagatggtaataaattaaaatttatgcaatttggccaaagaattaacagaaaatggaaaaaaagaaaattcacagaagaaaagtcttcataatgaacatcaaagcggcggaaacagcagcagacacggggagagtgaccagctgaaaatggacaaaatgaaaaggaaacgaagcaattaaggggattaaaattcaaactaattaattaattagatatttaaaaccaaacaaatttagtccattggtatttctttcttaagtaaggtttcaagaattcccgccccatcacaaataactacccaggaagtggcgatggaggcaaaaatgcgccaattgatgccttcgcccgatttaatggagcccacggcgacgacactgcccaccaaacagtgcgttgttgagatgggaagcccaagtttggaggccaacagagcggtgacagcagcgccgaattcgattgtgaagccactgaaaggggaatttgcgaatttatgaccaaatggggggagagaggggagggattacctgcacgaattcacatgggacagcttttggccaaccgtttcgatcacttaaaagggaatattgtttaattgaaccggccgaatattcattgattcattcgttcgttctttggcttcacctctgtgcccgagaagccaaaggcccgcgcaaatggcggaaacgccgaaaagaagcagccaaatgggcgtctgttcgctctgttccacgctgccattgtgccacacggaaaggagtgccaccaacggcgaaatggaattgctgacgtcatttgctccgtgggcgaagccggcgaaacaggcggtgaacaccaaaaaaagaagaagggaggacagtcaaagaaggcatggacaaagcagtagaaaatgactcacctgaattgtgctgaacattcgcaaagtctgcgggtcttcgcgacggtccttttcgtgggaaaaaccaggagaagagcccacggggggctaagcaaaagaacaattgaaattaaacactttttggcacttgtgccccttact

SEQ ID NO: 4749 - DNA, 1157 bp, Heterodera glycines
  misc_feature (65)..(65): n is a, c, g, or t
gacaatgctgtgagtggtggagacgggcagacggagcaaagtggctgtcagcagccaaacacttnccgcctgaaaaaattggcgttggaaggcgtaaattactacagaatcactctttatgaaattaattagtagagcaaagaaaaggcactcattagcccaaaattagcaatgaatggctgcgtttttcctttgctttcctttggcactttgtgattacccccgagaatggccaattgccctagcaaaaattggttggggtggtccatgtacaagtcaatgttgaccacttctttgcgcatcgcatctgtcacgttatatcctgcaaatgtatttaattaatttcagaatgatttgtttctcgcccaccaacaagaacagcgccaagcgtttccataatcgtggccaaaatgaaagcgtttcgcaatgtcaaaacatttgagcccaccgaagtgccgaatgcatttgccttaaatttttgccgttttccccttttttgaggccctcccccaatgactgatgatgactcaccacgtcatttgcacccattccgaatccgagcacaaaagcgagcagaaagccgacgatcaaagcccaaaggaaggcattttggaaaagggagagggcggcaccatcaaaaggagcggaaaaagttgggacgaacgatgagggagagggggaagaagaaaaaatggaggatgggatgaaggaagaggaggaaaaaaggggagaggaagaggaagcgatggcagaggagacgatggaagaggaagacattggacggacgagtggtcaattagcgtaattaatgggcaaattgagagaaatcagcggactgagcagcatcagaagtgcataatcatcaaaaagattcaattaatcacgaagatgaagtcccaattaataaaacaacaagcgatcattcgagtcttaaggacggagaggcccaaaaagcaaccgccgtgccggattggcacttttccgttcgccgttccctcccccccccccccggcgcttggacagttttgactcattaacgaaaacactttaggatggaaaaataaaaatcgaatttatgggaggaaccttttcaaaaagctaagcaaataaaaaagggtggggagcgattgagaagctaaaaactgtggggagtgcag

SEQ ID NO: 4750 - DNA, 3397 bp, Heterodera glycines
tagcatagtttttggaaatccgcatcgagaaaagtgaaatgttttgttgtcgcacattttcatcggcataattatgaacattttggagttcgtagctcaaaaaatcctaagttttggaatcctaagtttcttccacccttggtagcgatacttctcgagggcggattctttcatcacacacagatttgtttttggcgaattgtaccgaccatcagcaaaccaattttcttataatttgtttgcctgtcttaagttttagattccaggtgcactaaatgctgttatgtagaaagttttcacacctttaaaaagtttatttgcaaagatttcaagattatttgatcgtttaagtatattcccggctattttccaattttttgttaaattattcttaataaaatcaatttcttgaattactgtagacatctgggattataattacttctagtgttataacaccatccaaaggataaaaaagtgaatattgttcttcttttaataatacgtgttggaacaaagcctcggccgtgttttcgctagggtatcgaagagggcaataaaatgattcaaaaccaaaagaaagcttcaaaatgcttctgaatttgccttgctcatttttatatttttctttaattaacgatgtgaggatatctttaaaattttcttcagcattaattatgaaaggatttttaaaataaaatttagttttatattttgtaaagccaaattttaagtcttcatgacgaaatgactcaattaaagaacacccttccattttgagtgttgcccttttagtttttatgttcttatatacccatatgctcccaaacaattgtttggagcctattttcataatttaacatttggctttgcacccttcgggactcaaaatgtaatcttcgggcttctgttaaagaattttgagattgttcctcaagctttgttgcctggtcaaaagttttgcatctttcgaactcacgccacgcagattcagctttttctgactccaaattgatttgttccaggaatttgaaaatttcccaaattgaatcggacattttaagatacaattcccgaacaccattagcgtaaggagctttttctcttgattttattgcacgattaagagtttctcgagaagacttggcaaaatcgcttacatcatccgataacacaacgacatctcgccatgctctctctgtctctcttttagcagcttccaacaaaatggaattagcttttctattttttatttttctgtttttcttttatatatttttattatattttatatgcaatgaattcgtctctaaattctgctgagggtcttggcttttcaaattttatttgattttctcgcattatttcttttattttattggccatatctccaattcctaaatctggctgtgaataagagttacgataagtctgtccaatttcatgcctatattttttagctatttctattgattgtttggcatcttcggctaattcttggcacatcactgggtcctttctgtctagacatttttccatgccttttttaatatttttatattcttttcctcattttttattttatcaaattgtgaatgtatttttctaactccgtttaatagtttttcatgccaaaatatgatttcagattttcccgaattcctatccttaataatttgagcttcaaccatggtattatgagcagaaaatgaaaagtctttggcctcattagttaacctaattatatctttaattacttcttcaacaacccttcgggaggcatccatctgctgcttttcttctttcgacaagcaacaacaacactgacccccaattaccaagaaagacaacagaaatagttttagaaaaaacatttttatttaaataaaaaattaacttttcatttatagacaaaacaaatcaaatttcataaatatcaatcaaagcataataaattcccttcttaccaccatattctttcacactcacattaaccttcaaagtacaaatggtcccaaccaagtttttaaccttttcctaaaaaaaataaatttttgtgtttaaacatttttcataccattccgtcacccttttctacatttttcacgccgaaaaaagcaacaccccccaaaacgtctgtatcatccaagagcgacaatctcaaaaatgaagactttaccttctccataccacagttacacttccccttacgacaagagatgcaagcctaaaaatcaagatatgttttctatttggttttatttacattgtattccgcagacacaacacttgcaattttagcacgaaccacaaaaattcgactaccacaaaccaattcaatattcttaatgtcgcggattgtgttcatttttcgagactaaaataaattttagaaaattaaacaattaaaaataaatttcgactataactaaggcaaaaaaaaaattacacaattaatatttattataaaaagcaattcgaaagtgtgatggcagttttaaaaattcttccatcattttttctgcaacaattcgacgagaaatatcaaagagacttggagggacccgatagagcaacgaccaagagccaagcaattctctgtaataataatgacatatagatttttaatcgttaaagacctgtccatacgattaaagaaaacatttagtagtacttcaattggggaagtcaacagttcttttccccaagctaatgccatgacctttagcatttggacctttgccagaaaaagacgactcctaaaaaaaccgttgcggtttgtctggctccttccctcccagtaaaaccagaagaaaaaaaatagggagtcccaatcccgaatcatttcccaaatagttcccctgtacgatgccgtgtagtaccaacgtgtatctacccataggagtacccgcccctgagtcataaaaaattcgcatatctcgctcaaccatggtaaaacaaaacgcagacgtgtgttcgtgcatttctatgtagccggaaaacgggctttcataatcccggtgtatggccactttatattgggatgattcaatcaacatcgcttcaacctcagctctgttcttaggccagaaaaagtcttccttctcaagagcagtttcaaaatattttttgaacgagtacatttaaaactaaaaataattagcgaaataatttttaaaatacaagcgtataaaacattaaataaaaacatcttttttcatcaaaaaaaatttaattttggctgagtggcgaaatgaatgtttttggctgagttggcgaatgccaagttggcgaaatgtagtcgtgcccccttttttgagtaatgagtgatcgaacgactcatgctcaggaatgattaaagggatcaaaataattatctggtgcataaaaagcacat

SEQ ID NO: 4751 - DNA, 2805 bp, Heterodera glycines
  misc_feature (83)..(83): n is a, c, g, or t
  misc_feature (90)..(92): n is a, c, g, or t
ttaaaactaaaaataattagctaataatttttaaaatacaagcgtataaaccataaaataaaaacatcctttttctcaaaaanattattnnntcaggaaaagcatatgtagcaataataatcgaaattctctcttccaatagattcagctctccaaatgattgttgtcggtgcatgaactcgttgaaaacaatgtctgggttgattgttggaaggggcgagccggaatgatcacggggtccgacagggcactgcagtacagatcgacagaaattttcgaaattttccatcctggctcggcttcttgcttcggacatcaattttttgaggatttttttaaaattgttttcgggatcctcatttggtggacatttaaaataaaacgtgcggacatattctttaatcccaaattttttgttttccttcacatgtttttccacctcttcgtaatacttgcccaagtctgggctcttccggaaataattacgggtatttctcgaccgccttacgtcttttgaaatttcttggaaatttttcttggacattcttaaaaaataattagcataaaaaagttttcgtaaatattgaatgaaataaacaaactaaagaataaacacaaacacaaaattattttaatgatatccaaaaggcaacacattatagtcaacatcaattatccccttcttctgcactggctcgtattctttcattacatccctcgagaggactcgacaatcccttgtcggcccaattttctcaggataacgaaacacttttttgaacccatcccgatgattcaacaccatgtccttgaacaattcatagctgaattcgttcctcctgtccaacgtcatcccccgtatcttcgttttatgccaaatcacaccatctttcttcctcctcattttcaaggcgtactgttttggacccgccgacacatactccaaaatttcactgtctgaatactcacgagtcatctctctgaacaaatgtttatagaaattttcaaaaaacttcttttaccccaaaaatttcccctcctccaaaggacaccgacccttcggatgagcaaaagccagagaatcttaatgttttaattttatggaaacttttctaatgtccacctgtgtcacaatacaatagcttagacccctcctccctgtagacctgctccatatactcgtacagctttaccctggcagcactcgtggtccacaatgacaaaattatgttcgaaactttatgctcctttataaactcttgcttcttctggtatattgctctcatcacaccctcatttatctcaatcggtcttttaaactcaatcgtgtcatctttgatgagctccgtccatctttccaaattattaacaatctcagtcacagaaagtgtgttcctcattgaaaatttcccccataaactgttcaatcccttaatatttatttgttttttgaattttatttgtttttctcaccaatttagcgatcatacgtagcccagggttaaacaccattttatcatattccaaccaaatgttgtacttggccttgtacatttcgatgaatgctcttttttcctcctcatttctcacctccgagggccagcccgacgcctccacctttattttcaagaacatgcgcacatatcctttgaacagctgactgtcaaattgctcaaagtgataggcccgatagaagcctattactctatatcccaacgccaaggatttccgcagttctatcgaggtgaatgtaccaatcaaagctctccgctctggccgatggttacattttttgacatccttagccaacacaaactctttcttcgtttttttcgcacatgtataacaattggggaagagaagcatattatcaatatgcatagggaggagaggataaagcagttcctttggggggatgaccttcacctttagcagaccatcatagggcacatcgtcgggcaccgtccaattcacatcgaattccctgctcaccacaattttagggaccccaaccggataaggggtgtcttaagcgaaggaaaatttcaaaaatgcaagcagattttttaccataattcacaaacggatacaagcttatgatatcgaacatcgaaatctcaacttcttcggttgcttttgcatacaaacaaaaaggcattgtccgtcctcccgcgtaagcatccctcggatttattggacccttatccggcacagcgtcaaagaacctcttcatcgctctgttccgtttcaattccgctttcacatcgcattcctaaatttgttcaataatcaataaattttgaaattggcacacccaaacttcctccaccgagaagtttttacatttttccctcaaaaactccattcgtgtctaagttcgtcggaaatttacctccatacaacgcccattgggtcctatgttccagggcaaaaaacattttggacatccatgaaacgcacatccctttagcaaaaaataaaatagggaaggaaattctgcctacctgaaattcaatgatttttttctcagctccgatgatacaatccacttttaatcccccgatttccacttcacacccattgcatgcgtgtctaagtctcactcttttgctttgagcccaccattcaaaaaatttcacagcaattttactctgattctcagctctctcataacagccttccggaataattgtgagatgattttctctccaaaattttgttcgaaaaaattctcatcacaacccccggaattgttacattgtccttcaacacattcatcccatcagtaacttcaaaaaaaattgc

SEQ ID NO: 4752 - DNA, 1222 bp, Heterodera glycines
  misc_feature (1200)..(1201): n is a, c, g, or t
aaatgcttttcctctcttttccgtccctcgtcctccgccaaattcgcccttctttctgtgctgcttttcctttctgctgatgttagccatgctttttgatctgatcagcagcggtcgatcacttccactgggcccaaccaacgaaagggttttcttctccaacgcattacggtaagtgttttacttgggttcagcatactgtaacagaatcactacagcataaatcaaaaaatatatttttgttttagtaaccacaaaaacattttacttcaacttcgcaccgtcccagcgccaatgttagggttgaaaaagcgtcggccaaaatttggacgaattgttggcaaaaaatacagaaattgtagtttattttcaatataattttcactcattttttatattttgtttaggcttcttctcgcctgttcagtgcatgttgtccttcagagaaggctccatttttatggacaattacaaataaaaacgaaagatgaatcatcgaaactgtcctcccaaatttaataattataatatcttccatatgaaaaatttaaatgaataaagagaagccttttgttttttattttgttgaattttatttgccttctctacaagaatggaaatctgaattccacattaaaacacatttattatcatgtcgtccgtttaaaattagggcatgcgtgaggtcgaatttcgtcagggttttaccggggttctcggtcctgttattgaataaattgtgtcagtgaaaccatgaattacacggttttttcggtcgcagtcacgattcacgaatgacggcctacaatgagtacagcaaacatcgtctgccgaaaaagccaacagacttcgactttgccaagacgccggagatgcctgaaaagcttgtttgcatagcctcagtcagtgtggatcaaccggtatttgtgcttgcggatgtgactgagttgtagaccatgctagactcagtcacaactagagatcggaaatttcaaatttgctgatcctgttgcaggatttgaattcaaaattttttacaggacaggatccggcaggattaatcctgcaaatcctgcatttaaaatctgcaggatcctgcgcaggattacggattttaggaaatttcaaaaaattctgtattaataaaaaagtctttcaaagtatagcaaagtattcaaatatatttttaaaccaaaaaanntgatgaagatgaaaaattaat

SEQ ID NO: 4753 - DNA, 2311 bp, Heterodera glycines
gaaaaacaacaacaatcgctcggttcacttgtgccgtcatcattagagatgggaatttatgtcacgaaaaatccccaaaaaatcgtcaaaaagtcacgaaaaatgcaaaaaaaaaaaaaaaaatctgaaaattagccataagtaaaaaatccaaatttttaacaatttgtgttggacatggttatgggtttatccgtgccaccacttcttccgccagctatcaaattcaatttactgttcatgcgccaacggaaattgtgccatttgaatatgtgaacgaacggaccaacgaaaagctgacattggagaaagcagaaaacaatgatgaaagtatggatgaagaagatgatgatgaatgggatgagcgatggataatgaagcgatgtcaaattggggagactacggccgcgttaaaccaaaattcgggcaatttgaacaatgtcagctttacgttttatggaaattgcattgggtgagttgcaacagcttttgctttaataatcaaattaaaaatttcgcttaatttaggccattgtcgccaccggcagaagacgaagaagcgggacaaagcgccggaaaagagtcgacgtattgtgacatggatggattaatttggaaatgatcgatcattatgtattatgtgatgaaatgaattttatgaaggaaattcgcaaatatctacattcatatatatgtatgtgtacatgtaaataaatcggatgtataaaaaatgacaaaaataaatgcgaaatcaaaagttttttagaatttgtgtaaaaaaaataataatcataaattggtatttttgcacaaaattattcggtatccggacaattatattcattgatgaaacaaattgagaggagcaattatcagctatcaatttacgggattcccgctcccgtaaattatttattaccgggtaatgtcagaagaaatgattagggaacggatttcaatgcagaaaaactgacaaaaagacacctaaaaggaaaaaggcaaaaaaagggacaaattgaaaaaggaggtaaaaatttcatgagcttagaattctattaaaaacagacaataattggggtgtaaacattatgaccctgaacttaacttttttaattatttgagcttagaataatcagtggtgattttcaggtttaaaaatctgcgtaaaagtccaaaaatgcaaacaattaattaactaaatgtgtattcaagcgaaagaagcaacaaataaatataaggggcaattatccgatcagttcataactatcgatcaatcattcctaataattctttcactttttcttctgttgctgtccgctgggcccaggattcattttcagacgattttttgcgttaatttggcccgcttctgctggtggagacaatggcctaattaaggtcaatttgaattactttaaacaaaagaaaatgttgttgccactcacccaaattgataatgaagatgaagtctgacattgttcaatttgttcgtctttttgtcgtcccatctaaccgttgccgtttgcccaatttggcatcgtttcattatccattttttgtaccatttatattcggtttctttggccaatgtcagcttttcgttggtccgttcattcaccaattcaaatgggccaatttgctttgatttaaaatatttaattcgaatttcgtagctggccgaagaagagttggcacggagaaatgcctataaaatgggaaacgaaaagcaaataaatggcaattaatccgaatattttattgaaaatgtggccacacctctttgaaattggtgatcattcttttggtttttgacgtataatcacaactcaattgctttggctttccattttttgtcggagtgttcaaccatttggacagcgcttggccagcagttgcatttggcccatcatcggcaattgcatcgggcaacaaacgattggaattgattgaattcagctgattgagatcggtgagaattgtcggcgaagtgcggcgacgcaaattgtccaaatgatggctatcggcaaagttcaaatggtgaatctttggcgcaaaaatgggccaaatttcacgaacaaaatcattccaaatttgctgcacactcttggcattatgggaataaggcacatacaaattcaaattggtgcctttgtcccaaatttgtttattggcacggataaacgcgaaaacggagtggtcgatgaatctgaacaggaaatgatttaaggtactttttcactttacgccacataaaaaaataataatttttttgtatttttctggggttttcatggacgcggaccacaaatat

SEQ ID NO: 4754 - DNA, 3272 bp, Heterodera glycines
attcattcattcatttcttctgctctccgctgggcccggcattcattttcagacgattttttgcgttcatttggcccgcttttggtggagacaatggactaaatgaagtgcaatttgaattaattgaaaaaaagaaaatggtgttggcactcacccaaattcataaagcgtaaaaccgattttactcaaattattcgtctttttgtcatcccattgaattgtcttcccaatttgacatcgcttcattatccagcgctcttcccatccattatcgttttcttcatccacattttcatcactgttttctttcgtcaatgttagcatttcgttggtccgttcgttcgtcaaaaaaaaatccatcccatctcagcaaggcttggtttttatctttagggatgtcaattttgtaaatataaatttttttttcctggaatcttcatagctaaataatagagtgccacgggaccgggaattttgggcaaacccgggaccgggaccttttcgggttgaaaaaccgggaatttttggctgggaaaaccgggaaaaacccgggactagtcccggtcccggtcaaaaccgggaccttggtactcagttgtactcagttgtccgctaccaggtcccggtcccgtggcactctactaaataatatgaaaaaaatttttggtcatgtaattctgtttctttatttttaagctttattccactaacatgttaaatcatgaagtgagtttatgaatttccaaaaattagcttaaatttcacgcgcttaaaaaatgaaaatttataaatgttttttatgacgcgatgattttttggcgacatgttcaataaatttcaaaaattttaataaataaatctgtcgaaaaataatccacccgtctccatttatcccttcttatcttctaatcccccttttctgaggaggttgaaaaattaattcgagaaaatagtaagtcgtattatagcattttgatgctgcttagtcactattttctaataattttgaccaaaaaaccaccttttgtaattttatttatatttttggtacaatattttgttttttgtacaaatttcttacatacagttaatcgttggattaattttgacatttggaaaacgacaaagtcaccgcgtgaccatgaaaatgaacagacggtaaggaaattttaaactttcaaattctaatattaattaattatcccgcatttcagttggatttgtagcgacatttggatggacactctcccgttctttgaccatgcccaactcggcctcaaattggcacttctttcgccacggttcaacgcgttggtcgacaaacattttgatggcaaatcagaattgacacttttgggaccaatcgcaatttgcaaggacattgtaacagaagtgccaaaattatgtgtgtttattggtgccaattctgttgaatttccattgcccgaccgtccgttgcccaacaaaattcgctttaacgacattcggatcgtgtaattcaaaactttgttaaaatcattttgattgttgtacaagtattattttcagttacattaaccattccgtcctcacatttctccgtgccaaccagcaaatttgggacaaagccatcagtttggatttgtatgtgacttccgcccataatgccaagaaagtacagcaaatttcgaatgattttgcccgtgaaatttggcccatttttgcgccaaacattcgccatttgaacgtttacgatgttcaacattaccacaaattgcgtcgtcacatttcaccaacaattctcattgatcttgatcagttgaattcaatcaattccaatcatttgttgcccggtgcaattgccgatgatggaccaaatgcaactgctggccaagcgctgtccaaatggttgcacactccgacaaaaaatagccaacccaagcgattgagttgctgtgaatatgcgcatacctcagaaaccaaaggatgggtcaacagtttcaaagaggtgtgacccaatttcgtaaatttggaaaaattgcatttaatttcggtttccatttgttcaggcatttctctgtgccaccgtttcttctgccagctatttaattcgccttgcgctttatgaatcaacggaaattgagccatttgaattgataaacgaacggaccaacgaaatgctgacattggagaaagaagaaaacaatgatgaaaatgtggatgaagaatacggttataaatggcacgagcgatggctaatgaagcgatgtcaaattgggaagacaattcaatgggaggacaaaaagacggacaatttgaacaatgtcatcattgcgttttatggatttgggtgagtggcaactgcttttggcatttttaaactgttcaaaagatttaaattgcgcttcatttaggccattgttgcaaccacagccaggccaaattaacgcaaaagatcttcttgaaatgaatcccgggcccagcggacagccgaagaaatgaatgaattattaggaaatgagatattctgattgatcattatgaatggtattgactgataattgctcctcatattcatttgttccttttttcctttgaatgcatttaattagttttgctatttgtgacttttatagcggaagtgattagtttaaaaatgagtacgatttattcgggtgtaccttagtcaacgccccgtaaaaaacggcacaaataatatacccaatcgattcgtatcgacgagctatgcacgaaaaaataggtctccagttgcggaaatgccaaaaaaccggtttaaaactcgaaaatttgagtgaaaaagtgggcccctgaccctttaaatggtcaaattcgatcaaatttggtatcattcgaaagctcttgatgagtaagtctcaaaaacaaggtctaaattcgaactagagttgagcggtaatcggtaattgtaaaaaaaccggtaccggtactaaccggtaattttccaacgtaaaaatttttggacaaaatttttcaaatacaaaatttttattcaggatcagcggccaattttccaattttgcgaaggggtctccggccatgtaaattaatgtaaatcaatgaccttttttgctttcaacaccgcttttttcgcggcacgtttttctcaagacttttggggaacaacagggggccggcggtgccgataggcgccgccgggaaaaattttgtatttttttatgcgatttgttaacagaatttgtaaaaaagacaattgattaagttttgggttttaggatgcttacatgaaagaaaaa

SEQ ID NO: 4755 - DNA, 2104 bp, Heterodera glycines
ttcaaatttttgggtgtatccgaatagaaagaagttggaaatcagtacttttcacgcctataaaattcggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattgaacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaataagaatgttactatctctcagttatcggtaatcggtaccgctcaacccctacatttcagctttaccattcttttgtctttggaaaatttaacatacttaaaaatccatttgcgtaatgttgatttttttttgaatttctatgttgcaattaaattgagaaattgccggaggcgacaaaagagttgaaacatttacactttgttgaaaaaatgaatttttaagctcgcaacacccataattttaaatgcaatcagccgcttgcaattctgatctcccaattttggtatttagcatttattcagagcaataatacgagatgagcaatacaataatacaattataacgcggacaaacatccaatacaatgcacatttaatggtgtcatcatgccaaatattcatacaaatcgctatcctcctccgagcgcttcaaatattctttctcaatcagcgagtcgatgcacttcttgatgatcggcaccttaaaaggaaaggaaaggcattcatttgcacccaaaatcattctcccccacctttggctggaaacgcgttgtcaattggttgagcacctcggccaccaacagctgatgcttcaacgatttgcgcattttcataatacggacaatggcagccttaatgagggagaagaaaggggtcattaaaattgatttgtcaatttgtctcacctggatgaccaacttcatggacccaagcacgggcgaaagatgcccaactattctgggccaactcagcggagtgccaaggctcatgtcgaatccgaccggatgattattggacaacagcaaattagtagacaaatatgtgtgcttaattatcgctgaaaaaagcaattagaaaagcgttttgttatttcttttatggttccagttttggaaaacaaaaattgctaaatttgggttcaattgcactttaggcgtccaatttaggtaagctgaaaaaaggacagtctatgctagagcaattagcaatagcatattccaaagttttaattctgggaatgaatgtttttggaattcaaaaataaacacagggaaaatttggaactttacaaggaaattgtatgattagagaagacattaaataaaataaacggaaacgacatttgtgcagtttaaaaaaagtaaataatgacaaaaaatggagtttggtcgcgaatttatacaaaaaaaatttgctgctggacaaaaattaggtagtctacagcaggtccgaattagtccaatcacaattaccaaatttcacagtatatatatatgtcgtttttgaaaaatttctttcagttaaccgaaaaaaaataatttaattttttttttctcaaaaatttctccttcttcatcaatttcctactcttttctcgaccagacccccattcttaccagtgcaaatttttaccggcggtaccggtactagacaaaccggtaccgatactttgatttttgaaaaaaccggtaccggtaccggtaccggtaccaaaaaaaccggtaattaccggtcggtaccggtaccgctcaaccctatttcgaaccaatgccatctaagcactgggacaactgagtcccagcgaaaatggacacttcagtaccaaaagaaataaccatttaaaagcaaaaatttcgcaaaagggagcatgcgaaga

SEQ ID NO: 4756 - DNA, 1907 bp, Heterodera glycines
  misc_feature (97)..(97): n is a, c, g, or t
  misc_feature (1813)..(1813): n is a, c, g, or t
atagtaattaatcctccctatttttgctcactgatcaactgtttgctgatcaatcccagccagaaaaatgataaattattgcattgtatattcattntaatccaactcagtctgctgatcaatgtccaagcactttcacatttcacagattttgtgctacatagaaaatctttattttaccatttacatttataatttttaaattattctaaaattacgatagaaaaattaataatattttattgaaagtttttattatttactttttgttggttaactattcactgattgtttcgccacgggttagccgattcacaaaaataagcgattcataaaatcgcaaaaatcaaaatctgacttttcctatgatttttatcaataaaattgttatagagaccggcgagggacgggatctttcgcgggattttgcgggatcccagtccgtaatcccgaatttttttttgtaaaatgcggaattgcaggcttgcgggattaatcccatgggatcccatcccgcaaaaaaatttagagttctaatcccgctgtgggaccctctgttggtctctagcttattgtattaattattataaaaatggttataatttataaaatagaggcttaaataaacattcttccaaaagtttttggcttaataattaaacttacttaatattaaataaaaccatggttagtttactttgaattcattccagggaaaatacaaaaaattcttcatttttaattagaattggttaaatttttatagtactttggatttcacaaatttcccccgttatttacttcgcaatttgcaagcctgttgttggaaagtgactcgacccaagccctgtataataaaatacgcttattgataaaaaaatcaatatttccatctttctataattgttccattttttaaatgggattaaaagtttttgataaatatttaaaaaataattaaactgaccactgcttttattgaaaaatatcattggaaaagacagatttttgattttgcagtttttgtgaaccgacaaattataaggtttaaaaattattcaaattaaaaaaaaaattcattcagatctcttcgaaaaaaacattgaacattgttttatctttggcacacttaatgccattaattagcgaattctgcctccgccgctatgcagcacttgtcgttttcatcgttttctttttcgaacctatgtatgaactcgctatgccacttgacatctcatctgctgtattaattaatcacatttaccatttttaattattgccatcgtttggaaactattcattttaatcagcagcggctctcacttaatttgttaaccgtttcacttaaagattctttaaatcgcatttcaatcaaatttttgaagaagttatattcaatttttgcttctttttctttgttttattaaaagtaaattatgttcacgccatttattaaaacttgaaaaaacgcatcaaaactatttgttaaaaaatgacacataaatcagtgagtgaccaaaaaaaatgtgagtggacagaaagcgtcgtacccttcggcggatattagggagggtcattaaaagtaaattttatgacgggtcaccagcagcagtaatcaaccatccattagaaaaggaaaaacacaaattaagtgataaaacggaggcttaagaaatgtgaattttcccgggatttcttggcttatcaaacaaaccccgacactcccgcggtctttcaaactctaaaggatcttacagtaataaccattattgaaataatttttaaaatttattgggcatactttgtactntaatagtttcagtgatttagcgccttcggctgtttctccgtttgttttatatttttatgtgtgtatgcttaaatgaagtcaccgtcacatcctc

SEQ ID NO: 4757 - DNA, 1852 bp, Heterodera glycines
cgctatgcagcacttgtcgttttcatcgttttctttctctaacctatgtatgaactcgctatgccacttgacatctcatctgctgtattaattaatcactttattaatttttaattattttttggaaattattattttaatcagcagcggctctcacttaatttgttaaccgtttcacttaaagattctttaaatcgcatttcaatcaaatttttgaagaagttatattcaatttttgcttcattttctttgttttattaaaagtaaattatgttcacgccatttattaaaacttgaaaaaacgcatcaaaactatttgttaaaaaatgacacataaatcagtgagtgaccaaaaaaaatgtgagtggacagaaagcgtcgtacccttcggcggatattagggagggtcattaaaagtaaattttatgacgggtcaccagcagcagtaatcaaccatccattagaaaaggaaaaacacaaattaagtgataaaacggaggcttaagaaatgtgaattttcccgggatttcttggcttatcaaacaaaccccgacactcccgcggtctttcaaactctaaaggatcttacagtaatagccattattgaaataatttttaaaatttattgggcatactttgtactttaatagtttcagtgatttgagcgccttcggctgtttctccgtttgttttatatttttatgtgtgtgtgcttaaatgaagtccacgtcacatcctcgattagtagcaacagtagagagtttttggttggttggtggtcgattaattaattaattggctgtctttttgcgactgactgatgtcacacgaccgactcgcgcagcggcagcagctgacggacgacgaggggagaaacaaagagtaagctgaaaatggagagtgcggcgagaatggcagagaaatttttgcccccgaaattacggagcccaaagaagaagaaagaagccaacagcacgcagtaaaacaaatcaacagcagcagcagtagaaagagcacacacccctaatttgggaagaaaacgttggtacatgaaacgttgcgcagtgcgcgcgctcatttcgtcggtcggtcccatcgccggcggcgtcgtggtcggcgttctaaacggcggcgacggccggtggggcacaaaccaaaaagagccgtctcacccccccccccccccctccaccaattttctcagaatgattcatgcatatgcaattcatttggtatgaagtagccggtagggggagagagggtaaatccacacgcattaataaatatgggcaaatggatgagagagcgcagaccaaagggaattggaattggctgatcgatcagcggcggggagaaagacaaggggggggggggggatcagcagcagaatcagcacgccagacaaaaacaacgaatcagcagcaaatttttggttgcaaaaactgccaccgatgtgttgatgatgaggatgatgactactgtctgctatatgtacacaacgacgtacacacacttacacatatgtacaacatgtacatatgaataagagggggaaacgccgctgctgttggcgatgacaccctaaaacgctacgtgtacatccccccccccccctccccccatctgtacaccaccagcagcggcacacttcggcagcggcggcgtcgtcgtcatcatgtgcacagagcagggccgacgaccggtggttggatgaatggatggatgaaggaaaggaagacggacggacaagaagaggacgatgaagaaacaacagcagcagtgcaattgggatggggtggggcggagggcctctgctgatgatgacggggggggaggatggacgacgtgaaaa

SEQ ID NO: 4758 - DNA, 3922 bp, Heterodera glycines
  misc_feature (34)..(34): n is a, c, g, or t
  misc_feature (95)..(96): n is a, c, g, or t
agcagcagaagcagaaaaggagcagtacacacancagtggaggaggagagaaagcattggggtgtgcttgctgttgctgctgcttttgcacaatnntatggtgccccttttcccgggaacacgtacatttataaatgtactactcagcacatgtgtttgcttatgtacacacatacatctttctgttttttgggatatcgtcggcggtggcctacgatttttttttgaatggcttctatggcttattttgacacagaaatttaatcaaaaatttaaatttaattaatttaaattgaattttgagtaccttaaaatccggaactcaatttttcatgttaattatttatttattctttttaaatgtctgttcactcactggtgtcggttccgaccggactgcagccgattttctagtccggaatctgtctttttgggaattcacaggtttttctggatttacggatttttccgagcttaatcttgaaaagtcctacttgaaagattttgaaaatgaagttccgaatccaggaaacaaaattacatgccattactgggctcgtttaaatttatttgttcatatgtattttcattttaattagcaaatcgcctctttcatctttttcacagtaatgagaaaattgatgcttttgttttcaattttcgccgcttaatttatgtgtcattaacctgttatggaacgacgtttttacgttttcctcggcctcccctttcaatttacccaattagcaaacgcatcaaaataatgtgtacacatgcacatgcttacatatgtgcatactttttacaaccactgctgctctcattagctcattaattatgcttgttgcacaccatttttgcccctcgtttcagcatgatcaacaggttaattgtaaaaattgctattgccgacacagcagcaacagaacaacaacaaaaacaccagattccgaatgaatcagtgccgtcaccgccataatcaattgttagtgatcgaaaatggtggtgccaagccaaagcaaaagtgccaacaaaatgatgatgattatgatactgattgtccgtccgccttggccacatttcccattcaaattggccccagcattaataccgccgttgtctttcgcccttttcgccggccccaattttttgccgtttttattgttgttgtgcttctccaatttttgctgtttttgcccgccaattttgttttggccgaccaaaatttgttggtggacaccgaactgttctccgccgacatcatttcccaggcgtttgtccagaccgggtccgaactgcactatttgcgcgacatttcacaccaccaacaacagcaacaccaccaccagcagcaggcggacagagggggaggaggaggcggtggcccggccgcacggttagtgccggccacggcaccatcggccgcaaatggcagcggcgggggcggaagcagcaaagtggtgaaaaatgggtaagacgaaatgggcgagaaccctggataaagggggattttcaaaacggagttggtgccgttcgagttcgctggaaaatttctcatttgggtttaatggcattttctgaaaaaagcaatgattggcatggcccttgggtcgccaccatttttttttgttatggatgaactctaatttttaaaaaaaaatttttgacatcgctgggttttttctacttttgcttattgacttgaatctgaagtaactaccaaaaaaaaattccacgttgaaggtctcggaccatttttttttcttcaattctatgttttaaggttgaaagtggaaaagcgttcagcagtggaggaggtggtgacattgttcgagtccgagtcaaccgattttggccaaagcgcatttggggtaagggaaagtgacgaatgattcaaagttacaaatttaagccaaccttttaagtaaaatgttttttaagaggcaattttaaatcaaaatgattgatttttgttgtccaaaataaaagaagttgaaaatttatttgaaaaattgaagatttgctgggagagagaagctcgtattttttttgttaaaaagtacttttatttggaaaatggaatatttaaaaccaaacaattctcattttcactcaaattttgtccatttttcaggtgcctgtccaacggcgagtgtttctgtccaatccgaccgatgcgaccatttccatttcggccatcacaagttcctccatcagtttccattgctcttttgttgaacaaaaagtgagtgaaaattgctattaaatttactgtttttttttcattttcaaaaaattgagttcaattttacgaccgatttttgtcatttttagatttggccccaaaaagtgataaaattataagaaaaaaattgcgacaattttccggtatttgttaattctgtttaaatttaccaatacagggtgtcatggcaactcgtacaaaggcaactcgtacaaaaaaattctaagaattttcaactaaaacttagaatttttagataaaaaaattaaatgcatttttttacctagaaaaatttaaaaaaaattctttaaaaaattttcaaaaagtttttataggctaaaaatccatttggatttttttatctaaaaattctaagttttagttgaaaattcttagaaatttttttttggtacgagttgccctgtgcacgagttgccattgaccccaatacagagccaaaaaattattcaaaaaaaatttttttttttttctgagcgattttccggtcccatttttcgtgttttatttgaattcgaattggattcacatgtgtccagagttcagggatcaaagataactgcaaatttcattttgaaactggggatgaccttttacaaattccaaattccagctttttttatattttgtcaaatttccccatttttttgcagaggcaaaaaataaaatttgtgccaaaactgtcatatttttcaccattgaattaccaacaacaaattgttttcagtcactatcatcgggacaacgcacttcttttcgcgtctattttctgccagtcctcgagcagttcggcccgcaacgggaactgatcaaagtgcacacgtccgtcggcacatttgcccaccgcgtccagggcgagacgggcggaaacccgtaccggatacggtaacactaggattgagcagtattaactcattgcaaatatccgaatttggcttgagggtaacaaaaatttcttatccatccattcactttttgacacttttgctgtttggtcccccgaaaaatacataagaaaatgttcatgaatgaaaaatataccaaaatatgttgctttttaaatcataaaaaaacaaaagtgccattttttgttttgaatttttctttaggatttaaagtattttaaattaaaaaaattttcgaatttcccacaaaatggcttcttttcggtttatttggggctgaatttattgctagattacatatatccaccaaattgatgcccctaattaaggtcctttttgggcattcatcttcctctgaatgccactttttcggctccgctgagtctgcacaatccgcacacaaaaacgatggtcgtatccgagctgtttgtcagcgactgcaacgtgcgcattgaactgaacgatggcacaacggtggcaatgcaaaagcgacgatgggacggcggggacaaaagtggcggcagaagagaagcgatggattgggtagaaacttaacttgttggacaatttaccatgggggatttaaccgagtaaaacatggggactatttaccatgcggatttacgatttacagagtataaattcggagcaagtcgtccctctcccccacctggagtttttttttgtttttcaaaaaacttttattggaaaaatttctgtttgaaattttaaaaaacttcccagaggttactga

SEQ ID NO: 4759 - DNA, 3762 bp, Heterodera glycines
ggaggagggggagggaaaagcacggggaaatggcgagggaatggcaaaaagggggagggaaaggtgaggagacggaggggagaaggggggggggattgatgaaaaggaaaagggtaaatgcgatagcaccccgggggagggggggagagccgaggaacaatgcgcaattgtggacccaaccaaaattccccgaggagagattggggtgagtgatcgatcccctccccccctttcccttttcccttcttttcccccacttttattggactccctcccccttgtcgattccagcaaattcttttctcacttaactcaatccgcgttgaggcatccaaagcggattatcagagaaagagagaccatttatggaaagagggaaaaaagggggaggagggataaaatgaaatgaaatgaaatgaaatgaaatgaaatggaatgttgtggcctatgtaataattggaaattatggaaaacgaaaggggcggaaaactttcgaaaattctatttttaaggcgaaaaactctttaagagaatctttaattggttgcatttaaccaattgaacagataaccttttgaaaagggtgccaaaaatgccaaaattgccaatgtttgccggggtgaaatttgatttgatggattggactgtggtgaggtgagaatgaatggggaaacagcagcagagcaatcatttatcgtcattagtgggggggggggggggaatgaacgcggcgataatccgacaaattcccccgggggattaatgaaacggtgacaaatcatcggcggaatggcacaaaaggctaattggaccagtcagcaggcacaggaccaccccttctgtaccccgttttgttccaaatgcggccaaaacttggccaattggccaatgagtggtggcacgggagacaataccaagaagaaagaagacgggagggcaaatgtggcgaatgcaaatccaattgagagagcaacgcattgggatggatgttttgttttggcctctggcgacgatgttgggcttggccagtggacttggccaccctcttccctctctctctttccctctctcgtcctctctttctcgcgtcctctctttctctcccacatgtctctctctcgcctctccctccctctcttggtctactctttttctctgcccttgagtgttttgcggttcgatagggcgatggccaagagttgtgcctgcgagggaagagagaaacataacaggcgaaaggggaaagtgagtgccgtcagaccgaacattgcccaaggcaaaatgccatgccatcctaaaaagaggagcaaaatgccatcgcaagaatgggagaagaggggagaatagcaggtgctaaagaaagagagagtacacgaaatgagacggaatacagtgagcgagagagtatacggaatagagagaacgagaaagggagagcatttcacagaaagtggtttttctgtgtagcagagaaagaaaaagtcgtcctctcacactctctcatccgtctctcacttcttatgccctcctctttggcagcactctcttgcctttctttctctcaccgtctcatcattctcttccgttatttttttctctttcgctttgtctctgtcttttgcatttattatgcgcaaatgtaatacatacataatacaaaaagaaagtgcataaaacattcatgtcattatttaatttgaacaaatttgaggggaaaaccgtaaaaataaaaacaaaagagagaaaaaagagaggggcgagagagagagaaacagagagaaagagaggggatgaggaagtggggacggaaaaagatgggaacataataaaataatgatgggaatggtgagaatgataggaagaggagattaaattctgagtgatcggcgcgcgagcgaatgccaaccaaaccaaaaaaaaggtcacttctgtctctgatcagtccttcgttcacttgcctctggtagttcattgatccttctttctccgctctgtgccttaacatctttttgctagtccaccctctattctgataaatccattgcttctgactgtccttccgcttctgatcaactgtgtatcttctggttttagtccgctcatatccatctctgatcagtcctccatctgtctctgatcagtgcttctcccatctttaactctgtctctgatcagtttccgatcaatccttctccatctctgattatatttctccctctgctctgtctctgatcagtttccgatcaatccttctccatctctgattatatttctccctctgctctgtctctgatcagtttccgatcaatcctttctacactcaccccttctcttcttcttctgttctctgttcccttctccgtttgatcagtcgtcctcgcgcatcccttgcagcaacgcattgtggtggtgatgaaagtggtgaccatgcaaatgactgttgttctgcggcagatgcgtgccattgttgatgccaatgcccgcgctgtttgtcaaatgttgcgcgtgtgccaccagtggcgttccgtcgatgcctccgcggttcttcagctttttctgcttcatcctccgattctaaacagtcaaaatgaaaaagataatttcataatattttctatcatttgatcagatggaccgacctgaaaccaaatcttcacttgtcgctcgcttaatcccaacttttgtgccaattcccatcgcttctgcttggtcacatattcgctgaagatgtattcctaattggggaagaaaatgaaaaatgggagacgagcaaagcatagaagccaaaaataattcttctgatcagtgatcgcttttgatttctgatcacaaatggtccttggagacccgccaattaggaaagataattagtctttcgatggtttttaactccaagactgatcatatttattcatccctcctgctcgcgacactaacacttattccttttgatcaattccaatataaggtcagtgagtgatcaaatcagtccctgtccttcccatccgtcgctgaaatcatttcctttcaatttgctgatcaattcaatcttttcccgccctttctttttctgatcgctgatcacttctgcccttccccttccctttacctgctccaactccaatgtctgtccttttgcgtatggtttccgcttctttcgcgatgcgctgcattgagttgtccaatccaaatgtggaatcacatctgaacacttttggatgaaaatgaagtcgatcagatcaaattaaaagaatgccccccccctaattttatttgtcgtgtcattttttaaactgtcccaattaattaattgcctcctccgccccttggcgaggccattccgtgcgttgcgcctttttattcgttcatttccctggggaacaattggccactacccaaaggccaacagaaaagcattgtggtggccaattgggcttggttcaatgggaaaaatggaacattacaaattaagtggggggggggggtagagagagaatgagaaaaataagggggagagagaaagagagagatgatactgtaatggagagaatgggcgggggagggggagggtggaggattgatgggagggtggaggaagaaagagagttggaaaagagtgaggaaggagagagagagagagagagagaggagagagaggtagagagatggagagaaagagaaagagagtgagaaagaggagttagagggagatatagtggaaaaaagagagagatatgctaaaagagagttgggagaaatgaa

SEQ ID NO: 4760 - DNA, 1386 bp, Heterodera glycines
tttcctccttcgtcatcaaaacggagcgcacatttttatggcaatccttcctccccttttttgtatagaaagaggacggacggatgaataagaaaatggggggggggaggtaataaaacggaggacgaaaaacggatggaaatttggggaagggattagaaattgggcagagggatcgatatgatggatggactaaaatgtgcatgaaaaatgctggacgagaaggagccacccccacggcttcgaaatgccatttgattggtctgcaactcttatggcacattccgactgagttggcactttctgctttcatttggtattttcttacaaatccaattatttttggcacttttctcacaaatagcccaatgcttttcctttacccgtccccctggggttcattcaccgattgattagcccctaaatagcacctcttccgccgccactgccgcttatccccggcgtgccaaactccggcgccgtcgcttcgtcggtgccgttttccgctgttgcggtgcccacatagtggtgcaactgttgttgctgttgttgctgctgcatcactgcgcccgctgccaccgcatttgacagtgcgtacgcagcgtactgttgctgatagtaatgccattgggaggaaggcacggaagcggaagaggaggcggaagaggaggtggagggcacggccacgccaatgccattggcagtgtaaaagtcggacgcattggcggcggacgtggaaggcaaaacggcagacgaagaagcggacggcactccgccgcttgcgcacagtgtcgagtcgaagccttaaatggcactgggaattaatcatctttaaccaaaatggggagaaaaccgatcgaaaacatattgatcactattaaggaaattttgcattttagctttaattgacagttcttcagaaaagaaaataggtttgagcagttaagtaaaggtccagatggcatgatgagcagacatttaaagtcacaatttcacgcgatcggcagatcgccaaacaatgccatggacagtaattgcccaaggcactaccgtattcggtccttcccaattcggcaactgttaccattaccatgcaatatgcatactcgcatactcttttcccccatttttacaataacatctgccccgggagatggtattttggtggggtgcccaaagggatggcatttgcggggggggggggcatttaattgtaatatttggcggataattggcaggtgccatcatttgtgggggagggaggggagttgagagcagaagtggaggacgcatcgaattgcattccatcccatccccgccggtcaaaaatgccaaaaacttacggtacattcgaagagcgaaccgaaagaaaaacgggcggtgctg

SEQ ID NO: 4761 - DNA, 2636 bp, Heterodera glycines
  misc_feature (11)..(11): n is a, c, g, or t
tttctccgttngggttacccaaaagcagtgtccctttgatgttgccgacatggagggaaaggaggagagagagagagaaacaaacgagagagagaagagaaagagagagttggaatgaatgaatgttgttgttgcactgtgtttgagcgtcaccccaactctccttcccccccccctccctcaaatattagttcaaatcggattatgccccccatccgatgaatcctctcccaattgtgcccctaccgtatcccgccgggttcattgccgcaaggaatggtgccatcgctgccggtgccgttccaccgactgtgccaagagacgatgtgaagttgttgttgttttttgtactgctcgttgtcgatgccgtcgccctttcgttctccaccttcgtgtcatccgagtgctgctgctcgttgctgccgttccctttgctttttccgccaccgcttttgctttggcatttgcctttcggcgttgatccgttgctactccttttggcactcgcttttgccggcgttgtgccaatcagttcagatgttgctgctgcttcggcactttctccgcctgcttcgccttcgttactgatcattgttgaatttgccgacgccgttgctgctgctgatcctatttttggagggtttttggcattttgtctcccctctggtcggcagatatttccttgtccaactgaccccattcgttcattgatggccacccataataatacattgccgcagttgctgtcggataatttccgctcattagctgtccataggcacttaattaaccaattcacaaggctaattacgatttgagctgagagacaattcattaagagtttcaaatgtttgtgcctaattttgtcattttatattattaaatgttggctgtttttgattttaatttgccaacaaaaccccgtgcggttgtcctaacttttcaccaattatcacacttcaacaattaaccgtggccaattgccgtcgaccattctcacctgttagctcccaacagtgccattccctcctgtttcggcggcttcgtctccaaaatgcccatttctccgcctgaaattggcactatttcggtcatcaattaaagaagatcaccgacctcctcctgcttctcccccgacattaaaagcgttcgaattgagtccaatcgctgccgccgctccaccgccagtggcgccaattccggcaaaaaccgcgaaaggatttgtagcagcaccggcaaccgcattttgagcagcccaattgatgggatttgtcgctgtagccgccatctgatggtaggaaccaaagtttggcacaaatgccgtggacccggcggagggaaaagccgcggacgacgaagatgaagcggcggatgacggaattccaagtggaaattgagcggccacggcactgttgtgctgttgctgcaaggcggccacggcggcagcggacgatgaattgtgccccgcggcgacggactgcgcggcaccggcggagggacaaagcagagacgaggggaagtccatcacatcatgtgccgttttggggaacactgtgctgaacagattgggcgcctgttgatggtcaacggtgccaatgccattggcattgtgttggtaggagggaaaatgggctgcggcggacgattggcacggcacggcggcaccggtcatcagctgattcatcacggaaaccattggctgttggaggtgggaatggtcggccgagaagtggggagggcgttggatttgctgttgctgcagcggatggcgtaccaattgcaaattgtctcttaattttaattttttacatttgaatttcgaaatgaatggcatggcaaattgttggcaaagaatcattgaattattttgccttaagcattgactcgagacatttgaagtgacactgcccgaggcaatgcttttcctccccctttttttttgccttttttcgccctttcctttcgctaattatgctcattatcatccatcccatcaattttgtgctctactccgattgattattgcctgattaattggtttggaggtgtttaatgggcggggggaaatgaaataaaacggacgaaatgggcaacaaacaatcggcggaagaagaaaccgctgctgatcatcacaactcatcaaaacaccaccgcaaactcttctcctcccccccccccccctccccaaagtcacgccgctcgcataaatttcgttcattcgctcatcgatttgagagaatgccgtaaatggagcaataacaataatgggggaggggggggaggtgtgccgtttggtccaccatattgcgctgaccgacgccctccacgtgttcaccggtcatgacagacgcaagttgcgcgctctcacaccactaggaacgatttaaagcatgtatttactattaatatttattcaacttacaatgtttattttcctttttaaagaaaaattccttgtaaaatgccaataccacaaaggcatttgccgaactctgattaaatgctccgtcgattgatctatcattttccctgctcatgttagactcttcttgcgctccgtgtcctttgcggccatccatcgtacgcgcattgcccgcgagaatttgaaaaagtgctgcgacacttagtccataatg

SEQ ID NO: 4762 - DNA, 460 bp, Heterodera glycines
ggaggggagggagtacacccatccaacggggtgaagtgtccctcccccctcctcgcgtcaatggctcctcccccaaaaaggtcccgcccctcccgagagaacgccgattggatgatgcgacgcgacggaagagtggcggagctgggcaccttcgcccctctgccccctcccccccccggcgccggggcttttccctgcggggcgaaaatagcgcccggggatgcttttctaattattttgagagtgaaacgaatggaaaaaaaaatctaaaaagcaaccaatccatttaaaaagttcgtttctttccgaatgccttccaaattgagcaaatttgatcactttccattgatcagtcaaattattaatttggaaaacaaacaaaagattaatttaagcatcaaaaagaaaatggaatgccaaaataagccagagttaggacacaaattcagtgtaagcataa

SEQ ID NO: 4763 - DNA, 1599 bp, Heterodera glycines
cccgttgaagttggtgggttgagtcccagtgtttagaatgccgggagattggagtccattgtttggaatgccggagatttgagtcccagtgattgaaatgcagaagaattgagtctcagtgattgaaatgctgggtgggttgagtcccagcgattggaaagtctgataattgagtcccggcgattgaaatgttggagggttgagtcccggtaattgaaattctggtggattgagtcccgttgattggaatgttggtgggttgagtcccagcgattggaatgttggtgggtcgagtcacagtgatagaaattcagaagaattgacttccagtgattgtaaaggtgctcaatgagtctgctctgattggaatgttgttggttcaactgcccagattggtcattatagattatcagtacttccacatcgggcacgccgcggttgacaagccacggctccatggcgtccttcagccgtaccggatcaacaccgtggtcagcgacggtgggaaacgcggcccaaattgcgcgacggtccaccgacttgaaggagttctcgcgcaagaagcgcgtgatgccggcacggaactcggcaggcccaacctagtcctttatcccatatatctctcttcccaccacccccacaaaatccaaaatcctcaaatccgtccaacaattctcctcctccccacatctctccccgtatcattcattcatttattcattggtcctccacctaaacgacccgatttaaccaacgcattaccaaacaaaaacgggcgaacaaacattgggaaaagcggcaaaaacaaagacaaaaaaagggggcgcagaaccggtggtcgaattggattaggacgaggatggcatttggcacagaaatgtgaacaaaataaatcgcatcatttgtgccgatgggcgaaacgaatggcccgaggcaatcggagaaggagtgatttacggcactttttgttgcgcgagaaagatgaactcatcgccgcggggggagggagaaggaaaggaataaactttttgcaaattttcattccgtcgcccgaggggccaaaaggcatttgggagatcaaaaaaagggaggaaatgggaaatttatatggacaatgtgtgtgtgtgtgtgtgtgtgtgtgtgggtggtataagctgctgaaatttgcggggggcaaaagggggaacagctgaagagattcccccggggggcaaaaccatcgatttgactgactaaaaattgaaaaatgtctgtttctcttccgccttttctttcatctgttattctgcgcatattaattcactcagtgctcttctgctgctcgtccaccgattgattctccgtttgcccattttcgccttggtctttgccccccccgggcagcggggattttcaattggaattccgaattttctcgcgcggaaagggacgaagggtcggctaagtcccttcccctgcccacccaatgcttcttcatccctctgattcatcaattgtgctctctcaatccgttctgtttgtcctccatccccttcaccctatgtccgtttttccctaaaatgttcctctcgttctcttccttttttccctttttctgct

SEQ ID NO: 4764 - DNA, 2813 bp, Heterodera glycines
taagcgaaccgctaacgattttcctggaccggaaaatgaacaattgcagcagcggcagacaaagtcgtgcactgtttgtggggctgtccgaaaaagaattggcggacgaacacaacgaactgactttgtgggcgacggcactccgagtgggcccattgcccggcacaggcaaattaatttgaaatagaatattttagggtagggccacgacctcgaccccccaaaatttaagccattttcgtggtataccccgaccccgacgctcgacaccacttcgaactgaaaggcaaaaattggaaaaccctgaacctccactgatttgtttacaccgaacccgacctagctgcccccgaaaaactccgacttttctcaccccaaccttcggatccttaccatagaatatttaattaaaataaattttaaaaataatttttaagggactcttggaaaatcgacgggcgccacagcggcgggtgaggaagtgcgccagttttacgcgcatgggcacgtggacattggcgaattgtgctgggacatggcggagaaggagcagcgcgagttcactctgactttgcacaaaaaagtaaaaaaattttttgattaataaaattcaattttaaaatgcgttaattgtcagacggacccaccgctgccggcaatttgccgtcagttcccggctggtagcaatgccgccgtgccttacccggcagctgcttccaattgcggcggtttcggcacaactgctggcattggtgccgcgggggacaataaaatttgccttaagggcaccgtccagcggttgtcacgcgccgcaacagcagcacccgcttacgaaggcgtacaggtgcagctgaaactattgaacaattcccattttaaattatcaaatgatttaaaccgtatttcctaaaataccgtcgctctaataccgtaatttatttgaatgttttaagtgtcatttaattgcttcttcattttacagtctttgcgcatgcttaaaagctcggatgattgctgtacttatgatgaaggcgcctcatcggataagcatattatgccgagaaggaatgaagtgttcatttggcttcgtagtgccgacttgcacggcgtcggcaaatccgagaagaccatcgaagtactataattaccgtatatagaccatattcttgaagattactgctgcttacaaattagcacacaacttcctccctctatttttgaattttcctattaattgactctacagtaatccacatttaggcaagcatttctgtggtggatgatgaaggcgtttttcaacccgaagccattgaggtgccatttaaataattcgaaaactgatcgaattactttttatcaattcccatgacattctcgacagattgtcactcccgagggagttcggcatcaaagcacttttcggtgccgcgtttggttctcggaggatcggccaaagctgaacgaactgattaaaatttgtttgccgaaaggcgaagtgcgcaacctgcaccttcaggtggatcatgttaaattttgaaatttaaaccccaattaaaatggcacgaaaatgggggaggggattagaaagaattccctaaaatgtagaaaaatgatcaatcataatcatcatctgtcttaagattctgttctacaacaaattgacagggaatgataagaaattactgagcagcagcagtccttcggcgggtggcccgggcggtgccaaaggccctttcgctttggcatttttgcgtttgatcaacaattacgtactttgcgaggaggacgaggacgaattggtggtgtacaaggtgtggtgctaacgagtgatgcgcggcacattttcccaagaatggaaatgccaaaaatggtcacaggtggagaagcgacagtcatcgtcgtcgggcgggccaagggcatcggtgccgaatgagccgggcggcactcgaccaattaatgtggcctatttggcccaatgggcgacgcgcaaggaaatgcttcttcgccctcgtgcacaatcgagcacagtcggcgccggtgctgctgctgcttgtggagcgggtacgatgagtcggcacgaaatgtcggcactaaatgttggcattggcaccgccaatggtggcggcgccgctccgtacgctgtgcaaagcgacaaaaacaacggcgtacaatttgtgagcttcgtcaactcaatgctgcacaccacaaaccccattctgctgcaggttggttggataacaacggtggcggcacttttttttattatggcatttttaaaatttgtataatttaaaaatttaaaataaattttattaatttcggcagattttgcgctggaaagacaatgggcagcagcttttgagtcaacggttgcacgagttttgtttggcactcggtgacgagcgacggcacgacggaatggtcaaagagttgcgcaaatttttgagaaatattttggacgccctttttcaaatctctggtgaattattgttttcctttttttaaaattatttccttattaagctgccattgtgccgcttcagcgaaatgttttcgatgctttggtaattaaattgaattaataattaattaatttttgcccttttaattttgtcaatctcccaaattcgtctctttctttttaggcttacatttgtcacttttgcgggcaattgtctccatttaaatctctaacttggagcagtacatttacagcacacattgtccaaaagcattcacattcattttgcatcacatcgtttggtcagtttttagtatttaaaaataaaaataaattttgaaatttattttaa

SEQ ID NO: 4765 - DNA, 1000 bp, Heterodera glycines
  misc_feature (971)..(971): n is a, c, g, or t
caaacttatcaggcacttttttaaaattttatggcattttttatttaaatttcagagattcctcgaaagatcaaaatcagcagcagcagaatgaaaacgatgagttcaagcagtacatggatagtgtgtttgctgcaatccgacgtttgctgatgggccccggacggcggatgacctgccaaaatttggcaatgaggcaattggcatcgtccattttggggccaatggcatcggcggaagacatttatgagccaacagaattggccaagttggcgctgaattgatgagtcaaattaactgtggccctattatttaaaagatatgccatccaagtgttggattcgttgtccgaaggtgttttgatgagtcagaggctgcattttgtcggcgaactcattgagacaaaggtggcaattttctgttaatttgagcattaaaaaagaaagtccattatttttttatctttattcttctaatagaccctccgacagttctgtttaccgaacggaaaatgtcaaataatttttaaaaaattataaaaaacgaataatttataaaataatttgttttgagagggtggattaatgatcaaatttgacttttaactttccgagagccttggaagggaggcggggcggggggggggagggctttattacagggaagtcattaaaaatagcctcactttaatctgatcaatctttggatttgatcaaagttcaatgatcctatcctcccccgcttctgataagctgtttgccatcgccgagtgccgaacactgctgttgtgccgttgtttggacgagttggcctctctgatgccaccccacgctcgtgacgaagtgccgtgcgtcggcggcagcgtgacgctctttacgcaccgttcgcgcagtcgcagcgaatacagcttgggcacagcggcagttacctcgggcaatgacagcagcaggtgggggaggagacttcgacanaaagttaatttaacggggaagggaaaact

SEQ ID NO: 4766 - DNA, 2660 bp, Heterodera glycines
aaagcaacaaattcgctttttcagggtgactttgcttggcgacccgacacatcagcggacgctgcacgctctgctgctcggactgttagacaaattttcggcagaaaattttgacgcctattttcgcgcgctctccaatcagttggaacggtaattatgtgtaattatccgacacctttgaacaacaccctgtggccggcgagcttttcgggaacggcttttttggctcagctgatgtgccaatttccgattgaaaaggaggcccaagtcttctcttagtttcgattgtaattttgatctcgagaatcacctcctttctacaattaaattcgaccttttccccgcacttcgttggcattttttgtggttgaagtaagtatctctgttcaggcttgacactctgtccgaaatgcttcacatgttccgcgatttgctcctccgttgtcccgttcccgcggaatggtgccgtccgtcgccactttttccgttaattaatatgtgccaccattttcgcaggcaatcgttgcgccgtattcagctgcgactgttcgccaagcatttgcgaatgtccgccgcgttgtgccgacgcgactttggcacgccggcgcactttgacgcggccatttggtgcgaatgcattctcagttgtgtggcgttggcaaaatgttgcgccacgacgacgactcaaaaatcaacaatgatggcacacaatgccgaggcggaggacaatggcacaacgcacagcgattatgaagagggagaggaagaaaaaggtgagaaatgccaaaaaaaaagatggggccaacagcagaacgggtcccaacccaaaatgggataagacgggaattttgaagcctttagtcctgatttctgccaatttttttgcagactccgaattctgttacgtttaaagcccggaattttgattttccaacaatttttttttgaaaatttcatagatttttaaaatcgaattttggcaaaaaaacgaaattttctttttaagtcttatgtgatcaacaaattgacaattctgaaggtgaacaaaagctgggaaagtatgcgaccgaaattctaaggtaaatttttgtaattaataatttacagtacactcaccaaatacagtaaaacaacaataatccattagtgacagtttagagctctttggttttcacttgtgccggaaagcaaatgtcaactgatgccgcacatcaccggccaattgctcgaggtgggaaccaaattttattccaaaaatataaatattatgaaataaaataaaaaaaactggaaaattgtcaaagaacgcaagcaattactcaagactatcagaggacaaaattaccgaaataaaatttaaaagaattaaaataaattcttttgaaatgaaaataaaataaaataaatttttctgtcacttcgtttctttgattcgcataacattactttcctttcttttctttctcagtatcggatgattatgatgtatgtctgtgtgtcgtggtaatagcctaaaattttaaatttttagtttaattttttaattttcattttttccaaaaaacacacatccgtgccgactcgtctgcgcaaaaatgtccccgttcgattgcgactgccattggagtccctgtgtttgtccgccgatcattgcctgcgaaataatttgaattgtaccgtagttcccacatttcatttttcaaaatggtcatccgtgtgttttgtattggtatacggtacctaccgcatgcacaaaccaatagcccgagtagcggacacgcttaatctaaacgaggaaaaggggggcttgaatttgcatttctgtgttgtgctgtactgaacctggtcaatgatgtatttagacagttggcccatgttatgctaaatttgggaatatttttttaaaattgtgccgaaaaataagtgccgaataatagcggaggccgtcgtttatgaagctggacagtcggctgtcgtaacatgacgccacgttgaccgcgttgacgctgctcgcgccgctacgcaagcccaaccagccaagtgccaccaaggatgtggcgttgcggttctgctgttgatgctgagcagcagccactaaaagtgccaattaagctaatgccaaaatcgcatgattttggcattttatggcggcgcgaaagtgctaaaaacaaaagtgccattcgcaagataaacagacgcctcttaaagctaattctgcgcgagtgaaagtcatctccaaatttgtcaaaaattctagtcctcacagcagtgtaagtgaatctaattctctatccaaagatttactgttattgcgccgattggtccgattgtcgtcgcccatttgtccgtcgttggtgccttttgtcgctttttgttccggtgccatgggctgttcctctccaacgatcggagaagcatttgcgcaattggtgctgatcaccaccgccagcagcagcaaaaccaaagaaaatgccaatggtaaaaatggtcggcccatttgtgcgtttggcttaaacacgagtcttaaaataacccaatttaattagttttaattttgattaaaaatttttgccttttaatttgcagcgagtggttcaaagaattaatgggaaatgaaaacatttggatggctatttattatttatgttctgttctgatca

SEQ ID NO: 4767 - DNA, 3645 bp, Heterodera glycines
atcagcagatttactcgccaatacttttgcatttttgtgaaaatttgggcacaaaaagcaaagaataaattaaaaagaaatttttaaaaaaatggaaatgcctcggggggtaattggttattttaaagaaatgaaatttacagatggcctttgccggcatttttctctgcgagtttgcagtttcaatttttgtcgacatgctcaccaccgaactgcaaatcaactcggcaactgatgttgtggtggtgcgaaggcggaaaaagggtttgtggtatactgtagaaacctaaacattgctactgtatctgtataatacaaatacacacagtatttcgcttttcgaggggctcgcccttacaatacacaaaaatacagtaagacccagaacattgctttggttactgtacccgagattgacttttgtagtggaacaccagcagcaccatcaaaagctcttctcggatgtgttcatcaaccggttggacccgttgttggacttttcgttggccgacgctccctttggcacttttcgccgcgtattcagccgcgcattccaacggtattgcgtggagcaaagtgtggcagctgaccaacaatttgcgtttcgctcttttgtccaggtatggtatgtcggggtactataccattttggcattgtgcacaatttttttgttgtttggttcatccgattttggcacagattgtcgacagactattggaactgttcgccgcctacagatcggtgcagcacagcaccggcgacgagatggccgagttgggcatgttctgcactgctcaactcgttaagtgttgtttctcatttcgagactctcggactttatttggcatttttcacaattgaatttattatgcgattttcggcacatttagggttttcttgcatttctatcatggttttccgaattttctcattgatcaatggattcatgccgttttctgtctgtttatttcccaattttcaggttgacttctaccagtccatcgagcatcatgaactttacgtgctttacgtgtaaatatttcttcgttttttatgccattttaaaattttcaatttttatgccataattaacggtgccatccctccatttactttttgacaattagccaatctattaatttattcttcgcccatcagttacaagctgtacactttgcatcgcaccgttggcaattgggtggaggccgggctgacgctgaaacggcacgccgatttgttgcgctggagcacttcacatcggcccgagtcgttcctttgcgggacggcacggaaaagcggtgggaccgagtttggcacggagttggagttgaaggagtacatttacaaggagatggcggaactgttcacccaaggtacagtaattgggaacagtaattttgatttgcataaaaatgatttttacttaaattccaaattattaaaaaccatacaaaatgcttcaggcgagcactgggaattggccattgaaacaaatcgggaattggccaacatttacgagacggccacctttgactttgccaaattagccgatttgttggcacggaatgcggcgctttatgataaagtgacgaaaacactgcgcatggaaagccactactttatgatcgcattttatggcaaaagtgagggatcaatcgatggcacaccaaaatgccaaaaaaagagaaaaataataccatccctactttcctcttattttaaggctgtccctcccatttggtcaccctcaaatttgtggcccggggccgtcccctggagcaatggggctgtttcaagcagcgatttgtggccaatttctccgacttcaaatttgtggacacattggacaactgcgaggagacttaccgagaaatgaacggaaaattccttcaggcaacagaaaaattttaattttttgttttttaaaattttattttcttcctcagattgtgccggtcacgccgataccgctgaaggaggtgtatgccaaactgttgcagaacagtccatgccgtttggccagttggtactacaaacatcacaggtggttgagaatcagcgcatttttgggcaattaaatatttttaaattattaaattaatttgtgaaacttgttggcaaatttgctcctgtgctcagggtccaacgttttgagttgattcgcagagagttccgcacagacacaaaatggacaaagctggaggacaacgaaaccacgcggctttggcttcataagcgaatcatccaaattcaacggtggcggaacaattaattataattaaattaaattataatttaattctaattttttgtgcctcgtggatttaacaatacattttctttcattaaaattgcaattatgccccgttttctttaagtcctttgcccgacttgctcagcatgggcccagtggtgagtgagttggacttggacccgttgaatccggtggaagtggccattgaaaaaatgcgcgagggtatttttaattaaaacaatttaatttatttaatttaaatttcttacagccaatgacaaattgacagagactgcggcaatggtcggcgaaggttttgcccagtcattggtcaatttggccggaatgattcgcggcattgttcaggccgatgttggcggtggcatccgtaattaccaggtgaattaatggtcggacttcattcaattcctgctaatgtgattatttacctacatgcaaaacaggaatggggtcgagtccttcaatcagtcgcgaagtggcaaaatgtggaagcaaaaaagggggcggggtgagggcacgagaggaattttcgaaattttttttacaatttaaaaaaatttatctaaatgtctccttactgatgccgaaaggtatcggaaagcctaatttcctcacattttttaattgaaaaacccctgggaatttaataaaataaacaaaatcaattatagctacagtaattggtgtttttttctttaccccccccccccatttaagccatttttctcggaggaatcgtacgccgtctgtacggaggaggaacggaatgccattgggacgctgaagcggctgattttggagcaaacatcgcttttggaatacgctttgtacatccattctcaggtgctaatttggtacatacagttttatgatataacccccccccccccccctaaatttcagagtgaacgtgcccaagcgaatgccctcttccacaattcgttggccggctctttcatggagcatcgccagcgggtggagcattggctgggcccggtcaagtcggtgctgcctgaaaagacgtccatttacatgttggaagcgaccgcagcagcagcggtggagacgatgacgtcactctctcacgccgtaacggatggaagcggagggttggaaacattttgaaaatatttttaaatttaaaaatgtttaaaattcagtcgcaaccaatcggcgcaacaattgtccgctgtttcgtccactccaccgccacaacagaaactgacgcggatgacgtcactgcatgaaaatgggatgacaacaacaaacaacaacatgatgatggtctacccaacagcagcagcaaggtgggggcattaatttaccggcaatttgaaaatgatgatcatacatttatcatatattaaaa

SEQ ID NO: 4768 - DNA, 4195 bp, Heterodera glycines
aacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctaatgataaagcataaatattagcccggcaatagtattgttaaaattcgaaatctctgacaacttaacggacgggcacgactgggccccgccaactgggccccaaccaactgggccccggattaactgggccccaccaactgggccccaagagacagtaatttttccaccattattgttagggctgcgatttatatgtaagaaaaatcgtaaaatatgtaaataaatatgtattaaaatatgccgaaatatgtacgaaatatttacaaaaaccttaaaatatgtactaaaatatgtaaaaaaaaattttttaatggttattttttggaaaaaaattcttcgtaaaaagtgaaataggcacaaaatgctataaaaatgaccaaaatgaatcactttttagtattttaaattaatttttgatagttaattttttgaaaaacattcgattttttagggatacattttcaaaaaattttttttaatttttcacaaaaaacctataaaaattctcaaaaatcctcaaaatatgtaaaaaaaaatgaaaatatgcacgaaaaattgcgaaatatgtacgaaaaagtccaaaatatgtataaaaatatgtacatatgtaatatgtagaaaaatcccaaaatatgtaaaaatatgtaaataaaagtcccaacttttgttcgcaaacacaaaaaagaaagtgtttttcctactaattagagcatggagaatccaggaaaaaaatatgtatttacatataaatcgcagccctaattattgtataatattatttatatatttttcattacatacacatatgtatgtgtgtttcgtttacaataatctaatttgtgtttatatttttttcgttcagtgcctaactacaataactttccttcagctattttttaaatttaactatcatttcatggcaaataatatattatcgcagaataaccacaaaaaaattgagcatgaaggtcatctttatgttttcgccaaacttagcgcggatggttttatcaaatttttgaggtgtgagaacaaaaacaataaggacatgaagtgccgagggcgtctgcacaccaatttgaatgacgtagtgttgaaacaagtcaatgagcatgtctgtggagcaaaccctgcgcgagtggaagcacagcgcgtcgttacaggttaggttatatcaaatgctgaagattttgaatgcatatttgacaattttaggaataaaatgtagagccattgaaaccgccgagccgccatctacacttcgctcaattgcactccaaaatgtgggaacccctgtgttgtctgaagtcccaacaaaaaatgcaacaaaacaagttgtgttaatttctctgcgctcattgtattgccttttttagctaatcaaaagggcccgcaatgaaggaattactcccgcaatgccgcttaatctaaaccagttacaaatcccacaacaatatcaaatttatgcacggaacgaaaacgaaactgaaaactttttgctagccgattctggtacatttttgttgaatgaaaatggacccccgcaacggtaggcaatgcgttttgttcgattcaccattactttttttgttaggattttgattttcgggcgcatgtctcataatagctgggccaatcaaatgacagaatgttacgctgacggaacattttcattaagcccaccactattttcacaagtttttgcagttcttgcccggtatgctttaattaaatttttgtattaaatgttcagtttttttataggcgcggcaagtgggtcttcccggttttttacgctcttttaacatcaaaaacttccgccatttaccaaagaatgttcagtatgatcaaagcagtttggccggccttttcacctcagtccatgtcgttggattttgaaattggtttgatgaatgctgtacgagaggaattccctaattgcaatttgcgatgttgtttttttcacctcgtcagaaatttcaaaaagaaaatggtcgaacaaaatgttattcaggtcccattcttccccccaaaaaaataaaacatatttttagcggtataatcacgactctaattttgctgaaatggcgcgctgcatcacatcattggcatttgttccgttgggtacactcactcaagcaattgtcgcgctcgaccactacatccccgccgaattagaccccgtttttgattggtccaaacaacgaaaatttaaaacaacaaatttgaaaaaaactacttttaacaacattcaaaaacaacacgactttatatttttctgcaggtttatgaccaactacacgggtagagtgcgcccgaacggaacccggacccaacccctctttgacccaggatgttggaatttgcacgaaagaactgttcacgagcaggacagaacaaacaattttgcagaagcggcacatcgacgattgcagcgcgccttttcgtgtcatcacccatcagtttggcggttcatcgacacaattcgccaagaacagaaaaaaattgacgcagattacgctcttttcgttgccggtcatgatccaccgccaaagtgcaagaaatatcgcgaggcagatgaaagaattttgagactgacacaaaattttaacccactaaacattatggaatttttgattggtgtttctcgaaattaccagatggatgcttagaattttatgaataaatttttgggatgttaaataaatttttgacagtatgaaatggaaaatgtgacaggcccttggggcccaatcggcggggcccaatcgtaccggggcccaatcggcggggcccaatcgacccccaccgaaacttttgatgtggataaaggactttttgagtaataggacttttcgtgttaaaattggggatgatttatcctccagtaaaaaagttggctctggtgtcccccagggctctgtccttggacctttattatttttgatttatattaacgatcttcctgatgctttgccatcaggagtaagaattaaattatatgctgatgatgttaaattgtatatttgttataaagaaagaaccgaaacagaaattatgcataaagcattgcataatttatcggaatgggcaaataaatggcagatcataatctcaattaaaaaaacttttgtactttacttggggaataaaaaccccaaagaaatatataaaattgatggaaatataataaatgttgtggatacaattagggatttaggcataaatattgataataaattgcaattttccaatcatgtcgcacaaataataaagaatgcatatttacgtatgcgttcttaatttcggattattaagtccaagtcttctaggatttggattattttgtacaaaacttatgttagaccgttattggaatatgctcctgaggtttggaatccatcgcttctaaaaaatatttaaaaaattgaaaagtgtcagaaatatttcaccaaaagagtattttttaagtgtaaccttccacccattccataccaacaaagattagaatacctgcaactgtcaacacttgaaagcaggcgaaagctttctgatctgttcatggctcataaaataatttatggccgaacagatatgatcccttttaatattcaaacttctgacgctttacattcccttt

SEQ ID NO: 4769 - DNA, 528 bp, Heterodera glycines
gaccaactacacgggtagagtgcgcccgaacggaacccggacccaacccctctttgacccaggatgttggaatttgcacgaaagaactgttcacgagcaggacagaacaaacaattttgcagaagcggcacatcgacgattgcagcgcgccttttcgtgtcatcacccatcagtttggcggttcatcgacacaattcgcccagaacagaaaaaaattgacgcagattacgctcttttcgttgccggtcatgatccaccgccaaagtgcaagaaatatcgtgaggcagatgaaagaattttgagactgacacaaaattttaacccactaaacattatggaatttttggtcggtgtttctcggaattatcagatggatgcttaaaattttagtgataaatttttgggtgataatattgacaataatggtggaaaaattactgtctcttggggcccagttggtggggcccagttaatccagggcccagttggctggggcccagttggcgaggcccagtcggcggagcccag

SEQ ID NO: 4770 - DNA, 2510 bp, Heterodera glycines
gagtggtagtgatagagtgcttccttttattgggattaacaaacccataatttgtaatttccatttatttcgcttccatgtaaccgagaaataaaaagaattcacttaactaatatataaacgacctaattacagagtcgctttttagctaattaactaaaatggcagcaacggacggaatggtcgaagatggcaaagtgggaaatgacctcgaatcagcaaagttcacaaaggtgagaaaagtcgtgttcgttgtcctaagattgtgaatgataccttaaaggacaaagaagtcgttgacattgtgcagccaacggccaaattgataggattgacgaaggagcagctcgagcagtaccgaaatgaccccttttggaaggcgattcggtaaaatgggctattaaattcgaaggatttgccggaatttgaagctttttcattttacgcgtcttatctttctttgctcagttactcacttttcgtcgccttttggctgatttggctggccatgttcgtgggcgctgttctgattgttgttttgagcccaaaatgtcagcaagtgaattggaccgaaaaaatggtcgcttacaaagtgagacaaacactttatactctctcaaataaaacatcaaacaaatttagattttcaccctcgcatacaaagactctgagtccaaaaatgggttcggagactttgaggttattgagaaaaagttggaccaaatgaagggaattggagtcaatgcaatttggccaactcccgtgctcaaatactataaaaatgcgcttggcccagaggcaatcgaaaagttggaagtgtcggaccaactcggcggggctgaggggttcaaaaaactgatcaagcgggcccatgacaatcaaataaaagtgatcgtcgatttgccattgacagtcaatgccaaaggaaattgggccaacaaaacttctgatacaaaaagtgggaggggccggtatcccatgctgactaaacactctttcaagatggtattgccctgatcgaccttgacagtgcagcaaaccgagaaggacttaaagaagcggcagtgcgctttttggactttggcgtcgatggactggcaatcaccgattacggcctttttgccaattccgtccacttgggttctcttgtcgatcttattcgaactataccaaaggcggaaaaaatgtacagtgattaaacatacaaaaattacttaatcattgttttagtcccatttatgcacgtggctctttgaaagggccaactgaattttatgagattttgtctttggttggcgatgtgccgtccgatggagtgaacggattgaagaaaatgctggagggaagcattaaaaacattgaggagaatgggggtaataagtcgcgaatttggcaattggggagcatggatccgagtggacaaagattggaccaactcctcggcaaagagtcaaaaaggtaaccgaaaatggaattggcattaaaacagttttcttcgtatagtaaatgacttctccgattgtcttttgttttcttagcaatgagcagaaacaacgcatttcttccctcttcacttccgtccatcttttcatgccaaaaccccgtcgtcgttctctacggcgaagagcttggcctgttaagtggaaaaccgacagccaacaaattggccaaccgaattgtctatccgtggagtaacgaaacattcggcaatcagtcgcaaggatttttcgttttcccccaacgtacaaaaaacggagacttcgaggtaatttatacggataattattgggaattattattatgtttcattagagccagaaaaatgacaaacattcgccgctggcgttgttcaaagaaatcgcaaagctacgcgaggtacaataaaatggtgtcttaacccctgtcttttaaattatagcattccaatttcttctctggcgttttgtcgcattcgtcctcctccgatggcctcgacttttacaaaataaaacgcagtcaagggggattttttgtgttggtcgtaaattggggcgagaagcaaaaagcactcgacaacaaaacattgccggatgaactgaagcaaacaaaactgggggcggccaaagttatcgtgtcgacggatgccgtgggcaaagatgggaacgtgaattttgagatgggtgaaattccgatcgaaatgaaaccatacggagcgatgcttatggacatggcctgaccggcggaagagcgaaaaagtcattcgacctttggattaatatccgtgcttttcattttcgtaatttttactttaaatacttttgtagtttctttggctacaagtaaaaacttgcaattgataaaaattttgttagttttattggtacaattctttttattacttttaacttttatgatttttgtcctttttaattaattttggaaatggctggcaatttctggaagagttcccatttgtgagttttccccacttgctacctttatttgtctgtacgtttctttgtttccattca

SEQ ID NO: 4771 - DNA, 5842 bp, Heterodera glycines
accaacgacgacgatgcccttcgagtcagccgcatcgaaatcccgaggttcagcggatcgaccgaggaatgggtcaccttttgggctgccttcgattttgccgtccactcacgccactaccccgccttccaaaagcacctcctcctcctacagtacctcgagaagggatcgccaccacgacggatgattgaaggttacccaccgtcagacgccaattacagcacagtcgtgagcattctacgagaccgctacggcgacgtcggcaaccgacgggaccaactcaatgcccagcttctccacctcaaacctgcccggaacaacctcaaggagttgcgccaactccagcaagagatcgaacggatctgcacccaactttgcagcctcgagcccgagggggagctctcgccaatcgccaacagctcgctggtcaccaatctcatcaaaagcaaacttccaccaccggtactgcttgacctgatccgaatggagcgcgagagctacacttcctggacggctcgaaattggcgtgagggatttgcgacagtcgtcaccgacaaagagcaggtggacttgtgcgtccgtaccttccaggacatggacattcaaccccgcgagcgtcctcccgaaagggctcccgcaccccctcgtccgggcggtcgttcttctcggccaataccaccaccagcgccggagcgacgttatttggagaacactcgggcctttcctgctctcgcccaacccgtctctgccaatggcatcagttgctccctttgtgagcaggagggacaccgtccgagtgcgtgccagcgatacaccaccgtcattcaacgccggcgacgacttgaggaacaggggcgctgcctgcgttgcctccgtcaagaccacgtcactcgcgattgctctcgtcaagatcgatgttcgaaatgtcaggccaacgaccatcacttcctcctctgcccgtcaatcgaccctccggggcgaaccaaccatcggcaagagaatcaagagcggaatggaaatgcgtcccgcaacgtcagtcgtgccacgggagccaacgccgaaccggtccgaccgagagcgactcccaccacaaccgcactgctcgtgtgcgacgaggccgaaagcattcccgaggcggtatgcgccgccgcctttgaccccctccccgtcgacagcggcagttttcccgtccccaaatcgacgagagtagctcatttgatgactcagacccttaaggcgtcatgccaagggggcccacccgacggaattcctgcttttgtcttccacgaccctggcagccagtccggctacataagccgggcaatgacagagaagctccgaccccctcgactctcagagcacctcctccgaattcacaccttcggagactcccgccctaagaccgtccgatcagcaaaattcgccattcaactgcagcgcctggacggaggctgggagaccctcgagctcaacgtaatcgacgagatcacgaccaaaatcaaggccctccagtgggacaccaccgatggacccctccccccaaatgccgtcctcaaggtcgtcgaaaaggcgccggacattctgattggtatccgagaattctgggaattcttcaccggctgttccatgctccgttccgggctccacctcgtccgaacggttttcggtccgatggtggggggagaagctgagtttcccgaggccccacggcacaccccgacaattgccgtgctgaccctcccaccccagtaacgtcgagtcattcccctcatcccgcactgtcaatgacttttggagtctcgaggcgatcggcatcacggacgacccgaatcagaacgacgaccatatcgccatgcagcaattcagcaacaccgtccgccaactaccgtctggccggtactctgttcgcctcacttggcgggaacctcgtcctccactcccctcgaactgggccatcgcttatcgccgacttctttcaacaaccaagcggctgcaatgcgcccctgagctcctcgaccgttattccgccgaattgacacggcagatggacgccgatatcatcgagctgaccgggcgagacgacgacgagcatttcctaccgcaccatgccgtcatcaatcccaagaaattgcgcatcgtcatcgatgccagcgcccacgccaaaggcactccaagtctcaacgattgcctccaccgcggacctgttcttcttcccgacctctgcgggatccttctccgctttcgatcggcatcaatgcctgttttggccgacgtccagggcgccttccatgccattgaagtcgagccggaggaccgacgcttttgcaaaatgctgtggttgaaaaaccctgcccgacccgtctcaggcgacaatctgttggtctatcgctacaagcggctcgttttcggcgcgacatgctcccccttcatcctcgccgccgttcttctccaccacttcgaaaggcacgaccacccattcgccaaggaattggccgcgaatatgtacgtcgacaacctcctcatcgagtgcgagacggaagaggaggccatcgacaagtcgtccatcgccaaacaaatcctcaaagacgccgacatgaacctccgggagttcctcagccactccccaaacgtcatgggacgaatccccgaggacgaccgactcgacaaaacgccggccaaagttctgggactgacctgggacacccccagcgattgcatcaccttcagtctcccaaaagacacagacaccactgctacacggcgttcagtcctgagcatcattgccagcacgttcgacccgcttggactcgtcgggccatgtcttctgcccgccaaacggctcttccaacggctatggggagaatgaaccgcctgggacgcccccctccccgatgccgagcggcaacttggagccaaaccctttccctttggcaacaccaaacacttgtcattccccggcactccattctcggcaagcacagtcgcctacaactccacgtcttttgcgacgcgtcggaacacacgtttgccgccgccgtctacatccgaagcgagactgccgatagctcccaagcgaacttgattttcgccaaaaatcgcctccggtcacgaactgcgaaccagcgcttcaccatccctcgactcgaactcctcgccgttcttgtcggaatccgcgccatgcgtttcgccgagaaagagttccggcgcccgatcgacgggcgacacttatggtctgactcccaaattgcgctctcatgggtgaagtccgacgaacccaaggcccaatttgaacagcgaagactcgtcgagatccgacaagggccgcccaccacttttcatttcatcagaaccgaccgaaatcccgccgacgtagccacgagaggctgcacaccggcggagctccgaactcgccacatttggtggaaagggcctgagtggctcacgagtccggaaacggaatggcccgacgagttaacgttcgcaacgccagcctactccccttccgccgatcccccgtttgaaaaatcggagaccaagaccccagtatatctagaggcaaccaccgatctgtcagccccgagcttcatcaatgtcttacgacgattcatcagtcgtcgcggccgaccaaagcgaattctgagtgacaacgccccgacattcgttcaaacgagcaaggctctcgacattctgaccggccctccgtccgaaaccgacgccgtcacctttgccgcgcgccgaggcattcagtgggacttcattcccgcctatagtccatggatgggggcttgctacgagcgactaatcggcctcgtcaaatcctgcatcaaaaggacgatcggtcgacgaattctcgactacgacgatttgagcgcattccttgccgaaattgaggccagcgtcaacagccgcccgatcacatgggtgtcagatcaaccggactcatcgaagcccctcactccgaaagaccttatccagcccggccttcccaacaacttggaaatcgtcgactctgatctcgactacgacgattgcctctccggtcccgcgcgtctcgcagcactttggaaagcttacgggaggccgccgaccatttctggctcaaatggagtcatgagtacctcctcgccatcagagagcgcgccggatggactcataaaggtccccgccttcgaactcccaccgccccccacatcggccaagtggtcatcgtcgaagaggacctccgcccccggaatttatggccgatgggcatcgtcgttgcactaaacggctcactccctaacgtgagaagcgtccagttgcgaatgccaaatgggcaaaccgtcacgcgaccaatcagccgtctttgccccctggagaccgaaaaccagaccccggaaccacccccggacgccaccgtgtctatccctgctgatcaaggcctcagagaccccaaaaacgccgaaatgtctgtacacgaaatgccgccggtcccttcactttcgggagaaccgatgatcagtaagcacagcggcatgcttacgcgacgaaaatcacggcttttcgcgattcctcccaccacgaccatgatcatggccatcctcgtcactttcctgggcgtccaagcctccccagcacaaggaatttggccattcgcctcagaccatcccgagccacccccaacatctcattgcatcggaaaccacgtcaattgcaccagaagaggcgtccgagtctcctccactcccgccgtccagaagatcacgatttgttgcgccaattcgtgctttgatcggttgggcgctgccaccattgaatatgagttgtccgctgaccttctcgtcaacaattacggctgttccgcaacgttcagcctctcatcgacccgcagttgcgccgccgaaaccgtctgctcagccatcgacgaatgcgagctgattgactgctccgtttgcattgaccaactcgccaattggcggtgcaacccccgcctctctgtcttccttttcctaatcatccggtcgctgatcagctgtctgatcgggtgggtagtctgtttctgctcatccgcccgagttgtgctcaatttcggctatcaaatcaccgcgttccttctctcctggcccctccgactagcattctccctcgccggtcgtccctggacacgggaagatcgagaacgtgttgcggaacgtctcgaagtcggaattcaacgggtccgacggcagacacggcaccacgggcggcgagctcagcgagcagctactcgactgatcggcatcctattggccactcccgtcatcttcggcaacgccgagaccatctcggtgaccactcggaccgaatcttgcctcaagagtcactctggactcacctgccgcgtcaacaccgccaccactctgactctgcttccggcaggccaacagagctcattaattctgcgcgacgacaccggcaacacaatcggcacggttcaaatgcaccttcaatccctcgacatggtgtgccaccagcaatcggaggcatggctccgttcctaccacatcgaagttctgtcagtgaagcggtgcccaagagccggatcatgccgcgacgaccaatgtagccttacccgtccacaaacaccggttcccgagctcaaaaccgtccatcgatttcccggcaactccttttgccaagattcgacgagcttttgggccaatgactgcggtctgcctgcttccgcctgtctctactaccgttacttcgctcggcccaccagcgcgcggaccttcgaattgatcagctgcccatcttggggggttcaactcagaaaacaaaggagattgagtcacccggcggacaaacccgacaaatcaagact

SEQ ID NO: 4772 - DNA, 2318 bp, Heterodera glycines
cgatcacgccactcgccatttctctccccccgctcccgactctcggatcgagattcgtgactgacggacggtccgctgcgatcgccagccacctgccagccgacctcttctgccctaacgaggaagctgccgtcgatctcaactgctctctgtccttaggagcctgccaggagtgcttccccgaccactcggcagggagcgtcgaatgtcactatcgagacctcgacctcgacgcattgcttgaaaacccggaagctcgactgcccatcacaactgcgagagttcggctccacaaccgcggccccaccatatttgcctcccacgcttactcccctgttcaactccacctcgtcctggccaacgtaactctaaaactccggctggctgactcactatgtcgtgtggaggaacctcggctgatcgggtgttacagttgttcgaccggtgcacaactcgactatgtctgtcactccgacatggacaacgcgctcgccactgtttcttgtaacgacgggcaattttttgtcgccaactgcgcgccgaatggcaccaggagtcgtcaagttttaccttacgaccatgccgacatctcaacacaatgccatgttaaatgccccgcgggcgaaacaaccttccggctaaacggcacactgaggtatatcactcaccagcaccgatttggccatcggcaaagaacatcggaaaatctcatcccggaacccgaacaattttcgttttgggccgacctcagcttcgacaaattctcccctctcctttatttcggcaaagcccccataattctcgccattgtcgtcgctctcctaattggtctcgtagcgctatttttattcgtcaaatattcgcctatgctcgccacttatagactcatcctccgattgtttgtcgggatttcaatgattaagtcggcaacttcactatcttcaaatttcaactcggtccacccctcccccccaaaattaatccaaacgttcaacgaatcgtcccacccgtcaacttcacatttttccgtttttcccattttcttttctttttgtgttgtgttgtgcaccatctggcgttttgacatctccctgcgccgcgccccctcttttcagcacaaacaaattcggcaaagtcttttgttcgccgtcattatcatcatcaccatcatcactttggccgttgctcggaaaatagcaccggagggggatcagcccttaggcggcaaacaaaagggagaagacgtcgcagcagtctgctgccatcaccccggggccaacggggcggacatcacacattttcgcataaatagccccctcccccccagagatgctcacctttttcatcgccattcacacttaacaagtgcgtccatttcgtcaaaaatgcccttccccttccacaccaaacccactgccatcgttcgtcccacaccacaaacccccactctcccccctccactagtgtctcggggtgaaccccttcaaaccgacggattcagcaatgtggggttcgactccccgggggaaccgaccggtggatttgggacccaccctccccgtcaacttccccaaattcgaccaccactcgggctccgaagtctgccgtctcaccgctcgccaacgccatcgcctcccggctctccgaccatccagacggaatgggcgcgagccgaccgcctgctcgacatccgtctaggctcgaggtggtggttgcatgccgagggtcgccgccgcgccgaaaatgttctccgagagtcatggctgactcacgccctcaacggccagcaaatcgcctggagccgtctcgatttccttccggccagcgtccgccgagttcaaccagaattgacggtcgccgaccattggcgaatccgacgaaacacccctctccgccgtccagacctcccggcactgctccaggaacggggagtgcgggggacgtgcctgccgcagcatcaaacgacgactccgtaacgggggtgtttacataattagaggaaaaggaacttcgtaagttcgttacaaaaacgaatattttggctgttttagtaatgagagattattatttgttgagaatttagaccaatttagttaaaagttattttacaaagaactaaaatatttttacattgaattttacacaaattataaaaattttttaaactttttaataaaatatacaacttaatattgtaacaaaaaaacttttgagctatttagtgataataattttctcgaaataaatagcgagaattgataatttcaactaattggaaatgcgtctaaaaccgtcattaaaaaaagagttttcttttt

SEQ ID NO: 4773 - DNA, 3007 bp, Heterodera glycines
ggagctaatattaaaaaataattaagaaatttgggggcgggcagttccgaaaaaggcccgccgaggaaaattttttttcagaattttaacggaatttgtttaaataagccaaatttttagcaattccttttttccccttttctaagcctccccccccccccctttatgtatgttaataatactacaaattaccaagaataagtcagattaaatcgaaatatgggtagccttttaataaaaatagaaaaaacggattcatttatctcatttaattaattttaaatatttaaattcaatttttttatttaaattaaaaaatgttcaataaacaaatttataagcataatttataaaaaaaactattgtcagattaataaatttaattttattaaaattcataaaaattggatggattattttattttaaaaaataattattttatttaaaaaaataattacttattaatggaatgtttaattatttttaagcttccctctccctcctttaccattatttcacattttaattatttatttattttttccgcttacgcatttcgccgcttccgcgcgattgccaccgcgtcgcgaattgtcgggtaaaagttgtgcttttgcacgtagcggaaaaagccgcacttttcgaacagatcgcgcacgggcgctaaattattttggcattttgtttcgacaatttgttttaaataacgcccaccttttgccgctgcaaaatacacaagaactctttgctcgcgcatttcggtgaaaatctgttgttattttttcggctattaatgacttttctaataattacactcattagaataattagggtccattagtgtaattgtaattgaacaaaataagtatttctttgagtgcatttacgcccatacagtcgacgaaggtgaagccggaacaatcgatgatgaaatggccgaagaaaatggacgacgccttctccgaaaacttaaaacatctttaaaataaaatattttagtctgatttagtccagctgactaattacgctgatcaatgccggatttcggtgccttttgaatagagcacggcgcgggaatcccgcgtgggattttgcttgaccctaatcagctatccctctcttggaaattgcgggattttttgggattaccggtaatgaagaatttgaagttccatcgcgcagggagcccgcaaattctaattcaaagaaatcagagagaagcgaaacagtggtgcagcagagaaaacatagaaaaggggaaaagggcaatatttcctcactttctcttccacatttttaaccccatcaaacaacttataacacttaatgaattttcatatataagtaaaaagcaatgcaacaaatgttcgcgagctcagtgagaatcgtttggtgtgagattcggtaaaaacccaactcgtactgtttttcgacaaaaaaatggtcataacttttgtcaaagtcgaccaaattaaacattcttggtaccattcaatagcccttaatgttctccatctatctgcaaaatacaagaaaattttattgcttttcaaaaaagttatggccaaaaattgtaaaaaaaaaattttcgtccataacttttttcaaactttatcaaattttttgaaacttggtggttagatagagaacattaagggctatcgaatggtaccaagaatatttaatttggtcgactttgacaaaagttatgaccatttatttgtcaaaaaacagtacgagttggggcagtacgagttgggtgtcgtccgattttgtcgtcccttctttaggtgaaatgttcgaggaattgcgaggcgaccccgagtcgagagtggacaccggtaattaattggccagagggggagggggggggtgtcaagactgccttctgatcaattcaatcactccctcccccgaaaggcactctgtcgctggtgattgcggtgggtgtcgcctgtctgctcacttctctgatcactggtcatccctttttttctctgccttcttttcccctttatctctcctttcccctctttctctgctgattaggctgtgtttgtgcctttcgctgctgtggcaatttgtctcccgccgaagagaaatcgctaagtgcgctaattgactcgggcaatggcattttggtgagttttgcgcctcaccccaaatattttctaaaatttaaaaattttttcgttccgtttttttagtcaaattcggcccttctttctgagcccatttctccccaaaatgttccacaatttcgccatcatcccaattttggctcccgacgatcgcccacccctcccgccgctcataatcaaccaactcatctcagttttattgcgttctctgacacaactgttgtttgatcaattcatttattatttttaaaaaatatatatttttttctatacatactaccattaaataaataaattattgtgttctctgtttaaataaatccttatccaagctaaaactcgatcgcatagaaattttgacggtgtttcagttctctacttcgactgtcccttatggctctaggaaaatccgacactggaaaatccgacaccggaaaatccgacactggaaaatccgacacaagcggaaaatccgacaccgcttgaaaatccgacactagcggaaaatccggcactggaaaatccgacaccaactttaaattttaaaaataatttttgatattttgagttaatatttaaatacatataataaagttacagtactgaagttatttaaaataaatatttttatggtcatattctatctaggtaggcatatgaatatttttcgtatgccattttttgatcatctcaaaaaatagttaaaaataatttctgtgatccctgtgaaacgtcaatgtaaataggcttaacaatttttaacatatgggtgaggtaattctccgattttgaatgctattccgtcctctgttctcgaataattagggtctaccccatcccttgagtttgttaatgtcttctgaag

SEQ ID NO: 4774 - DNA, 2833 bp, Heterodera glycines
  misc_feature (98)..(98): n is a, c, g, or t
  misc_feature (136)..(136): n is a, c, g, or t
aagtgcgctaattgactcgggcaatggcattttggtgagttttgcgcctcaccccaaatattttctaaaatttaaaaattttttcgttccgttttttnagtcaaattcggcccttctttctgagcccatttctccncaaaatgttccacaatttcgccatcatcccaattttggctcccgacgatcgcccacccctcccgccgctcataatcaaccaactcatctcagttttattgcgttctctgacacaactgttgtttgatcaattcatttattatttttaaaaaatatatatttttttctatacatactaccattaaataaataaattattgtgttctctgtttaaataaatccttatccaagctaaaactcgatcgcatagaaattttgacggtgtttcagttctctacttcgactgtcccttatgaagggtatgcatatttttgtagatttccctctctttctttctctgcatacaaaaaatgcacaatggaaagagagaaaaagaattaaggaaatagtgtgtggaaaagaaattctctatcgttgtttttcggtgtaaaagtggacagggacagtgaagaagagaaaaaaaaatacgtaatacatagttacctattatttgtccttatttttcgcgaggctcacaattggaaaagtattcaatactgtatgttaacttttattttttatgataaagcatggaagactctgagcagaatattaccgaacaatcggtatcggctcccaccactgatcacgacgaatatgaagaactttgcaaattggtcaacccaatctcaaaaccgcttgcaaacagaaaattggcaaagaaagtctacaaattggtgaaaaaagcggcaaaagagaagggctttttgagacatggattggctgatgtgatgaaagccttccgaaagaatgaaaaaggaattatcgtcttggcaggttcttgaccatttacgctctattataaaatattttgaaaggaaacgtttcaccgattgacgtgtacagtcatattcctgccatttgtgaagaaaaggtcaattttctttttttcagtttaccgattaattttcaattctgtcctttcagggtcttccttatgttttcactccgtctcgtgaacaccttggtctttgtgctggttcgtcgtctatatattttttcctttatgttttatattttaaggctataaacgtcctgcaattgtccttttggtgaagcgacacgattcgttcgcggagcttttcgatcaaacgcacgagtcaacttatgcgctggtggtggaaccggaataagcttttaattccaaaattgttgtttgttcgttttgtttcactcaataaacaaattgtcttagcatttacatctttcactagttgatttatcattttcaatttgattcttttggcttgtatgtatttatctgtatgcattaaaggcgtttatttttgaatttttatgatggccaaactggtggttgaacaggcaattgatgcgagcgagaagtttttgatccggaatgtatcaatatctttttagaagaaatttggtgaaaaaaatatttaggttgtcactggaaaaagtgtcgaactttgcggctgctgttccaaaatgacgatgtcggtcttaatgaatggaactgagtcggttcctttgtctttggctgtggatttgcgccaggagaaggcgtttgatatcggcgtaggagtttcgaaaagccctgaccactcagaggaatttcttccggtggaggccgatgtgccaaatgtcgagaacaacgacttttcaagcaaaacaattttgtgtgagcaacataccggcggtgtaggcacaggttgcaaaaaggataacatgtttacaaagtggtctcataataaagaagtaaaaaaggggttatgcaattcttagacgcattggttttttgaacctctaacccggattcgaacatttttcgaaaattaaaattcgcgtttcttgcaaaaattgttaaggcattgttcgaattttacaataaaacacaagggattcagatatgaaaacggaaaaacacattggctgcattcaacaagcaatgttagtaaaaaaaaatgagaattttaaattttcaaaagagttcgaatctcagttcagggtacgaaattaaccgaaagaaggccagattcgcgctaagcgcatcggattaatttttgggaccgataatctttaccattgccttaaatagatgctgtcactgctgacaatgaacactttcactttggccaaaaccgtgaggaaacgattactttgaatgatgtgcatgagcaacagaaacagagcgatgaagtaattgacagtggttatcgtgatgaggaggcaaaacggcagtttggaatcacttcccggatcgaaatcccggtttcgcttcaaaaattcaacaaattaattgataaggtgcgagtttttaggaaagcaatgacgacgaattggacaatgaccagccccaaaaatcaacagcaaatgccaaaaagaaacgtggaacaaagcgaaggcacatgcccagtgttgctgcgacaaagtgcctcagcagtgatcgaccttttttgttatcattttttttgtgctttttaattgatgatgatattttttcggtactagtgtagcttgagtccgctttttaggtaaagttttttcaaaatttatttttctggtttaaaagtcttgaaaacaaatacccaggggttttcaaggtcgctgattacgaatatggcatccacttcgacctaatcgggatcccggaccagaatttgaacaaaaaggcgaacatttaaatttttgaaaattc

SEQ ID NO: 4775 - DNA, 2640 bp, Heterodera glycines
tccattttggactcttccgactttctcacctctcttttatcaccaaacacgcttaaagagaacatgaacagcaccaagatggacgaagccggcaaattggagactatcggtgaaagcattgaacggactgcgagttcgaccctcagctgtagcagcagaaccgagaagagagggaaatgatggaaggacaaaagaatgacggcgaaatacaatactattgattttatgtttttctgtataacagtgattagcgtaaattggcgcaataaattctctctctctctctctctcgctgcattttttctagactttgcgtttttatttaaccaattattaagaaaatgcaatcgaaattcaatttcaaatttaagttccaaaattagctcaaattgccaaattgaaagaccattactgatttttttttctaaaaccgtctattgtgttgttaagtaacatacctaataatttttacaacttttagcaattcaatggcggcttggcactttgagaaattgttacgtgatttttctttccaaatttcttcgccggaaaatgacaaaaaaatttctgttaataatcgaagcttaccacaacagaatgacactttccttcaaattgagcaatgcgttagggaaatgctgttggaaaaagaaagcagaagaggtgagctcggctcgactttttccatttgtgattttctgcccgaaattacgaaaaaattctttcaaattcgattatttttctgagaatgccctctcaattgggcctatttcccaaaaaagtctccaaattgtcagttggtttctttccattccaatttgttcttcgcttagatttgtttcattgttcccttcgtccggcacttggtcatttcgtcgctcttttgcttcattcttttggcaatgattccgacgttaatttacggtgagaaagtttcgtccgcaatttagtttgttggtttttggattttcaggttgagaagtggcgaatttctgtgtttgcttactcagttggattttgccgatgaatccgctgattttgttgcttttgttcttcccgggattttttcgggctgtcgtcaggtggcaatttcgaagagtttaaaagcaaaagttttacagattctcttaaatgttctgcccaatttgcattcaattgacctcgtaaggtgcgcttgtgaagtgagtggggaggggaggaaaagccatttcaaatggcaattaattaatgctaattgaaatgaccaattttcatatgattttacctttttgccttcattatcagctggtcaccaactccatttgcatttccttctcaaaaatcaatgtcaccgattgtttgagtgtttccgttggaaagtgcgtaaaatcgccgtcctctgaaaatgtcctcagctttcgtcgcgactccaattggctccaaacggcggcccagcgaattctcccccaggcaaaaatggcattgctttttcattttgttttctttttcagatttgttcacttttgtcacatctttccgcacattccgttgactccgttcgctatgagtcagccaatattttatcaaaaattcaacgacaaattccgtcgggtgtttgttgtttccatttgttacctctttgctatttatacactttttccagattactttggctcttcctttgtcaaaatgacaattgatgtctcccttttgctttacagtgacacaatgccaaagtttgcccttcgcgtaatttcccagcaaatgctctcttaaggacacgccatttggcacatcggataattgacgacatacggctccaacaaaaggaattattcgagtcgcattccctcgacaaactcaaaaaggcaatgaaatcgctcgaaagtgacgtcaaaaatgcatccgacggcggagtttacctccaaaatgttagtttttactacttttgcttataatttctcttttttttgaacagttcgtaaattgtgctcaactcgttggtccccatttgttgggtcgtctgtttaatttgccagaatttgttgacaaatttctttctccattaattcggctgatttctgttgatcacaacaaagaaatgatttgtgattctcttcatcacaaaacaaatggtttttaatttcaatctcctaatatttccatctttttagggctccaaaatttaccacccctaaaatatgggataaacgcaaaacatttgacacaattggccactctcatcgtcgaaactcacaattcagaggtaatcggagcattttgaagaattaaaaaaagagtatctttaaattattaattaatttccatgggttgccctccaataaatgcttttctttcccatttttttcagaaactcttcgattggtgcttcgacaatttccacttcgaccgttcggttgggcggcgtttgtcaattgcctatttttccttttttatgctgaattcacccggggaaagcaatcagtcggtgtgcccttttgtggacgatgttctccgaatgttggcctccatggagtgtctcctcgaagacgaagtgacggaccatcgaattgccaattcgccggttgtcaattcgacagagtcttccttagcacagttcgtgacttatgcttcttttgttcgatttggtatttattatat

SEQ ID NO: 4776 - DNA, 2592 bp, Heterodera glycines
ttttttaaatttcagcttcgggcagaaattacgggtctgttttttgttgcagttgtccttgtgtcatgtttcagattgcttttgcactgtctttccacttcccgttctcttccttttcatccgttttcctctcgagtttgcctttccatttcttttttcccaataaatctgtttcacagcttcacattgacgttgtttacgagcttctcaagtggtgttcgtcctctaacttttgtgtcaaaaatactgccgaatccgcactttctcttttcgctgaagttcaattttcaaaaactcggaatttgagttcatcgctttgttgtaaattttagttaaatggtcatccgaacgtttgtctgttactccaatgccatgccgaacaaattgtcttcaaactttccatggattctcgcgacttttccggttaatgtctcaagtttattcacaatttcataaatgctactcccttttcaagtttgtcctcgatttccgctcattttcgctgaattggtctcgcggtgtttttctctccaaattattctcccccaaattcgaagtgttgtcgccgaacttttgctttggctcgaccggagtgatcagaagcgaattatcattttggccaaagcacttcgcgcttatttaagcgcacttaacgaatggtttcctaatttgaagccattggttacgaatttgagcaaaacgaacgagaaatatgccaatttggaggagacggaaggggagaaagatggccatggagaggaagagggggcggagaaagtggacggacacaaaaagcaatgggaaggagacccaaattacccactggtgaaggacgtcgtgtccatcctgaacaggtggggtgcacaacgttaaaaataaattgtcaaacttagagaatttttggaaaaaatcagaattttccaataaatcaccgaaatttttgaaattttttaaaaaaattttttcgcaattttcttgaaaaaatcttctaagattttttttggaagttccttttacgtattgttaacaaaatgaaattccgtaagtcagaattccaatttaatgtgataatttcgtttttctttacgactaaattattttgtgtccccttttggtaataattttctatttttttcattgaacgtaattgaatttacaggacaaagcatttcattgcgtccgccaatctgccccttttgctaattgttcttgacgttctgcgcctctctttgctttttgtcagagattatgaagacgaactattgccaatgattcatcaaaattggatgggacttattcggctctttaaaattggcactgccggtcatctgttggattcacaaaaacttattatgatcaaggcgattgaggtcaattgaaaccttatagatagttcttgagattaattcccatttttaggttgtttcgtgcatttgcaaattgtcaaaagattttgtgtatcggaaaattgttcacgaatttgtcccttgcattgttgttttattgagggctcttctaaaggaatcacaaaatttgggcaaattgtacgcacagactgccacattcaaacttcaatgtgcaatattagatgggtacggtattttaattgaatcatttaaaaggatgcctcgcaaaataaaccaagaaaaggtttttagaataccggacattcttggcgctgcaaaagttgcgcctgaacacttccagcaattggaagaagtaatcgcggaatatgcaaagcaggaaagaaaactaaccaaacaattacgagacaaagcattgacaagcttaaatcacatcgaaaaactaaaaagatagctcccacatcatatttattttcataaaatttgaaaacaataaagaaagctctttagaaaaaaaaatttaacatttttgcagaccatttaatcgaaatgcaagagcgaccgactaaaaattccgaaaatggagaaatttaaaataaataaagacccattattaagtagcatgggaagatgaaagagcgagcgggagaagagaaaaggcaagaagaaatgaaatgtgaggaaaaggggtagtttcttagaaatcaaattgtcccccccccccccccccgctgatcattcattggtcggcactgttgtaaagcacaagcgaaaggcaaacggttgaggcgccaaagaaaaagaaagtgccggcggaagtattgtcgaagatgagaagggacaacagagtgactgcgacaatcgaaatggaagaagcgaagctgaaaacgaaaaatattgggggaggggaatgttgggacgaaagacgatagtgcaattagagaccttttatacaaattgtccaaatgtttcataatcagcgaaatgtaaatgccgcccagggaaaggaaaactgaaagtttggccgattaacagcgtcaacaataattaaatttctccgtgattataaattaacataatattattgtaaaacttacgaatgatagcaaaaaccaaaaagttatatccgtggaagagtccgttcctttttacgtgaatctaacaataagaaaagggaattgtggagggtaataaacaatttctcaacaaaaaaacttacataatcctt

SEQ ID NO: 4777 - DNA, 1866 bp, Heterodera glycines
ctaaattgggctaattaaaagaagaaagggcaagtgaatgtatgacttatagtggcatgggcgagtccgcaaatggcacttgctgaagcgggagagttgacatggttaacataaaaatacccataaaaaatcgctttttacctgcgatccaattccacgaatcgtcctcatcgcgaaatgtagccgaagtgcatgaagtaaggccaaaggtaaaggaataaaacgcgggcagaatcatcctactactaaatagccacccccggaacgattggatgacaaactccactgcttcaaagcgaccgacattggtggctgaaacaaaaaagacatacaactctttgattgaatatgacctggcggatcatatccacgaagtgctcctgcataagcaatccaagctaaaggtgtagacgcaaattaaaagcctaagggcgcgtcagtcaaaacaaaactcactgatcggcagcgaatatttggccagtgcaagtcccttttcgaaacagccctcattcattggtttatcccaaaaacgcggccaagccaatattttaggaaatagagggaacaccgtgccaattggacggtatttttggcgaatgatcgagtcgagcgaagggttgaccgcaatgcccgggtgctcgtcactgaggtcccatttttcagcgatttgtttgtattgcgaacagttctccctgatcttaagagaagagaccaaacttaggatgaaaacaaaataaagaaacctgcttctggaagtcttcaaactttccgggaattccccatttgaccattttactttggtggtagcgactgtccttcccttgcggcccgaccatcgaagttccatcaggcacttaaaaaaaacataatcgggtacttccttaatttaggttattttttcgaacaatttttgtactttacaccccaccgaacttttgtgaatgtagaaagaaaattcgaaaaaatttacccgaaaataaaggattaccggataatcatattgaaaaccaatttcattctttttgtcaataaaacaatacatacctttcgaatcaacataacgaatgtccctttcctcaaaaaaaggataaaaaccagttgtcaagccacgcttcaggtcaaggtctttgtatccaagagaagcccaccattcggttcgccctttgctagaaaatcaaaaaagtcaatgtttaatatagaaatttgaaaaaatgaaataaatttttatatatggcgaactttttgaggtggaccctaaattatctttgctttgattgtgaaaaaattttctaccgaaaaattaagaaaatttaattaacataattacttaactattctttccacgaaggaaaccatggcggtggatcaacaggcacttttggagccaacggaggagcataaggatctttgtaaatatgcatatcactcaacccactctaatctaaaataactgaaaagctataaatgattcgaaattgcttgagaaaacaaaaatgaaccaaaataactaaaactagagtagagcgggaccgggaccaaaacacggacaactgagtacaactgagtaccgaggtcccggttttgaccgggaccgggaccagtcccgggttttttcccgggtttcccagccaaaaattcccggtttttcaacccgaataggtcccggtcccggttaagcccaaaattcccggttccgctctactctaattaaaacctttaaaaatgtgtgtaattcgcattaggggcgctacttggaaagcggtcctttacttttttttggtcaaattttttaaaaattttttttatgtaaattgtttttttttattatatggtacgcatttcacgctatttaataattggttatga

SEQ ID NO: 4778 - DNA, 2584 bp, Heterodera glycines
gaacatggccaaaatgatgacaaacacccactctaaactttaatgtagttgtttattgtgtgcatttatggcctaaaatcacgaggaataacactttccatggagtgcccgtcaatgcacctctccatggtcttacaattccaacagaatttattaattaaatacaattgaaaaataaatcttttttccaatttgttgtttttggttttaaaactaaaatataaaaaatttttacaaaagaaaaaagaattagaaaaatagaattaaaagaaaactccatcataaaatcaaaaagctttttttgtatttatttgcttttccttattggctttcacctttcggtaccaatccgtgaacattttcgtatttgacatgcagagcctccgcttcctttaatttaccaaaaattaccaacttgggctctccttcattttccaaaaaatgataaaattatgcacgaaatgaaaattttgggtttggtgacccgtttttcctttttttttaccctccccttaattttttcataaattctttgtatttttcaagtgccaaaagggagtggtgcacaaattgatggcggaggcgacggacgacgaccacaagtcggacaaaaatcgtgtgccgtcggcgccacggtttggcacaacggtggaagcggaggaggaggacggcacggagccggaggatgagcaccacccgcaccatggccaacagaagccgtactttgcccgccgctcgttcaagccgatggtcatcggacggacggcgccaagtgccgtcaaatatgtgcagcagccgaacggacatcccaacggcgacggcactgtcattgtgcaaatggcaggggtttgtacaaatggatggaaaaatgtggcaaaattaggggcgtaacgatgcccgaaaaatggaaatttaattaaaacactaaattttggcgcctatcagtcgccattttaagcaattgtttttcataaatgactcaaaattcacccattttggcaaatattcaaatttacggttgcgatatacgccaaaaacgttgttttaaaagttttttttcaaaaatctaggtgttactgaaacaaaatttgctaaatttctagggaaaaaacgaaatcggtccatcccttcttaataatcgaccaggagcagcccttaaatataattttaccaaaaaaatacgtatattatttacgattgttttaacaattttagtctcacaaagtgcgacaccgacgcccagcgcagaaacagcacaaaatttacactttgcacggctttttgcacattgtgtacattccgttgctgaggcgaaaggctgttaaagtgagttttatgacaaaatttttttttatcaaatccatccatttttggcttttgcaaattttgatttttaatttttttaaattaaattttaaaaaatttgaaaatgctttttatataagaaaactttaaaaattgctggaaagatttaaaaaaaattactggccattccatccaattttaaaagtttttaaattttttcttcggttttttttattaattaccccctcccaaattgtgcccagtttgccatcctcgtcacgatggtggcactgtttgcgctcggcatttacggcctcagccgttcgaccatcggtctcgagctcagcgacgtgttgccggacaacacggcgccggccgccttcctgaaaacgcgcgacaaattcttctccttctacccaatggcggtagtcattcgcggggcaaacgtcgattttgcagcgcaacagcaccaaattgacctgctgaggcgggacattggtggggaaacggacggacggacggagggggggggggggggggggggccgaaatgaacttcataatctgcaaccatgaaaaaaccaaaatctgggggcaaaatttaaaaagggctttgcttattaaaaacaggttaccgtatctcaccgctaagggatggtattttttttttgcacgggaagaaagttgtagcgcgagatcagttggataacgcaaaaataattgggtcgataggcgcagaattcccattgtcccgaccacatttgcagtgagcccccccatttttttctatataatgataagcaaaatcgaaattttcatattcatccgaatggtctgaaaatcagtatccgggggtaatttggggtggggaacacgattctgacatttgtttggcccgtccaacacttagccatcgggggaggtgttgggcggggcctggagagtgaaaagttatatctcagcgcaaagcgcccggcgagagacggcaattttttttccaagccttacaggtcagcagacgtgcggggaaaaaaattttgactccctagcattgatggttcaaaagattgctgtctatggcgcaaagctggtccacaaaaagacagcaatctcggcgccaagtgtgcggatcgggtcaaaattttttttttaaatgctcccccacggcatggcacgcatatcgccgagcggcaccgagccgctatctgtgcggagccgggcgctgcgcaacacttagcgaaaacaggttagcatacctcaacgcaaagggatggcatttt

SEQ ID NO: 4779 - DNA, 2885 bp, Heterodera glycines
aataagaaatgaatttggcattttcaggattgtcaccttccccaggcaaactaccggacggcgagccgagtgagttttcttaataattacatataaaatgtttttttaattaaatttcattagataaacaaaaaatgcaattaaaaagaggatagcatttccgcccttaattcctctccccaaaatttaaaaacattttaaaaatccgattaaaaattgtacattttgccgtgccgttcaggtgaacgctattggctccagttgttccgcgattggctgcgcggtatgcaacagcggttggacgtggcgaagcgggacggactgttggacaattttgacggggatggcacaacgacggcgacaacaaattcaagcagtatatccgcagcagcaacgacaccaaaggcgaaacatcattcgcccgacctgcaaattgcctattcgttggcctgctcctacgggcagaactacgactgtgccagggtgagttttttttatttaaaaaaactaaaaactgaaaaaacacaaaataaaaaaaactctaaatcaaataatacaaataaaagtattaaaaaataaaaatgtaaagaaaaaaaatataaaatcttttttttaatttttttaaaatttatttttttatatttttagcttttttcttgcatttgcctacaaaatttttaaaaattcaaaaaatttcggccaaaaaaaatcgaaaaccacgtttttaatgaattttcatccatgcttttgaaaaaacaaaattttcatgtagagctatcgaatgatatcaaaattctgtttacttggattggttgaattttaagaaaaattatgtcggtttttcaatttttaccaaaatgaaaaatccctcaaatcaaacattttttgttaaggccggcacagtccgtctgattgatgagagcggcacaatcaacacggaaggcttctacaactatttgtatggatggcacgaatacgaacaaatggtatggggttgtccttctaaatttactgttttttctcgaattttttatgaaaatttgaaaaattaatcaaaaaatgtaaaaaatttcccttcctttcagttctatgccgtctctcaggccagcttctacccccgtcttcgcaagttgcgccaggggccgcctgggccgatgaaatatgtccgtttttgttgcatttccatttttaaaatttgattttggtttaggtccgtaatagaaaaagtttttccgggggttgggaagggaatccgaggagtttttcttaacccctcaaaaaaaggtacaattttttgttaaattaaacaccgtaaatgtaaaaaaaaaagcatttttagtagttttgttacaaaaaatgaatccttatggcatttaattacgaaaattagcgctcctactttaaaaattaaaaaaaatttccataaaattttttttaatttcccatttgaaaatttttattattagtcctcaattaattcattatttgatattttaaaatcaaatttatttcaaattatatgcatacatttttcaatgtatctctcccattttctcagcgctatttcattccgcccgcgccgaagccgttgttcagccgaattccgttttactgtgacgggttgcgcgacacgccgaccatcatgcgcatgatccgcgagatcagggcaatcagcgaaaattacagccgtgcgggcctgcccaactacccggaaggtgttttttttttggaaatttaggaaagttttcggggaaaatacaaatttattttttcaaggcgtcgctttcaccttttgggagcagtatttgcacttggactactacttggtgttggctattggcgtaagtttttctttctttttggtgaacaattattatacgaaaaataaaatattcaactaaaagttaaaggattttttcatagctttgcttgattatttcttaatttaaaaaaaaaatttttagaaattaaaaaaaattacattttcatcacaaatttaaaaaaagttaattcgctgaacacttaaaaattcctcattaaaatatataaaattgatgaatttatctaacaaattatacaaaaaaaagatttagatcatttccgtgtccgtcttctgcgttatctccaccatcattttcaacccgtgggccgccgctttggttggttaaaaaaaaatttttttttttgtcttgccgaggccccaaccccattctcctgtatacaatttgttaaattttttggtcattcaaattctccaaacatttctaaatgtgtttctgataaataaatcatattttgtttatttttgacatggtcggtaattgttcgctaattacttttccgcttttccgatcacttcttctgatcacatcatttcatgccaactttttaacttatttctgattatttctctcgtctctaatcactttccccattccaccatccgatcacatcactgacatcaaatcatacaatttcctttttctgatcgttcccgctcattcagagcacttcctaatcatttgtttctttgctttgctttttcctttttctgatcacttaccatttatccccaaacaacacaggtcacctgcgttgtggccagcatgaccgtggagttggccggcttcatgggccttgcgggcgtcaagctgaacccgatttcgtccgtcactctgatcaccgctgtcggcatcggtgtcgagttcactgcacatgttgcgctcgcatttctcacctcgttgggcacccgggaggagcggatggtccaatgcttgcagcacatgttcgtgccggtcatccatggcggcatgtccaccctgctggtcagtcagtcatccagtcagcaggctgaaagtggaaaatgccagaaaattgaaaatttc

SEQ ID NO: 4780 - DNA, 2085 bp, Heterodera glycines
  misc_feature (2003)..(2003): n is a, c, g, or t
  misc_feature (2039)..(2039): n is a, c, g, or t
  misc_feature (2044)..(2044): n is a, c, g, or t
  misc_feature (2059)..(2059): n is a, c, g, or t
aaaaatcgctttttctttactgagctttaacttacctatttattcttttggatgttgtaatattttgttttttgctaatccaattattaccgtaatttatctcgtgtttttcctattaatcgtcatttcgttttgttcacattttgctttaaatgtaaattataatccatttgtcgctgttgagcttcattttattttgtgtgaccgagaataaaaaaatggaatgcaaaaataaattaccattatcaaaatgggttttgaggaaaataatgtcctgttttttatgtcataaaatatgtgaaacaaatttaatttaaattgaataaaaataattctaatttattattaggaaaatcgtgaaatagacacctaaaaaggcataaaaaatcgcaaaataggcttttaggattttttttttaattttattcaatcttaggggtgtattttctgaaaaaattttttgggccattcttaggggtggtttttcgtttttattgcatttttgttaaggaatttttcgaaaattctaaaataggcacagaaacccagaaacaggcaaaaatagataaaagtcatcgtagacaccccgaaccaagcgcaaaacgcgtttttcgtgctatcttttcgaatcaaatgtgcaaaattttaggcacttgcctaaaaaaagaatccctatttattatgtactttaataaatgtttttgagaaaaataatgcaaaaaatattttaaaaactaatgaaaacaattttgaatcagaaccccatactgtcaaatttaggtgcatttccatgaacaaaatttaggaccttttagcctctggtcaaatgatcgggaccgttttctgtatgacataaggcaaaattggaaatcacccgaacccggtctatctgctggagagtgagagagcgtaagagagagtgaaagacaacagattttttcaaaaatttttgtgttcatcgagttgattgatgtttgggccctgactttaagattttttagtttttaaaacccaaatggcagggccaaatccatccgccaagtgttaggaaaataaaaaatttaggacatataaattcgtatcttggccaattttcaatgaaattaataatttttggtatcattcaatagctttaagtgttcctatgagaatattaatttataaaatttttatatgaaattataaaaaagttatggtcataaattttcaataagttttgagtcaaaattattttaccaggacttttttaaaactagatgaaattttttgaaattttaaccataaatagagaatcataggacaatcgaataaaaatttatttggacttaattgcattttaatgacttgaaaattaatgtttataattatatttgcatgaccatggcaaaaaacatagcctgttcaatgctttataactttttttcagaagcaattagattaaattttctttttagaatttcaagtactctttattctatttattgtttaagacaaaaaattccgacataagatttttggaatttaataaccataactttttaatactattttaaaaaaaattgaaaattaatattctgatagataacacatagagccattgaatgatataccataaatactattttggttgaaattgaaccaagttgtgaatttatatattatacgttttttgtttttctaccccttggcggtttttaggaaacgccctagcacctttagaaacattgaaagaattttccaggtacattttcatgcgaagtaaaagtgactgggaattgtttttaaattttcttaattttttatttatataaatccaattcctttttattgaaataaccgtttcatctctcctccaacgggtcggggtcattttggcgcagacaagtttaaagattcataacttttttttaattcgaccaaataaaataatgttgatattaatcaataggtctaaatgttctttattagcctgcaaaatttcaaaaaattatattaggttttanaaaagatatggcgcgctgcgccaaaatggccagganatgcnatttttttgaggttntttggcataaacttttttggttctca

SEQ ID NO: 4781 - DNA, 2385 bp, Heterodera glycines
cccttcacatgtttcttcactttcttttcgaacttcatgaactctgtcttattttctgtagacaggacaccagtggtttttcgggctttcgccgccgccatcactttatagcgaaggccaccaaccttgccaatttgtttgttttttttgatcaccgctgatacggctatgtttttcttcacaaaaagcccactggccaaagcatacagcgcgattaaaatcgctgccgacccagattcgccgtacatctttccatcgtcttctgggcccactggtggggctaacacctcgattttcgtggtctcgaaaaaaggtcctccatttgcttggcgaaagatgctttttgcaacttcgtacgctgtttgccatgatcgctttaaaagagtttctgatgatggtcatatttagcaaccgaaaattcaaatcctagacactcatcagcaaaaaatatatacgaattcagaaaattttagaacatttcagtccgaaattcctgcttattaattttaaaggttcaagaaattagatttttactaatcacattgccattcaccgaatgagcggacgggccaacgagtctttttagtgtgaccatttattgtgagtgtcaaatgaaaatcaaccttttttattaacaatatgtatacatatgtggaattaaatactattattctcaatttcgcagttccgaattggtttggccaaaatgaatgtcgtgataagcgacccaaaaccccagaaataagttttcatgtcacctgaacacaaaaaataaataaattcaattaattgatctgagctcagcaggtcccccctaatcgggtattttttcacactagaaaaatcgaatgaaaaatttttattttattttcctccgggtcaccaattctccagtgttaccaaactacgcataccactcgatttctgacgtagaagcacggcaacccaattgcttcggctttccatcgcttctcggaatttgcaaccatttggccaatgcttggccaacagttgcatttggcccatcatcagcaatagacgcgggcaacaaattatctgatcggattgaaatcaattggttgagactgtagagaattgttggcgaaatgtggcgacgcaaattgtcaagagcatggccataagtaaaataaaaatggcgaatgtttggcgcgaaaatgggccaaattccactggcaaaagcattccaaattggctggaaattcgacttctacatacattcaatagctcgttcgaaagctctttttaggctctacaacatctgtgtatgagttttacgcccgactaattttcttaaaatgttggaaaaaaatcaagtagtccatgaaaaatcatagataaaaatcaatgattttcaaaatctgagttcagattcgtgatcagcgcacttttttagccccagaaaaattgcttttcaaaatttccccccgtccgttaaattttatgaaattcatttacagccaaatgagcaaaatatttttgtatggaaatttatttttgcccaatttttactcaataacaattttatccaaacaatgaaaccaattagcaatcattctcaaaacgccttaacattgttggcataatgtgccaccattccttctctttgtacaacacggattcgttggaattcttttgttgtcgctttgcaatattatgtccagcaaattggcgtccatcgccgcctttgctttgtgataaagccggccgattcgaagcaattgccaaataaccaaaataccgtttatccgttgtcgctcggctgaatccaacaccaccaatccaatgacaccaatttgatttgccttcgagcaattaaggcatttctgatgggggcgagcgtctccggagatgaagctgaaaaagcaatgttccttcttaaaatttaaattatcaataatgagattacgaaatattgttgctattagcaaaactatttaaatattttttggtaatagttaagatgatagccccccattttttggcggaaattttcaaaatttaaaattcgttcaaaacaagtttctaggtgttttcgaggtcgctgatcacgattctgacatccattccgcccaatttcgaaccccgaacccgaattcgaacattttttaaatttctaattttcaataaaaatttttttttgactttttcgcccaatttcctttgtcacattaaatggctgcgttactttccagagtttgtgtggcgtcagcgttttggtaaacgcgagaatgtgtttttcaatttttggtcgcatgtatctgagttttacccatgccaataaaatgttgctgacgtaaaaaactcaaaaaaattttttattgaaaattagaaatttaaaaaatgttcgaattcgggttcggggtt

SEQ ID NO: 4782 - DNA, 5432 bp, Heterodera glycines
taatggtttttaaccatattttggtcacttacagcagatgcctgacccaattcatttcatacaaaaagcccaaataaataatttaccaaaattttttgccaaatttactctgaattttgattgattggtaaataaaatttcttcctaattattgaataaataattaattattcgcattttatttatgtttcataaataaataaattaattaattattagtccaaattaatgcgacgatcaattctttttccatctttcatttcttggttaagctccgttttgttccaatctcagcagttattgcaggggcagcagcacatgaaaatctgacaaaaatttaataaaatttaatttaaaaataaattctgaatattactaatacacactcattatgaggatttatccacattttttgacaaaaatcggtgctttactgtaatctgtgcggagattcacaaaaaaaaattaattaagaattgtcttggggtttttagggtcgggaaaaccttctggtatctaatttgtcccaattcgaaccccgaaccagattcaaaccaaaagtagtaaattcaaatttttcagatttcgaatttttgttcaagtccggttggctgtacttttgttgacaaatgaattttctacttttttcgagttttgttcgaaactgggttcggggggtatatgaggaggaggggggggggctttaatagagcaaatacgatacggttttttacaattgccggccagcgacagcgccatgaacaacggcatgggcaaaagcaacaactgctggcccacacgcacaccaccaatggcacccgacttggcagtcggcttcccggtcggaggcgctggtgttttagcaggatcaaaaaaggcactgcacttccaactgttgtcgaacagagccatcagcaaaaacaccacaattaaagggcacacaaaacggggaaacattttaagtataactaaattaggtatagtttgattatttatttgtacacggacgggggtggctgtatttgaaaaaaatgtattaggtactttatttttaaaaaaatgccaacaaatgggggagcaaaatgtgcgggagcggtgccaaaaaagtgtggacacagcaaagactgacacggtggaaaggtggcattgtaaataacgaactcataacaaagttaaaagcctactggtccgttagtgggcaacccttgaaaatttagccccgaggctttaatttttcaacccccccccccccccctcaatagggggctgctatatatcaggggggagcttgtcattcacagcaagtaggggggaggcttttgttttccaccccctcccctcaataggggacttatatttgaaaggagggagacttctataattattttcgtaaaaataattttcgctaatggccaacccccaactcatttgcttcacccatcccaataaaatgagaatgaatgaacagattggtagctaaagccaaacaaacgatggtggtggtggtggaatttgtgaagctaacaaatggttacgtggcacaaaaaaaagcaaaaaaaaaaacagatagcaaaagcaaattggttttgatgatttggccaagtccacgacggaccatcaccaacaaatgaaccaatcgccaaaaggaaaatggaaaatctgtgctggtaatcagccgatccaatccatccaccgattgtcatcattttgagttgagcccaacaaattatgcacatatgtaatgaagttggtaatataatcaaaatgaaaagccaaataaataaataaataaaaatatacgaaaatattgggatggacttaaatggacagccttaaaaatcctcaaaaaaccctcattcggcagagataaataaactctcttcagatggatggatggatatgtgtgtaaatttgtattcggaccccccggcttaataattaaagccgccgtgggctctattagaggctaataacgataattatattgaaaataggtatgcacattaatttgtgttcaaaatgaatttcttcgaattcaattatatttttcttgaatcattttttcaaatttccataaacagaagaatatttgtcgttaatcaattaaattaatttctcaaacccatttatggggaataaaatttataaagtttccattcgagcatttaaattaataatcaaaaaggtcgttaattaattaattaattattgattaatagattgatgattatgaaatttattaaaattaataaattgtattttttgtcattttcaaagcatatactttttatatttacaaaaaagcaataaaaaataagaattattccaaatttttacaagatcaaggaaaatttcattgtcattaccagccttaagaataatttttaattaattgttctcaaattataaaataatttggtactttcctgttttgaaggcaaaccttggactcgtatttatgtgagtttctttggctcgaggattgtaagcaaccaacgtctatgaatttgacgaaattttggcaaaaattgttgcttttcatatgcctccaaaataagtcaatgttatctatccaattttttctaataatttcgacaaattttttgagcaaattcgtcttgaaactattggttcatttgaaaaagtacataaaatttccagtaatactcaaaactggaaattttaaaatttcagcactcgaaacacaaaaaagccgaatcttttaaaaaaaatttcttaatacttaaaaacccgaccaaaaaaaaaaattaaatttaaaaacaattacttttacagttaattgagaagctctaatttttttgttgatgagaagaatttgagaggaccaaactcaaaaaaaaggacaaattttcttttattttcaaaattaaaatcaatttaaaatctgcaaattcatggtcaacagaagaaaaatgttaatgagcagtgagtataacctgttgtagttgaacgagttcaatttagtcatcaaatttaggcaataattaattgaattttataaattttccataattagcataaacaattatgaacaaaatttagttttatttaattattaatatgaattaattaatttttttgtaaatggttttgagaaattaatttaataattaatcacaatttttgaggtgataattgacaaatattcttctgttagaaatttggaatatccaattaaaatcacaatcctaattttaagtgcatttgtttaaatagcaaaaaatatataaagtaaaatcactaaataaaaaaacaatattaaattttatacattaattttataattaattaatgaattatcgatcaattttacggcttaagacaccggatggatataaatgcaatccgttgtcaaaactaatctttgtatattcatttaaaaataacaaaataatttttctttttttcaatttttttttaaaattccaatgcatttattttattagtaaaaaaaattcaccgtttcttgctaacttttcaatgacttaaaatgaaaaaatttatttgttttgataccagcaaagattgatttttcgaagcaaaatttcctattttaaatttaatgaataattgaaatggttatatgcgcgttcgaattttgttcgaatgacagcaaattttgtgtaggattaatcggtccgatacagtcggaaattggttttgaatctaaaatctaaaaaaacccaaatttgggggctttttttctttgttgtcggattcggctggatccaccaatgttttttcaaaaattgaaatttataatttctgcatgattgaaatggtaatgagttagaattttgtttttgaatgactgactgtctaattaaaaaaaattggtcgaacttagcaaataaaaatttatttaaattattttcaacaaattctcgattctcgagctgacaaatttctcgagttttcaactacaaaaaaaaatattgaaattttaaaattttatcgtaacaaaacccaacaaatggatcaacaaagcactatgggtacgcgccagtgtcagacaaaattgctcataacgccaaatagcgcatttggcgtaaatttttgcgcgttaattcaaaagatatactgatcactgccttttttgaagaccaattaacattaataaactttattcaattgactaaactctttatttaataatactatagaaagcggaaaagatgtgttcaacataatattcagatagtggaaatgtgaaatggtgaaaatgtttggaaaaatgaaatttgatcaaaagtttgggtatttgtttccattttcttgactgttttcgacacctcgatagtgaagggcattcagcagtgtcacgtgtttcaccaacttctcaacaaccttctctggagtgccgagatgagcataacgaccgacctggatttataattttaatgggaaaaattattcattaaaccaaattgttgcacattctgtgcatatgctccattccctgttcactgatcagtccccaccagagatgagtgcgtgcaaatggaacgacgtgagcagcgagaagatgaagctttggccggactgggtaacgagcggcgtcaattgttcggagttgctgcctcggtgtccaccatctccaccgacggcacgtccatttcctgcggtgtcatcggtgatggagttgatgttggtcgtccgtcgttgtcccgcgccggtgcctctgtcgacggcccttcttcagatggttgtggcatttcggcatcggtgtcgggctggggagcggctaaaaattggaaaatttgggaatttatgaacaaaaatggaaaaactcacttctcttggccaaataggcttgtctcgccttggccgtctgcgcttttctctcctcccatttattccaacgtttttgggccccttttttgctttgtagtttctttattactagggctgggaattatatggaaatccatatttttttcctggactgtggaaggcctgaaacgcacgaaaaacatgtttttagcttggtttgaagcttctaggatggatttctatatccatattttccatatttttccatatttcgcgatttatgtccatatttccatatttttccatattttggcattttggtccatattttatgtccatattttggcatttttcaaaaaaacctctattagaacggcccccatcagctaaattagcctttttgagcccaaaaaccgaaaatttttcaaaaaatcattttttcgccaaaatttctcgagaatattgaataaatttaaattttcttaaaaattaataaatttatgtcaaaaataagcaaaaaagcgaaaatttcgcttttgtggttgattttgcgctaaaaaaaattaataaattttatctttcatgttttttttttctaaaatgattgcacagaattgccgaaaaaattcgagaccaat

SEQ ID NO: 4783 - DNA, 2839 bp, Heterodera glycines
tccaaagttgctcaagtcgccgccacacggaaatgcagtgcctcatctcctgaaaaatcacaccttttaaaattgacccccaaaaaaatgatatgtcccaccctgctcatccaaaaggcccaaaaatccgtgttgcgcgcaaacggaacaaagtggtgaagcagcaaatgggcttttgtcttttttgaaagaagcgttcgcaccattggttgttcgtcgagaaatgccttgaactggtaaactgccgtctccagtccatccaaatcacctggagacaatggctgggccttaaatttaaaaaaattatttccacaaaaatgaaaaccaattactttggtgaaaatttggattttccccaaatgtgccattgttttgcaaattgttttggcccattccgtttcgaaaagggcctccatttgatcggcatggacgaggattttgcggatgctgttccccgtcaagtcgcgctcgcggaacgcgagcgatcacgatagatgacgcccacaattgcgtcgacgatgtcgcgcctggcgctgcgctggagttcatccacccttttcttcggtcttcctctgtttggaggcgctaaaattgaatgaaatgggttttttgaaatttaaatgaaaaatgaaggttttttaaaattaaaatgtgagattttcactcacttttgctgctcgttggtggtgccatcggtggtacaatgtgctcgtccagctgccgacgcagatcactgatcgacgcagatcactgatcagcgcttctcgattgcgcacctgctcgcgcagaaatttgatggtgtcgtcccggtccttgagctgcttctccagttgttcgatgcgctctgatcgctcgtcaatggccagcggtggcggggtcgtctctccggtgtccattggcgcagttggtgttgtcgaaagcgttgtctccaaatcgcccatcttttctgcacagatgtcttcatgtcagcgaaaagccaaagtccaaaatttcctcgtccatctccggcgttggccctggtcctggagttggtggcggcggttccatcgctttttcggcggatgcagcagatgttgacggccctgcttcgtcctgcggtgccatttcggcattgggattcggttgtgtagcggctggaatacaaaaaattgattttttgagataaaattgatgaaaaaactcacttttctaggcccatcggccttgtctcgccatctccgtctgcgcttttctctcctcccatttattccaacgtttttgggccccttttttgctttgtagtttctttattacacttctcttagccataaaatctaatttaaaaatgaaatttttattagaaaatttacaacttttgagcttgaccatagacaaaattaaattcactatagaaagatgcagaattcttttctctatcgatttgcaaaatttggtgtggatttaacatacagaaaagaagctaaacagaacgaagtaaatgttgttttttacataattaaaatgaagagatagtacgccaaagagagagaaattacaaagaaaaagagaaacgacgagatagtactaggcttttctctgcacagtgggcgtacccatagtgacaaagcaatgcgatcagatttcactatctattttcttctgctgatgcctttactggaaaatgcgtcagagaaacaaaatttttgggaaattcattcattgattaattttttaaaaaatttgggattactttaaaaaaagaattgtgtttagaaagtttaaacatttttttgaaaattactaaaaattcgtaaaaaaaatacagtatggttttggtggtcgtcaattgataccgtaattttgacaaaaaaaactctgtatcattacgcatttcccactgacgcattttccgagtcagtcagtggcttttgtccatgtgtcattcggacggcaccatttgccatacggatatggtgaaaggatgacatagagacaaaagaaagagacaggaagagaaaaagagacaaagaggagagaaacgagactttgatgaaaaacgaatttattaattgaactctatcaaaatttattttaaagcgctcgtatcatataattaggtctctgtttttagggttttttaaattcttttttttttggcaatttttattatcaaaatgcaataaaagataaaatgaaaaatcattttaagctgaagagatggccttttttaacagttttttttgttgtaaaatattaattgattttttttaattaaatttcaaaaaaatctttgatgaaattcaaatttggcttttttaaatatttatttcctttgaaaattaatcggacaaagagtttatgcggtacaatcaatgatcacctgatttttcggccatattttttttgttatttgtttaatccatatattcttggtatcaaacgaaagcttaaagtgtatggaattaacaagaaaaggacaatctgtagacttaacgctttcaatttgaaccaagaatgtaagttttgtccaaataagaaaaaagcggaaccgctcagttgggcgcgcacggttgggcgctcacggttgggcgccagcatgtttttccacgatagcttttttctttggcacccaaatccaaaaatcttggtatcattcgaaagctcttaacatgctctattagccttaccaaaagcaaaaggattttcaagcctggaaaaattttattaagaaaaaacttcaaaaatttcgactttttgcaattttcataatataactcttttggtaattgtctaatggctaagcaatagcttagaaaaagcttaaagacagattaagctttcgaatgataccaagtttatt

SEQ ID NO: 4784 - DNA, 2575 bp, Heterodera glycines
  misc_feature (2455)..(2455): n is a, c, g, or t
  misc_feature (2505)..(2505): n is a, c, g, or t
  misc_feature (2520)..(2520): n is a, c, g, or t
  misc_feature (2524)..(2524): n is a, c, g, or t
  misc_feature (2531)..(2531): n is a, c, g, or t
ttataaccgaggcgctctgtcataattaagttttcaagaaactcccgaaaaaaatattttttcgacactctcgaaaccaaattggtgctgtcaaagcaattagcgaacaaattaggccaattagtaatggacccagtcaataaaatttttttaaaaaacactcactccgtcttggagcaaggcttttccaccggcgccgcttcttccgccgttgcgtttgtttctttggcctccggcgccgtttcatcggcgctcgccaatttgatcagttgcaccgtttcattcattgtttctgtgacggcggctgcttccgcgcatgggatttgcagcttctccttggtgcccacagtttcaattgcgcacatttctttggaaggcggcgccgcttcttcagcgtcactgtaacacaaatttgaagtgatcagcccgactgatcggaaacccaaaaatgattccctttgatcatatatgcgtttataccaatgcaaattgattagattgaagtgatcagcccgatgatcggacccaaaaaattgctttttgccttttaccaatgcaaaactgattaaaattctttctgatcaggattagacttaaatttctttgaaatatgattgtgattggttaccagattttcagcaaaattttttgaaaaattagagaaaaaaagtgtcattctcttagttattgagcccatcattaggaagttaatttttcccgaaacttcgagtaatttatccaaagctcgaagtttgaagctcaaaaaaactcgggagtttcccaagccgaagccgaggtttcgtcaagccaatgaaatcaaaaaaactttaaaattaaaaatttaaaaaatttccatggctcttacctcggctcctccccgctgccctccgcttcgtcgaatgtcaccccctttttgccggccgctgcctcaggacaatttgtgccctgagcgtcctcccgcgccgtcacattgtccgcgcagcagccaaactcggccacggacgaacagttggagcagccctcgaggtaagggccggaggcgaacgactcgccgtccggacagcagccgaactcactgtcggtacaatctgtgaagtgtggcaaggcaatgtcaaacaagaacgtttcttttctttttggtccaaagtgataggacgacggacgaatcccaaatgcttaatgaactccgtactatctaattaaccctgggtgattgattataccatgagcctaattaatcctgcctaatataattaactctgaaaaattggatttattattctatgacacatggattaaccataaaatataattaactcaaggtgattggataaattattattgtttggtgaccacaatctaaataattaattaaccccatacgatgtaattaactctggacgattgattagtgcgtgggtccaaatgaacgctgtcgtaattaactctgggctatcagctaattaacccatacaaatcatattaactcagggtgataggattatctccataagcctaaaatgattaaattattactatattcaaatccatttccccactttggcatttgtccatgccgcactcctgctgctccgccggcttttccttctcatcgcaccattccggcaccggctttttatcgtagttcaggcagactactgtacgcgtctgtgtgccaccgtcgcatttggccgtacagttgctccacgggccggtgaaaaatgtgccggtgcatttctcctcgttgacgcactcctcccgtgccaccggcttttcctccaggctttggccacacagcgcttcatccacacgcttggtttggcccagctcgttgatggcacagaacacctgtgaaggaagccaaatgcggggggcgtttggtaccataatcgtttcgaaaatggattttaccaaagttactgtatcgcttacaacagtgtccctgcaccccgccctccctaaatttgtgctgccttccaaaaaaaatgttgtaattttttgatggtttttgagtaacgatcccggcaccgtcccaatcccttaatgttgtgccaccccccccccccccaacgaaaaaactaaaaacattgaaaaatttttatagtcaagggaatctcaaaaaacactgcccgagatagaaaaattcccagcactcgagaaccaaaccacaattttaaaacaaggtaccttctttttcacagtaaatttatttcgaaatagcaaaataaattttcgaatgttttcaattagccatgtctgtggttggacctttcgttgtttgtgcccatgtccacattccgtgctgcactttgaccattgcgatgtgtgccattcataaacgcaaggctaaacagaatgccaacaataaaacaaaaaaattttcaaatttgaatacttttgtttgaaaatgcttttaagaactgatcagaattattttttaattggtcagaattgngaaaatttgtgactgaccgcttggcttgcgcatggcctcgtgtcctccgnaattttggtgacttncttnccatccnagcacttctccagcggatactctcttccatttttgtctacacag

SEQ ID NO: 4785 - DNA, 4197 bp, Heterodera glycines
cactaccctaggtctgatcagtttcttgccatatatatctctgactctgatctgatcattcgtctactgttgatcagaagcctttcaattttcttttataaattatctctaatcatgtattctgatcggcatatccgctactaattacagtacgcgatctcccacgacagtaccctctgatgccgctacaccaccgacctgcttggcgtcgccgcactgggaagagcaggcggaccacgggcccgcctgccattccgggcatgaccagcgcgcacacggctgcgacatctccggccggggcagcccgcgctcctccgtgcagttggcgtccgacacggtcatccgtcgcccgtccgcgaacacgcggtggcagtacagcacgcggaactgcacgccccgatcaccgcaggtggtcgagcagggctcccacgcgccgacaaaccacctgaaaattgtgggaatgatcagaagcaggcagcaatgatcagcacagcacggcagctgtgtgttggcagggatcaagtaaactattgatttggatcagtctattgtgccgttgatcaatatttgataaagatagatttggcatgggcgtgagcgatgccggtgatcacggatcgactcagttccgtgcgcacgtttccgtgccaaggagttttaaaaaaccataacttttttctcagttgaccaaattctataaatctggtatatttaaaagtgcctttacaaactcattattaattcacaaaaaatcatatgattttccaaaatataaaaaagcacggaaacgggcgcacggaacggagactaaccgcggcgatcagtattgattttgtcaacaaaatgatcagttagtataggataatgttttattgatattttgcagcactaattacttactgctgatccgaaaatagcaccaaagtttgatcaaagagagaaagagagagattaatgggataataaaatccagcgacctgttaatattttcctcatcatcaaatgatcacgaaatttgatccagctgattgtagtttctgccctaccgtaccctttacagtaaatccgttacaaccacttactctggctggcaatccaccgtagtgcacttcttctcgaattccggcttcgtcgcattgttttcatcgcacaatgagtcgtccaggcgcagttgggtggccgtctcggtacagtacagtgcgcgagtgtgaacaccttttcatggtacagcattactgtatgccaaccatttcacaacaactcccattgcctcccgtttcccctcccttttttcttggcacccattgcctctgtcttttttcttggcacccattgcctctgtcttttttcttggcacccattgcctctgtcttttttcttagcacccattgcctctgtcttttttcttggcacccattgcctctgtcttttttcttggcacccattgcctctgtcttttttcttggcacccattgcctctgtcttttttcttggcacccattgcctctgtcttttttcttggcaccaattttcccctttttcgtggcaccccattttttgtctaactgttttggcactcgactgtttaggtttccatggtaacttgtctgtaaccctcccattcttggtaggtatcattttgccctgttgtattcgtcttggtacccatttgtctgattggtcgaaatctttggcactttttgtgcctttgtccgtgtgccatttctatcccatttttttacctctcccgcatgtcactgaacattgtgaccattcgcccggcttgtacaaatacttcacgtccttctccaacggcaccgaatattcatatttgaccgcactttgtttggcgccggtccgttggagcagcagcgaaacggtgacagattcctgataaaaaagcaagaaaaattactgtaccaaacggtactgtatttggcttactatccttaaattaaaaaattatcaagcgtgaatttttttattttataattcaaagattactgtgcatagtaagtaaaaaaacaactaaaattcaatgaaatatttacagtatttttttcaatttgataccatgaatactggcatactgtattttccaatgctgtaaaatttgtataataaattggtattttgtgccactcccccaagacatagcttcctctcatttcgaggaaggttgaaaaatgggtcccgtcggggactgtattttagaaagacggtattgttttgataactgtacttgtaatggaccgttagctgttagccgctcagtaccaccgttgcccttctcatatttgaatgggacaccaccagccaaaatgttcttgtccaacacttggatttggaagttgccgttcaggtagaagaagccggtggcatttttgatggctgaaatgggcatttcattgcatagaatgccacggtaggttataatttagcaatggtaaaaatttaaatttttgaaatttttgaaatattattttgacttttttaaaattttaatcgcccataattcttcttaaaatgattgaagcagttcaaattttaactggttagtaaaaagacaaggaaaagctaatcctaaaattgttttcatttgtttcctttagtaattaattaaaattaatggattttcgacttttttaaatattcttttttgcctctttttgagctaaaattttcaaattaacaaagagaatcctacgaatggcacaaaagtaccaaaataattatgcaaaaaatgtcaatttggcattttgagtaaaaaaaaaaagaacaaaaatggcacaaaatgccatttgcggacacatagagaaaaaatggcataaaaggtgacatttcggtggctttgggatgccgaaaacttttaccgaacacattgctggacgggcgcaactcttcgatgtgaattgcggtggcgccgacgggcaacgcgatgatgtcatgatatccggaagacagcgcgcgttcgtcgaacagtccctccaccgttttgcactgggagccgtcgccttggcaaacgccgcatttgtcacgctttgcttctgtagtacaaaaataaagcggtatacggcaaacatacatcagtgtgatgagtctcagtgatcagtaactaccgagcgagaattgatgaaaacccaattttgttgtattaatcggtatgatcattatttgggatttcgctgaacagtgatcaaaaaagacttttggcagatcattacataagtcatttttgtgcagtttataccgtacccgagcccaatttgccgtcgcatccgaccggcaggcaaatgccgtccacgcaaatctcttcgccgtaggcgtcgcattttgtgccgtcaatcactttctcggcccaattgtagtaaaagctgtcgccctccggccgacaggtcaattcgcatttgtttttgcttgtgtgtgggacccactaaaatttgatttattttttaattataattattgataataattttatagttctattaattggaatgaaatataagttttccaatttattttgaaagtcagctaaaaaacaaagagctttaatttcatttaaatgttttaataattttgagttttaatcaattttaatataaaattgaaaaattaatttaatatttaattttaaaaatctgttaacctaatggaaaatcaaattagatgtatttctaaaattaataagaaatatttaaaatgtttaaaaatatttaaaaaatgaaaaacagaaaattctttaaattttttacatttctccccatttctgtaaattaaatacctaaaaaaataattaaaaataattattttaaattccgcgcctcctattaccttataatatttgtcggccactgggtcgtcattgtgcgccgcgcactgttcggcccggaaatccatcgcatccgctgggcatggctccaaattgcaggaaatgtagcgaattgacgggcccgcgcagtgtccgtcaccgctgaaatttcaaaaaaatttattttaatttatttaaaatttttaaaatttaaacccgcaaatgcgccgttccgtgtaaacaccgccgccacaagtacgcgctgaaaagggcgcaaaaatagtgtcaacaaattgcaaccattgagcgtgtgatcatcaggataagtagtgatcagccaggtggggttgttatatttatcctaataaaatcatgggggcaaacaa

SEQ ID NO: 4786 - DNA, 6627 bp, Heterodera glycines
atgaacatttgcatgtgctacaggtggtatgtcaacatggtgatcattggctggatgatggtcaacagtttgagttggtgtggctctatcttccggcaaaatttgacgagtcggagacaaattccgattttgtggtgggagttcggcattcaaaaaaacctcggtttgtaccaccattttgatggtcattgtcatcagatgaatgagtgacgagctcgagacctgtctcatttgaattgtgcacaacggttggttgagtcaccaaattttgtccagcaatagagaaattattttgctcattcgctgtatttgatgtatttcccatttcatgttttgccatccgtcgtttccttcttcctgacagttctttttgtggcatgatggaacagtttttgcagtttccaaaaaatgtttgaaaagcggctaaaaagagtaattaaattaataaaaatttaaattttaccgttaagcaaatcgtagaaggaattaacttttctgcgttccattgcgttttgaattttttcattcagttttcggttcttgctcagctccatttcaaccatattttgaaccttttcttgcaatttcgggtcttttttcaaatttttgattaaattttccgtttcattttccattttatttaatgtattctctatattttgcccttttccaatttcttcacaatatttcttatggatttttgtcattatttccgaaattgttgcatcaatatctttaccatttttaggatatacaaattttgttttttcgcaaaaccacaaagaaaaacattcctttgtgaatttgttgaaagaaacaaattcagaagcattcgaaaacccattaaatgatcccataaattcattttcatattcttggcattctttttcggcggtaatttgatggcttacgcatattaaatgcaaaaacaatgcagaaaagaaaaaatgtttgaattcaatgctcatttagcgttattattggcgaggaataatattagtaaacaatataattatattttagctttttcctaaataatattttctttattttaatatccattttcgttagaagtttttgcggctctgacatttacgcccaacatttacgcctttgtccaaaatcgggttgaaaattaagttttttcaatctctgatcgcgtgaaaattttgaaacaacagaattaatgctcctaataaactagaagaccgtatatcttaattttaatgcggttagactatcagggcttgaaaaaattcaactttgagtccgattttggacataggcaggcgcaaatgtcgggggccgcaaaagtcggggctccgtgctggtgaccacccgtggtgagccgaagctaaaaaagtatgagtgtggcgaagctaaaaaagtatgagtgtggcgaagctaaaaaagtattagtgatgggtgatcggaaggggcgggtcatttcagtacggaataaatgattttaattaattaatatataattattttaatttattaattagatttgcagaccattattataatgtcgatttattatttaatatttcccaaacaaattacatttttatgagagaaatatagtctcttacaccaacttgattagatcactccttcctagtgacccggacacttaaaagacactgaaaatcggggaaattttcgaaatccatagggagttgggaaattttttctagagaaaatgggcaagccctctggaaagagcacaaaatttgctaccgaattgcttttggaatggtgggtctgcgatttgtacatagaaagtaatacttggttgaataactgatcaccataaaaatgatcaatttttgaccaatgcccataactttttgtagaagcatccaaattaaacaatattggtatcttttgatagccctaagtttcctctatttttctgtaaaatttcaaaaaatttcattgtgtttcaaagaagttgtagtcaaaaaggtttaccaaaattttttttgaaattttacataaaaaaatagaggatactttaggctaccaaatggtaccaagaatgattaatttggatgcttctacaaaaaaaatgatgcattaaatttatcaaaatattacatgatcgtgtcttatttcgtggtcgtgtaaactgaaatagagccagatatattttattatttattagattattaattaatttctaattaactgttaatttaattaataaaatcatttattccgtactgaaatgacccgccccttccgatcacccatcactaatacttttttagcttcgccacactcatacttttttaaatggaggaaattgagaaaataaattaataaaaaaggatgcgttgggaaattatataatatgagatgcttaaacaacgaattaatcaatttttgacatgtcacttgacgattttatgtaaaataaaatgaaaattataaagaaatggcagtgtgtaggagaggaggccatcaataacaaaattggtggtggtgaaatggaaaaagtggggaaaagacaaatcaacattttaattatatatatgtttacggaaattaaaaaattgacgttgattttttatttatataaatatattacacataaacattaataccaacgccatttttatgggtttttattttaatgtgaaagaaaaatattttatttgttttgtatgcaattgaccatccgccggtcgcctcccgccgtctctccatccgccgattactctgttgtttccggttgtttttaaaattagttttttaactctattgaggcttttttattagccagagaggcttttggatattgcgagccctgtttctagcccgaaaattcttagtttaacgtcactattcaacattaactaagaatcactgtttgggacttttcacaccaaaacgaaatttgcgcctcgacacttgcgccaccaagaaaaattggacatttgcgccgctcagtaaaaaaacatttttttaaatattattaccatttgtttagaaaaggcataacatttttataaattttttacaattcttgaaaattattagagcacaaccagaatttgatccatgcatttcattatttcacgatattctgagctaaataaaatcttttaatattatgccgtcagatggcaaacaaataatcaatatttatttggagcagaaaaggaagacacaaatttagggaggaatatttaaataacaaacgaaggaaaataatataaagaatgcacgaatgacggagaagggtcaacctaggggttttttaggtacgtagattccgaatctaatatttaatttgctctaattctaaccctaaacctgaattcgaaagacccgaataaatggatgaaaatcatagataaaagtatatagaaatgaaaatctgagattggattcatgatcagcgaactcatttacccatagaaaaatgtttttaatattaaataaaaaattttggatcaaaataatttggtggatttttgggacacttctcaaacgacaaatttaaggtgcgctgttgagcgcaacccaagtatttggcgtttgtcgttggtttcaatcacaattacgaacgccaaacaacaaacgccaaatttcagacgacaaattttttaattgtgattggagatagggacgtcgtaggaaaaagaatagtccaatgggaaaggggaattgtatcccaaatccaaaaccaaatcgccgtctcttttcactgctttcttttacttccaattaataaaacagcacacagccaatcaattacaaatttaggaagagcacatatatcacacatactccaaccaaaacaaaataaaataaagggtcacaaaaactaaaacaaaacgccaaaataattcaaatcaacaatgatatgacatcctcgccctctacaaagcgatgtcctcagcgcttcaaatccatcggcagggcattcggcttccaaaaggggcagtaaggatggacaatcagcagtggcacagaccaacatcataatttgacctgtaaaatgtgcggaaaaaacgaaaactacaattttgaacaggcctgatagcgtaacttgacgcagatttattcgtaattgtgccatcaacggctgacaattttcgttctgtgtcggctttcaacaacttcgtcgttggacctgttgagtcggccaattcctccccagccttcgaaaaaacaattgtcctcaattggccattccctttcggtgttttcactttgctgttgattccgttttctttggaattttcccttttcctcaatttttcaaatgcaacattcaacggattccataatgccggcaatttcgagctgctactagccgtagagctgattcggcggctatgagttttagcctttacattcgaaaacgcgttggcaacaaccaaaaatgaagcaaaaagaccagcaaaaattgttgaagcatcggctgactctatcggtttctgcgacaaattgcgttcgtttcggccatcctttgctcgtttaggggcggagacttttgggaaaatttttgctctcggtaaattgtcggtcctaattctttggttctctttttgaaaattcatattgctgttattttgttcaaagccgcattttttccaagtgaatttgaccttacaatttcgcgcgatgtggccaattttacggcagttataacagacgcttttatttgtcggtcggacgtaaaatttttcccaatcggtggtcgtcttttccaccttatttggtttaaagctgcgtgctatgtgtgcgttttcattctctgcaattgactttgcggctttttgcgctatttccgcacgcacagccaacgcgaccaagctgtcgtagctcaaacccggacgacgagccatttccaatgcaatcgaaattttggcattttccaaagcacgaatgaagtgttttgccgcataatcgttgtacaaatccaatggcaaacctggatatgcacaaagcacaagttggtaaactcgttctgcaaattcttccagattttcgcctggtcgccgttttggtccatcccacaattcgttgaatgcttgaattgcggtacaatcccattcgtccaaaagtgactccatttcgcttcgtattgcatcaaatttcgccggccgattcactgcagcggcgctgaaagcacgttccgcctttccacttacactcgagtgctgaaattcggcgtttttctggccattcttcggtagctaacgaaaattttttgaaaaatgtccgtatttgctctcgtccttcatttccatttagttcgggaagtttttccagagtgaggagaaattccaaagaacaaatttgtttttgttctttctcactttcgcatccaccattttgtaatgaaaccaaaaagttgcgattgtctttccaattttcctcggccgaattttgtgttgagaagaaattgcatgttgaaatgggattttcgtttcccggttttgaagtcagtttttagacgaagttaatttaccgaactgacaaatcgtgatttgtttcacactttacggcttttccttttcgaagttgcgttttttttttatatgcagagggatttagttttcccgttttactgatttcgtggccacaaccaatgaagaaacttcattagggatttgtttcccttttccagagaccaggatttgcttttcctgttacaaattgcagaaggatttacttttccttttaaaatcgttgctcgtccaaatttgtcgtttattgccactgctgagccacctttgtacaggagcgccacgtcgtaggaaaaagaatagtccaatgggaaaggggaattgtaccccaaatccaaaaccaaatcgccgtctcttttcactgctttcttttacttccaattaataaaacagcacacagcaatcaattacaaatttaggaagagcacatatatcactagggttgtaaaatatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaacccta

SEQ ID NO: 4787 - DNA, 2499 bp, Heterodera glycines
aataagaaaagaaattccgaatgcgtcatgcgacataacttggtctaaatttttcaaaaaataacacccaaataaatgagtgagaattggtctcggggatacgacaaattcaaagcatttttaagccgagttttcctcattactgcttggcctttgttcaggcaatcatccgcgaccaaatagcagaaaaagcgatggaattggaggaattgggagctgatggactgctcgcttttccacctaccttttcgcttgatcaccaaacggaccaacgacagaattacgagtcggccgccaacacaccgacgagtgacgacgactcggggaccggcactttgtcgtaggaaggagacggacgatctcaacggcattcactttgtatcactcactcatctctctgtctcttcgtgccttttttgtaatttattcgttctttttttgtttgttttttaatcttaagccttaatttgctttctctttcttttattttgatttattaatgtacaatgaattaatctctttttacttaaattgttctgaatctgaattcaagttctgctcggactatgtaatatttccaatagtttttttacctttttattatttattttttgctaatttccatcagaaataaatgtcagacgaaggtcagcagttgttggagtccaccttgcgcaatgtgttggaccagcagtcgcttcgatggattttcgttggcggaaagggcggcgtcggaaagaccacgtgcaggtcagttgatgtggatattacaaagaacgcttattgtgcgaaaatgatgccttgaattccgtcaaaatctcccaacttttaattaccatttcgaagtgccaaatttttagttgctctttggccgttcagttggccaaatatcgtcgcaatgtgctgatcatttccaccgatccggcccataacatttcggacgcgttcaaccaaaaattcacacggagtcccaccaaagtgaacggcttcgacaatttgttcgcgatggaagtcgacgggtccaatttcggggaccatggtgtgcccaatttgggtgacgaggacgacaagtgtactcacttaccaatctgtattcatttaattcattgtttccgtttttcagctgatatcttttccatcggaaagaactttttggccgattttgctgccggacttcccggcgttgacgaggccaccagtttttctcaaatgattaagtaatgtcataccaatttgctattttttcactaattgggttccaattgaccattcaaaatgtccattttatcgcgccctttcagactgatccgttccatggacttcgaagttgttttgttcgacaccgcacccaccggtcacactctccggttgctccaatttccgacagttatcgagaagggtctgtccaaatttctgaaggcgaagacgcaatttatgccgatagtctctcaggtggttttatgattattattattgtaatttggtgtacgaaaaacagaaaggtaattgctctaggccaataatctgtgattgtatttcatttcattttcttttaaagatggcaccaatgttgggtttgcccgactcgactttggactccacgacggacaaattggaggaaacgcttcaggtggtacggcagatcaaagacgaatttaggaacccggtataattttgaattgtgtgtaaatacgataagaggttctttaggatctcaccacatttgtctgtgtttgtattgccgagtttttgtcgatgtacgaaacggagaggctggtgcaggagttggcaaaacaggcacttgaacatttattaaatattttttggaatcaaagacgaaatgtcaaaatgaaaaatccctaggaaatcgatgtgcacaatatcatcgttaatcagctgctgttccccgacaaaaattcggacggttctgtcagctgcaaaaagtgcctttgtcgtttcaaagtgcagcagcgttatttggcacaaatcaccgaactctacgaggactttcacatcacaaagcttcccatgctggacgaggaagtgcgaggccccgaaaagatcaaacagttcagcgaaaggctaatcaccccttattcttctgctgttgttgttgaggatgacaaatgaatgcgtctctcttttctgctgcttgtgaattgatccttttgttgttctgctctgatcacaatgtttggtgatggatgagttggcgtaacgttctttgagaatatcaaaacattaaagtttattccctttatacacaccaatttattaattacctttctttgttttacttttgttggactctttctttggttttgagagtggttgtttttctgctcattgtcagaatttatttgtgtgtttttctccttgggctgtatttttttctgtttcccgtgttttttacgtataaaacattttttgacaattttaattgtactttttgctttttcattaagccgtgttttatcttctcacaacctcctcgttttt

SEQ ID NO: 4788 - DNA, 2872 bp, Heterodera glycines
tcggttcaatggcaccgcgggttgaggtcccttttttgttttgtttatttatgtccaatcgatgagcattctctactccctcccccggtaataaaaatttcgatccattttttgggtttttattgaccatttatacctatctttttcacacgcagcttctctctgtctctctttttcctccttcttcttccttttcactctcttttctttccctctctcccacttcgtccctttcacgtgcactattcccctctctctttgtctgttggtcacttttgattcgtttatcttccccttttcagcttcctctgctcgttgacatcgttaagcatcgtcatgagctgaacagcaaatccacggccatccacgcgcttctgatttctcccggacaaacgcgcattttcgacaaattcgaggaggtgccaaattacgctttgggtcggtgagttaattcaatgcctccgaattttagaatttcacacttttcagaatgttccgccaccgaaaatgtcgtcgttcttttcccgtcaaagaattcgcagtccatcgcccaatttgtgcgtgaaaatggcccccttcaccgtatcgtcgtgctcgactcgacatggaacaccgtgggacaactaagaaacatggccaacatcgccaaactaccgatggttcaccttcgacagtacacaacggactactggcgaccgcaagtgggcgaatgggggggggataaataaataaatgaaaaatggacggaataacgacggaagggctcaaaagggagatgggggggggggcagagtctgcgtttagtggccaagttttaaggtccgcttttcaaaaaaatggatatgagagggccgcaggcgccgtcggggataaatttcgtttatgaatttcttgaatgtaagaaaatagccaaaacagtatttcttgaaaacgagtccccaggggttttatttttcaagcccctcaaaagggggctctaattcaagggggatatttatatgttgcgtatgttttggttcttttatgattacggtacccataatcttaatttatttttcccatcattttcccctgctaaaaaggaatttttttgggaatgttatgaataacataatgcattgcattacattaaattcaaaaattattcttggcgtcgcatcactttaattattgatcatctttatcacttcagaatggtctttcagccgaccatttggccacaatcgaagcaatttactacgcatgtgtggaaagtcaggaagctgaaagggaatggaggagaacggaggaaaggaggaggatgggagagggggaagaaaaggaagtgagagaaaatggaggaagcgaagagaaggcggaggaggagcagcaccgcctggacaagctcctcttttggttttacttcttccgcaaaatggtgcccgcgaggatatttcggatgaaaaaataatgtgccaaagtgcgttgtgcccttccctctgtttggcttaacccgtggcattatctcctctcctcttttgttctgtttttcactttttgttttgtcataaattgtgttttcgtacatttgtcactttctccgattgttttcgatgctttcgatcatcgactgattattttcttgttttgtggctttctcaatcattggcacattttccgcttttgccaggtgtatgaggccggacccgactcagttgaggaggtaccagttaagtacagcagcagcgaacggcgtccccgcgggtgtttttgtcggcagtgccaaccgaacgcggcgacagtggcgctttctgctgctgctttccgtgcttttctccgtcactttcaccttcggattttggacttttcaatctgatgggtccatcttctcgccgccttaccacaagttggagcagttcggtcagtgattggttggcttttggccgtccatgtttgactaattcgtcttcgactgatcgttgtttagtattggttgaagaaaacgtttcgacctcagcatggaatacaacagcgcaaagttcgacaacggaagggacgaaagaaccaaatggaaatgacgagggaatttctgaaaaaatggcaaaaacgaatcggtaacgttttaatgaccgattggtcacatttttgactaacattgaaattcattttgtactttcagttcctatgaaaatttcccagtggaagtgaacggaacattgtcaaatcaaattgaattgctttccgtaacttatgcccaaaatgccactgaagttgcgctaaatgtctcttcgtctttcgcggttcccccacggcattccgtcgccgatttgcccgcgtgcgctgaccatcccccgggactgatcggtcccattccggtgtggatggacgggccgggatttgagacgctcaacaaattgtacccgcgtgtgaggcagggagggcacaattggccggacgcatgcgcggcacggcatcgagtggccataatcattccgtacaggtggaaaaattggggatagaaagggtgggcgaattaacaattgaaaactgctctgatttacccaatgcgttcgattatattcgttttctaacttacggttttaattttttttttccccgagaaaaagataaatttgtagttttttattgaaaatttcagggggaggggggtgtgggaagtacaataagggggaaacagcggggggggggggcgaactgttccctgctcctcctcatttgttttgcgctgttcagagaccgcgaggcgcacttgcgcattttccctgcacaatttgcactttttgctgtccaaaacaacagatgaactacgcccatttttcgtccgttgaacaggttgaaaaaaggccagaaaattggaaatttttgcgatcac

SEQ ID NO: 4789 - DNA, 2031 bp, Heterodera glycines
cccccccccctccccgccccctctgggggggggggggcacacccggcaacgccgacggaaatgcatcgattattccgtcctttcggcaatgtcccatccatctctgtgcgactgtttgcttctgtatcatcactaaacttttgcctcgtcgccatcgacagccccatccctcccccctctatcgccatcccctcattagcaaagccgtaaatgatatttattcactcaattgtttttcgaggctaacaataagaaaaagaaagaaggaagacccagcagcagcaaatacaacaaattcattaagcaacttcaattcctacaacaaaatggacgtcgtttatgccgtcgtggaaggttctaacaaaatgaatgggcaaaagagataaacgggctgaatttagaaaagcatttcatccactttacatcatttaaagaaatattatttaggtaaatacaaaatttgatgttaatatactttgagagaaaaatgggggaggggagggggaaaatgaatgaatagtctatttaaaataaatttattcaattcgtatttcacaagcataagttattaggtgcgcaattatttattccgttcttcgctatctttgtgcttttgactgttctttaccattacaataaaagtggacgattgctggatggagaaaatcatcggatttttgggggagaagcggacaaaagagaggaggaaagaagaagtgatgaagaggaagaagaggaagcggagagagaagaggaggaggaagaagaagagaaggatgggacaacggaaggtgaacgaaaaggacatagaaataggggagagtgactagagaaaaggagagggcagaagaacgggcaaaaaataaatagggacagagaaaatgagaaattggcataatgcaatccaagcaaaagccaaccctttccccccccccccccggtgattacgatgcattcattgctttgttcagattattatggtgctaataatggaagaaagcaaaggcgacagaacgacaaggaaaagtagggaggaaaaggacaagtgacagaggaaaagagagaaagtgggcgccgtgaagggagaacataaggccaaagtgaaaacggaattaattagccattgtgcctgtctattgcatacaaaaaaaaagaatgccaaagaataggcaaatgatcaatcgaattgcgagtgatcggaaaagcgtacagagagaagggcaacggcactcgcgaattgttgtggcaaaagcgagcgaaagttaagggcgccgcaaatcatcccatcagcagggcattgctattccgactgcaatttataaattgtaaggccaagctgaacgttcattcgaggggaggggagtgaaaaaaaaacgaaaattccattgtaaggtgtcaaaagtttaactgcaatggacgaaaaacagccccacttttgtcaccctttgtactgccattttccaccagcacccaactcactgttcgatcaccgaccgaacccatgcggcgaattcggcggtttcttccattctttcgtgccgtttgtagaaggcgtcggttgccaacagcgccagcgttgccctctccgccacattctttcgcagacaccgattcacaaagtccacaaattggtcagagaaaagtccacgcggcagcacgggagggggctgaacagaaaacggtttcgggggggggggggggggggggcgtcggtccctttgcttccaaatgactcactctgttcacaatgtaatccaacagttcaaaaatggccattgtcttcggcgttaggtcgtccgccgtctgttcctcctccgttccgttcttttccattttcacatcgttcggatggaccccgaaaagtttggcgtactctctgcgcgacggggccgggattgggtagcggccgatgacgagttcaaccagcgaaagaccgaaactccaaacgtccgatgggacgctgaaacggggcgcccggccaaacgttcgggctgaaaaaaagggaacaaatgactttcaaatttgcttttt

SEQ ID NO: 4790 - DNA, 1394 bp, Heterodera glycines
atgcaaatagaaatgtcattgttggtggtgaaagcgccgtaaaagcataaacggacaaaggcatgtgaaattaatggacattcaaaaccccaattttaagaaaaataaaatgcaaaaattaaaaaaaaaactgaccgacaatgtacggactgttgcatttgtgcagcacttccaactccttcagaatttggttacgcactgacggcttcacctccaaatggaccaatttgcgggccaaaaccacgccaccgccactttttgtgtgccgcattttgtgcacaacgccgccgttgccgtggccaaggtcgcagatccgttccaacacatcgtcactgagttcgccgatcttcaattgggaaatgagttttcaaaaagcactatggatatgaaattcctccagtttgctttggtcttgaattatgcggatgcttaggctacctacataaagcccattaatcggctaattaaccgcgttgtccttacgccaattcgtccctttgcgttcgccgacattcacccatttccaataggccgtgtcacttgcctgtttcttcaacgttatccactcgtacattcgctgctgttgcgagcctgacaaattgagcgagcgcagtttcgagtccaacgacgcgtcggccgttccttccgttccgactccttccgtcggcggctgtcctccgacccatgcgccatcggcgccgaccgcgccctcctcattgacagtcggcggaaggctcaaattgagcggattgcgtcttttgctggacattttgttcatcgaaaaaataacactgacaaaatgcaacgaaattacgagaacgaaaatcaaagaaaatattaaataaaatttacaattaatttaaatgtcaggaaaaataatgcgttttctttaatcttttattttctttttatatacaaattaaaagcataagacaaaaaattggttgtttcaattatagaaaacaattagaataatcaaaataattgagaggtgagttttcgtggggaaggccctgcagaaaaaagaaaaacgaacgactaattaaaaaagaaaaatatacaaaaaaaggaaaacgaaatgggaaagcaaaagcaatggaaggaaaaaaagcgttgaagagaatggcaaaagggtttatatggcaatttgtcgcgagaaaaacaaaaggaaaagaattgcaaaacggcaaaaagaacggagcgattgctgggatttgtcaacgtcaaaaattggaggaaagcggccaatgggcaaccgatttgactgcacaaaagagggcactgtttgccgtccgttttcgcttccgtcagtgtggccgagttggcacccgaattggccttccccccgccgtgaccgcgcgaaaaggaaagtcgcgccaaaaagtcgccgtagc

SEQ ID NO: 4791 - DNA, 1896 bp, Heterodera glycines
aaaaattttcgataaataggaggaattgccctcccatttatcattcaccatgccattcggcagatcacctttgagcgatttaactaatcgctcgagtgaaacaagacctggaagacacccagagtcaactggacaagaaaatttggatccaagagatccaagagaggaggagaacccttctcttacagaggaagaaattcctcttgaacacccaaggaattgggagaatatgtctgaactcagttcagactcaccgacttgggctggaagagaggacagcccaatgtcagatctctccgacagaacgtggaacccaccacgttcaatctggccgagggaccggagagaaccattgagttcttggtttcctcgaataatgggaaaccattggttcgaaagagaaaggcgatcagcggaagcacttctcagagattttctgagaagtggggcctttctccgaacaaatcacctcaccacaaatcgtgaagttcactttgatggactttcacgcagtggggctgagcgaacaccgattttccccggaatgtctgttcaaagacattttgaaagacgggggattaccattaatccccgtgtaccacttgtccaggaaagtgggggattttcgcccaacagaggggacatccacatggactatttcccgacagaggtagtagacctctgttacttcggagaggaggaaaatatcctccgcgccatgggagtcccaacaaacggctccccttcacggggaggtcaatctccccctcaaagagaaatgagaccgagagagaattctcggaccatttttgagcctcgaagaggtcaggagggaggcccttcctcttcctttgttcaggaaaggggaaggggaaaccatcggcaggaaaggccgacaaatacgatctcggcacacagtccgagtcgtattccgacaatctttgtcatttttttaatgatgatttttcatcaaaatgtaatggcaaagcattacatctcggaatgctcaacctttccgcaatttgcggcaaagcatcctttaatagagatgcgagtgcactctatgaatcaccaaattcatcgggaagagatgaacaagctcctccctcaagaatgggaaggaggaaaccagtcagtatttaaggcactgactggagagaagaaggatcaattgaaattaattgaaatgtcctcctcctcctcttccccttttgctccatcaatggaagatggagagatttctgagtctccctcagaaaacgaaattcctctttgccaaagagggataaaaaatgccaacaccgagctggaagatgccaccaatccggtgggtaagagggtcaaaaggcgtggaaaggatttggaagccctagggcttatcaacgctgaggccagggaggttccggaaaggaagcctccccattgctcggtctgtggcctgagtggccacagaaaggggacaaaaatttgtcccttttactccagcggagggcagaataaactccgaccttccactcctattcaggaattggaagaggagagaattggccgttcgaccaatcgacgagcgttggccgctcgaaagccttcgccaaaagtggctaaaagagccaccaaggagagcagtttgtattccgggctgccacgcccggatacctctggcttagtccgtctctcaaaggatggtcaagcgggcaccagcggtttccgggagaacccggtggttcctctgagagaggaaatccgcgggctgcagtcagccatcgacgcgctgacggaggaagtttgtgccctccgtcgggcaatcccccctgtgcttacagggggaaacgcgactccactggggagacgccgagagcgccaacagcgttcttcctcgtcggaggaagaaccgaa

SEQ ID NO: 4792 - DNA, 2171 bp, Heterodera glycines
aatccattacatccatctaaagacaagcagcttttatctattatatgtgaacgttcttgcggcaacaaaatttccttcactgtttctgatcagtgatcactcattttaaccaaacattgccgaagtaacaatcattagaaaaccagtattttattgtggcctttgggcattccgtcatgtttttgaagcaaagaacggaatttaaaccgattgaacaatttggataaagacaaactaaaattttaataattgtgaaataatttcaaacttttcgaattaacacaaaataaaacattacttatttttaattcgtgtttcaaaaaccctaagattttcaagatatttttaaactgctgaagtttgagaagtaaagtcataatagtgctcggccaaataattttttacggctaaaactcgttgaaagaaaattctgtacttcaaggattataatctcgcaatcaacctatggatcagtcaagattttaaaaaatgagaacaataatgatgacagtacaatacgaaaaaaaaatcgtgattcaaaatgtcgctatgccgatttctgaaatggcattcaaaattgtagcctttgggcattccgtcaagttgaaatgcacaagcatgcaaatattcccacaaaatatatgtttttttttatttctttgaccatttttattttcggaagagatctctgaatttttatttcctgttttacttctcttagatctttttttattttgtcatgtaaacctttttttgaaggtgaaacaattagtaaatttattttgattgtctgaaaaaggcacagtacatacacttaacagagacttgccgtataacaatgatccaaaatggtctcctagtaaatactgcgttagtttctaccagattgtttttctacagttttttttcttccaatcaccaatgatttttttttccccgtttcaccgaataaaaccgatgtacccattaaaaatatgccaagtccgtccagttcagcaaggttatttatggcgaaggtattcttggtaaaaattacagcccattagattataggaagtattaaaaaacttgataatttatcaacagactgtaatgttggcagttgcctattcgacggtttaaaatcacggtcttcggacattccgtcaagaattaatgagccgaatctcatattgatactcataacatcacataattcaaaatcttaaatttctctgttctaaaccaagcagtcagaaatgatgcctcaagaccttaaccgaagaaaatttggatgaagaaaaagtttattttgggtactttctaaaaattcaaatcgatgtttttctttaaaatattttatttatctcaggctgttttcttttgatttagtcatgcaaacttaattaattttattttaattgagggagaaataaaagggaggaaggctcattcggccatcagcagccgactcttcgtcttgcccaaccagtggcaagacactcggccatcagcagccgactcatctagcctaacccaacaaagggaaggctcattcggccatcgccgccgctcattcgcctaacccatcaaagggtaggctcattcggccacccacggcctgttttcatggagcggaatgtcgacggtctggtgttgtcaaggatgtcggctgcacgcagaaactcgttgtcgttggcgatgtcgatgcgcaccaccttgcgttccttcagcacatccttggtcagaccgagtgcctgaaaaacgaaacggaaaattgtggcataattaacaattaattagtaatgatgatgatcattccatccatacattttttgtggtgccgcggtcgctcaagtgcattgtttcaatccgaatcagaaagttgtccttcatatagtccgggttggtcaccaccgttttgcagtacggaaaggcgttccacgaccgttcatgcagcgtcgtcgaacctcttggcataatcgtcctcagaaaagcaggcacttttctggagaaaaaaaagacgaccaaattagcattaattacatttccacccctccctcgaaaactcacgtatctaagtggataatttttgtgcgtgaactgtcccggacgggaagaggccatttgaacagactttgggccttcaaagggctccgatgcgaaccaattgaaacgccttcaccaccgcc

SEQ ID NO: 4793 - DNA, 1493 bp, Heterodera glycines
aagcacataaacagcactcctcgggactttgcgcgagtttcgccaacctgtcgcgatgcctcggccacagaaaacaattggccaatttgatactcctcaatggtcaacggcatgacgatgcgactgaaaaaaggaaagcgtaattaattaaggtgtcagaagaatgatgatgaaaaaagcaactcactattctctgatgagcattgttgctgaagtgcagtcaaaaggggaacaaagtgaagaaggagacagacgcttattatgtcagtaaaggacaaatgaagaatgattgtttctgcgcttaaatcgtcccttttatacaaacattttcctacccgtcaattccgtgtaaaaattctctataaaaagggatgaaatttgcgtgatccactcattcttcgcattggcgactttcactctctgctgaacaatttcttctctcgacgacactttgcgcattcaatccgagcacacttcttcacccattggctggtcccatgtctctgcaatacgtcggcatcgctgcggtaatcctcggaagtaagtgccaaaacaattgttattaatccatgttgatttgctgctaatttatcgccatttttcagctgccatcgctctgttccaaactgtgtcgctcagcaccagacgacaaatcgccgcacaaaatggccgaagcagcagcagcggcagcaaacgccaaagcaagtcgccgtcgtccgcaaaaaccttggcacacaaaatcgctgcgacggtcatcgctgagaagagcctgagctccatcccggacaacgaaatcttgcagctgatggacatcggctttcaactgctcgacgaggtgggctcagcctggatccgggatgaccagccagtgcctctgttaattcgtgccaccactgttttcaggagccggcgcgtgttgatgtgcatgccccttgctacgttttcggtgacatccatggcaatttgtcgtaccttctcaagtgggttttggactcgtcgactcggctttttaacatttcagcggcacttgcaaatccgttgttgttcaggtacttctccgacacccacatcgaaccgcagctgctcaagctccaaccgccgctgttccatttgctgttcctcggcgactacgtggaccgcggcgagttcagtctggaagtcattgcgctgctcgtctcgctgaagatcctcttctgggacaagatcactctgctgcgtgggaaccatgagatcgcggaagtcaacgcggagtgagtgccattggcgaaaagtgccattgtcgtcattcaattccccttttcaggtacaccttcgaagaagaactgagaacgaagcgaggcaagggccatggccgcatttacaaggtgtcaagagctaccaaaatgaatgaatttttaatgttttttgttcccctttcatttcagaggtgcaacaagctcttcaccaagctgcctctgtgtgccatcattttcaaagacgttcctctgcatgca

SEQ ID NO: 4794 - DNA, 1081 bp, Heterodera glycines
ggtggattttggaggactgctgacacagcattttggtgaccgcttttttaatactttcactgtcattttcaggaccgcgagacttcaattcagttcaacgaccgctttgcgcaagagttcttcaaccgctttccccacatccgcggcatcttccgggcgcacgaaaaccaaccgaaagggcacagcatcaacgaggcgcgtacaatttgcacggtgttcagctcgcctcgctacatggaagacacggactgtggatctgtgctgcgggtgggtgctgcttttgccatgccatttttttgctttcaattccttttttttccccctcagctttctgccgacatgaaacacattcacttcgtcacgctgaaaccgaaggctactggagagaaattgagccaggaagaatgacagacgagcggcggaaagaaagaagccccgacgacgtaaatgaagtgctgcatattcaattcgatcacctcccatttaatgatgttgaccattctcctgctgttgcccgagtagatgtgataaataattgctccgttttatgctgtcccgatacatatttgaccacgtatatgtcattgttgtattatatgtgtatattgtatatatgtatgtatgtttttgtatatgtacttgttacaaaacgataaaaagaatgtttaacccgcaaaattttggaattccaatcccgcagcgggaccagggacggacgaagctcggcttggcactcgaagtcgaagctcgaatcgaaggccaatttttttcgaagctcgaagttcgaagcccaaaaaatcgaagttttcgaagcacgaagtttttcgaattttttttatgtcgaaaaatatattcaagactaaatttttaatacaccccctaagaatcgaccaaaaaattttttaaaaatacaccactaagaattggaaaattttttcaaaaattcttcccccaaattttttttcttgacaaaatttttgatttaaaaaatgtcaatatttgctaagagaattttataaaggaaatgtactcatttgcaactgcaatcagtgaataaaaattattttttgctcaatttttg

SEQ ID NO: 4795 - DNA, 5987 bp, Heterodera glycines
  misc_feature (41)..(41): n is a, c, g, or t
  misc_feature (5965)..(5965): n is a, c, g, or t
  misc_feature (5973)..(5973): n is a, c, g, or t
cgagaaatttcagtacatgctgggggtatggtctatcccgnttgtaccacataaattaaatttttcaaagaattattatgtaagagcattcgtggaaatgtatgaagcgttgggcatggctaattcagaacgttcatttgacgtttcaatggatcaattcaaaaatggatgggccttttttgtcatctctttgaattcaaccttagacgatagctgtggatttgagctgttgagaagcggtacaaccagtattagggccacatttgattcaccaattccaaagggaggagtggaaatgattgttctcggagaatttgaccaaatgattatgattgattataatcgacacattgtctccgactcaaagcttgggtaaattattgttgggaatgttcatttgctcatattttaaatttcccgcgcttttaatgctgaacatcactattattgatttcagccattttccctttttgacccgtccttaaaatatcagtccttcctctcagttgtcgcctcctccacacatcattatattttgctccttgactccgccattttcattctgactttcattttcatatttatttcttgtttgtcttttattttatttcttcaataaatttgtatttaaaagtaaaagacacaacaattggcgacgcctgatcgctttccagcattgctgtgaactcacccaagtgtgatctcaaggccaccttcccctaacccataacacaaactgtgaacctcccttaaactcgccaagagatttctcagtttcaagactgattaaaaccgagtgggggttcagttttgttggttaagtgagaaggagtttctcagtattttggctgagtaaagcctcgttgtgcccaatttttctcatttaaattttcatttcattatttcatttgtctcaatcattcatcattctctaaatggcgagtaaggaggagttgaaaacaatattggaggcgcaacaaaaacaatttttggagttaatgaaaactctcatgtccaaaaatgaggctccagcccattctgacttattttcaaaattgaattcacaaattccggattttcggtatgatccggaaaatgactcaacattttcattatggtatgaacgatacggtcagtttgttgaaaaggatggtcaagccctttccgacgacatgaaggtccggttagttttaggtaaactttcggccactgatttcattcgttatgagcaacaagtgctccccaaaaaaactgccgaattaagttttcaggaaacaatcaccaatcttaaggctttattttcagacacaaagtcagtgtttgttcgacgatttgagtgtttccagctcacgtgttctcctggacaggacgttctcgactttggggcaaccgtgaatgccaaatgcgagcgtgccgacatgaatttgtccaaggaggaaatcaaatgtctcatatttgtcacaggtttgggtgaaatgcaccgggacctccgtcaagaatgtcttcgacaaatggagaaggcacggaaagtgacaccgccacgcgacatcaaattggaggcattgttggaagaatgccgttcaattcaatcattgcaacactcagctgcggcgctcgcaaatcctggtcaagttcacgcaattcctagtaagccaaagattttgagtgatggtagagccaaaaattggcaatcaaattccaagaattggccgtcaaaaccaattcaatttcaaaaattttcgggcaacaattcttatggaagaaataatggttttcaaaataaacttgttaaaccacaggataaaaatgttgagcagcagaaatgtaagcgctgcgggcgtgctcatttgcttaaggaatgccgttatccagtggatgttcagtgctttggttgtggacagagaggacacatcaagacgaattgcccatcatccgcaaagtcaaattcaatcggagttgcctcaattttcagtgtcgctaactcgaaacgaggatggatttggactgaacttgtggtcaatggccatcctatcaatttggcagctgattcgtgttcggatttgacaatcattcagcgtcctgtttggataagtttgggtgaaccaaaacttgaaggtgctggacggttggtcggctcattttcagggcataagctaaaacttttgggtggtttcaagtgtaaggttgtattcagaggtgtcgaattaaatctgttttgttcagttgccgacacagacgctccaagcataatgggcctcgactggattgaaccttttgaaagacacactcaaatgcccatcgcgacaacattaaaggtcgtatctgccggcaattctgggcccgtctcatgcacaatccaatcgtcggatccaacgcagctggccaaggaagtcagggcaaaatttccaaaagtttttcagccaggacttggacggtgcaccaaaatgcgagcaaaattacatctcaaagaaaatgcaaagtcggtgttctgccgcgcccgtccggtacctcatggagttcaagaagcagttgatcgcgaaattgaccgccttctggaaatcgatgcaattcgcccgattgatttttcgaagtgggcagcgccggtgcttgcggttcggaagaaaaatggagctgttcggatttgtatcgatttcacgaccggtttgaatgaagccttggaacttaaccggcacccgcttccaagaaccgacgacattttccattcccttaggggttcaaaaatattttcccaattggatctcagggacgcttatttgcaattggaactcgatgatgaatccaaaactttggtcggaattaacactcatcgtggattattccaatatcaacgacttccatttggtgtcaagtcagcgccatccatttttcaaaaagtcatggatcaactcacgtccggtattagtggtgtttttgtgtatttggacgatttgatcatcgcttcgccgaacatggctgaacatttattggttttagaaaaattgttttcccgaattcaagattatggcttccgaattcaactcgacaagtgccattttgttcaacgcgaactcaaatttcttggccatattgtttccgcggacggcatacgacctgacccgagtaggtcagcggcaattcgtgaaatgccgcctccgcatgaccttggcacattacgctcatttttgggagcaattaattactatggtcgttttattaaggaaatgagagccatccgtgctcctttggatttgttgttaaagaaggaaaccccttgggattggggtccaacacaacaaaacgcttttgaacaggcaaaacgtcttttgcagtcggaacttcttctgacccactatgatccggagaaaccgatcattgttgctgcggatgccagtcaacatggaattggtgcgacgatcagtcacaaatttccggatggatcagaaaaagttgttgaacatgcgtgtcgttcgttaacttcagcggagaggaattattcgcaaattgaacgcgaagcgtagggattaatttttgcagttcgcaaattccatcgcatggtttacggtcgaaaatttgtattgttgacggacataaaccgctcttggcaatttttggtggtaagaagggtatcccaattcacacagcgtctcgtttgcagcggtgggcccttacccttgccaattacgaattttcaatacaatatgttaagtctgaaaattttggacaggcagatgtgctctctcgtcttatcgcagcaaaacggactgatgaagaaatggtcattgctcacgcatccgaactgcccgataacgacgacgacgaattggtcgagtatgttcatctcgccaatttggagccattgcccgtcactgccgatgaagtgagtcaaaacacggtaaatgatgaactgcttaaacaggtcatccaatttacgcgtgagggttggccgaggaaatgtccctcaaataatttaatgccatttttccaaaggcgtaccgccctttcggtggtgggtggatcccttttagttggcacgcgcagcatcattccgcaaccgctccggcaccgagtgctcacaacgcttcactttgcacatcccggtgttgtcagaatgaaggctttggcacgtcgacatgtttattggccaggtcttgaccatgacattgaaagtatggttaagcactgcgccgaatgccaattcgctgccaagcagccaccaaaagcgccgctccaaccatggccaacacctgacggaatctttgacaggattcacatcgattttgcaggtccatgtgaagatggccgcacgtatttgattttagttgatgctttgtcaaaatggcccgaaattgcccaaatgaattcgacaacagcaatcaacacaacggacgttttaaaccaaattttctatcgttatggttttccgaaggagatagtgagtgacaacggaccaccgttttcatctcacgaatttcggagattttgcgagcaaaagggtataaagcatagcttttcacctccttatgtcccgcattgcaacggtttggccgaacgaatggtagatacattcaaacgacaggccaaaaagaattcacaatcaaacaaaaattggatttctgatttccttttcagttatcgaacaaatccaagtcaggtgctaaatggtctttcgccagccgagttgttccttggtcgtctaccacgcacgccactttcaatcttggcaccgtcatcccgttcagagcctgtgcaccaaagtgcctatcaacgcaaaatgaaagagcaatacgatcatcaccatggagttgctgatcggaagttcaaaatcggtgacacggtgctcacgctcaattatggacggtttaacaagccttcgtggcttgagggtaaaatcatcggtggaaaaggtttgatttggcaagtccaaatatcatcattgggtattacggtaaatcgtcactcgaaccaaatacgtaatttcttccccaaaattcccgttttacaagaaaacgaagacacggaacaagtgcaggaagacgatcaaaccggaaacacacacgttccgagtccaccgcgacaacaagtactgccagccgaaccgcgtcctcagcgaaaccgaaaaccgccaaaaaaattggtgatggatccaaaagctggtggacgatatgcacttcaagaataggagggcaacaaaacttgaagggggaaatgttgggaatgttcatttgctcatattttaaatttcccgcgcttttaatgctgaaaatcactattattgatttcagccattttccctttttgacccgtccttaaatatcagtccttcctctcagttgtcgcctcctccacacatcattatattttgctccttgactccgccattttcattctgactttcattttcatatttatttcttgtttgtcttttattttatttcttcaataaatttgcatttaaaagtaaaagacacaacacgtccaaagaagctggccgaacctgcagattgtcataatcaattaataaatagcgtgaaatacgtaccatctagtaaaaaaagtaaattccgtatcaaaaaaaatatgtcaaaaaaagggaaaaaattttcaaaaacaaaaaaattatgtcaaaaaagtgaaaaaattttcaaaatggacctctttgcaactagcgccaattttccttaaaaagcagtaaatgtaaatcaaaatttcgaaaaagtacaataaaaattttgacatttgtttttatctcaatttggacacttctaaatacctataccgtattttcatacttttttagaatttcctatcttcaaaatgaagaagttattacataaattttggaaaaattcgttttttgagaaaaaaaattaatagcgctgttctgaaaaggttttttgaaaaacacgaaagtcttcctctataagcttctgtttattctatattcttagaaggcttttgaaaaaanagtacaanaaataaactgattt

SEQ ID NO: 4796 - DNA, 4206 bp, Heterodera glycines
attgcagctcttaatccgatgatccacaaatccttctttgccgtttgactttgtcacagttgtattttcacgaaaagaacagcatagcattaggaaaaaatttttaaattattttcggaatccatgtggatcagaatttcagcgggacaagaaaaaatctgggttggaaagttcaaaaaaactcaaaattattgtcgtccaacccaaaccagcaaatgatcattgtcattatcatcttaatattactttaataccgagattgaatccgaaaaagccgggaattgggggccactcatggttaaaatcccggcaccgcccgaccttaattgacgattatcatctctaacttcttcacaaatccagccaacacacacatattaacaccctcatatcaattcaattgaagcacttttaggcaggcatatcccagggatatatccctccgcctccaacaaaatctccgctcgatctcccatcagatccttttatgaggaagcaaagcctccctttttcgcccactcagttccattcattcatcccatccaataatatatgctgcacactcaaaaaagcacctaaagcattcccaacaaacaattaggctcattgaaaagcatttttattcaccccgcagggcatatacacatatcccatccatcatttcacagatccatccatctaaaaaaggctttattgtttcagaaactaccaagtatgacctcaacggagaaggcacatttggttggagagtttagcgagcaggatttgaggtcagaggggggattaggaaaagcaattaaaaaatgaattttacaaaaaaaacaactttttccctcaaggcatttccgccgggtggcattcgtcgctgtggcattgtccacggtgacaatgttggcatgtgttctgctgatgccggttgcctaccagtacatccagcgagtgcagtcctccatctccaatgacatcgaattttgccgtgtccgttcatttgattttttcgtgtgatttttcgaatcaaaaatttttttaaatccatttttttttattttccgatcctttttaagagcagaaaccgcgatctatggtccgaagtggtgactgcacaactgggcaaaggccaattggaacatgcggagcgtcttcgccgcagcacatccgcaagcggcagcggccgatggctgttcggccactacatccaggaaggcgcacgcgggccgcccgttcaaggacgtgaaattcgccgtcaacaagccgcttacgggggcggtgcagcaccggcggaacaagcaggaggccatggtggcgcgtatggacccggcggatcggcagccgtcaatgcgggaccttccgcagcggagggcggcggagaggagtgctgtgggtgccaggtcggcttgccaggagcgcctggcgaggctggacaggatggagcgccgggacgcgacggacaaccagggcagaacggtgtgcccggcgaaagtcagtggaacaggggaaccgcgccgagccgaggcaaatacatcatgaaaaatccttcgtccagatgcaccagctgctgcaccagcagcgccatgtgttcgtgagtgtcccgtgggcccgcctggaccacccggcagtgttggggacaaaggaccgaagggctaccctggcgagcagggcgagcccggcgcggccggcaaacctggcccgcgtggacctcccggcaaacaaggaccccaaggaccgcctggactgcccggacggcctggcgagaaggtagagcagcagcatttatcgaaatgacttacagcaatcaacatttaaatgccattaaagggagaagcaggaaagcatgtgcccggtgttgcaccgccaggcccacccggacgtgccggcgaggtcggaccccctggcccacctggaccgcccggagagaaaggtccgtgagaatcctcttggatatatcaaagcgttcatgcacctgtcttcaactacaggcaaacttggcgagtcgggcccacaaggtccacagggagaccagggcaacccgggaccgtatggaaagccgggcgcgctgggcgctcagggcccgcccggacagcccggagcggtcggatcgtgcggtaagtgtgccgtccgtccgtacggatcccgttatgtcgaaattactatatttttttctttttgtaagaccattgcccaaaaccgcgaacaccccccggctactgaagcgttgtgccttttccctgacgacagcagcagaagacgagatcagatcaccgttactactaattgtcacattattattgctatacagtagtgtacagtaaccccttccattgtgaaaaattggatagatggaaaacaaaatataaaaaaacacatttggccaacagaacattgtgccaatcaatcatcacagaaataaattgtttataaataagactcgaaattatatgcaccgaaaattgcaaaaaaaaaaaaaaaaaagtgaaaaatttgcttataaaccttgccaaatgaaggtggaaatttctcaatttcacatattccattaaatgtaaggtaaaaatcttgaaaatagataaatatgtatggtatgcaaaaacaatacaaaacaaagctaaaatttattaattctgaagaaaattgagtaaaatcggatttccattttgggcttacataatttttggaataatttccatttttttaacaatttatattttttaaaattttatcgataaaataccgaaaaaattaactttttgtgaaaaattttcgctccttaaaaaccaaaagggccgctttaatagagtgaaccgtttaatagaggattttgcatatatttcgagccctgtttataaaaacttctcaatcagtgtccgtttctgacaatgtcctttttgtccgtcactggatgcagatgttccaccgggattggcacaccttgggactcgtccactgcttgggcaatgtactgcttgaattcttgattggggaaacatgggttatcagacgcgcaattacatgggcaatataataattgccatgaaagttgattttgttgtctccgttgaggtcagcatttttcagcacactgatcagaaagcgcaagtgcgatttgtacgcgggatcaacatggttgtgctgaagcaattggttaaagaacaaattccatcaaactgcatcactttcttcgcattcaacagcatgcaaatcagatcctcgcgcccaatgtgcccattcatgtccttgtcctaattttgggaataatcatagttggtatggtatcggattactgtattctaaattaacgcgctcactcgccccctcccctaaccaaagcatagcctcccttttgagcgaggggtgtgaagaatttggcaacgttcgagtcagtaatttgaaaaactgcggacccggatttccgagtcggattcggacagggtcccggacaaaaaatcctgctttaacaggactctggctccttttgaattttcaaaaaaaaaatacagacctgaactagggccctggaaaaatactgtacaggatcctggtaaaagcaataagcttgaaaaagcgtcagaatttttccatattttgaatttctcgaaacagtcgaactcactaccaagagtgtgttacacaaatcaaccaaaccatatgtatgtatgcattattgtatacctgttctacgaacatctcgcgcagtttatgttctgtgaaatggacaaaaaatgctgcgtgaaaattaagaccaaaaaaccgaccccaattggccatatttgaaggcaaaatagacaagtaaattaataaatatcctctgggctggcaaaattgactttgtcgaaaacagaaattggtgaaagcaaaattagaatttcagctgataaagaccacaggaactgacataaaacggagtgtccaatgcagaggctccggcgagctgccggccgccctctttccgaagacaatgatagccgaaggggtgcgggagggggtggtgatcagtgatcactgatcagtagcagccagcacacagtgatcaagacaacaataatgacaatgggagctaacaaagattcacagtaaatagggagaaaagatcacatttcgcaattccggattttggccgggatgtgtacagacagactcattggatgtgcgattttcatgaggaaagcaaagaaaaaattgcttggatctaagctacttgatggagatatg

SEQ ID NO: 4797 - DNA, 2489 bp, Heterodera glycines
ctcgaaaaatgctgaattcaggggtttactcattgcaattttttctatcaatatttgtatttttttgtattactaaattccagagacattaagctttaggttaataccaaaagtgtaggcactagaaaagttatattccaaaaaaaggatagtcactgattgaacgcgtaaactagaatagagccagagattctgccattactggaatattcaacaaaaacggaaattcctatcataaattaaagaatgtgggaaacaagaacggcagtgtttattataaatttggcacttttcaccctatccacgggaattttttttttgaaatttttggcagcagttggttcttcatccacagctttccattcacctataccgtatttcctaaaatacaggcacccctctgaaatgaaacccctcttctaaggaggggggatgagttgaaaatcaaagccaccgggggctctattttagggaatacggtatgcgatggtcaggcatgctctctgatcatctgctccggcgtcgtgccctgcgtcgtcccacacctccactttgctccccctcaatgccatcgatcgcttgcgcatcaaacgatgtgccgtcaacgctgggcggcacataatttggttgactggaaatgaagaaatcgtcgaaaaaggtgaacagatattcaaaggtcggccgtctgtccgggttttgatcccagcagttcaacatttcttggtaaatttcatccggacaattcttcggacatgccatccgtttgccttggtccaggtcacgaagaacatcatgattttgtactcctgcgcaaaaattgttgaaaactgtattcttccggaatcaattgtcagacggggacgcgctttatcgccccccatcgaaaatttcgcaaaaaattttaatttttcaaaatttttatgatgaatttactaattgttggttttccaaaattaaaatcaataacggcggggggggggggggcggtgttgtttaactgtctgtaaaaaatcaaaatggtatttttatgttctcttttttactattttttgagttccgaatgtatatgagaaagtgaatgccaatttcggctttacaacatcatgtaaaagggatgtctcaggaccaattttcaaattttctttgttgacagttttttttggagattgggtccgggatgccgacaggcactaccggaggaaaaaaatagaattttttcgagaccaaccccggtctgagctatttgtgcacactgcatgcactacctggatatggcgtatggccaagtgagaaaatctcatagagcagaattccaaatgaccaaacgtccgacttgaccgtaaaatttccacaacgctgtgcctctggcgcagtccctaaattgttaacaaattttttttttttaaatggcaggtaaagaaaatgaatgagcactgccgggcccggatttttcttgcttttaaatttaattttatttttctgattttttttttgccccatttttcaccccctggttacaggcctacaggcccggattcttcatgggccctgcctggcctaggacatttcgtcaacccttgttttttgtccataaatccagggtaccaatgactttttcaacaaaccgttaaaaatcccatggtaaaaaaaactgacatttgactggaaatttggcgcccgttgccgcttcgtaaatgttctcatccatcaatttacgggccaatccgaagtcagccactttgacctcgggcacgccggaaattttgtcgcccaccaaaacattacgagcggccaaatcgcggtggaccagctttctgctttccaaatacatcataccactcgcaatctgtgaatgaagaaatgaacaaacagttaagtgaaaaactagtcagatggagtcaaattaatcaaaaaaaaaaatcgggtgcattataaacctttcgccctccatgtcattttccattctagttttgttaattttttttaatatttttcaaaaaaaaaaattcgggtgggcgaggggagagttcaaacccccctttttttacacttcggtcccaaaactgtttttcccggccagtgtaatatttttttaacaagccatcacaaccacttaaattgttaagcgccataaaaaacatgtcaaatcaattgcaacacaataattaattaatgacctgggctgccatgtcgacaagtgcatgcaagcgcaaactgttgttggtatcacgcagatactccaacaaactgccgtttcgcatatattcagtgacaatataatactggaaaatttgttttttagcccatttatgcccattcaaatcatcacaaaattaccggttctcccttagtgcacacggcataaaggcggacaagttttggatggttgcattgcttcatgatttgtgcttcgcttaaatgttttgggaaaacggttcaaaaatttgatacaaaaaaaacagtctctattacgggaaactcgtaaattt

SEQ ID NO: 4798 - DNA, 817 bp, Heterodera glycines
tttgggatgacgcagcccccaccagtcgaaattgctaaatgggaaaaatacttttaaaagtatcaacaaaacaggaaatttaaaaatgttctaataaaaaaatttttttatgaaaaacaaaaaaattccgtaaaattttcagtgtcttttttcaaaattttatgctgaatttaccgtttgtcaaaaaaaagaaaataatgcctttcatccaaaagaaccatgatgtctccttttgcaaaacacacatcgccttccacatggttctggtactcgtacattgcgatcacgcgatgttgcgctaaaaattgaatgtctatgtatctgttacaaaaaatcaggaaatcgaaatatgaatgccactccgtttggacaatttaatctattttttaggtccacaaattgagtgggttttactgattaaaaaaaaaaattttgtgcttactgtggtcaactacaggcggcagggctgcccttcgaacatcaacaaccgtcgccatggccgtcgttgcgctggtggcaccaggactaccaattggtgccaatgccggggatttaccagcaacaccagcaccgccatggccatgatggtgcggatgataattgacgggataatgcattgggtatgcatgatgatgaggatgatgctgattgtgatgatgatgatgatgttgctgactgctgttgttgttgttgccctgttggtgatgcatcatttcaaccgatgaaggctgatacacataacgaacagctgaacagacaaaaattggataaattcactatttgaaaaaaagaactgaaagcagtaattgtaagagcc

SEQ ID NO: 4799 - DNA, 5139 bp, Heterodera glycines
accttgttgttgccgggatggcaatgtccacaaatttcagcggcgagtccgtgttggccaccgcaatcaccggcgtgttcacgtaggacgcctcacggaccatctggtggtccaactgcgggtcggacaccacgagcagacgcggttcctgtacaaacaaatggttgtaaaccaaggcttttatgaagtgcaaaattttgggtacttttccgtttggctgccccacatttatttaaattaaaaacgttaaaaagcgcgatgaattttcaaaaacggcgcttcagctatttgggaatcataaaagcaacaatttggcccaaagtataatcgaatggatcagcatggcggttgacgttttttaaactaaataaatgtggggcccccgaacggaaaataccaaattgtgtttaaaaatctttttgatagaagcaattaaaaaccttgaaattcttttggatttggttggtcaaagagccgggcgtgaaacggccaacgattggcgtggcaccgatgtgagcggcgaactgaaacatgaagaaaacttattatagaaaggttattgccatcgattcagttaaacaaaaaagagggacccgcttcaactctgtgttttcatttaccttggaaaaccaaactaaacttttccatgtaatgcatttgtaacgggttaaccgctgcatattaaggggaccgaaataaaaaaaaaaatcacaatcagcacgaccccggaaccatggaataaggaaaaccttgagcacagcgcgttgggcgtacggctgggcagagacaaccacacatcggacggattttcaatggccgcgatggcacgggcggcgaacaacagtttctcccacgttttgcgaatgttgatgatgtgaatgccttaacgcggtgggtggtttatttttctaaaaatttataagattttgtgctcggcatggcaattgtaaagaatgggggtccctaatttaacttttttttattttaggcttaaaatcagtttccggtggttttcgagggttctgattacgaatctggactcgggtttgctcaattccgaaccccggacccgaattggaacaaaaaatttaaatatttttttttcaaatacgcgttaaaatcgatctaattttggcgtaaattgcatattttttatgcaattaatagttgaagcattattttgatcagaataaatagttgttaaatgaattcgaagcttttacccagaaaaatgtacctttcgaaaaaaaattccaactttttatcatgggtcgaaaatgaaaaatttactggttttgaatatgaaaaaaacggcaagttttgctttgcattacattttaaaaaaatttattgtgcaagtgaaaaaataaaccgtctgatcgacgcttccacacataatgctccatttggtagtccatcttttttggtgccgatgtgcgattcgcacaacaaaaatttcattgcgtcatcgtccgtcagtttgaagacgtcaagactgcttgacatgttgaaggcagaaaaataatacgtttattaatctttaaaaacggttattgttaggactaaactcataaaattgggcgaatcggactcatcgggggaaacgatttgcgagaaatttggatatcagagaagacattatggggacacgttcaggaaagaggccaaaataaacagggaatttgggaaagaagctgacgtcaaaactacaaaaatctatgatttcatcaatgattttcatcttgattttttcagatttttcgaaaaagaaataacgagtcttatcatatatcaatttaacgccagattcatgatcagctcctaaaactacactagaaaagtgctttcctttgccgggaccatgacattttcataggggtagcaaaaccggtacttatgtggtttacagaccataaaaaaaaatttttttttaacacattaaaatttcggaaccaatttttaaaacgaaacagtgcacaaaaagagaggggggggggtagaagacgagagtaattttttgaaaggatcgcaccccatcgaatatttccttatttctttttaataactgtccaaaggtgactgcgtcattgattctcttctgtagtccttaaggtacttggactttccacagtaagatgtggtacaaattttgttttttgtcgaaaattaaatttcggtttttttcgagtagggttcgttgttcgaattgtttggcactccattttcggcacttttcatcctgaaaaagggcaagcgcgcccctaattctatttttccaacacatttcaaacctttttacatcgattctgactgtttttaagcatttttgagtttggggcctatgatcaatatttaccaaaatcactttcgagagaattttttgaaaatttttaggcaatatatttgtttttaaatttatttttaaaattttctttttgtaaaacagttaaaataacaattattaatgggatatgaacatatcactggaggaaatgcgaattccgttagaaaattatagcactcattttttcgaaaatttcaaaaaccaaataaatgggaagggagcaagcgatgccaacgggactgcagaagaaaaatgtgctaacagaatttatccaacagacccaattcaagggttttttgtgaaaataaaacaaattaacaggatttagtaagtaatatagcagttccgactggcaccccactaggaaaatttgggttttcatgaaatttataacaaattttgcaccaaaaatgggtaattttatggatgataaattaatttaaggaataaaaattatttagataaaaaataaattatggaaaatgctcagtgaaaattcggcagtagaaaatgcagcagtaacactgtatttcgaaataattttgtttagaataaatattatagtaaaaaggtcaaattatataagaatagcgttcagtctcttttcgtctaaccatccctccctttttgtgcactatttcattttcaaaattgggaacatttttttgtttgtttttttgaaactaaaatgtaaaaaatttactaaaatatttttgattttaaataatacttctgttccgaattttttgactctaagaaattaaactgtaatttttagaacaaataattctctgaagttttgaacttggcttaaccatgtttttaagtcccactgtgaggaagggacagttccaaaatttgtgccacatttcactgtggaaagtccaagtaccttaactggacaattacttgtcaacgaacacagtcgcctctggcctcttatggaacagaaaagggtaaatatcagatggggtgcgtcccttcctaaaaagttctcttttcgtctaaccatccctccctttttgtgcactatttcattttcaaaattgggaacatttttttgtttgtttttttgaaactaaaatgtaaaaaatttactaaaattatttttgattttaaataatgcataacatatatataaaaagctgaaacaaaactgctctaatggatatcgattttgtcttgcctgttaaatcagggctcccatcgtccatgctccgtttccaaggacgggtatgccgatttgcaaggacatagtggggaaaattcatgaaatccaaggacatttaaaatttttattatatgcaatgaaaaatggttaaaatttattaatggcttgtatttttcaattttttccaacattttttgttttcactgatcattttcctcatttgcgacgacttttttctgctttaaaaacgctttttttcggcgcgctttttccaaaaatttcgggaaaaagggggggggggggggtctggcggtgccgacaggcgccgccgcggaaaaaattttggaaatttgaatttttttttaaatttttaaaatttttttgaatttttaaaatttcccggttggtcccggttcccggtttttcttgcggtcccggtcccgaacaaaaatcgaggtcccggtcccggcttctcaggtcccggcaagtcccgttcccggttttggcaaaaattcccggtcccgtggcactctagaacaaaataatgctaaatccccaaataagaacagatccaatccctggtttatgccgcccaccttttgttggagcggcgcacaaaaggtaaaagaacaaacatttttcaggggtgtatttctccgtacttagaattgccgatacattccatcgaaatccctttatttgtttgatttcgctgctccgttcgctcaaaaaaatctcttgcgaaaattccgccaatttgccaatttccatcgcaattttcccgtttgttttgtttggatttgaataatccaatttctccgtatttttttccttcacaattacatcgatggccaatgtcactttgtcctcttctttattgtaatgtcctttgctcgggtccatcaattccttatatgtttttatacgtaaaaaggtttaatgaaagttcaccgaaaaagtgatgaatttgaagaatcccctaacagatgctttgttgttaaaaatacgattattgaatttccccattaaatcctccgtttcgctattttgagaaacaatttgaaatgtagctgaacacaagcagttccaattttgatcttaattgtaattatataaccaattaacattttaattatcactaattatcccaccttcccttggggcattgcatcgaaggaaaaagcccaaacttttttctgtgctgtctttcttcatatttatcaatgtcaatattttccgggtccattaattgcttaattaccgactatttaaaaggcattccaaatttgccgctcacttcaaaagtgatgaaaccggggaaaccgaacgtgcccattttaatgctaaaaaagtggtcattgcgcagggctcccatccgtccttgaatggcaaggacgtccttgaaattgggccctctttcttgaaaataaaaaatgtccttggatgccaaggacgtccttgaaaatgaacatttagaaaagttttaaaaaaattcaaagaaaatgacacatacaaacatacatacacacactcaactttattatataagattattattattaatatggtattaggaatctttcttgaatgaaatgtaatttttttctcatgattgagaattttt

SEQ ID NO: 4800 - DNA, 1805 bp, Heterodera glycines
agccatcaaatgagcggtttaatttaaaattttgcgaaatcaatcaaaaaaatcccttttgtacaatttttatggccaaattgagatgtccgtccgccacttcaaacacaaagtcaccatattcattcgtccaccatctttgaattgtgatgacacaaagtcagcgccgagtcacttaaaacggatgaaaatgattcattcattcattttgggccgatggttttagccacaaaattcgcgccgcattttatttgcggtttcgctgtccgcagccgatgctaatgcccggcccgcggcggggggagggggtggactgcggacactcttaggccgccaaaagttttgcttcgggtgttggaccaacggattttttttgaaatggcaaacgggggaaagcaagcgaattgatggaccgatcgttttatggaagaggaggtgatgatgatgaatttgctggctgatgtgatgaataatcggctggtgagaccccccgggggggggggggacgactgtcatcaaagcaaaagcacacatttttatatttatttgaattggggggcgatggagatgagtcactcaccgccgtcggtccatcgatggccaattgggaaaccatcaaaacacagaagagacaaaatgtagtaacataaagccaaagatgggggaaaaggagtcactaaaagttcgatcagatactttctttctttctgctgtacgaacgttggggagggagctgaagcgggcagagattgggagggatttatgagactgatcaaagagataaatgttgaattttaaatttaaattttatttttaatggtgagaaggagttgagagcattgaattttatgctttgtggtgaaatgtccagagaaggctttccaaaggtgaaaatattaagattatctttgctttgggttgagattggaattttaaaaataaattttaaattaaaatcatttaaaataaagataaagtctgaaacataagctaaaatccaataatttagacaaaaatttagtgcagggttgccattcgtccttgaatggcaaggacgtccttgaaattgggccctctttcttgaaaataaaaaatgtccttggatgccaaggacgtccttgaaaatgaacatttagaaaagttttaaaaaaattcaaagaaatttgagaaatctttgtaattttcaacgatattttgattatattatggcattatgtcaatttttttgctcatagttgagaattattatttattattattattaatatggtattaggaatctttcttgaataaaatgtaatttttttctcatgattgagaattttttgaaattttattgcataaagtcactatttttcttaaaaaattagcccaaaatcgcaaattttggtcatttttggacaaaaacctgtaaacaaatcgcattaaaaattacaaatttttttctcggcgggcggcgctttttcgggacccgcgaccccccccccccccctgttccacaaaatttttggaaaaagcgcgccgcaaaaaaagcgtttttaaagcagaaaaaaggcgtcgcaaattaggaaaatgatcagtgaaaactagtggtacgggaccgggaattttgggaaaaaccgtgaccggtaattctcgcccagacccggtcccgtcccgacacaccgtagtgaaaacaaaaaaattggaaaaaattcattccggtgaaaaatacaagccatttgaataaattttaaccatttttcattgcatataataaaaattttaaatgtccttggatttcatgaattttccccactatgtcc

SEQ ID NO: 4801 - DNA, 1331 bp, Heterodera glycines
aaatattattattattatcattattattaaatgaatgaataaaatgtaactttgtgggtgtacgattttttggaatgttaacaaaaacacggtttttgagaagaattaaatttattttgttaaaaatgggattaaaatattttattgttgtttaattaaaaaatgattatcatatattaattaaattagccttgtaaaccaattaattaatatatgaattacatcgattgtgatttatttaaaaaccgttttggtaaattcttacttagtccatgagataaaaaaaatgaattaaaatttataattttaattcaattaatagttaggacaatatatattagtaaattattaggtaaaataaaataattaaaataaatgaataaaattttttattcagttacttcgagctatgaatattaattaaaatatcaaaaataaaaaattgccataataaatttaagaattttacaaatattatttgaataattaaggtttttattgaaataaaataaatatacgaaaatttatttgtcgttttttaagatgacagaaaatgagtcagaaatacataagaaaacaatgtgaaaaaaaagatgacgcattttttgctgcttcaaaaagtgatggcgaaacaggccaaaaagcaaacaaaacataaaaaatgaaggaacaaacggaaaaaaataagttgggccaaattgaaaaaattaactcacaaaaagcacaaaattaatcttattggcaaaaaaatttattaaaaaaatatagcaaatatttattaaattttttgaagtatttgtttttggggaaatgaaataaaaattttgcgaggaaaataattccaattttacatatttttgtggtaatccgacgatttagcgggggaagtaaaagctaatgaatgacattggccgattgattgattgattaggttggaattggaatatgattaacagaaattgcccgtttcgtgtgttaaagccccgagcataaaaatgggcgaatgctttgtgtttgtggccatatgattgctgatgggttgggtggactcataagcacgtgattttgttgaaagccaaaaatgcaaaaatgtaaaaagaaactagtaaaaataaaaaatggaaaatgtaaaaatattttaaaaaggtaaattttttcgtacatttcaaaaagtttgaccattttctctcctgcgaattttaggcaaaaagaaaatcttgttgacgataaaccagggctcggatctgtcctgatttgtcagatttgtttctgatttggaggtagcgaccaaagttgtcctgatttcttaaataaactcaaaccatttttga

SEQ ID NO: 4802 - DNA, 3756 bp, Heterodera glycines
ttttctcaatttcatttttcattttcccgttctccgcttcgatcttcgctagcagtgcattcgtttcctgctgcttcaacttttcttgaagtcccttctaaatttaattaattaattaatttttttaaataattatcaattcccatttaattatgaaaaattactctttctgtaataaaactcacatttttgagctccaatttggtatttttcaatatcaattccattttttcaaatttttctctaagttcctaaaaataaaatattgcattaaaaattatattataattataattttaataaattataaatatttccaaatttctatgttttgttcaccttcatttgttgcccatcagtgaatgattcaccgtttgtcttaacaacagtttcttccttcaaaatactcaattcatcataattcatttctaaaaagaaaagcatttttatttcatttatttatttttaattatattaattttctactgtttcccaaattttattttctaccgtttccccttttctcgttatcacaatcatcagacgaaaaatcgtcactatttgttgaatcgtttgaaattgacatttccttctgttcaatttttttataattgtcaaattgggtttgatgatgagaaatggagagaagtttgagtactgtttgtatgtaacaagccttttgaaatttttttggtatctattgcactttatgagtccaatcaattaacaaacaacacctgtggttttttagaataattttgttttgtttatgttcgaacaaaccctatattttaggtatcattcgaaagcacaaagtccgaataatgtaataatacgagaaaacaagataattctaacagttaattacaaacgaaaatatcaacaattttttaattaatcaaatctttttttgacatggcctaaacgctaaaattttatatatttaaacttctttaggctttctactttcgaatgacatcaaaaagatagggtttgttcaaacatgaacaaaattattttataaaaaccaggtattgttaattgattggattcattaaatacctttggtttcataaaaagtcgattggactcataaagtgcaatagagccattttttggacaaataaagtgaatttttaattaaaaaataaataataataataataaagaaatatgatattttaaaaattgtagtaataaatgaacatttgctgactgctgttgcttatgttaatgtatttatcgaggtcaatcaacaataatttagggcaaaatgatgactcaacaattggagaagagcaaaacgaaaatattataattgactcatttatccattcatttttgcatttctgcattattaatagggctgctaattttatgtaagaatatttgcgaattatgtaaataaaatatgtataaaaaatgctaaaatatgtacaaaaatcctcaatcagtgaatgattcaccgtttgtcttaacaacagtttcttccttcaaaatactcaattcatcataattcatttctaaaaagaaaagcatttttatttcattttatttatttttaattatattaattttctactgtttcccaaattttattttctaccgtttccccttttctcattatcacaatcatcagacgaaaaatcttcactatttgttgaatctgttgaaattgaaattttcttctcttcagattttttataactgtcaaattggatttgataatgggatttgattaagtttggatattagtagatatagcgcgcacactttactgcccctacttgactttttttgctgcaccttttgctgcacaacatttggctgcccctatatgtttttgctgctgctggtgatggtggtggcggtgggggggggttgatttggacgaattttcgctgcccctattcgacttttttatcaacattgagcgggggcaggggggggggggggagagagaggcgccggggggcagaggacccccggtgtgtttagtcaatgctttcgcgccctgctgttcacttttatctgctgcgtttagaagagaaacaagtggtcgaacgggagcacttcccgtcgcaattgagggacagagcgagaggcgtcaagaaaatgatcggaatttgccttttcttcccaattttctctatttttcaccttttttatcccaattttctcaatattttgctatcgtaattttattcaatttgtcgtatttcaattttgaccctttttctcccttttttcacatctgcgtctgctcttacccttttgccccgccgctttgccatttatttttgaattcacctttgtcttcattttggccgacacttcccctccggccttctccgattcttttccgatttttccccatttttctctttgttttgttaattcaaactttggaccattcacatttttccattcacaatgtttacgcattttgctatgccagggagccatcctctccccggcctttgactctccccttttttcttatcgcatcgttcattttcgctcatttgtccaatttgcatttatctgggcctaaccccggggggaaaatatttaccaatcgcccctcccccccccttttttcatcactaatttgtccgtcacatcattcattcgttcacttttcttcctcactcccctctagggagaaaaagttgttctttttgccttaatctctcaccacaccactcaatcacgcattcactgttaatccccatttttgccgtttgtcacatttgcccccccccctctcacgaggtttaattacccaagtttgagcgcttcttcaataaactatttttgtcattttgtgttcggcattttcgggcgggtcagcgatcaacagggagccgtctccctattagcgaatcatttctccggcccctttgcctgggcatttgcggagtgttgcggcaagtcaaaacgggactcctacccctcaggagtgcccattccaatcgatccccgtccccttttctcaacccccccccccggcggtcggacagcgactcggacggcgagtgaaaacgggagcgcaactcccggccgcagcgattgaccaggagtcggcacgccgaaagtgctgacggaagagctcggacttggggagtaagcctgggagcaccggtctctccccaaatttgatcggtggtgccgttaatcgtgtaaacagcccatctcttgtttgccttccatcccttttctccattccacccccttgggacaggaccaaactgcagcggagagagagagagagagaagaccaagttttttgaggagtggagtggagcagagggaagggagaaactccctgccaaaccgggagagagttttcgccacaaagcgaaagcgaaacgccaaaaaaggcgaaaagcgaaacctaggcccatcctgatatacaccccctaaaaatgacttgaaaaaatttttagaaatatgcccctaagaattgaaaaattttcttaaaagctgatcaccaaaaattaatttttttcatgataaagttttatatttaaaaattctccttattcgaaaaaattaaaaatatttaataatcatttaaataaccaaaattaagttttttggttatgttttacttgttttgcttcctaaaaagccttaaaaaatttttaaatgctttttttcttgcctttttcgggattttcgtgcctgttcatgcttttttttcaatttttggtgcctattatagtgcatttttcgcgattttcatgccttttt

SEQ ID NO: 4803 - DNA, 3154 bp, Heterodera glycines
cgcagcgattgacccggagtcggcacgccgaaagtgccctactaagagctcggacttggggagtaagcctggggagcaccgcctctctccccaaatttgatcggtggtgccgttaatcataaacagcccatctcttgtttgccttccatcccttttctccattccacccccttgggacaggaccaaacggccgcggagagagagagagagaggagaccaagtttttgagtagtgaattggagccaagggaagggagaaactccctgccaaatcgggaaggagtttttgccacataataaaattttaataaaaagatcgcccctgaaaaattcttcacttttatcgaaatttttttaaagtaatgaaatttaaaaaaactttcaacagcggtgcctatcgtcactggcaccgccggcaaaattacctaaaatttttaaaaattctacaaaaaatcgtttaaaatgttagagatccaaattttggcagccatttgttgtgcttcttttagcagcatatacatttgtttaaatgaacttatcaattttaaattttgtgtttgccatcttcagctttgccctcgtcggatttgcctataaaaaagctccgttcacagaacagtccaccttcaacaagttaccgaatttgaggtcaaaccagaggccacgaatggaaaacatcgggtcgtatttgaatgcagcaatttctttggggtaactaaaaatgaaaaatttaaaaaaaatttaaaatggaatttgaacccagttttttgaatcaaatagtcgaggcaaagttcgaaggtttggtcttccattgttggcgacacgtactctgaaaaattgacaaaatttttaccatttttggaaatactgcggttttcccctccattcctcgaaaaataaaattcaaattaagaatgcacacccattccgatcaattaattccttgtccaagacctaattcaaattaaaaactaatttttcgatttttgggggagggggattcccgaatagtgggtctttcggcgccagtccaagtttttgggctataccttttttaaatttcaactaaatcagacaatcatggtatcattcgaaagcccttacatactttattagccttaaaaaaaattctcaagcaatggaaaagttattagcagaaagaaaaacaggggcctgttccagaggttcgacatggaattttaaaattaaaaaaggtcttacccgccaatgtatagtccatgtcaaatccaaacaatttgatgtcctgaaggtgcaccgtccggttgacgaaaatcgttccctcgctgtgactcatttttgtcacggaatttgggatttgcacaataattaatttgtatctaattaattaaatgatttgtaaataataattaatttccataaaaatatttcctggctttggtataaatgtaataaaccatctcaaaagtgtgatccaattgttggccatttgagtgcaaattggtttttcaaaatttgtacaaccatcactatttttggtcaaaaaagaaattcaggacattttgaggtctctgaccacaaatatgtcgtctgttttgtcctatttcggcttgaatataacaaaaataaataaatctaacgctctaaaaatatggcgctttatttaaaattggccaattttgaagtttcaaatcccttttttcaaaaataaacataaaccgcaattggtgggatatacaattgtttatctgacatccggaaaacaaatgatgatttttttcaattttacctccttttaagtcgcgggttgacttttcaacacaacttttggttccaaattgagttcagtttcaagagtttttccgaaaaatgatgccatttcctgttcaatgacttcgatactcctgaaaacagcctttttttaacccaacaaattctttcatttttgcagcaaaagattgcgttgttttcgccaccgaaaacaaacactccgtcctcacacagcccgtcaacaaaatctccaagttgtccgaccatattgcaaaaaattggggggggggggggtcttcagcttacaattagattgattttagattttctggaggcgggctggtggtaaggttcgccccaattaaaaaatttcctaatattcttttgatcagtgaccctgaaaacgcgagaaaactaaaaaaatcaaattctaccacttttccagtaacgccatttgttttcacagctgcactacgccttccattaaaaaaaactataaatttatcgaattgagatttttcaaaaagaaaatgttattgtttttcggaggaaaaacaagctgcttcccatactttctcacatcatgttttttctcccctaaatcagcaggtctgaatgggcttccatcaacaaactgttggtcggctttggtcaaacaatttgtttgccggtgcgaccgaagtgcgacgaatgcgcaaatcgcccgctctgtccatggtcatcaccagcaaatggagcagcaccaaatccgaagagcaagaaaaagagatgacacagagaatgaacgatgaaagaacggcatttgtgccaccaaaattcacttacaaattaaaactgatcctcggaggccaaaattttaaatcgacttttttttgccacccgtcatagatttcaatatgtggaattagatttcgacctggatttaggtccagtccattttttttgacaacttggatttttgtccaaaaaaaatgttaatattggttaattaaacaaaggctctcaagagcatcggtaattgattttattgactgacccttcaatttctaaaatttttatcaggaaattttttttattacgtttacacctttaaagagattcaatatgggtcaactccactagtgctgagtcgttataaaagccataaaaagggcgttataaagaaacacatcaaattaaaatttttaacaaaaaaattaccgtaattcttgatatcattcggtagcccggtacttttctgttttgttacccccccccctgaaattttcaaataaaaagtcatttctagggtaatttgtggcgatgatcacgaatatgacgtttatttttcaaaattccgaacccgaattcgaaaaaaatgatctgaattctgaaatcacaggccaaatatatttttagggggtttt

SEQ ID NO: 4804 - DNA, 1324 bp, Heterodera glycines
  misc_feature (1268)..(1268): n is a, c, g, or t
  misc_feature (1294)..(1295): n is a, c, g, or t
tgcaggtctcaaaatcaaaaaaattgtgacctttttaaatacgttaagggtactttcctgtttagggattgcaggccaaaaataaaaaaataaacaaaaaaatcaaaaaatgagtgcaaattcacaaagcacatgcagcatttttgtctcttgttcagcagtttatgcgtccatcaatgagtatcctcagtttcttaggccaaaacttttttcttaattggtcattgcctatgttcttgatataaaactaaagttatttgtctattttatgagcacataatttagttatacaaaaactatagactttaagctttcgattgataccaagaatgtagacaatgaccaactaataaaaaagttatggcctaggaaactaaggatggtcattgattagatgcgatgcataaactgaattaggccgcatttttttggtaataaaatctcgtcaatgggtcaacttaagtatatgagttgtgtgcctttttgttgtttttttcaagttttggtgtgcgatcacaaaatagaaaagtactatttggaattttacccataaaaaggcaacattaaaatgtgttttaaatttcaccaaatcgccaggcaacgttttccatgtccacccaattgggcctccgttctccgccccttcgttcagttccaacacgcggacactctccgcctctttgacgagcagtcgccgactgtccaaccattccaacgactccaccgagttcagaaagcgatgagtgagcacatcggccaaagtgacgcgcttctgcggttggtcagcgtccaaaagagctgcaaattatttgagagaattgcatttttaaaaactatgccatgaaaatcagtagtccccaatttgtgagtatatttttggaccacaatcacaaatttgacatacattcagacgaatatgacaaagccaagggcaatttagaataaaaattaaaaattattacaaattcgaataaagtcgcaaaaatcgtgaaagtgtatttttggcttttcgttgacattcaaatgccgaatttgaaatgcgtctgatgaatgagagtcaatttacgagtgccaaaagtaaggaaaagcaaaatgcaaacgcacggggcgtaagcacaagcacggcaagtgcaatgatggaacacattgcgacgatgacgagaagcgctgttgcaatgccacgccaattgcgctcctgcggactggcaacggacaattccttcaattgcggtgattgggaaaatttgtgtttgaggagagtcatttgnggatggaattggaatggaatgtatgnngctctttttttgtttttgttaacagagca

SEQ ID NO: 4805 - DNA, 1275 bp, Heterodera glycines
aaaaaaagcggagaaaagaaaaaggacaaaaaaacacattttatggcgatgaatgccaaattaaaaaaaaaccaaagttgacaccgttcgttcgccccaaaatgttcgatcgatcgatttgccatgcattgccgttcatttgattggttgcgccgtttttgtttgtttgttttttgtgtttgttttgccgtacctcttccccaccggcgtcgccgatgagtccgctgctgctttgcatttccgcgtcctttagtccgcccatttcgctgtttgtggctgctgcagccattcaattgggcgcagagaaaacagtgcacacagaacaaagagatttggattttttggcagaaatttttttattttggcattttattaagcgtggaaaaggtggtccatcgagccgaaagtgacgacggaaattggtgaacacttcggcaccattcggttgcgaaaaggaaaaagaagcaacgggcacacggccaaacggtggccaaacacttcttcccccccccccactcattcaattcattctttcattcaatccacgccttccttctcattgccaaaggccaacagcggcgggtgatgccctcggcgtcgtatcgaccaaaggcggcggcggagtttggcagttaattggccaatgttaacgccgacagagaagaagcgaaaacataaacaaaccacacgtgaaagagggcgaaaagaaagtgagaggagagttagtgagttaacagcggaaaagggggcaaaaggtcgagaggaaaagggaggggggaagagagggagaggaagacgagagagagagaggggggagagagagaaaggaagacgagagataaatggaagagagaaaaagacgagagagagaggggggaggagggggagagagaaggggtgaaagagagtggagaggaagaggagagagacgaaaagggtaagggaacagcagcagcagcaggacaacaggggaaggagcaaaggcaggccatgtttaagaagggtcggacggacgatgccattggcaccgccagaggatggcaaacccccgtgttattttaatctcaaattttcatccggctgaaacagccgaaattgtaggtaaaattacctaattaatgaaaatgggtcggaaagggaaaagcgtcgggggcggggcgcgacggatgttggcgatgttcgtcactccgccaatgtttgtaactctctttttgctaccgatgattccccccttcccccaatttcactgttctgtcgctgttcagttcaccgatc

SEQ ID NO: 4806 - DNA, 1380 bp, Heterodera glycines
acgacagtgcccaccatcgcacaatttcctcgcttgttcgtacacttggatgaccagctcacgggccgacgacaaaatgagggcgtacggacagccccgtttcgacttgaaagcgcattccttcttcagcttcataattctgtcgatgattggcagcaaaaatgccgcacttttcccgctgctcgtctccgcgtgtgccttcacgtcgtagcctaaacaaagttcttcaaaacaacgtaaaaacgccggctaaatgtgtcgcaccgtctcttatcagcggaaaagtgtacgattggatcttccggggcaacacgtacttacaccgattgatgttgtcgactagctttggctccagattgaagtccttccaagtccttaaaacagacgaaattcaacttccattaatcggatgaatcgcttactcatacgatgtgaatttttcattgtgtccaaaaacagccaagtcttcgtcttcgtcacggatgtccacgtagcgttcgctgacgagaaagtcctcttcgtaaaggcactcgatggacctttttttgtaagtgtgtcttggtcggctcagcccttgctctaaatttggttttttagttcgtcataaatgctttagctccattcgttaccatcccgtggaaagcgttcgtctccgccatttgcgaatggtcctcgctgactgtgattcggcggtctttcgccaaattcgggtcgtcctcttacgcctctgccgcgcccgaaacgttctccgccgtctccttcgcttccgcgaccaccgcccctacggtctccgtaactctctcttccgcgtccgttgttttcggcatttggccgggcattgcccaaaccaccattttgacctaaaaatttgggaataaaataaataatgcaaaagaacgacgggggggggggggggaaccttcggagttcatgccacgaccacggccccgtccaccaccacgcaaaatagtgccaatgctcggcggatcattcgaagaattgagttctattagaataaaaatgaccacaattactctcaaatttacgggaatgacagaccaactgtattggcaccatgtccaaaaccgcgacggtctcctggaccgagttctgtgggatgaaattgaaaataatccaaataaccacacttaaataaccgaccaactgcattggcccctcttccaaaaccacaactcgtcgttcctccgcctcctctcgccctgctaccattgaaaacggtcgtcgagtcgaaggtgaccgatttgggtggcgaaatctccgcattcactggtggacgactgatgttgttgttttgtgctggtgctaaccaccaaattatgagtgtttagcactgaaaacgaacctcctcttcccaatccg

SEQ ID NO: 4807 - DNA, 2850 bp, Heterodera glycines
tttatgaaaattgaaacacctacctatgtaatttttttacattacacattcggacacgaacaggaaacaaaacattacgccaatttatcagaataaaatatcaaattaaaattaaaacaaagggagtcaagattttcacataaaattttcttcgacataacatacctacctacctatgtatggatttatcagtttttacttcaactgaattcaatagaaatatgtatatctgtcattttaatatgtcccaaaaaggggaggggttgttgttatgaacgaatgaaggatgattcttagattcgttgaattcatacaaagaaatccaaattttgtgtgtttttatatttcgtgtcaagttaaaagaattccaaagatggatccacctccctcacacccaaaaaatcagcaaacccagtccgccaacgctttctccgcaaatgctgcaccggctccactgctgacgtatgggagaggcatttttgggtttatttttgtgcgtaaaattggatttgcatccaatttcagcacatcgtccgcctctggtgtccaaccgctgcttttgccgtcctcttcaaccggcgccggtgttccttatcaccagtgcgtccgccacggctttgacagttatccttcgtctgcgaacgaaacggtggcaatgtacgggcagccaggggccggtgcagcggtgtattcgtcgtttcagcaacaggtcggagcccacaaaattccgctgtcgaaactccgccggacgaaactgaatcaaagtattcaaaaatttttcaaaaaaattcgttggtggaaaactgaatttttttcaaaagttttctaaggttttttcttggaaataagtgaaaattttttgtctcggtggagtttcgtcggcggagtgcgttttgggggtaccggcaacaggtgtatggagaatggtagaacgatgttgaccccttaccgaaaaatttatctgtttttttgtccacaatgtgttaggcatattgtctaccacatttttttccctaatgtgtcaattttcatcggttggttttcagcacgccgaagttgtcgatcagcagtgctaccaacaacagtccgctgattctgtgggttacggtccgttggtgccggccgccttcgtgtcagtccctcttgaacaacagcagcaggcatcacaaaagggtgccgtcacttcgtcggcggcaaaaccgctgccccaacaacactttgtgcccccgccgccctccttttacacggccggcaaccgttcgtccaacgccgccgccgccgcactgcttggcgttgtgccaccgcctccgatgcttccgccgtcggtcggcggctcggcggtggttggcccaccgccgcccaccgcttacgcgacacagcagcaacagtcgatcaatgccgtcacttcgtcatcggcaaaactgctgccccagcagcccccgcagcctttttacgcggccggcaactattcgtccaaagccgccgccgcttcaatgtttggcgttatgccacgacctccgatgctttgcccgtggggcggcggctcagcggtgattggcccaccgttgcccgctgcttacgcggcacaacagcaacagccgatcgaccccatgccgtcattatcgtcgacattggattatggccaacagcagcactcatcattccaacaccagcaggtaaaaaacttgtgtttgagagaggaggtggtggatgggtagccccaatcaaagaatattaatattttagatggtgggtcccacttcatcaacggcagatttgcaccaaaagctgttcgttccgactgccgaagatctttctgacagcatgatatacccatttgatgtgacgcatttgttctgcagagaaaaaacttcggagattttggacccccaggttagcaaatacctaatcattaagagaggagggggtggatgggtagcaccactcaaggaatattaatatttagatggcgggccccacttcatcaacggcagatttgaacccaacgttgttcgttccgactgccaaagttttggaccccgaattggttagcaaataatcattaatttgaattagggaagttacttagacacaggagggcattagttttgcatattcaaaaatgaagcctcttaatttttgtgagtgaaattatggatgacttataaaactgtatcaaaattaaatggttgtggtactcatttgggtggtgcagaagatgacccatattgatttgttcaacaaaagtaatggtcattttcgatttgcatctctttatatcatggaaatgttttctctaaatttgcttttttccttcccaatctccgctcttttcggttttagaatgtattaccctaaaatgattaggcttccgtctgaacttatttccgaattggcgagtgctcttccccttgacccccgctgggccgtcatccgtgtgtcctcggcctttgattttttcgtttatacaaaacagataatttataggaaaataaatagccaggaatttaaatttgtcttacattattttaattgttcccacttttagttggatgaagggcttaaaaaagcaaagcaacaagtttcgtcagttgccaatgctcagtccagtgacgaacaacgacgaaaactgctcacaggttggaaccatcgatgttattttgtatagcctaatagaggctttaccattttgtgttgttgactttatctggtaaaagtcggcatttgttttagaaatcgcggcgtttttcaatgacaaaacgtcagaggctgaagtgattttaagcaccgcagtgtcaacggatgtgaaatgatttaaatgtgtgtgcacgcattctttacactcttttg

SEQ ID NO: 4808 - DNA, 1646 bp, Heterodera glycines
taccaaaacttttttggaaagttttgggttttccggattgtatactgtcaccttttttgtgagcagtagtttgtgctgcgcacgtgtgtccatctctgttgccgttcgttttgtaatgatttttaggcggtgtggggtgattggtggctgattatgggcgggttggtaaactgactagtggactgacaatttaagggtgaacgccgtggctttaaatagtgagatttttgaggcgttcgccctttaatcgaaaacagatcaaaaaaacagttgctaagtgctaattgttgccttttgatcggcaattacgtgggcggcaattaaatgggggagggggctgttacatgaaattggtgcgatcaatatatttgggtgaaatttgggataacaaaaagtgcaaagcaattaatgatcattaatttcttcccgatcgtcccccctttgatcacttgtcccttgtgatcacttttgttccctttgttgctctcaacaacttttcacttttcctctttgttcgtcagtacttgtggaattgcacaatacttttgtcgacagttccttcacaatttttgcacatttgctgacaattccttcttctcgccgtttgccgacaattccttcgcaactcctcgccgtctgctgacaattccttcgcaattcctcgccgtctgctgcagcccaagtttaactttgatactgaatttgttattccaattagcgaggtaaacaaaatccgactgtaatcaccgtgacttgtactccaaaagtttactccaatcacgaattaaaaatagaataatgttttttctgctaaaacattgtgataatttagggagaaaatttttcggatttaattagacaaatatttggtacttaatgaaagaagcatttggtgaatttggcttaatcgaatgaatgaatgtggggggaattttggcctaggactccaactgatcacgagccccaactgccccgatctatcgtaaataattcctctcgctcccgggagtctttaatttgctaattaattaattgcttttctctttcgtcgacttaatcgtttttctcgaaattcctttggcaacattagctgctttttgtttctttacattcatttgtttcattactaatcatatgtcacttttcctccgttttctgcccaacttccttgtccaattagcccttaacgcaacagctggccaggctgtttgcgttcagccaaagttcggccaacaaccactccatcgctcattcattaattcattaaacatctgattaacaattcgggagggccaaagttaagcccgctcccgtttctctctcgtgatcaagccaatttcgtctttttctatttctgcctattaatttcgttttgtcccccttaatttgattggaattcgccgccgtcgacgaaaatgctgacacctgttggttctctcactttggccagcagacgccgccattctcaattttgcccgcttttgttcgagcggaccggagggaggggggggggggtggtgaacaccattgaaacgggagaagcaaaagaatgagagacagcgagagagtgaacatgttgagcgttacaaaatttgttgatttgactttttgttttgggacggagcaaatttaaataaattttctat

SEQ ID NO: 4809 - DNA, 3877 bp, Heterodera glycines
attaaacgagtccaaagtgtatattatttttaattattgtgatttttttaacacagcaatcgattgactttccaaggccaatttcagaaattagcccaccttattttccaatgatcgccaaatccaaaaggtgttccgcttttttttttttttgaatggtccgaacaggacgaatttgactgtccacggcaaatgagcgttagccacgtgttgcgtttgtccggttgtgtcgaaggcaccgctcagccacctgttataactgtgaaatttagttttggtttctcaaaacaccaaatttatatttttgccgggttttctggcacttttcgttttttcctcttttgttcgtcagtacttgtgggattccgcagtacctttgccaacagttctttctcaatttctcaccttttgctgacaaattccttcacaatttctcgccgtttgttgacaattccttcgcaattcctcgccgtctgctgccgcccaagtttaactttgatacgtgacttgtactacaaaagttgctccaatcacgaattcaaaatagaataatgtttttctgctaaaacattgtgataatttagggagaaaacttttcggatttaattagacaaatatttagcgcttaatgaaagaggaatttggtgtttcggctaatcgaatgaatgaatgaatgaatgtggggaggaattttggcctaggactccaactgatcacgagccccaactgccccgatctgtcgtcaacaaattttcttctcgctcccgggagtctttaatttgctaattaattaattgcttttctcttttgtcgacttaattgtttttctcggaattcctttggcaactttagctgctttgtgtttcttttcattcctttgtttcatcacaaatcatttgtcactttttcctccgttttctgcccaatttccttgtccaattagcccttaacgcaacaactggccaggctgtttgcgttcagccaaagttcggccaacaaccactccatcgctcattcattaattcattaaacatctgattaacaattcgggaaggccaaagttaagcccgctctcgtttctctctcgtgattaagctaatttcgtctttttccattttctgccaattaatttcgttatgtcccccttaatttgattggaattcgccgtcgtcgacgaaaatgctgacacctgttgattctctcactttggccagcagacgccgccattcccaattttgcccgcttttgttcgagcggaccggaggggggggggggtgaaaaccattgaaacgggagaagcaaaagaatgagagacagcgagagagtgaacatttgaacgttacaaaatttgttgaattgactttttgtttggggtggagcaaatttaaatcaactttctataggcggagaaatggccaaacattaaattggcagtttattttctttaaaaaaacagtttttcattcctgacaatttgtaccctttttattctttctttattttatttccaaactttttaggcatttgatccaaaaaaatgtgggagcttaaagtaaactgcccaatttcttgtcccgcttctcatttttgttgggagccagtcgattatacggcgcccaccatttgtcttgccgggggcatcaatcccaattccttcctaaatcatttgtcgctaggcgaaaacaacgtcattctcgcccttcttcttgtcatggcggggggaatagcactcggatggatttgctgtctcttcttgatctgctgcttccccacttgccttcgtccaattcgtcgtcgtccgtcaaagagccgaaaagagtccgcttccgtcaaagatggtcatcgcactcctcctgtcatccgcactccgcttgttgtccatgcttcgcgtgcttacactgccgttccgtttgttgagcgcgaatctgccgtctgaatgtgagttttttttgccctaaaaccgagtcataaaccctttcttcaaactctttttctcattttcccattttgaaatttcttgatttactttccatttattttgcctctgatcacataatttttctcagatcaaatcagtcacatcacttaccgtatttcctcgattataagccccggggcttctattgttcaacccccctccaaagggggcttatattcgagggggggggcttccaatcgagggggggcttttattgttcaacccctttccctatataaattcttaaaattttttgctttctgcataatggtacaatttaaatcttaatctaaatttttgaattgaaaagatttttcattttttggcccttggaaatttaggcgaatgtttgaaaattcataattcacttctaaatgaatcaataaagtgcaaaaaagcattaaaaatagagaaaaatctggagcattttatacttttttagaatattctatcttcaaaatgaagaagttattacataaattttggaaaaattcgttttttgagaaaaaaattaatagcgctgttctgaaaaggttttttgaaaaacacgaaattcttcctctataagcttctgtttattctatatttttataagacttttgaaaaaaagtacaaaaataaactgattttggaattcgggatcatagattgaagcaaatggtttttttgggccatgggttcagatccacttgcctgtaaaaatgttttttagggtttttgggaccactaatcaagaacttggcatccattttgcccaattccaaagccttgatccgaactcgaaaccccaaaaataattttataaatgttgcaggcatgtggatttgaacccatggccaaaaaccccatttttaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaagtcgaaaattttgaagttttttcgtaataaaattattccaggcttgaaaatcttttcgcttttggtaaggctaatagagcatgttaagagctttcgagtgataccaacaatgttgtatttggatgtcaaagaaaaaagctatcgtggaaaaagagctggcgccgaaacgcaagcgccgaaacgcgtgggtcccgtttgtacatttagtctttctaaaatattttatgaattttaaaaaaatactattttttcagaaaatttttgtgttttaaaagtatttaaaataacaaataaatattataaaattatccataaaaagcgacgaagaaattgatgcagaagtttcctaatattttttttgttaatgttttattaaaacaaattgttcaatagtttttgcacgtttctgacttcaaaagttttgaaaaaaaattttttttgaggggggcttatattcgaagggggcttctactcgaggggggggcttctatttttcaacccccctccaaggggggcttatattcgagggggggcttccattcgagggggggcgtataatcgaggaaatacggtatttgcttttttaaacattgccaagtttatccttttcaacactccgagtgccgtgccatgttgatgaattcgaactgtttttctcataatgttcaattttggatgatttaaagtcgctaagaaaactttaagaacgagaacgaaaatgtccccctgccgtacaaaaacgtctcccttacggaaacaaccataacgaccctgaccgtgcacttccggtttacctcagttgggccccagcatatttttggactatatatatttttttcattagaaactttacgatcttggcatcattagaaagctt

SEQ ID NO: 4810 - DNA, 1067 bp, Heterodera glycines
  misc_feature (1053)..(1054): n is a, c, g, or t
gggggcgtataatcgaggaaatacggtatttcttattttccaggcctccaaactcctgccaatcaattcgctcattccagcctctgctgtttccgactgaccattccgaccgattttgcctttattcccttcaattcttctccattgatcacttttgccacttttcctttgcatttttttttactccgatttgcttttcattcctttaatccacttttttctttgtttttaactatctctatttttttattactgtaaattaattcactatatttaaatatttcgaaattttatcgttttgaagataatcccgagggcgggacctccatgaaataggcgacgggtccctccccaaaaatcccacggcggcatttgaatatgctctttatttcagtaatgtgcgcacaatacaattatatatgatgagtaaatgatgagtaaatgtgggatggggaagggactcccagttcggtctcgggataattagtgggaggagggagagagattgggggattggctaagccaatccctctcccgaacagaatgaatgctggccagggacgggggacacaaaaaaaggaaaggggcggtacactggtaaatgcctattttgtattttttattttgatcagccataacacgcttcattcccaacaaaaatgaacaaatttggtatctaaaaaaagattttgaaaaggagaatctttttctaagtgaatgctaagcaatttgacatctcagaaaaaagttgtgggagtttcaaattttcattacgttagaactcaagtcctaaactactgttttcaccaaaaatactaaaatttattctttttttatttattctatatgtccaaagtgatcttgtagcctataaaccaaaattgttagaatttgagagtttcatgttttttatgtgttagagacatgaaaatagtacgccaaagcgagagaaaaagaaatgcaaaattttcatcacactataacttaagcaccgagcgtaaaaaattaaaaatcgagcgttaaaagaggttcgtaatttttttctctatcganntatgcaaaatttg

SEQ ID NO: 4811 - DNA, 3553 bp, Heterodera glycines
  misc_feature (31)..(31): n is a, c, g, or t
tttttagcacaaataaatcccaaataaaatncgggcaccctttatttttcctgctgttaaattgggcatcgcgatatataatttgaaatttttgaattttttaaattttgtcttcaattgattctaatgaatacagtaagcgtcgtgtaagcgttgtggacagttcggacgatgactatcgctacggtattttgggcaagtcgctgcgccaattcaacgatggcggggaactgtatttgcatgacaaccatcgacggaatgacacggaaacgagcagcagcagcgctgaaggggcgacgacagtgtcaaatgcaatcggcagaaatggtacggtagcaataaggaacgaatactgtaatttgtttaagtacggtaataacagagaagaaaactgtagtttgttgccaatgtgctgctaaccttttgaaatttataggaaagcatttaaaatttaatgaacaagctacgatggtattgtacaatcagctttttatttttagaaaatcttactgtaatattattttcaaattctaaaattatattttaaaaatcaaaactttagttttattcgtttttttcgaaaaaaaaaattatttttgttgatttggttttggccagatttatttttgttgttaattcgatattttaagaagttttctgaatacatgacccaatggtttacggtaataagtttttctacgtcctactgtatcggtgtattctccgatcgacttccaattttgcctctctatcaaaaatgccatcgttgctcttcacccagtgctggcaacgtcgattgtgccaaaacggaaacggctttcacttcggcccgccggcgactacagcggcggtggtggcatttaccagctgccgcttcaggcgaccacagcggctggcacaaataaagccggcggcggcggatttgacagccgggcacgctcaatccaagtggcagaagagctgcgcagggccgcaattgagggtggcatgcgcagagacgaaggcggcacaatggcggaccatcaggcagcagccgggtgggctttaaaaatttttcgagcggtaccgtactcgtcgtatcgttaggcgacaatggccaacccgtgaaactgtaactttaatagattactgtagcatcaccgtcataatttcttgaaaagtaccaggcccatttggctacgccctcagcgcccttaatcgtttcatattttcttggacaaagtaccaggattctattagatcaatttattaataagtgaaaatctacatgtttctttttctgggagccccaattttttgggagggaaatgtcacactaatttggtctatttaaacatggacagaaaatcgtcgtccgtgaacccatccgctgctgctcgtggcgcttgtgatggcgacacggacggtgacgaggcgcaggacggcgccggggacggcgcagcacgcgcggcggggccaagcggtgggctaagtgccgaggagctcgaagaaatggcaaagctggaagggctcagcaaaggtgcagctggattttggctttggagggataccctcccacgggcggcaataaaaaaaagtttgggcaacgagggataccctcgatttttaataattttcacgaaaaattgataattttgtggattttgagaaaaattaaacacgaattttgtttgggaaattttggtaaggaaggtcttggagggggtagcaactaggaaaatagaaaattttctgcaaaacactaactttcccttaaaaacaacggctgtgagagactaacgtgaatctctaatcataccttaaaatacattctacaaaaatgacgggtacagtatgcaatgtttgctttaggcggtgatcagggcgcactgttgctgcttatgtccaagcaaacgaattgccaaggagtggagcagctggtctcatccggcgcacagttggacatgagcacatccgactcacaggggtgggctgatctggcaattaaagaacattgaaatacgttaaattttaaccttcagaaattttcaaaaataaaaaaaaattctaccaaaagtttaagaaagaaaattttgattttgaaaaaacttagtcattatttataaaaattttaaattgctacaaatatttttcaaactttcttaaaattttattaaaaaaaacttctaagatttttcaaaaaattctaacttttgaagggggaaacgagctgctcccttttgaaacgtaattcagcaagcactcagttttgctgctggttgtttcggcaattctctgatttgacaccaaatttttctgtctttggtttagatttaataatttcagttttttcgtttcatgactccactcgggtccatttggggttaattagggccaatttttgcaaaaatacttctaattgatcaacactgatcataagtgatcggcactgatcagagagactctctgattcttcctaatatgtggtgattgacttcgtcaggtacacgcctcttctgttggcagtccgtgccggccttttggacattgttgatctgatgattgagcggggtgccgacctttacgccaccacaaaggcacttatttataaaatttattttttaaatggcaaataataattcaggatcggttgaccgccgcgcacatttgtgcccgttggggaagcgaagaaatgttgcaaaaattgttggctctaaaagtggacatttcccgaacagccggggtaactttgaacagcattttttttagaaaatttaaaaggacataaaatattttttcaaataatttgaataccgacggaatcgacggttagcattttttagtgggcatattgatcaaattatcagattaaggccataattgatcggtctcaaatatattaattggtgtatgaataattttgttcactcattagtagggcaattaatttaagttaaatttttaaatcattttttatttttatattttttgtattttcacattgagcttattgctaatggatttgttcatattttgaacgttttttcagcccctcgggcgcttgcccattcacatgtgctgtgagcggaccagcgcacgtgctgtccccgtcgcgcaacagttgttgcacacagcgcccggcacgcgcatgcaggcggacaagcgcggcgcgttgccactgcatgttgcactgcgtacagctaacctggccatggtgcagttactgctccaacgggacggcgacaagcaaattcgagtgcaggacgcggacgggaacacggcactgcacttgtgcaaaagtgaaatgggttatttccagcctgggcagggcttccaaattttccaatttccggtttttttagggttggaaattttctgaaactcactgcctcctgatcaccctcttcttcctcttcaaaaacttttctcaatacaaaaatgggtgctatgattagaatttttgagttaaatctgaagttttattaaacctttggttgtgaattctgaaaaagttaggaaagaaaaattccaaaaataaataaaataaatttaaaatataaattctcctttatcc

SEQ ID NO: 4812 - DNA, 1345 bp, Heterodera glycines
ggtcgtactccgttacatgaagtggccaaattgggggacgaaaaaatgctgaaaattatgtggaaaatgaacgccgatgcgaacattcgggacaaagtcggcaaaaaatagaaaataataaaaatgttaaaatatacaatatatttcgaataaattgtaaaaattatattttttatttaattcttcatctaaatttaattaattataaaattttaaataatttaaaaatattaaatgcaaaactaactagaaaaataataattaaatagaaaacagtcacattaaaaatagaataataaatttgatttgtaaatatattttctttttgtttaatttaagaaactgaactgtatttattttcttaaataatgtaattaaaaatgtttaaatattcgaataatcgaaaaaattttaaatttaaaagttaattgaattttaacttaaaaaattgaaacgttaattaaggaagataaaacgcctttgcatgtggcagcggaaagaggtcacacccaagtggtggagactttgatcgacaaatttgggcaaaatttatttaaattttatattaaataaatttaaattattacattttgcattttttattaaagttcctcaattcgcgcccggacaaaggacggcagcactttgttgcaccttgtttcagcggaaggtgcttcacatttttcaattttttgttaatttattttcaaaatgtattcttcaggtcatgctgacacggcactcgcttttctgagtaagtgcaaaatgccataaatttcaaaaaaaatgaaaattccaatattcaagagcgtggcgttccgttgtatatgccgaacaaaagtggcgcggtcagcctgcacaaggcggctgctgccggatacaacgaagtggtcaaggtgggctgatgatatatgcgtttattaaatttaaaaaaactaaaattttggggaagtaaaaaaatatattattttatattaattttttgaatttgctaaagtccccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaa

SEQ ID NO: 4813 - DNA, 4211 bp, Heterodera glycines
actattaaaaaaatgaaattcgataaccaaattgtttcggatttgttaaaatggccaaattcatgaaaataaatttaataaccttgaaatatggcatttcgagcaactctatcaagtctcgaacgtgctttggtttaatattgtagtaccgttatccaatttcataatttacaatttcgctaatttattttattgccccctaattaccactcactaatttttattttttgcccatttcttccaccgtcatcagatactaattaaccgtggcaccaaagtggacatcccaacccgggacaattacacggcactgaccgtcgccgtccgatcgggccaagcttcggttgtcgagacactgctcggctttggcgccgatgtgcacataacaaatggccaaattggcgaggtcttcaggccaaaaattaataaattaaaatcgaataaataaattaaaaacaaaaaaaataaattataataaattttaaataataaatttaaattttatatgagggaaacactcaaaaattaaattcattcaaaaatttaatgggcatttgaaaaattcaattttaaaaattattatattttttaaattcttaattttaattttattctactctactttaattccaatttaatggacgaaataaagaaagaaaatatgaatttttgtttaaatgttgatcttttcactcttatgaattttctttccaaaattttattaattttattaaaatttgcgggtcaattgctaaggactccgtggcgcaatggtagcgcgtctgactccagatcagaaggttgcgtgttcaagtcacgtcggggtcaattaattttttccattttttaaattgccatttttaattgctaaataattttaatttaattttatgtggttttagtattgcttaattaattttgacaaaattaaatagaattaaaatataaattccaaaaaatattttaaaaaacacttttgcacacagactgcactgcatgtcgctgcaggtttgccctgcggggacattgaatgcgctcagatgctgttggtccgtgtaaattccaaaaatgatgttctgcttgcgtttttcagaaaagtggcgcgcagcccaacgtacagcgtgtgcaggacgggcgcacgccgttgcatattgcggtaaataaattatgtttttttttttaattttaaaattttgattttaaaggctgcggttggtcattgcgcaatgtgaggaaggaattttttaattttaatttaattatctccaaaatttttataaataaatttttaacgagaaaaaaattaattaggaaatttattgtgtaataattttaatcatttttaattctttaatatttttaaataattttcccattttattatttatttatattgtttaattactatcatttttttaaattcttaggtgccgtttgttattggctgagggggccgacgctcaactgaaatcgaaggtgaatttgacaattataatacaaatgattataaaaattcgaatatattttaattttattaacgagaaaaaagtcatattattattaatttaattaataaaataaaaatatatttaaacatttaattaatgcctttctctctactcattttttaatcaattaacttggtaattaaataaatttcatcaaaaacaactaataatcattaaaaaagttaattagttttttatatttggaattaaaattaattaatgaaaataaattgcggaataaaatgccgtaattaatttaaaccgttaattacgaaattattttctcgcaaagaatggcgaaacggcgctgcatttggcggccaaacattgtcatttcccagtggttcaactgctattggaccatttgagcagcagcaaagacgcggacagcagcagagtgcgcagctttgtcaatgccataacagaggtaaaaaggaaatttaaaatataaaatttaaattatttaaatttaaaataaggatggccaaacctgtcttcactatgccagccaaattgggccagagcaagtccatttcaaggacgaggatgccaaaattgtgtcactgctcatcgacaacgggggagactccgagctgcaggcactcagtgtaagcaattttaattttttagaaatttttttgacaaatttaaattttgaattttacaattttaatttttggaaattttcttgactctgtttaaatttcagaatcttgaaactgcgatgcacatgtgcgcacggacgggcaacgaaagcatccttttggcaatggtaggagaggattgaaaatgagggaaaatggggggacgaaaaacaaaaaaaaagtgcatttattgaaattttgaggaaaagcctcgacctggattcaatgttgggcctggatttctttgacaaaagtcaggaaaacccaggtccaggaaaaattcaggcatgccatggcatggacttgaatttttgttttaaaaagataacatatatttattcttttctggaccaaaatccaggggccagaagaaggccgagttctattttataccataaatttaaaaaagaaaaattacaattattatacgaaattttatatgaaaattgaataactttttaaggaaatgaccacttccgcatattattattattattattattatttggtttaataatgcgtctttgattattaggtcaacaaaattgggcctggcgctgttcagattgtacagaataagaagtcgaaggtgtttttaatttttaaattatttttatttttgcttggcgttctgttcagaatggctggtccccgctgttggaggcgtgcgcgcgtggccatgtgggcgtttcacgcattttgcttcaacaccacgcacgcattgacgtgttcgacgatgcgggaaggacggtaaaaaatttattgaaatttttaaaattttcaattatttaaaggcccttcacttagcgtcagcaaacggacacatcgaattaaccaaacttttgctaaaatacaaagcatttgtgaacaggtctggccatatgtgaagcacactaaatttaattttaacaattacatttcaaaataaccattgttattgcaaattattaagtttttaactttacaaatatattttttataattaaatattaagtttttaagtataattaattaatttaaataatttatttaaaaataaaattaatttatcgctttttcatttgcttaattagaaactttttttttcaaatagtaaataatttctctttgataattttagtaaataaaaattaaattgaatcaataaaataatcaattattatataacaaatctttaatatgatcaaatttgaataagtaaaaccgaaaaaaaaatcaaaataagtaattttttataaataatttttagtattttttaaattaaaataattaagcaaagccaagccaagaaaaccaccctccccccccaattaataaaaagcatccattttaaaattcttaattttttaagcaaagccaagaatggtgaagcgccgctccatttggcagcccaatacgggcaccctcgggtagtcagtatgctcgtccaagagcacggggccagtctcgaagtgaataaatttcaaattaaattgaaaaataatttcgaaatgccaaccaaggccatcactttggacaaccaaacggcactgcacttttcggccaaatatggccaattggtggtgtcgcagacgctgctggcgctgggcgcaaatccaaacgcgcgggacgacaaaggccaaacgccgcttcatttggcggcagaggtgtgatgacgagagaaataattttgtaaatgatgagtagggatttgacaaatattttttaaaaaccccgatatattgagaaaataaagaaaaatgaaaaaatttgggtgtaaaaataattaattgctctatactaccaaaacatttcttcattaattacattgaatataattaaatttttcaaaataattaaaattacaaaaatcaaaaattttggcaagtaaaaaacaaatattcaaaaaaatatttgtcccgtccataatgatgagtgtttaaccaatcagcgttgactccgccccttgcgcaattaatgctgaccaatcagcattgacccccccacgctcctttcttttgtctatacgagggtagcgcaatgcctctgcagagacgctgcagtgaaggcactctctcgc

SEQ ID NO: 4814 - DNA, 961 bp, Heterodera glycines
agcgtctctgaagagaggccatatagcagcggaagatacaaataaaattctgttttttcgactaatgatttaaagaaccatcaaaatataaacatttaattatacatttactaaaatttttaattattttatatcatttgatagcttaaagtatcactgcaaaattcaaaaaaaaaatgtttactttcaaaaagctatgtatgacgaaaatgctcgaaaacccagcaggtcttttgagttcttttgctcgtaaattttttaaatttaaagaactttttagaaattttgcaagcttttagaaaaaacttagggctattaaatgttatgaagaattaaattttattattttcaagaaaagttatgaataattttttgttaaaaagaaattcggctaaaattgtcaaaaaaaatttttgaaggatttcaaacaaaaaaaggcggcaattttgaaaaatcttcaaaaaataattatttttcacagaacgatttcccggacgtggtgaagctgttcctaaagatgaagcagaacaaccacgcggtgctgaccgcggttgaccacagcggcttcacctgtgcccacattgcggcgatgaagggcagtctggcggtggtcaaagtgcgccaatttgggcactaattagggcaatttatattttaagaaaatgggaaaattttttgaatgatgacataattagctttgttttttataaatttgtgattttgtattctgaaggaattgatgatgatcgacaaagcaatggtcatccaagccaaaacgaaggtgaatttgtaaaatataaaatgcaactaatttaataattcaaattaaatcaaattacgctttaattttaatagtgcctcgaggcgacaacgctgcatatggccgccggcggtggtcacgcaaaaattgttaaaattcttctggaaaatggtgccaacccggaggatgagaatgcagttg

SEQ ID NO: 4815 - DNA, 9856 bp, Heterodera glycines
aaaatgcgttggtccgcgcttcgtttcgcgaatgtcttctctatcgccgccgttgtcgtcgtcactgtggccgcctccgatttgctggtggttgacgctgtttcgtccgccgaaacgcaactctttgttcgcgcacggtccaccgacggttggccattggcatggcactcatcggaggggaaaatgagggagccaattctataaaccaaaaatggtttttttaaatcatgagagaatgttgggatgattatgaaaatgatgaatttatatttagcttggctttcactcgccttctctcttcctgctgatggtcattatttctcgtcattgcggattctgtaaaaatgcattaaaaactgtggaattccaatataagttagagaatgatatagttagcaaacacaaaaatccaaaacaagcaaagcttctttaattttgttttttgttaatttgtgctaaggacaacggacataaaaagcaataaaagtaagcaaacagtgccaaaaccaaccaaccccttcgtccgatcgatgcggaagcttttgaggatgtattggttgggatctgttccaatttgtcctgatcatgttgttctaattgtacaacattcgactgttcagtgtttgacggtacaattgacatgcggcatgacgacgatgatcgccgctccgtcgttgtgccgttgttgtttgttttggcattattttcctgcgcggcattctgtgcctgcgtttgttcctgtagcggcgttttgcttgtccgtcggaaaaatgacttaaaatatgaagacattgaagtgacagaggaggaagcagaagtggtcggttgatcggcgagcagtggtgtcgtcttttttggcacagcttccaatggttgtgccgccaaagggccctgttgttgctgctgctcacacttggccacagactttctccggtcactccctccgcccgtgccgagcattatcatatcccgaaaaattgatgagcggcgtcgcgctgttcgttcgtcaccaccggcgacagcagtaggcgacaacgggctgatcggtggactgtgcgcgtcaatgaagcggatgatgctgtcatgacgattaactgccgatgccccgccgcaatccgttgagcagaccagttcaaccaggtcagcaccagctgcagaagaagctgaaggcctctcagaaaaaggtgctgcagttccgccgaacaatggaacggcttcggaattatgtgccgtctctgaagcggcgccgcatgttgttgatgagtcaatggatgcgtcaagggaggagggacgacggcgcctgggcacggcacgggcagaacccaacacggaggagcatttgcgactgcacctaccgttagcgttgtcgcaatggtcgctttccctgctcgccgtccgcgactcggtcgacccttccttcattcggtgcagtgcgtccttaacttgtgccgccgcttcagcttcatctttcgccgcttttcctttcggcgtgtcgtcagtactgttcacctcctcctgcttctcttgcatcaactgtcttccgtcaatggacgacatcagtgacgaggaggacgtctcgcgtgccatcctttcccgtgccaacaatgtgttgcgtcgccatttggtggtgaagcgagcggatcgcacgatgacatgcgttgcggtcatcagtgtcatcgcctggggtaccgcttcagcggccgccgccgccattgtcgacggaggcacagtcagaatggtggcacggcatgtgggcacgtcgtgctccaactgctcgagtttgtgatgcaaataaagctgttgttgctcgtccattacaccatgtccaagtcgttgctgttgttgttttccatcgccatgttcgtcgtcgtcgtgttccgttgcgcaactgttgttcatcaccaattgctgctgtttctgcttgtcctccgcctgtcgtcgttgttgttgtttctgttgcccaatttctgtctccatgccttggatttcgtcaatgctgcacttccataacagttggctacggccatagtccaactcgcgcagcacaatgttcgcctgcagagtgcggtgtgcaaattcggtcgaatggtcagcaaaatctttgttgtgagtgctttctaagtgtgtgcaaagcgatgaaaatgtcagcagaggacaaagacaaaaaaaattgctatttgattgtgctgcggttaattagcggttaattaagcattgtggggttgacgacttagagatttttgtgggaaaagaaaaatggatggactaaaaaattcttagttttttccgatttttctgtacctaaaaaccgctaatagaattgttatggtaaaagcgaaataggacaaaagctaagcaacgatcaaaagacgaacgaacaccaacaccataacaacaacacatgacattctctcactcactcactttgccggtgctgctggtgatccttaaaatgttttaatcggataaattatttgtatcttttataaaatgcctaatcatttgaattccccacccttcctatttacaattgttgttgatgtcgttgctgcaattgttgtccgtctcgccgacgttggcaccgtaccaacggcgggcgcctgttgctgcttttgctgctgttggctcattgcactgatggtgccgttgttgttgatgtttgtgctgctgctgttgttgttgtttctgtccaatgcctctgccgatggcaccgcagcagctgtcgtccccgtcgcgttgccgaacggcgccgacggcgacacattctgcggcaacattcgcccagtgggcgtgacaaaggcaatttcaacctgcgcaatgcggaaacccagtttaaaagaaaatataggtccatttggtctaactaatagtcaccaattaatttatgcattataaatgtcctgatcacttttcgtttacacaccgactcaaaaaaacgagagatgaaccaataaatagagagtgcagagaaaaatgcatctctcattttggcgtactatttatttatccattttaatagagaaagactgaatttacttcgtgacgtttaaattttttttctacacgttgaattcgcttcaaattttgcatatgatagagaaaaaaaatctgagggtttttaagaccaaaaaaaggattagctgaaaagcgcctatatattttttataatgcatccaatcgcttatcagatgcttagaaaaagcttctccttcttgagagctttcatttgataccaaaccgttcaatttggctggccttcaaaatatttaaaaatattaatgtcttgtggtgggcttaaagctcatcagccattcccttttctatctttgaaaaactactgaaaatgagtcacacatgcgaatcttttttggtacaggctctcattttccggatgtgttaaatgatcagaattagttgaaaattcataaaaaattcgggtgcactgatcgggatcagttcacgaccacctgcgcgtcccgccagcgaatgtaatgctccagcccgtccagcacatatccctgtgggtgcggttgagggggcggcatcgaatggctaagcggaggtgggggaagcgacgggacggaggcgccgcgttttgccattttgggcgatggagggactaaaaaacaaaaaatcattcagttaaaatgaaaacaatttttgcccacttttcatcctgttcagttgaggcggagcctttcgcgcggtcggtcggcccaattggcacatcagccgacaaaagagggcattcgtttgcctcagatcaatctgaaaatgagggaattgctcattaataaatatattccgatccacccaaaatctcaccgccgaaaccaaaaataaaaaattcaaacagattttttttcaagatgaattactaattttttcaaaatttttccaaaaaatcgcatgaaaaatttttcaattggaaattttctaagttttttgcttaatttgagattttatcccgtcccaaatcctcccttttcttacattgttctgcaaaatttcttccgcgttccgttggccttcgcgcacataaaaaagggacaccgtttccgtcagtcgcactgggagctgatcaaccgtaacggacagcgaatcgtagaaaatttcactgcaatttttaagagtttagatttagtattagttaaatcaatttttgtgcttgctcacaatgatgaattgtcgagcggtgtgaattcgcggccgaacgcgcgtctgttcaaaagtcccatgtcgtagaggaaaacgcggagggaattgcaaatggcgacagggctgaaaatacgcttatttaaaaacaaaaagtgttaaaatgccaatcacaatgaatgggcaattaaaatttgtttaattactcaaataattgatcaaaacacctttccggcgttggcactttggtcaaaatagcgcccagtgacgcgttcagccacacattgcgcgtgtcgcggtcgcccaccggcgcgttgccctgcgcgagacgcgcgcggatttgtgcaagttgcgactgcacttccgccacggggccggggacgggctcaagtcgagggaattgtgcgtcgctgaaccattggaaattgaattggcaattttacgaaacgtccataatgcactttttatgaaacgacctagcacctattctcccaacccgaccatcagaattctcactttttagttaaataaacttcgaaattccggtcattttcaattaaaattatggccaaaaactaaggtttaaagggcaagcaacccaatgcgtacagtttgcactggggctgcagcacttcccgtgggatttcgaactgcttcaccggcgccatcctcgtgccatttgcgccgttttgctccgttgccgcgggcgtttgggcgctgagtgaagcggttcccggactcggtactgaagcggcggcggcagacagttcggaggaagaaggcgagcagaagccacctcaaattaaatataacttaaaactgaatgctatttgcttgctccaccagtttgttgctgtctctgttggtccgtcgtcacagtgccgtcgcttttgtccccgcattttttcggcctgcacatcgcccggggcaacagctgaagcagcgtcgcccacggctcgtaaaagggcgtccggaaaatggcgacaaccgccggaagtccttgggaagaaaacaattccgtttccaattagatagttatcgttttaccgtccgacaagtgaacgatgggctgtgcctcgtacagtgacagaatggtggactcgccgatgtaaaagtgccgaaattgggccaaatccatgccaaacttttgcactaatgcgaattcgtcgaccgcagtctcttttttgtgcgtctgataatttatgaaagaattgtttattccttttcaactttttcatttacttcagtaaaaagggaatgcaaaagcatttcggccgcgtcgcgcaccctttgactcgccggtttgtattggtcgggagccttgagaatttttaaaaatacaaatatccttttccaaaatttcaaaaatcccacagtcctgacaatggattccataagtttaaaatgctgacttccatttttcacaattaccaaatgtccttcccccgcttttcccaccatttctttgcccccagtgacgcccaattcgatgctttgcgccactgtgctaagacaactttcgatctccgccaacgcaggcgcggcattcagccacacattcatgcaggaataggcggcaacaacctcaaaggatggcattcacaatagtattattttattaattagcatcattttggcactaatagcccgaggctctttctaaaacaatttaaaaatgattggcacagctttttttaattttgatgctaaaaatagcagatgaaccgcaccgtggaatgcatgtcgcgtgaatggtgcggaggcgacttttggagttgctgatcaatgaagcgacagagcgaagtgataatcagagagccgatggacaattcacctgaaaaacaataaacttttaaaaattttccaatgttatattttagtaagtaccctgatgaaacagtatttggtgggacaacgagctcaagcagttcaggcagtcgaacgcggccaaacagcacagcgtgtcgctggcccagcccggcttgcacaaattgtcgcacaacgcactgacaattgcacgcaccagcgaaatggagaagggcggagccactgaaaggggacaaaacgtcgacagaatggacaaagtgtcacaggggaaagacaaaatgaccactcagtgctcaccgtcttctctcgcactctgttcgtctgtcacgccggtgtcatcacagtctttctgctccgccgcagttgttgttattgtctgactctgtgccgtgtcatcgccagcagtcgtgccgaatgtaactgccaaatcgtatcgcgcactttcgcacgcgaaaagcgtgcacagcgcaagtgccaactgcacattggcgggcacagtttcgttgcgcagtgagtgcaccagcacgcgttgcatgcgaacccttagggggaaagtggggttttaaaatttaaattaattttcaacattaatatttttgaatttgcccaattagtatcagtttttcattggcaccacctcaagtcggtgtaatgctgctccgtctccagcaaattggcagatgagccctgacgcaaaattcgatttctcgagggggacagcgaacgacctttgaaaaggaagggacgaagataattaattaattaattaaattggggattaactgactgagaattaaattgctgccaaacactgagggccatgccaacacggaagctaatgcgcgaagacaggcggcacgcatttccgcctgactgaccgaagggtgcaatctgagcggaaaattaacacaaaatgacgaaaaatttttgaaacaatgggggaacaaccgcagtttcatcgactcggtgtgcacaatgtcaatggccatcacataattgggcagcagaatttgcacaccgttcagcgccaacttgaacaattcatccgaagtgtggtaaagcagggcacagagcatgagacggtcacgctgagacaattaagcgaaattgtcaataaacaaaacaattagacatgtactataaaacgggaaccgcccactttggcgcgggtattttggcgcgaggttttttggcgcgagcttttttggcgcgggccattttggcgcggccatgccctatttaaaatggcttttatggcgccagagctgaaaaatctccaaaaattttcagaaaatttttagtttgtctttctttatggataattataagccattttctttaaaagaaccatgttaatacaattgctagcaatggtgcagaattgtggtgcctaatttaacttttatactttggtccaaaattactattcggtgggttttcgagggtaccatagatttgactaattacgaaccccggactcaaattagaatatgtatactggatttggactcgaaaattcgtaacacaacccaatattcgattgtacacaacacttcaaataaaaattttattttttaagcaaaattacatcgataatgtagcgcacagcaggaaaaaattgattttgacagggttagttctaaattttgaaaatttttaaaaaattcttttacggcgccaaaaaagccattttatatagggcgccaaaacggccgcgccaaaatggccgcgccaaaatggcccgcgccaaaaaagctcgcgccaaaaaaaatttcgctccaataaaaatcggtttacctcggttgggtcccggcatgtttttggactaggaacttttttctttgtcaataaaaatccaacattgtttgtattattcgatagccctaagcgtactctattaacctgcaaaatcccaaaaaatttcgtcaattttgaacaaagttatgaccaaaagtaccaaaagaaccaggttttcagacattgttggccagcttttttgaaactcaacgaaattttttgtaatttttcagcctaatagagattttgaagagctagcgaatgatactaacaatgttgcatttggttgacaaagaacggggcaggcccgtatccagggggtgaggaaggggtggcacgtgcccccgcaccgaaattaaaaattttcagagaaaaatgggcaaaatttttaaaaaatttgaatattttcttaccatataccattaaaattttctgcggcgctattggcaccgccggacctctttgaaccaaaattttttgaaaatgtgaccccaaaaatggcaaaaatagtgatttttgacgcaaaaatactacaaaatcctgctttttcgccccagcgtttaacattttgaaaaatacaaatgctcttcgggtgccctccccgaaatttttttctggataaactgagcgagtccgataaaaatgcaatatgtatttgtgtttttaatttttacacatagacaatgtatacaaatgattttacagacaattcaaaagcataatacataatttttttataaaaaaccaagctagttttgcaccaccgaacctaaaatatgaagaatggaatttcaacatcaatgaaaacgcctaaaaattggttttgattttaaaaatggacaattaaaagtgattggttttcttttcttgggtcgtcgctttttgcctcaacttcgtccgtattgtgcttcgtactgtgccctggccgccatggcatcttccgagtcgccctgttggctggcacaccacagcgcaacatcgacggcaccgctctgctccagcatggcggcacggcggagaaatggcttttcctagcaaaattcaaagaatttcgagggcgctgattatgaatccgatcttccatttcgaccaattaagagtcccgggctcaaattcgaacatttggtcgaaaagtcaaaaattatcaaaaaacttttttaccaaataatgtatgatcaacaatttttcatggttttgaatcagtgaattgagaatttttgacttttcgaccaatgttcgaatttgagtctgggactctgaagctattttgggctatgtcacgaggaaaattagtgacagaaatttatgaattgctaaatcaacccaaaaataaataaattaaaaaacagcaacgccttgttgaaattcatttgttccttggataagcggatcaaaaaataagtttaaaatgttgaaacaaaacacaaataacaactgttgcaacgaaaataattgtatataagaaatataaatggctagcccttcttgtccgttgtggtctagtggttaggatttgagactctcactctcaaggccggggttcgattccccgcaacggaacaaccttttttcattttgtgaatttgcaatattttttattttttgttaatgacaatgtaaaaccgattttttctaaaacttacaagcaattccctgtacttcggcctcttgttcatgtccttctgcaaacagtcggcaatgaactgacagaactcggcactgaattgccgaccatcctaaaattatgggggggggggggggaaatttgttagttttttctccaataaattcatcccacttggttaggctcaagacgcggcgggtcattgttgtggatggtgatcatcaactccattgcgttgttgacacattcgtaggggaatcggccggtggccaattggaacagtgtaatgccaagggacctgcatttcacaaattttggcactaattgttatactaattaatgaagttggaaaaaatttcccgagggcgcttatcggcaccgccggcccccaaattcccaatttttcttaaaaaaagggctcaaaatcgcaaaaatgggtcattttttagtaaa

SEQ ID NO: 4816 - DNA, 4960 bp, Heterodera glycines
atgcatcagtcgggaatcccgagggaaagggggtgcgttagggtgggaaaacacatcggacggtgtgccctcatcatcatgaaaatattcgcctttgtccgctgttttcgtttctgttgttcgatggttcggtcattgtctgtgagcattggtgctgctgaatttgtgccgccgtttgggtggacgacgacgtcaaaaggggcggcaaataaatgtgcgaagagagagacgaaaagtgagcggaagaagtgaccgtcggcggaggggggacggggacggctgaacattgggccccaaattcgatgccggtgtttgttttttgttggtaattggtttggcactggacactttgggcacggaggaattcgtttggaaaactctgctgctgaaaatgagttttgcctgttaagaaaaaatgtctcaagagtaatcccatacattttcttgcatttgatgatggaattgtcggggtggcatttcgaaaacggcgggagacagcgtggcatttgagtcgtaatttgcgtaaaagctggcggaggacgacccaaggccaaattgtgcgtcaatttgcgaggcaaccgaacggtacttttgtgactgttgtcgccctccccccgcgcgttggcattcgtccgtttgcgttgcgactgttcgccgtccgccgatgggaaatctaatggtttaaatcaccagccaaaacaatgctaatattgtctttctcaatacacaaattcccaccggggcaaaatgtgacggaagcgcacactttggcccaaactaatcggaacaagaaacacttttggcgggcaacaaatgccattcgtcggcccttttggcagtggcgaaaggcgcgaattcgaaattgggactggtttctcagcgcatttcgcacttcgacaaagctgtgccaagaaaaggtgttttacttcgttattatttcggcttttcctccgacttttttctgatggtagcgcaaatccctcgccaaagcaaagcgtgccgaacactctgagcagcggtgtctcttttccgtgtgctaatgggatgaaaatggccaattagcaacatagcaattagtatattataatggaaatgaatgaatgtgtggcgactcaaatcatttccattcctaccgccgaccgttcgttcgttttgcccaccgttttctgaaagtgctgaaccaacaatttcgcggatgcgaagtgcgtcccccgcgtgccctcccccctccggcgacatccatccaccggacaatgaaagcgaaccgccgctgcccctaaacacaaaaagtgcaaaggtaattaattaatcggatctcgtaaaacgaagttcaaaattgacagaaaaatgtgccagcatttaagcagaattaactagtcgataacttgaaatttggacgcgaattgacatggtttaataaaaatcacaataacccaattattacaaaacatttgtttttgggaatttctctattggggttattatataattttggtccttctgtactacaatatttaatgctacaaaatatgtttttaggaatgaatactgtattactgacggattttcagggagccagccgactaggacgacattcaactcatttttggccaactcgttttttgggtcgaaacccgaaaatcgagaccaaatcgcttaaatttcaaaatattttgacctaatttaattcgggaatattttttatgtcattttaagtgatttttaatagcttaagaccaaaagttaggaaatttgaaaatccgaatttaaaataggtccaaaaatcttagaaattctttgatttgataattattttcagatttttccatcaaaaaaccgagatgtttttaccgccgactaaaaccctctcacaatcagccggcctaaaaatggaccgttagcagtcgttgtaatcccaaaaatcgcatccaaagtgccaatattctcttcatcagcaccgccaaagtccgtcccgtgccgttttttcatgtgaaaatacatggaaccccgatttctgaatgctttacagcaaaaagcgcatattggcggcgcacctttcgacggcgaagcgcccaccgccaataacaattgggactcagttggacggatgtcaattggcaaatccatcggaaaataaaaataaatttattatttgtttatggaaaagataaaaaaattcactgattaatagggaaggcaatttaagtgacgaactatttatacttgggtttctgttgtttttggaatataaaatttaaatgaaataagaattgaataaaaaaagaggcttttcaaacttcttaacaggctcattgtcaggcattaaaattgccatccctactgattaaacaaatctgttggttaattaatgaatttaacgaaatttatcgaacgagatatgttttgacgtataataaaaatgcaaaggcaaaataaaaaatcgtcataaaaacatatcacagtgtaaaggaggataatgcggaaagcatctgggtaatgattaagatctggaaaaaataaacggaaaataaatgttaattgtaaaacttacaatgaggacccagactcgaaattactcaaaactataaatttagcagtaaaaaatgaaatatatggaagaatttcctttattgcgctttttgagtctgggcctcacattaatatttaccaagtaatgaaaaatgccttaagataactgtacccggaaaaaaattgaacacaaaaaggaaggggaaaatgaatgtaagaaatcaccgggccaaaaaaaagtattaagtctctccgtcgtcgattttgtcgtagcaaacacaataagtggccaagaagtagtttttgtcgattatgcagtgcggtgtgtctccgtatttgttcacgtgactgatggccgtcatgtcgacggtgatgcgtcgctgtccatcgaagaacagcgtggcctatgattttgattgtattggttagccaattcggattgctcatgttttttgttttgagtaacctcgtatttggcattcccgggctgcgtctggaaaccgatctgatatgtggcgaacgtcgtcttcacattccccttcaaatccggcacaaatccgtctgcgtccttcacccccgagtatttcatcaaatccgaatttggcacgagcctggataaaagaagcattgatttgttataataaaacaattcgcccaccttttggcactgtccaatttagacaacgacagcagggcacacagcttcctctccgattgggtgtattcgttgatcacttttatcaccgacttagccaaaatggcaatttcgtgggtcgaattcggcaccgattcccagcccaagcaagtgcaccaatgcggttcaatgccggcctatacattcagttttaatagagcggatttagcaaaatcaaaaatattaacaaagaaggtttaaacatttcagttgtccattgtcacctgatcacacgtccgattagaaggaatttcgcgaaagaacgaaagcgaacgaccggcgggaggcacagactttgccttggaggacgaaagggcgacgtcagaagaagggggcagggacaaataatccaacggaaaaggccatctgattatgtgttttggggaaatatcagtttttcctccctcttttaaggttagccgacatttgcggaggaccgccttttgcggaccgacatttgtgactaaatataaaaaaaagagaaaatcagatcactacttaaggatgatatgaagtgatcaaatttttagcaccaagaggaattgaaaaaagaactttttggaaaaactttataaatttttcatattttcattcgcattaacttgcttaactccgaaaaatcacatataaaattcaatattcaaatgatcatccaatttaagaaaaaaatttgtttttgaaaattaaatccagaaattacgacccgcaaatgtcggtccgcaaaagtcggtccgcaaaagtcggtccgcaaatgtcgcactacgtcttttaaaccctcccacacgcacttcgcattgaaccccatattatataagttttattagtttaatcacctcattgcgtccattagcgtcgcatggacatcaaacggcgaagtgagtcgcttttgtgcgttcgttttcagatttgacagaattctttcaacaatttgaggcgaaattccgtcgattgaaggaggaaaacggagggagaaaaatggcaatcgctcctcaagttgtcctgagaatgtgataaaattataccttcaataactagctgtttttttcatttaagatttgtttttgtgtttttgcatatccacaaaagcgatcaaaaaaatgtattaaaaatgcagtaaaaaaggtgcgggcaattaggtcgtaccataaaaaatatacaaaaagtgttttcaactgtcccatcttttgaatgccttttccggtttgtttgcccttcccattccctgccccccccttcaccttggtgcgtttggcgaaggtcagaaaagcgtgcgccgtggtcggccattacaattgccacagcgttctcaaaagcgcccactgtgagcatcttcctcagatggttctccaaatcgtcgtccacttgctgcactcggttgatgtcgtcgtgtgacaaataagagtgatgcataagcgaaaaacggggaatgcccaatttggaatattcgcgccagaacgattcgatgtaccggaaccaaacctgaaatttggtggaatatttgaatctaaatttaaatttatttaatattttaaaaacagatataagtggtttgtaaggtgtaaaattttaaagtaaaataatggaaggagaagtagattgaactggttgtatacccaataataataatgttttgctcaattcaaaaaagagtttaacaaacaaagccccctccccccccccccacttgcattgtgctgtttttcattgccaatgcacacgtgagcgcgttcgaccgtc

SEQ ID NO: 4817 - DNA, 7406 bp, Heterodera glycines
atcaaagctgtgtttgtgacagtcgctgaagaagcgcacattccaattgggcccgctccgaggagcgttgttccaacatcggacacccgtgacctcgtggaattctgcaaatgaatattttgtgatagtaaatgcggaaaaacggaaactccgaaagacttaatgttggtttattacctgcagcgtcgcgccgacaatttgctgttggggctgcagctttacgagttgctgtaattggtgaccgacaattgccgtctcttcaatgggttggccagagtttggcatgagcacattggcgtagtgatgttgctgcgggtggtggtggggatgggcagagtccaatggggtggcggaatttccgggcaacgaattactaaggccggaagcattttgggtggagtaagcatcctctatgaattcctctccggacaagtcgctgctctcctgcttccgctttacctgcctttatataaaagcgtttgatttccaatttatgcttgcagggaaacgcacgctgcgcgttcgtccaaatatcggtcgatccaaaccaattcccggtacaactcccaattgggctcctcattctccgtaccattggtcatgcgcagtttccttttttcgcgcacatatcgatcccttattttcttccactgtttgtaaagggcactcacatcgcctgaagaaaggggcggataattaactgaaagagacaaacgaatgctcaccaggaaatgccaggttttttgcaatctcagcccatgcctgatttctgaaagaaacacgtattgtattatatgaaaaagaggggggggggggggatcaacaacagatttttataaaagatcaaaacacaaaacatgacgacacttttttgctgctcttcgtttaatgttagttttttcagagctgttttcaaaaaagcttattgtggacgggcaaggcgtggcgatagataatctcatcagagccacacttttagatatttgaaaggaaagtgccatagtaccaaaaagacatatgggacaaatccagtgaatggatgggaatgcgattgccaataattatcattttaataataaactcgagaaagacctgtactccgtgtgacgatacttcgtgtccttgatatcgtataagcaaggctgcgtccgaacttggttgatcaggtgaagagcaaagtttgggtcggtaatgacaatttggcgttgttcctaaaaacaaaggttctgcaaagaaaagataaaatgcgttacagttttgccttctttgttgcgctcaaaacgttgttgtgtcctgtccaccatgtgcggatcgagaaattcgagatgctaaataaaaaaacactttacctttttgcaaaatgttttgaacaccttaaaatattgccattgcgagtgctgctccccgctgtatttcagtttctttttctgcaaattggcaaaaaattaaacaatatatcgactttgaagttgcattgacctcttttccgtatttgtctctcaattgcttccaccggttgtacaatgtccgcgcgtcaccttggaacccgagaacgtgtacaagccgattccaaacctttattttgtagtccgcgcttctgtattgtctacacaaatagaaaatggtcatttaaatgtactgcctttttaatttttcacttgtccgaagcgtcgtagagacaatggctttgcctgaccgcgtcaattaaacgcaaattgaaggtcggctcctccacgaccgcctgcatagcggcggacagctgcctttgcatggaagaggaggcgccattgtcactgccctgaatgccgggatcggtgtccaattcgtgttcatccgagttgatcatcacagcagtttcattggaaccaattgctctggaggctgaggtttcatctagcatttctggatgcttttaattggtgtacccaaatcatttacttctaaaaaacaagtgaaattaaaatgacgaaacttagaaacatatgtttgttatgctctgttttgaaatgtaaataaatttatccaagtcctttgacgaaattaaacgtgtcccgacattggccggtccagacatttgcggccccgacttttgcggcccgacatttgcgcctttgtccaaaatctggttcaaaactaagttttttcaatcactaatcgcataattagctttaaataagcgattaaaagtgattgtgcatgatcatttgatcacaaaaaaatgttgaaaaaataataaaattttcaaacaaaaaattattgatcataatgaaccataaaaccgtgttttcttaattttaatgcttattaggctatcaggggttgaaaaaattcaactttgagtccgattttggacataggcgcaaatgtcggggctcctttgaaactaaccatttccttctccctggtccggaacagtccactttgacaaagtcgcccttctccaccaaatcgccaaatttgaacgcctcccgcggtgtccatttcaattccgtgtcacttatcctctcataaaagctccacaaacatttgattttgtccacgccgatgctaaggaatagcaaattatttggcaataaattatgcaaattttaatttaaatacttttgcgccttttctgtcgccattatccgccggtcctcatcaatgaaaacccaaggctccttgtcttttctgtcgttgcagaccaacggaggctgttttttgtaaaatttcatcacatcggagccgtttacttcgagttttgcgattttgcaagcctacacagaagtggatttaatttacagcaaaattaataaattatccaattgaaaatcacatcgtcagtttttcgcttaccccaacgttcgttctgaacgccgcactctttgatcgatggtcagcgccgctttcttcagagggatttccgcccaatttcacaatttgcatttcctaaacaattattaaaaactcagaatagtcatataacctgacactcattcatattaaatcacgtaaacaccagaaaataaaatagggttgcgcccccgatcttttttccgattttttatgaaaattttgccccgacattttttaaatttctccagccaaccccgacaaatttagtcggggaattttccaaccccgacgtcggggtcgcaaccctaaaataaaatatagaaattataggaaaggtgccaaattaggaaaataataaaaacctgcagctctttgtcagcatcatcagacagaggaaaagtgtgtgtcggcattttcactttgacaggcaccgaattgtaaggccaacgaaagaaattgaaggaaaaaaataggaaaaaaaagaaagaaaggccgaacagagccaaaagtcggacgaacaccttttgatttttgcgtttcatcaccgaatttgagacggaatggctcagaaaccgatgggcgtcaattgtgccaagaaaagaaaattattaaaaaaacaagaaaggaaaaaagataaaatggaaataaataaaaccgaaaacaaatttaaaaaagccattaaattaatgtgatttaaccgaataaatataaattatatattacaaaatgttatactacaaaacacataatttaatcctccaattcttcgtcattcaatcgggcaaaaatctccgagaaaattggccttgcaaaccgatccttttcggtgcacgaaataccaacagaaagtaatttgttgaaaataagcagacttctttctgaatttaagtagacgggaattgttctatttttgtgttcaaatagaaagaccaatcaaacaaaacaaaccgtcgtccgttttgggcgttcgtttgtccgctaattcaaaataacatttgtttttgaagttagtatcatctttatgttttgcttcggtgcacattttaaggacaaattcgacaattccttgtgggttgcgactggcagaaaaagcgcgttgtcctaaaaataaaatgaaaaatcataacttttgtagaaatttgcttcaccggtggacacttcaagaaggacaacaccaaagctaaacacgtcgagtttggtggtcaaaatacgactgaattaaacagctaaataatattaccaaacacgaggaacctggtcaagaattcgggagccaaataagcgagagttcccttcacatgagaagcgatcatcggccgcttgtcgcccgtgtcgagttcaacctgacaatgagactttccatcgttgggatttggccattttcgtggaccaactgtccttttagatcacctgtccatatctgctgagcccaaaatcgccaagttttggctcaaaatgcttgtccagcagaatgttagcggatttaacgtcgccgtgaatgattggcatttggttgatggtgtgcagaaagtgcaggccgcgacaaacgcccccgcaaatggacagctttttggcccaaccgagtggctccgtcccattcgaaaaaggaaagattgaaatgctgacaatgagcagcagtcaattcgattttttaaacgcaaaaattacaaatggtttccgttgtaagttacccggcatagcaaacggtcctcaagcgtaccattggacatgaattggtacacaaggcaaggctcgggcccgtccagcgaataaccatacagtgagagaacgttgtcatgtcgaaactttgccaaagtcttcaattcttgtaaactctgacgaattcgctccctttgctgctgcaataaatgggatttccaatgtaacagtttaattgggttttccacagctttttttattttggaagattcgctatttttctctaaaaccctaactgctgcatttctgctcaacataccctttcgtcacttccgcatttcccctgaattcgtttgatggccacctgaaaaaaacgtgtccaacagtgcgaaagaatgtgtcttcaccggcgtgtgtttccacactccgcgatagaccacgccgtagccgcccctgccgacgattttgttgggactgaatccgtcagtcgcgacagttaaatcctcgtaagtcacagccggagtgttctgcagcccgttgagcagagagtccgttgctttttccgccagatttgatgaatgtggggaatttgttgcgggcattgccgcgccaaagtcggacggctccccattaagcggaaaccctccagcagtaccaccactcgacacagacggttcagcacagacggaattggaccataaaaagggaaaaatcaaaaaaaatcttaaaattaaaaacacacctttcttattagagtaaatcactgatgcattcgtatttgatttgtgaattgatgacgactttcgtctaataaaataagataaaattagcgtcataaatttcttccacagactgtaagatgaattggcgctgattctgggattgaatggactcatcggagcaaagtttgacaaagtgatgaaactttttgtcaactaaaaggtgaaagaattatccagcagaattggtgcgtgtaaaatgaccaaatggcagcaaaatttgcatgcaccgaagaagccttgtgcggtagaaaattttgtacaagtccaaaaccgtgtaccctttcgagccccaaatgcgcaaaagagtttcagtcggacggtctccaagatgtgtcaatctacgacaggcatcaatgtcaatgtcgcgaatccctggcatagaaaatgctaaacgatggacattagataaaacataattagtgtaatattacctcattaaattatatattacacaaacccattggctcccaacaatttcctgtgtccaatgcattcgatatttcacatacaattcttgcgggaagttgaaatatgtaaaacacatctttctgaacattattttcagatcccatgttagagatagctattttagattctaaaaaggtaagcaatgatagtctgcgtttttttgatagcaagtgaatttgacagtaattgattccatcaaatatccgtccgaggcaaaaaagacgggaacgggattcccgggttttcgagcgggaatcccattcctacccggtctctaacctatgcgtcgtcgcacacccacgccgatgtgttgtgcatataaacactaacacttctatttttttttaaattccgaaatgaaatttaaataatttttttatagttaactaaaatagtgagtaaaaatccaaaaatagtgaagaaatagtgacaaaaagtccgaaatagtgacgaataaatgaggtaacatttcctttataaaattctcttagcaaatatttaactttttaaatcaaaaattttgtcaaaaaattttgggggaagaatttttgagaaaattttttcatttcataggagtgtatttttaaaaaattttcggtcgattcataggggtgtatttttctgaattttttgtagtcgattcttaggggtgtatttttcgtttttattacatttttcttaaggatattttacaaaaaatgtcaaaatagtgaaaaaatagtgacaaaactccaaaatagtgatttttaactattttagtgacgaagatgccaaaatagtgatttctagtgaccgatagttacatcagaatcgaaaaattttaatacagaaatgcgttttttgagctcctttcttcaaaacaattgagcaaaaaaaaagtttttcactaaaagttgcttccctaataataataagcagtttagtcgtcgtctttggattggtgggacgccgctactgccgcccacggttggcggagtggggcgagagcagtagacaatcagggcttagccaccatcagcagcagaggggagtagcgaacgacctgcgcgcgcaagaagtttatgcgcagtagaatgacaatcgaaacacatcgaaaacgaaaacggatcaggacagcggaaattccgctgctttttggtggccaaggaatgagacgccgtcggcaatagcagaaccaagcaaaggtgaggcgatccatcgtttatcatctcagcaacaaaagcaagcgcatatggacgttggcggcaacgcttatttgttagtcgattttggtcaaataatggctattttactttgaacaattgaaacaaaagcaaacggaagatcccataaatccctcacagaaaggtctgcaattgaaacaaaaagcgtgcagaaactgcacagagtgtgccacgacaaaaagcagcgaaagagtggacagactttccaaggttttgcacataggtgtaagagaaagtaattcaatagaggtacaccacaaaaatctaatatggatccttttggacattttagatattatggaatttatgcccccaaaatagctggttttcttctcacctctgcaaagctgagcgtacctgctttaaattttttagataatcagattggcgtaaaaaaactttgtccatgcgaaaattattgctctatatttttgatatt

SEQ ID NO: 4818 - DNA, 8833 bp, Heterodera glycines
ttcgtttgttgcgaatttttgtgcggggcgcacccacacccgactatccgcgctccaaggtcaaaatagtttttatcttcataatctgtcaatcaaacctcttgggcgagaaaatttaaagcgctgcggagatgcaaaaatatttgcggccactttaccgcagtttttatacacgggaactgtcaatcatataaagaagggaacgccgaagcgacttcatttcatttccatttcggttgaggcggggggtcggtgccattctttgcctctcggggcgcttgcccacaaatattcaaattttttccatcgatcatcttgatctgtcaatgcggcacggcagcacggcataacagggggaggagtcagcagcggcaccattcataagttcacttctcatcatttgccactttggtccgttttcaatttgtcaacagcggagacgcatccaaaattcacttttccccagttgccattttcatccactttcctcatgtcttttgttgcccccggcactttcgcgttcctttcaaaagactatggggaattttcgactgggcattttaacccaaacagagcatacgacccaaattcacttgcagaactttcgtaatggcatttattttgcttccattatctttcattttttctttgtagtcaatggagaaaagagtttctggacggccgatacggatccaaacaactaacccctccttccaccccgcgtgccccatcgccaagattcccaatcccggtcattgttggtaattttaatttgtttattggattttgcaaatattccgtttacaggaaatcgtccacaggatgaaaattgtttggttttccacaaatatcttgtctgattttttccattttagggcggcagatgttccctgatgacgatgggtacgaatcggaagatgatgaaattctcctgccacctccgccgatccccccgcaacttggccaccctccaccaaatgtgccggtaatttcggtctcgcttttcgttgcttttctcaaatttccgagtggttttttcaggcagttcgtgttcagccaatgcatgttgggcagcagcggctgccgctgagagacttgccacaattcgaggaccatccgcaaaatgtgccggtaattttgggttgattttcgctgcgttttctcaaatttctgcgtgcttttttcaggctgttcgggtccaaccgatgcaacaaccattgccgctgagagacctgccgcaaattttccaccctccaccaaatgtgccggtaattttgggtctttctttcgattgctttttctcaattcccgagtgcatttttcaggcaattcgtgttcaaccaatgcagcaacccgtaccaatgagagccgtgccacaattcctccaccctccgccaaatgcgccggtaatcttgagtctcgttttcggttgctttttcaaaatcccgagtgcattgtttttcaggaaattggtgtgggaccaattcatgatgggcaacaaccactaccactaagagcgttgccacaattcgcccaacctccaccaaatgtgccggtaattttggctcgcttttgttactttttttcaagatcccgaatgtttttttcaggccgttcgtgtccaaccagttcaacaaccgataccactgagagacgttccgctatttgtcaacccgccaccaaatgtgccggtaattttggctcgcttttgttacttttttttcaagatcccgaatgcatttttttaggtaattcgtgtccaaccaatgcctcaaccgctgccgctgagagacatgccgcaaattcaccatccaccgcgaaatgtgacttcaatttggatcaaattgtggttgctttttctcagtctctgggtgtttcttcagggaattcatgttcgacaaattcaacgggaatacgcagtaccgcaatttgcccatccgccgccaaacttgccgtatcatccaccagaaaacgttccggtagttgggtcttgtttttcgtgcgtttctcatattttcggatgcgtattcaggcaatccaaccacggcaacgaccgcgccagctgagagacgtgccactattcgaccacccactgccaaacggacaggtaatttcagaccctgtcttttacctaacaccgaaacatcttttcttaagcaaatgtatgccaaccccccgagagtgctggaagtgatccgacggctggacgagtggagaggaagaccaagggacccaagacgtccgcctcaatgaatgaatagaatttggattttgataaaatttgttgttttaatttttgaattgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatctatagattttttttcatgtgcattattttggtgctagtaagatattgtcgaatgaattaattggttttttctcttcattttaaaacatttcacgtccccatgccctgtccacttcccgcggaattgatcaaggaaataattgacgctctcccccctccaaaaacacatcggcttttgtgcgtaaattttgttttggcatactttgttaaatgtcggttttattccatgatgagaagattgtttcgcccagagcatatatcaataccaatggcccgaagaactggaatgtatttctttttcgatgtccatactccccctatttattttccactttaccaataataccatttaaataaatttataaatttttattttttaatttgataatttttaatcgatatttctgataattaaacaaaattgtatttttcccaaaagaattttctcgcagtagcaactcatcggcttttttactcccttcataaaatgtctcgcttttgccccctcgcccaaatcaaggaatcgggtcggcttaacaccccaaaggggaaattgagtgagttccaaatcctgtaaatcccacacaaatttgaaatctattacttgagtttaggccttttttatgccctcgaattcgctcgcaactaccaactgatcgagcatggaatttctaggaaggctttccgttatttaatggaaactgagaaaaaacaaagagcattagtctttgatcttatggaaaaggcagggataagcacagatgacaaaacttttggtacccaacaccttgaggcggtacaaaaatactgggacagggaatttccgggcatgttccgagccgttgttttcgataaggttaataaataaaaacacaaaaaaatcttttctattttttttagaaatttggacttaagccaattttcaagggccaaggcgttcgtaagaatgaagtgtgtgtgataagagagggagaccattgggatgggatcaaatccgcttcctggttttttggtgttcgctacttttgtgtgggttgcgaggttacgtacgatcgccctgaaagacaccggatggaatgcaaagagcgctgcaaaaaatgttgccggatgggattcgggttcccatgtgcggatgtgtgtgttaagattcactgcgaggaatgcaaccgcaacttctataacaacgaatgttttgaagcgcacaagaaggtggcttgtaatgagtacaagaaatgtgaaaaatgcgcagaagtctaccaaacacgttcgaaacacgtttgcggggaaaagttttgcaaactttgcaaagtttgccacccagggaggcaatgtttcatcaaaaaaattcaagtgcgaccgcagaaagcctacagaattgtggcctacgatctggagacgacagtagatgggggagaacaccggcctaatcttgtttgtgctgcacgtacttgtaacatttgtgcgggagaagagcgggaatgtgagatttgtgaaggccccagtaaaatcacatggtctgtagcggatggttttgacccaatgagcgagtttgtcgtttggataatgagttttcaacgatttgaaacgattgctttcgcgcattatgctgggagattcgattcccactttgtcttgtctgaactaacgaagaaggaaatcgcgacggaactgatgatggcagatttgaaaatttatcagataaaggcgggacgagtgatttttcgtgacttttggatgctcagtcagaataaattggcggaccttccaaaaacgttgggattaaacattacggaaaaattgtattttccccacaaatacaataagaatgagaactttgggaggagattgcccaacctgccacctttggaagactattgcccggacaatatgaaagaggaagaagccgtaaaattggaaaaatggtataacgagaattatcaaacggaatttgaactaggtagacagaaaaaatatgggtttttaaattatattggatttaggggaacagctgaagatatattgcgaaaacgacgtggaaattctgttgcaatcagttttgaagtttcgacaattgtttttggaaataacaggggattttgatgtgatgaaggacagcgtgacaatcgcaggagttgtgatgaagatcttcagggcaaaatttttgaaggagaggcacattccgatcatgcctgagggagggtatgagagagctgaaaatcagagcaaaatcgcagtgaaatattttgagtggcttgcccaaagaaaaggagtaaaagtgcggcatgcgtgtaacggaggagaagtggaatttggggggctgaaagtggactgtgtgataggggcagagaaaaaaataattgagtttcaggtaaaaggaaaaatattttctttttaaacaatacttaaggggtgtgcatttcacgggtgtccgagatgttttttgccttggactatagcaccaaacggacggactatggaagagaatcaaagtagaaccgaaattcgcatggaaattttgagggaaaagtgcaaaaatttttcaatcggagaagtttgggtagaataaaacatttagaaatatttattaattgttagttttaggagtgtgacgtgaaagaggaattgaagaaaaataaggagatgaaaaagttctttgaaagtgtgccggacaagggaccgatcaatccgagggatgcttatgcagggggaagaacgatgccattttgtttgtacgcaaaggctaccgaagaaattgagatatcaatgtttgacatcattagtttgtacccctttgttaattatggtaaaaatctgcttaatttttgttaaagtttcctttcgcttaagacaccccataccccgttggagtcccgaaaattgtaatgagcaggaattttaatgtgaattggacaacacccgacgacgtaccctatgatggacttttgaaagtaaaagtgatcccaccgaaaaatcttttgtaccccctcctccccgtgcacatcgatgatatgctcctcttccccaattgttgggcttgtgcaaaaagggccaagaatgagtttgtgatgacaaaagatgtaaagaaatgtaaccaccgtccagcgcagagagcatttttgggaacgttcacttcgattgaactacggaaggctttagagctgggatatcgggtcataggcttctatcgggcctatcattttgagcagtttgacagtcaactgttcaaaggatatgtgcggatgtttttgaagataaaggttgaggcgtcggggtggcccgcggaggtgaagagtgaggaggaaaagagagcattcatcgcaatgtataaggcaaagtataacatcagtttggattacgataaaattggactcaatcccgggttaagaatgattgcgaaattggtgagaaattattttaaaaaatcgaaaaattgtttaatttaagggattaaacagtttgtggggcaaattttcaatgcgcaataccctttcaaatacggaaattgtgggcagcatggaacgctggatggaattgggaagagataatacaattgaatttgggcgcccagtaaaaataagcgaagaaatatcacgggtggtgtaccggaaaaaggaggagttcatcaaggagcataaagtttcaaatattgttttgtcattgtggaccactagcgcagcaaggataaaactgtacgagtacatggagcaggtctacagggaggaagggtctaagctgctgtattgtgatacaggtggacaggaataaaaagaaaataaaaaccaaaaatttagattctctagcgtttgctcatcggaaggggcggtgtccgttaaaggaggggaaatttttggggtaaaacataaattttgaaacgcatttaaattgtggttttaagggaaatgactcgagagtatgcggacagcgaaattttggagtttgtgtccgcgggcccgaaacagtacgccttaaaactcagaagaaagaaggatggtgtgatttggcacaaaaccaaaatcagagggatgacactggataaacgaaacgaatttaaatatgaattgttcaaagagatggtgctagactacaaggaaggggtcaagaaagtttttcactacccggagaagattgggccgacaaacgacttccgggttctctcaaaagatgtacaaaaagaatatacgccggtgcagaaaaaaggaattattgacgatcattttaatattttaccatttggatattattaatttttgtttttggataattttgtctcatgtttataacatttaatattttaaattaatcaaacttgtttcctatttttagaatgtcaaagaaaaatttccaagaaacttcaaaagaaattcgccgctcgaaaaatacaaaaaattatttcaagaacagttctaatttgggaaaatgttttgaagaagtggaaagtcacacaaacgaaaataaaaaatttgggataaaagaacatgtgactactttctattttaagtgcccagaaaacgaagaccccgaacaaacgtttaaaaaaatcctgaaaaaattaatgacggatgcgatgaaccgtgaagctgagccggactggaaaattgagaaaatttcagtcgatctgtattgcagtgccctgtcggacccagtgatcatccctgcccgccccttccaacattcgaacccagacattgttttcaatgagttcatgcacagacagcaatcatttggggaagtgaatttgttagaccagagaatttcgataattattgccacttattcctttcctgttaaataatttttaaattttttaaatttctttattttttgttgattacaatcgttatctattcgagttttttctttattaatttttcagttaaaatgtactcgtttcaaaaatattttgaggaggctctcgaaaaagaagagtttttctggcagaaaaacagagcagaagtggaggcattgttaattgaggcatcaaattataaaattgtagtacacagggactacgaaagccgctattctgattatattgccacctatcgccgcacctctgtcttctgtttctgcatgattgagagaaatttaagatttttttacgactcgggaaccgggacgcctataggaagggttacaaccgtgctacatgttaccgttgaggcgagctatacaggagagggattcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaacccggttgaagttttaattgatatcttctaccagcgtatagataggttggaacatggaaaaaaccaattaaaaaaaatttgtttagagatttggtcggatcgtggtcattgctctataggctcccaccctcactttttgacacttcacgccgggcggtcgcggagaataaactggaagaatttttaaaattaccatcattttttcgcatgcttttttataataaatattaaatgtaaagttctttttaaaattcggtttctgaccaaattatcgattcaatcctaatttgctattttttcgtagaaattcagaaaaaatgcaaacaatcgttgaaattaaaaatattgagttagttggcggcgggagagtcattgctgtgagagctaagattgaaaatgtagtgcatgcggagtacagggtttgtattaaaaatgaaaaaaaatatcagtttttttaaggcttgcgttttatgccgtaagggggtgtgttcgtgtggcgttgagaaggtactgacgccttatttgaaggtgtccgtaacggatgatacaggagttttggaaaatgtggcgtttttcggtgtgcgggggaaaaaaaatggaatggtaatattttaagggaaaaaaccgtacaaatttaaatttaggaggagttgaaaggtttgtctggggccgtgtgtacagtgaaaatcggggcgagggtgaaagaattcggaggaaagaaggggatatgttactctttgatcgatattgtcagtctttaaatctataaatacgcttgttaatttttattaataaaaatgatgatcttaaaattatttttgctctttattatagtaaacgtggcagaaagttgctgctgcattacaaaagaagaaaaacaacaattaggtagtacacggcgaacaattgaggccgtatttggagatataattaggttaacgaaagaggccaaagatttttctttctcggcacataataccatggttgaagctcaaaacataaaagacaaaaatcctaatgctcatggggtaaaattttggcatgaaaagcttttaaatg

SEQ ID NO: 4819 - DNA, 954 bp, Heterodera glycines
  misc_feature (933)..(933): n is a, c, g, or t
gccgccgaaacgtcgccgggacctttcgttgtcgcaaaaaataaataattttttttcaaaatttcaaaaaatctaaaaatgttttagcttttttgaaaagctaagtgttaataaaaactaaatttgctgaatttaacccaaaaacttgaaaacattttttatttccttgaatttcttattaattttttttttctacaatttgtttcgaattaggctaggtaactataatttttgataattttttcatgattcttttttctaaaatttaaaaaacttttgtcccgacgacgttttgtcctgctctctctctctgtacgccctccccccgtctgctcaccctccgtgtcgctgccgcccattatttcgtcggcgctttgcgtcggccgtccgtccggcggcgcgtcgtcgtcgcccgcctcgctggcggatgagaattcgttttcccagcacagctcgtcctccgcgttcgggcagtggagcagtgcggagattggcgttgatgaagcggcggcggacgcggcggaggcgcggcgtccgtcgcggtcgccgtcatcgtcaggcggcagttggagcggcggcacgcgctccacggcattcgggttgggcggaatgcgcgaagcggacgtcaaattgctaatgtcactgcagggaaagggcggggtaattagcgatcattaatagagtggggagaggggtaattgtcatataatttgcgagccttgggtaaactttattaaatcgtaacgaccaaaaattggcggacgggaaaggaaaatttttaaacaattaagctattttgatttttttcccgttccggcgacgttttaatgacgagtttttgtcctttcccgagtcagtgaaaaaaattttaaattttctacaaaaaaatttacgaaaaatcggtgccgtgccgagacaggcgccaggactgangaaattttgaatttcagatga

SEQ ID NO: 4820 - DNA, 7693 bp, Heterodera glycines
tgcggcaaaaacactcgtccaatttgcgcaacaattcattttcaccgcccagacggaccgcgtaaaaaccctaacgaattaaaaaaatattttttaagtttttaggtgaattttttattctaaagaacatttaacgaaaaactttttttttgaaaaattacaaaattaaaaaagtccttccttcaaaattaaaataaacaaatgaaaccaaaaaatgcatttttttaatttcaaaaaaaaattgatttaaaaaagaatctttgaatgaatgggttattatattccacaaatgaaaaattacaattttttttctggaaaatgaggaaatgaaaaaaaagttaaataaaattaaacgaaaaaaagtatttttagaaattttctattttagtttaaaaaatgaattttgaattttcaccgtaaaatgacctgcgccccaatttttcctgtttttttctttatttgctttacatcggtcagttgcactgtcctgctcggacttgacgatggggacgggtcatcaccaggagcagcatcagctgaactaccaccactggtggtggacgaggcaacaagtgacgagcgttgctcgatcagctggtcaatggagctccacaagcagttcgatttggccagccggcacaacaatttgtaggccatgatggagccgatgccaacaacaaaagcggtgccactggtccgagctgtacacggcacagaaatggatgatgaattaatgatgtacaactaatcattagtttattttgaagagcgaatggttcccaacgaaaaatttaaaagaaaattttcaaactaaaaaatttaatcttaggtttattcataagtattcaaaaaaattgaaacaattttcagcacttttttcaaaaatttatgatgaaaagttattaagttttttcaaaaaattatacaaaaatttcaaaaaattttcgtgaggaaaacgataggggggacgaagtgcaccctttatttttatcccggcggcactttgccaaacatgtttcccaaaaaaaagtgtgttttgcctttttgcgtcaatcttggcattctaaattaaaataaaaaatcctcccgtgatcacaggaaaaagatgttaagtccaattggcataactattgtcatgaccgtgccacggcatgccttggtagtaaaattccgagggcgaggaggggggggggggggtaatttgtatatattttattgtttttgcctattttggcacctctaaatttgattttcagcgtgccatagccaatgcgaatgtgagaactgttgctgctgcaaaaagtgccggaaattcgttgcaatgtgcgggtgccccactgaagcaaagactgccaaacattgaaaagggtggtcatttttaggggtttagtgcagcaaataatttgaatttgccaattttggcaatgcgtcgtgcattaactctttaaaattcatatgagacagaaaaaaagcaaggaacatattctatggatttccagggaatgagaaaaaaattgaaatggaaattgcccaatcctaaaaatgcggagaacataagaaattcctaagtttttgcagcaaatattcggagtttgtcttagtctcgaagatagatttctcaagacatttggtccacgagcacatgtatacttcatcaaagatgcaagctgatactcgaaaaatcggtatcaggacttgaattagataaaaaaaattttggggttcggcatttcgccgccccaaaaatgatgggattggatccttgggatcggctcgaatcttagttccaccattacggaaatcctttttcagaagtaaacaaatggatcatttattatttgaatttgccttccgccggagcgctgcgccgaatgattttttcgcaaatttttcgcttgctttaaatagggggggggggggagacagcagctgtttgttgccactgctgctgctgctgataaagcaatcagtcatcattcaatgtgaattcattcatctcgtcaatttccattattattaatcatcggtcggtgtcagttgaaaatgacaaaaaatggcaaaaatattataatggggcggcggcgggcgaattgttttgttttgttaaaaagcatcaaaatacgcgctcaaagggcacagaatagcgcacaaaaccaattttaaacaattttttcagtcacaacgccaataaacccctcaaagttcccagccaacaattttttgtcgcccccccccccgcccactaattgcgtttgggatcgaattacgtttcgtggccatttgttgtggggcaagcgtcttaaatatcttgccaaaaagagtttctgtgttcggtcattctcgtggttaagaggacaaaatgaatgtgtgtaaagtgaacaaaaagaatcaatggactggagtgatcagtgaacaattaattaataaactaattgagttgatctgatgaattatgactggtcagtttagacaacaaaaaattaattaaatgattaaaaaataaatgctgtaattgaagcgatcaatggtcaattagatggataacaaaataaccagttgaaattagtcactcggttccaaagaacaatagttgatcagacagagaggaattgaagtgattgaaatgattgatcatttcaaggaaatggaacattcaaacggtgttttcaaatcattttaaacaattttttcgtgtagagcatagttgtctgctattgtaaattttaggcttttttggcatgacccacaaactgatcagaaataaataaaatacaggctcgattttttgttttttttaaattttctttttgtgggcaggccaaaaaagccaaaaatttatcatagcaaatcgactatcctctaatctctaaagtataaaaatgatttaaaagtaatttgaacacctatagttaaaaagtattcttgtgaggaaaattgatcagactaacgatcaaacgaaattaaggaactccaagcaaaataaattttaaaaaagtaacgaaaaaaagaaagatgtaagaatgaatgaaaaatatacttagggtggaacataatttttgatacccaaattttttccaatttttaaaaattcataactccgttatttctgcgcctatttaaatgaaatttggaacccaataaaaaatattcaaatctcataaataggtgtgcaattaaagaaaaaagtgtgtactttaaataatttgggaaggatgagaagcaaatgaatgacagtttcaatcagaaaaattatgacactgatcacagttggatgaagacaacaactgtttaaaacttaaaaagtcaaacaaattgcccccagcaaacctaagctaaacatttcaaagtttgaggctttgaggtcagaagaaatttgatcaggaaatgaaataacaaaaaactacccaactaacaatttactgctgttgctctcattgctggagagccttgatcagatcagagatccgttccatggcagatctatgaaccggcccggtgaaaagcagtgcaccggatgttcgactaaattccacgagtctctccagactcggaatttgccagattattgaatccccgcaaaatgccgttgccctagttagacaagagatttttttggttttgcaccgccaaaaaaattcatcgcacactcacaaaagcaaaaaactattttacaatgatttattgactggccacaagctcacaatgtcgataattttgtctgtgtgtatttattgaaacgatggtggccaattgtcgccgccattgagaattgagcgccccaaattatttgggatggccgcggaaattgggcaccgatgggcccacaaagattggccattaaatatccgctattaatccgccggatgggcaaaagattggccaaccccgataaataaaggcgaagaaagtgtgtccaaatgtcacaaagccttggccaattcaacaaatgatgttacaacacaaaagagtggaactattttaccattcattgggaatgggtcagcagaaaaattagtaaactatctgatcagtgtcagaagagtgatcgggaggggtaaagtgaatggaaaatgagaaaaaaaaaacaaattattttaaaaacaagttcaatatttttttatttaattattcaatttatgctaattattataaaacaaacttaatttaatttggggattattcattgccttttttaattgtttggggttttattttcgcaaaaaaacgcatcattttcatcagcaatagcaaatgacgaaacaaaaaaaaaagttgaagaggaagtaaaatctttagaaatttgatggaattgtcctcaaaaagatgattgagtttttccactaagtctagcctatgtttcaaattgaaaaaaattgccgtaacaataaagaaaaatgaaaattagattaaaaaaatgcgttttaaatttaaaaaatatatattaatacaaaaaatcaaagaaatttcatgaaataaaataaaattaaaatgcatcgttttgacgttgaatgaatgaatgaatatcatcatttacctacatattatttgtcttgttggcgctacgacaattatttattaagggcaaaaaagagagaaaaattaattattatttttctcttgaaaaaatgccctcaattacctacattgaaaacgtttttgttcattgtcaccatcatttttgtgctgattgcgattttcatagagaaaaatatgacaaaaaagtgattaatgatgggcaacaaattaccaaatggagcgcttcaaaaatatgccttaaaatttggatttttccgtcaaaattgcaccatttcggacaattttatccaaaaattaatagcaatttttgaatcatttcacgactgacaatgacaaccgatatttgcgcttaatgttccttcctattatggtgatcgcggcatcatttattgactgattgagcattggcccattttatgccgaatcgggcaattttataatgtgagagcaaattgaaccaacttttcttagcaacaacaaaataagcattcttggtgtctgtcgataccttgcaaaatcgaccgaatcatacaaaaaaaagcttcattttgttgttgctttgaaaaattttcgtagcatcaacgatggagggttgggtcaaaacattctctgtccattaataaatatgccagctaatggggggggggggtatcccatgttggctaattagccagaaataagcgtaacaaaagagaataattttgtaattagaagaggcttaagggaggataagaacagatttgtgcttttgtgcttaatcaaatgggattatttaattatatggcgaaacgacggattttcgagtttggctgggggggggggaatccccggccgacagttcgttcgctgtcgttgctcaaacactcaaatgtacccttgtacaaattgactttataaaaatatttcacaaatttcagtgttaaaaatggaaaaagttaagcaattatttagaattataaaactcaaatatataaaaaaaaaaatttaaatttctatgacatcacagcagcaacaacaacatggtttgaggggaatagaaaacaacaacaaaaaactttactaaatccacaggctttgagccttaaattcagagcattagggctcggttgggttgggaaatccaaaaaaaaaattcccatttcttttgaaaccttaaagatttaggttctacaaaatcattcagttgtgttgcattttgcaatattttctaaatttagcagcattcacataaatcagtttttgcattgtaaacgaacttcccatttaaaaccatttaaaagtgccaaagatttttggcattatgggtccaccatacaatacgtgcagatattttcgggtttgagttgtaaaaaagggatggatattccctgatttttacggtttttgaaaaaaaaattcatggccaagtcgaaacagttggcccaccggcaaatccaaagaccgaaaaattccatgacccaaattttaaattatattaaatttttttcaaatttttaatttggccctacccaaaatggccatgtccacattctgtgccgcttggacggacagtcccaactgcgtgaccaattggttgccgagcgcattccctccactgatccgcgcttccaacgccaacggaggcaaaaggccggcgatgagttgggcctggaaaattggcaatcttcaatttataaagtactttagagcctaaatgacaattaaaagtttcaaaatggttgaaaaagaattttttgaccaaaaaataggaaaaaattatttttattcggcagattttttaacacaaaaatgccaccatacattttaggtacttaccattgtttccacattatcagcatgtgaacgacgatgggacatgatgatattgatattgatgttgagcaataacagccaccaaaaatgaaaaaaattgctaaattaaaaaaaactggcacaaattgtaaaaaatttattatgtttagggcttatattttaggctctaaaaattgccaaaataattaggttttaggctctaaaataaaaaataggcacttaaaaaaaagaaaataggctttaaaaattctcaaatttaggggattagaaaatgacaaaattttatttaaaaagcgaacaaaattaagcttgcgatacataaaaaattttgtcaaaataaaaataaattttcgagaattggaaaaattttcatttcttaaggggtgtattttttctggaaattttagggccgattcttaggagatgttttttttcgttttattgcatttttgttaataaattttgaacaaaacgccaaaaaagatcaaaataggttattaaaatttttttgacgtttttaagactaaaaataaaaacctagaaaataggccctaataattcgaaaagtaacttaacaaccacccaaagtatgtttttcgtgctttcaggccactccggaatcgaaccaaaaagcaaaaaattttcgtaatttagtaaggtgtttttcaagttgaaccccaagggcttaaaactttaaaatatcacacaattaccgattttgtagtcccaaaaactgtctccgtctactgaaggcttcaccaaaaaaaagtgtggcttattgctaattatatgtatattctgtgccgctctctgctgttcgttcacaaagtgccacactcaacgagacaaacggtcgaccctcaacagaacaaaacaataggcaatttttttgttcggcctttttgttgtcaaaaccaacaaccactacacaaacacactaatctatgcagaacaacaacaaaatattatcattattattgttttacaatcgttgtcgagagtctcgagagaaagggcaaaaaacggacgaattggggggggggggggggagacgagaagagggatgcatttacagaagaagagcaatcgatcgatttattcattttggttggttgttgtgttggcttacgccgctaattaatgggcaaatattgagagagcggtcggtgggggtggtgggaacatggaacaacaagaaatttgaaaatagaagaagcactggcttcttgatagacggaacccatgggtttaaatgtgaggttgggtacaaaattttaaaatcgattagagggtgagagattggaggaaaattttaaaaaaatggttttgaggggggggggggggg

SEQ ID NO: 4821 - DNA, 485 bp, Heterodera glycines
atagaaatatttcagtataaccataagccggaaaaatggtaaaaaatattttaaaatagattttcgcagggcaccattgggtaaaagtgacgcgaaattattggataattgaggagagacagtcgagaatatcgagcggtagtgagaccccctgttgtcgagatggggggggggggggggggggagaaaatgaagcacttaattgagaggcaattagattaattaatatttgcggagaagcagagctcgccgcagcttttgcttttaggcttttggctaattcaagaggcaattaaaaaattagacaaaacgcaaatatttttaatattttaaatattttaaacggatttttcattatgttaggcaagcaaagaaagtctcttctttttttctatttgacctctaattttgaaaaatggcttttcttagcttgatgtacaggtggggaatattgaggagaaggcttgtgtgagagagaacacata

SEQ ID NO: 4822 - DNA, 2911 bp, Heterodera glycines
  misc_feature (1579)..(1579): n is a, c, g, or t
aaatcagaatacggaaaaaattgttttataaaaaaataatcttgcaggaaatcgtctcaaaaattattcaaaaaaccccaaattacgatcaaaattacggaaaaatcccaaaaaatccgtaatccgtaatccgtaattacgcccaaccctggctgggagccctgattaaataattgggaaaatagacccctaaaaaatgacttgaaaattttcagaaaataaaactcctaagaattgaaaaattttctcaaaaattgatcaccaaaaattttttcttaataaaaatttctatttaaaaattttccttatcaaaaacttataaaatatttaataatcatttaaatgaccaaaatttagttatttggtgaagttttaagggtttttcctaaaaatcctaaaaaaatttgaacgccttttttcatgctttttcgggattttcgtgccttttcgtgccttttcattccttttttcaattttttggtgcctattattagagaacggaccggacctgatccggtaccggatttttctggatcaggaatccggtccggcgattttttggaaaaatagggattgaccggattacatagattgaccggattatgagagaccggatcccgaatccggttgtttttgaaaatgccaatccggtccggcgaatttttgaccggatccggttcggctcggtctcaatctcaaccaaaaatccttcacttttgttcattttcatttgaaaaatatctctttggcataatgtttctaactttaaatgttcaaaatttcgaattttttccctcggcggggcctgtcggcaccgcttggccttcaaaacttattttttcttaaaaaattggctcaaaatcgcgaaaaattggtaatttttagtgaaaaatccattaacaaattgcctaaaattttcaaaatttttcccggcggcgccttctggcaccgccgtcctctttcctaaaaattattattttttttgaaaaagggcgccgcaaaaaaagattactaatgaaataggttttcaaaaataaaaactttaaaattctttaaagtttttcttgaaaaattgaaacattatttttttcggtgcattgtcttttcgaccgcacatttctggtgtaccgaatttatacatataattgatgacattttgcggggttttttcccaaattaacatgtgaaaatttaaatttttaccaatccggaatccggttccggatctggtaatttgaaaaatagggattgaccggattacatagattgaccggattatgagagaccgaatcccgaatccggtcatttttgaaaataccagtccggtccggtccggcagatttggaaaatccggtctctacctattatagtgcccttttcgtgatttttgtgccttttaaaaaaagaaattcatagagatatttcatttttccataattaattattccaacttttgttagtctttttcatttttttgtgcctttgttgccatccggtaccgtttatcggtaccgtcgctcataattttttttaattccttaaaaaatccacaaaattaactattttagaaatttattanaaacatttattacttcattgttttatagaaaatttttatcatttttaaattattttaatcccataaaataatatttttgctattgattatattaaaaacaacaatattaggttggttcgaattttcaggttcacatataatgccttattggtatgttggctttatgcttattttcgacattgttggtgcctaacccaagatttcaggaattccttcataaaatgcacttcccctaagaatcgaactgaaaatttaaaaaaaaaaggtcgagttacacgggtctgggtacctgaccagtcccagaccccgggtacatggctttttcaaaacatggaactgtctttttaaaaaacccagttcgggtctaacctgctcaaaaaatacactggtgtgaatggggatctggatcaaatttttaagcaaagttcgagggaagaaattttttaaaaaattaattaatatttatttaatatgaaattgattattgctccgctgcttacaaatgagttgttaatctttttgactatgttccttctttctcaggttcaagttttcctcattctgatttctttcaaacattttcttaaagattttgttgaaaactttttttgaaaatttgagtgcactttgtttcgaaaattgtttatattcaaaaatgtacccataaaattttgtattttcgttttggaggacgaattcgaggaaaattttaaaaaaatttcatctcagggggaaacttggaattttctgtccaaaattctttatttttttaaataaattaacaacttaaattttttgcttttaaatcgcttatttttggacggtttttacaaaaaatttggggacattggggcggggacggggtccggcgccggaaaaattttgaaattttgagtgcgatttgttaacagaatttgtcgaaaaatgaccaaatattagggttatttgtggttttaggctgcttacaaaaaaaaaaaaattttaagcagaaatattttttattacttaaatttaattgaaatgatgtaaagaaaacataaaaaattgtatgaaccgtcggggatttgaaccaaagagattaataataaaagtcaaaaagtttagccactattaacaatgcttgctgtaaaagaaattaaaaaattttttttttctcaaaaaatctcattcctcatcaattccctctcttttctcaccagacccccattattaccagtgcttaatttagtcccatcgggatcgggactggcaaaaccgggaccgggatttcaatttttccaaaaaccgggaccgggacctgaaaaaaccgggatttcccgtcccggtcccggt

SEQ ID NO: 4823 - DNA, 5622 bp, Heterodera glycines
ttttgactatgtcccttctttctcaggttcaagttttcctcattctgattttttcaaacattttcttaaagattttgttgaaaactttttttgaaaatttgagtgcactttgtttcgaaaattgtttatattcaaaaatgtacccataaaattttgtattttcgttttggaggacgaattcgaggaaaattttaaaaaaatttcatctcagggggaaacttggaattttctgtccaaaattctttatttttttaaataaattaacaacttaaattttttgcttttaaatcgcttatttttggacggtttttacaaaaaatttggggacattggggcggggacggggtccggcgccggaaaaattttgaaattttgagtgcgatttgttaacagaatttgtcgaaaaatgaccaaatattagggttatttgtggttttaggctgcttacaaaaaaaaaaaattttaagcagaaatattttttattacttaaatttaattgaaatgatgtaaagaaaacataaaaaattgtatgaaccgtcggggatttgaaccaaagagattaataataaaagtcaaaaagtttagccactattaacaaattcctcatcaattccctctcttttctcaccagacccccattattaccagtgcttaatttagtcccatcgggatcgggactggcaaaaccgggaccgggatttcaatttttccaaaaaccgggaccgggacctgaaaaaaccgggatttcccgtcccggtttaaaaacaattaattgaaagaagtttataatgattttgatgccgagctgaaaaccgaccgaaattttaaagatcataattatgacaaatagtaaaatgattatttataaaatatatatttttcgtgaatatatttctgtattcttaaaaatcgataaactttcgattcaaactctattgacgaattaaggatacggggagatttaaaaaaatgcaaaaaggatctaatgtaaagggccgcaacttttagtgacgaaaaatctcgaaatagtttaggcttaatcttcagcttagtcctaggcttaggtttcaacttaggcttcagcttaggcctagacttaggcttaggcttcagcttaggcttaagcctaatcaagctgaggcttattcggggttcgaatttggtcaaaattggtgtcataaccgttttcagcgacctcgaaaatctctaaaaatatttttccttttaattatgatttcgaatttttgttcgaattggggttcgaggttcgggattttgcaaaataaaggtcatattcgggttcagcgctacaaattaccctaataaaactatttaaaatgccttttagcgttttttattaataaaaagcgaaaattgaaaccaaaataaaaagcgaaaaggcgaaagcgaaatgtcacaaaaaagcgaaattttttttccaaaaattatatgaatttgaaagactcaaaaaattcaccttttaatgcttaactgttctgatgattgactgcttttttcataaattctttatgcaattcctctggtgattgtgagacaatgtaagggtcgacgaggttggggttttaatttttttttcttatgcacatagtcaaaaaagctttctttgtggcaaaaaaggtactttcgagaaattgccttccaaaaaataaattatataaataaaaatagtgaattttattcaaaaaaatcaaaaatttctgattaccttttttcccgttataattttttctaatatttcgtgaataaaaattattgcaaaaattatttcagacattccggaaagttctttttgacagcttataaccgtgaaaaccgcaaagtttcaaatcgtttttgaattgaaggcatttttctggaaaactgaaaatgcggcaaattttcacatcatttttcattgatttcagtaatctttgcaaaattttcacaccattttcagtgatccgaatgtggtgaacgaccagcaacaacagcagaaacacattttaccgcttcctccacaacagaacgaacaaaacgaagtcaaatcgacgactggtctgacacctgctgaagctgttcggcgttcgcagatctctgcattggtggaaccgaaacaaccacaacaacagcaacaagaaatcaacaacggcgccggcgacgaacatggcggagtgcttcgcaggcaaaaaaaaaaaaaattcagtaccaatttgtgactcaccattttccccttttcaggtcaatttcggtgctcagtgataattggtacgattgggttgaaggcaatcagacggacaaagctgggtaaactccatgttttaagcaattttgatcgattctttccccacgcacagtttaagcaatcaacaacaaaatgtcatcgtccatcagtcagtcaacagcaccatcaacgcggatgagcatggcatatctgatgaagccagcccggtcgcctcactatccacaatcgaccttggccgtgtgtacaccactgttggcactgtgatggaatcgctgctggttaactttgcgcacctgtggcaatatcgggtgagcaaccagagcggcaaatataccaattaacacggggacggacgatgaattaatttgtctcccccgcttccgtttttcagcttttccgttttgccttcgtccttctgtccatctacttctgtctgggcttcttggaacagtgtgctgtcgcgatgaccgccgcatgcgtccgctgggcttggccaccggtgcacttcatgctcggttcgtcacggggaacgctgttctatttgactgactggttcgacttcttgtcaagttgggtgtgcgacatggccaattctatgcataacacttcattttttctttaaacctgactgtacaccccccccccccctcatttactcaacgctttcatcctcctttttgatctcgattttgaaccttcaaaatttattcctaattcaatttccaaattcagttttcatttttatggatctaaatcattcaaggaagattacgatgatgatttctttgaatcaacatgtattgaagtgattgcgccgccagagcacgaaatcatttatggaccatctgcttttgttgctatttttgtagccatttatgccttggcgacgggacgtaaagttcaaaaggcaacagcattaacgggggaactgctgcgcaacaaatcggttgtaaaaattggtggactgcgtcagaaagtgaaggcggcagcgaagtcgggaaaaaacggatcattttatcggtggaaaatgaactgcagttcaacaagctggagaaagaaaaatcccgaaaatacatgaagggagaatttgtgatcgattgttatggtcttctggtgttggagcaggaattggatgaggaataggaataggaagttatattttaaaaagaaggccggatttatacacattggaaaaatgtatttcattaaaatttaaaaaataatgtgtttttaggaaaaaccctaaaatttctgcgcatttaaaacagcgggataagcactttaaaaaaaaaaccatttttagtttgctttaaagttactactacggtcactttttgagaaaatttcttaacagaaaataaacctcccgaaaaatgaaatgataatttttcgaataaactcctcaaaatggggaattaaaaaaaatatgactaagtttatgtatttacttttgatcaaaatctaattctcaaaatttttctcattttccattaaattttacggtagatctttttggcatactattcagttgtgtgtaaacccggctctattaattcatttctatcatttctaatgaaggttattcattaatagggttaaacgatctatggactgttcaatgttgtatatagatgtcgatgatatatgtatattttgtattgttgttgttgttatataaaaataggatgacaattgttataacgtaatattttggaaaaaaaactattttctcttctctttcacctgctctttcccttcctcggtctcttttcttctttttttctctttcacctactctttctcttctctttcacctcctctttcccttcctcggtctctttttttcttttttctctttcacctgctctttcccttcctcggtctcttttcttctttttttctctttcacctactctttctcttctctttcacctactctttctcttctctttcacctcatctttcccttcctcggtctctttttttcttttttctctttcacctgctctttcccttcctcggtcccttttcttctttttttctctttcacctactctttctcttctctttcacctgctctttcccttcctcggtctcttttcttcttttttttctctttcacctactctttctcttctttctttctcttcctctttcacctcctccttcccttcctcggtctcttttcttctttttttctcttcttcgttctcttctttcttttctcttcctcgttctgttttttcttcccctttctctcctttttacctcctctttttcttcctcgatctctttctcttctctttccttcctctttcacctcctcgttctcctctttctcttcctcgttctcttctttctttctcttcctctttcacctgctctttcccttcctcggtctattttcttctttttttctctttcacctactctttctcttctttctttctcttccctttcacatcctctttcccttcctcggtctcttttcttctttttttctctttcacctactctttctcttctttctttctcttctctttcacatcctctttcccttcctcggtctcttttcttctttttttctctttcacctactctttctcttctttctttctcttctctttcacctcctttttccttcctcggtctctttttttcttttttctctttcacctactctttttcttctttctttctcttcctctttcacctcctccttcccttcctaggtctcttttcttctttttttctctttcacctactctttctcttctttctttctcttctttcacctcctctttcccttcctcggtctctaaataactgatttgaagcaattttgcaaaatgtccttattttggacccaaaaatcttattttttggccttgatgttcttattttgaaaaattttcgatccgagccctggattaaacaaaaaagcatgtataaaataattaaaaaagcgtaaaattctccatcaaattgggctttttatgcttgtatgctatacggcaacaatttcagtacacaaaataaaatattatttaaatttcatttcgatgccaaaatttatccgacagcgaagcgatggcggtacttgaattgtaataacttatctaaaatacggtgtgtgtccctttttgtccttttgaacataaaaaccatcaccacttgactccctatgttctgctgttgttgttgtcccccccccccaatgtcgcgtcggccttcactttttatgcaaatcgttttgccattgaattgggggagggggtggacgaggacgaggggggcggggggggggggactctgctgttgttcgtttggtttgtctggggttgaggaggagagcctgcacaaatggacaataacttctc

SEQ ID NO: 4824 - DNA, 4706 bp, Heterodera glycines
  misc_feature (4459)..(4459): n is a, c, g, or t
  misc_feature (4470)..(4470): n is a, c, g, or t
  misc_feature (4476)..(4476): n is a, c, g, or t
  misc_feature (4484)..(4486): n is a, c, g, or t
  misc_feature (4504)..(4504): n is a, c, g, or t
  misc_feature (4568)..(4568): n is a, c, g, or t
  misc_feature (4571)..(4571): n is a, c, g, or t
  misc_feature (4585)..(4585): n is a, c, g, or t
tcactaatttttcactcagaccccattcttaccagtgcttgtttttcccggttcccggttgccctaccgggaccgggacctgagcttttcaaacccgggaccgggaaccgggaccgggaccccggatgaccgggaattcccggcccggtcccgtggcactctagtgttaaggacttccccataaaattttaaattaataaggaaaagttttcatctctatgcacctcagtataaatctttttggttggcttgttccataacgctctatttcattgcgtacatgcgtcctcctcataagcagctgtaaactgacccgaaattgccatgcccaagcacgccttgaatcgtccagttgacgcctattaccatccccggttcaatgtttaagttagccattagacagctaaattgagaacagtcacatttggagcgacccaagcacataattcatttagaaaaaataacagtatttacggctatctgtaccgattttaaaaaagtaaaatttttgggattaacttgttttaggggttttcatggccggggaaacgaatttcgaaaatttttaaattctttataatttcaaaaatcacgaaaacatgttccgaggggcttttgggtctcagatcacgaatccggcatctacttcgaccaattacgaatcccggaccccaattcgaacaaaaagtgaaaattcaaaattttcaattttagtttaaacaggggtgcgatctgtcgtgatttatcagtttgtcctggtttggagggtccaaatctgataaagtgaaaatgtcctgaattgtcatttaaaatggttatataaatcataaaatttagagaattttaacaaccctgtgcttaaaaaattatattttcttgaaaattaaaaaatttatgtatagaaacctggtaatcttattatttggtcaattcttatagctgtttaaacgtagagttaaacgtgtattagttattgtttgaacttacacctgaatacccagatttgttgggtctagcaaagtaagcatgcttaattgagcaaatattcgttcaaaaactttcgattcctagcttgattaaaatttactctgcttttaaattatatatttgcaatttaaagaatcaattaaaacttttttatttttaaatccttaatttggtgcccaaacttcccggtgcccaaatttctggtgcccaaacttcccccccccccttattctaccgtagtgaaaccactcattccaagacaaatttaggattacgccatttaaacattatgccataacaattttagattaatttatttatttaacagtacggggtcaaagaattcaagaagttcacgtttttatcccgaattcggctcggtaaatttcttcgggattgccctcaattaccccctcaccttttctcttttttcgattttttgaaaattttagttaattcttcctaaattgttgttgcatctaagttctgttttataataatagtaatgtcgctgctgcccatcagtcgctgctcctcccttttccatgccgcccgttctttggcgtgccgtcgtcctcctcccctggcgtcgtgtcattgtttgctctcagtgccatccacggcaccgttttcgtcccatttgtcgtcgtcgtcgccagtcgtcctccacagcctcacaactccgggtttgtcaaaaataaacatttgcccgcattcatttattttcatggctttgcatttttttagagtgtcaaccttctaaaaacccaaaaaaaaaatttatattctgtttttttttattaacttttaattttccctcaaaaagtggagcgagcaaagcctcaaaattgcagtgctaaagcgttaaaaattggggtgcgctttactaattcatttaacaattcggatgcctttttagaataaaatttagaaaaatagttagtgaggcgtcatcggagcgatttaccatttttattccaattaaagcgatttttcatgccccctctctttaagtgacctccactcactggtgccatcgtcctgcatttgcctctcaatcgacgccatccgcaccggtgccaaattcgacaaacaatactccggctgctgctggcggtggtggcattgggttgtatcagcgctacgagcaatggttgcagaactatccggccctgtacaaattgcatcgactcactgttgacggttcgaattcaaaaaataccactgaataatgaatgaatgagtcgacgattatttcgcttttttcgccctaattcagaaaaatttaaaaacagaaattttttaaagaaaaatcatagaatttttataagaaaaaaacgatttaaaaattcttttatttttaatttttctgatttatttaaattcaaatatttcttttgtgtaggctccaaatggtgttactccgatctcaaaacgttcttttggttggcctacggactgcgcaaagggcgcatcacactgaacgatctcaacgcgcgcgaactgttcatctacatccaggctggtggagttgtgcccggggggaggaggggcagttcgtccccccccgaaaagttcaaaaaattttcaaaaggttttaaacaaacttattgttagcaatttcacataaaattttcgaaaaatcggtagaaaattttgtcgaaaggagagaacgaaatgcacccgtcaaagttccgactcaactttcctcacaactgacaatgagccaccaaacaattaaacggccggacacataaagagagaaaactcccccttcaattagcttgtgtgattttttctctgtttcattcccaaatttgtcataattttttgggtcgtcccactttttttcacttttgccctttcccatcggtctcatttgtcagtgcgcccctgaagtggtccacattacgaccatcttcattttgctcgcaattcctgtcagcggcgagctcgtcactttgttggcgtaagcaaaaaatgaaattaaaaaaaaactaaaataaaatttaattgtcgctgtccaaaaaactcgggaattccgaatattggcatggcatacatacgccaacacggacggagcaagtcgcgtcattccaaatttagtttttttatttaacaactcaatggtttctccatccaatcaaatatcttccttcatttcccatttttaggacaattttatttttttatattctttttaagaaattcttgcctcgtccattcactgtatcaactatttaatttaaaacttttttggttttaaaattaggggggggggttaggtacctgccgctatggcgaattttttttttttaattgcattttttgttaaaatattaaccgcttctcccatgggatttgatttttaaattttttccccccccaaaaaccaaaaaaaaaaaaaatcctataaaaattttttttttttttctccccgcggcggggccccccaattgttgggaaaaaaattgagttttttctcccccccccggggggggggttggtgcgcggggccccgggcgaatttctttctcccttaaaaaaaaattttttttttggtgaagaaaaaaaaaaaaaataaataaaatttttctttaaaaaaaaaaaaaaaaattttttttttttttttttttttcccccccccccccccccccccccccccccccccccctcccttttttttttttttttttttttttttttttttttggggggggggagagaggggggggggggggagccgcccccgccccccccccccccccccccctttttttttttttgtttgggggggggggggggggtttttttttttttttttgtgtccccccccccccccccccccccccccccaccaaaaaaaaaaaaaagaaaaaagaaaaatattttttttttgtttttttgttgctctcttcttcttgtgtgggggggggggggggggggggttttcttttttattaaaaaaaaaaaaaaaaaaagagggggggggggggggggggggggggccggccgccccccccccccccccgagaaaaaatattaatttttttttttttctccccccccccaccccaaacaaacatatattatattatttttgttggggtgcgggcgcccgcgcgccaaaaaaaatataatatttttataaaacaaacaaaaccctcttggggggggggggggtggtgctcgcccctctttaaaaaaaaaaaaaaaacacccccccccaaataatatctccccgcgggggggggcgctttttttgtgggggcgccgcctctctcactaaataaccccacaaatataataagagggcgacaatattttttgggaatattattttgagaaaaagcggggggggaataacccccccccccgcccaccaaatttttttttttttctctcccaaaatttgtcgaattcacacacttgcacgccctttcctaatcctccccatctcttttcacagaancacacaggggncgggancattcaannngctcatccggcaacaaanccaaaacggggaccgtcgctgacgggggcacaaatgcaagtgttgtgtgtgatgacgagactcnaanttctccgagagtgnagacgtcaaaaaacacgcgtgtgcgcatatacgtctaattttttttgaaaaatttccggattttacgtaggtcgccacaggagattttcgggaaaaaacctggactcgaaaataccgggaa

SEQ ID NO: 4825 - DNA, 2232 bp, Heterodera glycines
cattcccaaaattggtcataatttttttggtcgtccactttttttccttttgccctttcccatcggtctcatttgtcagtgcgcccctgaagtggtccacattacgaccatcttcattttgctcgcaattcctgtcagcggcgagctcgtcactttgttggcgtaagcaaaaaatgaaattaaaaaaaaactaaaataaaatttaattgtcgctgtccaaaaaactcgggaattccgaatattggcatggcatacatacgccaacacggacggagcaagtcgcgtcattccaaatttagtttttttatttaacaactcaatggtttctccatccaatcaaatatcttccttcatttcccatttttaggacaattttatttttttatattctttttaagaaattcttgcctcgtccattcactgtatcaactatttaatttaaaacttttttggttttaaaattagggggtgtgttaggtacctgccgctatggcgaattttttttttttaattgcattttcttgaaaatattaaccgcttctcccatgggatttgaattttccagtccaaatccaaaaataacatccataaatttgtttcttccaggccgggtcccaattggtcaaactgagtttgctcgccgcgttggctgtgctgcctgccggatttccgctgataatcatttcgatgtaaaaaattgaaattttctaaaaaaaactttaccaatttctcaccccctctcccacttccatttttaggcttgtgtcgcccaaattggtactgacccggcacttttggaccgattggcaaagccaacagttccaaatggacgacctgcggcgcaacgagcgcaaactgttcccccgcattgtggacgcgttgcggcagcacaacccatcgtcagcggtgagtgatgacacaaccctggcaggagacagaaagagcggttgctaatttgtgtgcattatgttggctccgccgaaacgtcgccgcaaaaaaatataaaaatttttcaaaaaaaattctgaaaattaattgttttaaattttttggaaacctaagtaactatacaaaatttgcttattttccagaaaattcaatttttttcgtattagactatgtaactaaaaattatttatatgtcaattgacgaaaatcgaaattaattttaaatttttcaaaattttttctaactaaaaaattaaattctaattaattaattattaggccgcattggcagcgcttgagcagcaattgccactgactgttgaccaattggttacgctgcaaaagtcggcgaacattgtgcccgcctcgttggacgcgtacacgcagcagcaccgggtagctgcatcattctctcctcccccatatcactccccccaatttctttttcctctccgaaatttttttttaatttcatttacaaattagaaatttctttactacataagaaaaattcaagcaaaaaaccaaaatgtttgttgttggcccttctcctcccctccaattttttggtcggaatgtacttttggctctgcgtatataatccaatcaaattacattttccattttttcccaaatttggccatacaaattttgtcccatttttccccagttcttcctgaaaagggtgcacaatttgccgttttggaccaccgacggcgcactgctgcggcacatcaaactgatgcgtctgctcgacgcacggatggcggctgaccacgcggaggacaaagtcgtggacaaactcagcgtgcgcgaactgcagacggtgcgtgccgtgccgggaagggtcaatcattggccacaaaacataaaatatcattaaaagttttgtcaaatattgtgggctatatgataacgagggatgccaattaggtgtatgaatttcatattattttttcctgaagtgtgggaggtctctgaaaagcacaaaaatatttttgaatttaaacatttgtaaaaaaatgtctatttttgtcaaaaataagcaaaattttcattttttcggtattttcgcaaaaactatttttactttaataatttagtgaacttgaaaaaattttgaaaatatctacccctcaatttgaaatttgtatccatatttttgccattttactgccaattttgcaattttatgcacatataattggcattccccaatgatgaccccgctgtaaatacggtataagttgttgatgaatactgtgtgtttgttttacttttttg

SEQ ID NO: 4826 - DNA, 1763 bp, Heterodera glycines
acaaaactggcgctttaaaattttggggtgtggccgcataatggaaaagtaccgattagggtgcacattcaccacgtaaaccttcaagattctaaaatatcaaatgtgaacagatccgtcctcgttcgatccgctgctgtacgcacatgcgccggtgttgacccaagcgaactcggccgacttggaccggtggaggaagaagaaagggccgtcgtcgtcaggcaccgcaacggcggatggcaccagcagcacaacatcatcaccgctccaccgcagcagcaacagcaacttcttgcagtcgttggacaatttggaggagtggaaacggatgggccagcggtcggccgagttggccaagcgctcagcggacgcggtgaagccgatgctgcgcaagggcactgcgatggctgccgagcggtttaagcaggcgggcagtgcggtgaaaaaggcgataaactaacgaatgagcaacagctgatcagagtggtgattgatcaatattttagtccattttttgtgtttttattttgctgttgttttattaatggtggaaatatacaaattggatgagaatggaatttctggtctctgctctcggcaatttattaaatattatttatttcctggggcgagaggcttaaaaaactaaaaacagtttcacttgttttgaaacttctggaatagggttcttatccatatttcgcaatttatgtccgtattttggccgtggctaatgatttcgtcagtgaactatttttatttatttcactgttgtccatttttttcgtcagtgatcgaattcgacagtgaatattttcgtcagtggatactttgttttaaaatgtataatagcttattatctatggtaattcgttctcgaatgcatatatgtcgaccctaatccaacatctgagctacaggattattttaaattttggggataaatttcgtcttttaacaaattttggaaagcaacatttcactattgttcttttctggggacgggacgaaatctcgccgccgaaatctcgccgagacaaaatctcgccgcagaaatttcaaaaaaaaaattcaaacttagaaatttttaaggaaaaaattttagaaaatttttttttataagaaaattccaaaaaaaaactatttgctaagttttttttgaaaatttttcaaaaaaaacagtaaattttcataaaatttcaaaaaaaaattgctgaagaatttttcaacaatttttttatttaaattttcttataaaaaaatttttctaagaattttttccttgaaaaatttctaagtttgaaattttttttttgaactttctgcggcgagattttggggtgtttttcgcttagagttgtgtaatggcatggattcacgcacagcatgttaattaaaaaggaagaggtaactggcgacggcgtgattcgtgatcggattgatgcgataattggcacagcatgatgaactttttcaatacaatagtggaacatgacagaccgtgtggaaatatgttaggcaagactacaatttaaatcctcttttccaggacattggaaattgtgatacacttgaatatcttcagacctgtgcttactgtttacacttttaaattgtcttaagtatttttatgaactaggagatgtgttgaggtttttatggagagcacttctaccagaataaagatcgtctgcgacattactaggcagagaggtattagacactggaacatgtggaatggatataatagagaaagcagaaac

SEQ ID NO: 4827 - DNA, 1087 bp, Heterodera glycines
tacaaaatctttcagcaaattatactcaatttttcctaacggtcccgaacaaaactcaattttttactatatcaatcattgtatttaccgtcatttattctttcaaaattaaccattgtgccatttttagcttacattgagacggcacagctggacggggagacaaatttgaagatccgacaggttctctctttctaaacaaccagtattctcgttagttcatctccgttcctttaggccgtccctctcaccgcccaactcactgacattgcccaactgtccgcgttgcgtgcgcacatcgaatgcgaaccgcccaaccgacgggtgcacgaattcagcggcaccatgtgtgccggagacgacgaaaaagtgccactttgtgagtgcgatttcccattccccgtacattaattagttgtacaacgaaactcagtttcccaattaatatattttcccgcagcgattgaccaatttttgctgcgcggtgccaaactgaagaattgccgctgggtgtttggcgtcgtcgtctacacagggcacgactcgcgacttctgatgaactcgaccagcgccccgctgaaaacgtcgcgcattgacgtgatgaccaaccaacgcagtgtcatcctttttctcatgctggtgctggtcaccatcgtcaggtgagcggacgtttaaaatgagagtgccgaatgggactatccgattgtgccaacaaatgtctacggaaaaaacgcaccttctgattggaagtaattaaaacgcagaatttcggcttgtgtctggcattaaaaactagtttcgaataagcatttaaaacagaaattatggcccattgtttggatcatacgtggacaagggggcgggggggggtgggtcaatttcgtaaatcgtacgagggtccgaggcaatttcgtaaattttcggccaaaatcgaaaaagcactgggtaaagatgggaaaattgtacgaaatcaaacctgttaccaaggggggggccccgggcccccccccccccccccctcccccgaaagggggcccggcccccccccccatcgtccgccgtaaggggggggggggggggggggggg

SEQ ID NO: 4828 - DNA, 1737 bp, Heterodera glycines
acgtcattggttgaacgcgagtttgacaaatcattggaccggatggaattgtattaaaatctttaactaaagtggaagagagagaggaaataagagtcagacccattagcactggaaaaaattttggctgaaccattttactggtttcccaattacttattttggagggtgctttgagagtatcattcatcattgatgaatgagttttgtctgtactagattcagatactttttgaatggtgtttatattttgagaggccgcctcagcggattggtcatttctaaaagttaaactattaactttagttgatagatcgtttatcagtctgttttgttcatcaattgctctgatgaaattcaaattcttagatggttgggtaaattcgtcacgacgtttaaagcatttaaacgcgaggtggccaaccttcccacagtagttgcaaactggtcgagcattccagcgtcggtcattttgaggggcttggttattccaacgtctatcatttctggaaaagcgattgttccatcttctgtcattttgaggacgattatttgatgtattaaaagagcctcttgaggcttgggcgttgttatcccagttgttccggttcctctgtctgggatctataggctctctgttagagcctgtgggagcccatgttctaaagttgccttccgggtggttcggcggctcggtgttgttgaatctcggattttgttgttccgaaattgggaaaagaggtgctggaatagatttaggaatctctctatgcatcatttctgcttcccgtgcattcattctcaatatttggaaatcccttctgacgggcccactcaggggtcgagtgagaaattgagatttggattcatttttccaaaaatgctcgacagagtacctcctcactctagcattagttgtaaggtctgccgtggtggcctcaattagaggaatcagtcgtgcactaaactcatctacagattcccccccccccccttgtccatgtatggtttggatttttgaaaatagtaaagttgaaaaaaacatgtctatggacaatggggtttacttaaatcttccatacatggcaaattgatcaaccatagttataataattcatgcaaatccttgtaaatcccgtttttaaattttgataacatttcccaaagttatttttggtcatttgcattttttatgagacggcctattagtagtatgatcttaaaaggggctgtatatatgtactttgtgtgtgtttgtgcctccaatcagtctttttcagtgccatcggtgccgaagtgtacaacaaatggtttttggacggccattggtacatcggcgccattgtccattggtccttctggtggaacatgctcaccttcttcattctctacaccaatctcatcccaatttcgttgcaagtgacgctggaaattgtgcgcttcttccaggcgtcgtacattaaccaggcatttttcattaaaaatccacaaaattacaaataaaaatgggaattttcaacatttttgatacaaaagagtatggagaattttaagatgtcgcccatcggccacatttcgactcttcaattttatatatttttctaatatttcttaaaacccttccatcctttaaattgacatttttgagcatcttcaattatttttttttaaaatccccaataattaagtccaacctttttaggacattttaatgtatgacgaggcaagcgacgtatg

SEQ ID NO: 4829 - DNA, 2241 bp, Heterodera glycines
gcttccgaagaagttgctttgtgggcaggcattacattatcagatacgtcttggttcaccatcaaggcatgccttgaggcgtgccaccttttcagaatcatcccactttctgccattgcagtcaagaagatccatgaactttcttgcccatcgatcgaattctaatggagaatttccagagaagatcgtgaaagagggactgctttcagcgaaaagcatgttaacatgatggaatcccgaaggatttaattcaaattcctcatcctcttcctcactatgtatggcttcaatcaccgaagtattagcattgccaaagctattgttcggattcctgagtggagagggagttgcccaatttaagaccggagggttgttgactaatggagactgattttggttttgcaacacttgaactgtaccataactatttgcgagagtatttacttgagttatcagggtttgagtatcatccttgagttcagtcaagtccctattggtttgatttatcttcctgttaaggtgacgtgtcatgcgattgacaccatcctcagtccgaactaagtccgtatggagcttgtccacatcagacaaacgtgctggtgtgcttaaaatctttccagcaaacattaatttatcaactactgataactcaggcaaatcattggatagcccctcagggtctgtcagtgcattgtttgacgccgcagcgcttcgattaggtggatccccaccagagaaaggaaacataatgagagggaatgggaatgtgaaatgagaattagcagtggaattgtgcaagagtatctaaaatagaggatagtaaaacgaaagaatggaagaatgaatgaatgaatgtgaaatgcttagattaaaggcccttgataatgggcgtggctggcgttccagtgttacaataattttgttatcggaactagtgtaaaaaaaatcgctttgagaagaaaaaaaatggcggaaatctattaaaaccgtaatgcggtgggaaagtgtccccactgattatatcacagcgtaaacggtgcgaacaccggaagcaagggaggggtgaaatgaaaaagcttgtgagtgcagaaaaatgaaaggaaataaagtgcttaagtgataggggccaaaaatgaaaattacctaactaattaaaagttcaaaaattatgaactacttagacatatagacataccgcagtgattggtgaaaggaagagcagtgagacccgcagggcttcatgtgagttcagcgtctgccacccttctgtcgtttcgggtttccaccgtagtgcatccactgattgtccgggccacgtcttccttgacctcttccatactgtggcgccaaagtaggcgcacctctttgttcaccaccgttgccagatggaccggcacggtctgaagaccctgtcgtctgtagtgcaggaaattggcgattttggaattggaatgagggagctctcggctgctgcgattgttgtgcaaaggcattcgttcggtccaggcgcaaaccatgcttcagcgcccagctttcaagaaagctttcatcctccacagattctcttttggccgaatcaaataggcatgtcggagacctcatgagtgttcgtcctaaaagtgccaaaacgtattcggctcgaactacgcttgttcttgttatcgccatttcgatgaaacgtttccacacttgtcctgcacttattgagaccaagtctccaatgatgaagacagcgtggcgagctcttgaaagagcaacagtagcccgttgatcgtcttcaaagaagtgcatgttgtccgtctttccggatcccacctcggagtattttgatcttgttgtcactattatgatgacatcgcactcctgtgcctgataggcatcaactgtgagtgcacgaacaccgcagtgcttcagctttcgttcaatttccgaagtttggtacgtgtacatacacagaacaataattctggacgaaaaagcgttgccaaaatgttccaaaagtgcttgtaccaagaacgatgccacttctgtttgatggtcatctgtgagcgaatcgctttttgggtccacacgaaatgatgagaaagcattaattagtcccacaggacattcttgaaccggcagaagaaaatctgagcccgtgatgagtgagcgttcttcagcgcttcttgctggaatgagttgctcattgtgcaattcgaaggaggcatagctgatgagctttgccaaaaatggatggct

SEQ ID NO: 4830 - DNA, 1451 bp, Heterodera glycines
tggtgaaaatactcgaaaaattgacaattaattattttaacaatcataaagaaaattcttttgatggtactcaacaagggaccaccacgttctgcaaaattacatcaatagaataattttattttagtgattgtattttcctaaatttattaaattatatttttataaaattattattttaacaatcttaaaaaaaaaaatttttttttcatggtactcttaaaggatcacatggttctggaaattactttaagagaataattttattttaattattctctttttcctaaatttatttattttttaattaaatttatcatttttcggtttgtttttataattaatattttaataaaaaaaattcaagacaaatagccgtcgtcagttgatcaatgttctgcgttgatcttttggaagaatcactgtcatttgattgactagctgttgtctaattaataaaatttaatttaaaaaattaaattttcaaaaatttttgttaattttttttaccactttttgtttattctttgtcgctttgttcgaagatttcactaattttgtgagttcgtcgttatccatggcaatgacaaaacaaagattgacaaataaaaaagtaaataaaaaatttatttttaaataaatcatttttatgtctctgaaattacaattattgcaacgaaattatctaaaaaattaaaattatataaagtaaaatgatttattaaatttttttattgtaaaaaaaataatttcgaatgaaatgaaaaattttaatataacaaataaaaataattgaatcattgtgatttaaagtagcattatttttattcattgtattaatttaatgacaaaattaatgccaacaaaatttgattgatttttttttgtttttgcaaattcaatattcatttccttatttcaatattttatttttacacaattttatttaattttatacaaaatttaaattatttactttttttaaattctttttcgaattcatatttgaataatgagcgctatgttaattaaaatcgtagatttcgaattttttaaaaaaccctaaggggggagggactctgttgatgtgcaaaatttatttaggttcggaagtcggtattggttaaaactgatgtgagattcgtgatcagggatcccaaaacccctcaagaacaaattttctttagtagaaataattttacaaaaaaaaaaaaaaaaaattcaaaccaaagcccccctaccccttttgtttttaataacattcaaatcagacgacttttcaacgagcgacgaataatgaagcaatttattattttaaatgattagataattttggtttcatcatatttgtttatttgttttcgaatgcaaattttatagatatatttttaaaataaaaatattattattttccatatttcttttcgaaccccaaaatcccattttttttt

SEQ ID NO: 4831 - DNA, 2697 bp, Heterodera glycines
  misc_feature (70)..(70): n is a, c, g, or t
agaagagattttcgctctggctcaaaaaattaatttgaaaaattctcaaaaaatctcttttttaatattntaaggcctttcaaacatgaacaaaatttagcgataaatttttgcggattttttgatatttttttttacaaaaattttcattgaaacttttgatcaaggcttttcaaacacaagcaaaatgttgcgaaaaaggtttttgcgttcttttgaaatttttccaaaaatttttcattaagaaatttttgagtttgggacaaaatctcatctcaaagaaccggcagaaatgccattcgatattttaaaaattgcttattcagaagaaaatgtcattcatcaaactcaaaattttggtcgtcatcgttttctttttgctgatcaaattcaccgaacctgtcaacggtatttgccttttttcaaaaaaaatatattcaattttaatattaaaaattccaatttttttttcaaggcatcgaatgcatgaaaggatttatcagccatcatcctggtgtgccaccacgtgaacttttggcgatcaactgctcggatgaaaagggggaaaatgtgtgctacggggccaaatgcgttgaaggttaaaaattgttttaataaaaattgatattaaatataaaatttaatatgaaaatattttaataatgaattatttgatttaattgtttgaatatttagtaaaaatttatattagtattaaattcgatgctgaaaataatttaaaaattgatgtcgatattaaatgatatggagaaattttattatttattatatagtgatattttaattaaaaaatatattcattattattttaaagacaagaatggacaggagaacaatgccaccatttacgtatacgattgtgaggctgatcgtaatccgtgccatctgcccaacggaattgaaccgtaaattatcgtcaaaaatttttgaatttgaatttaaaaattttaatgaaatttaaaaggtgggaaatttttaactccattcaataaaaaaaattttttaatttttttttcaaatattcatttttaacgaataaataaaaaataatttacatacgcattaatatttttatacttttaaaatcccattaattattttaggtggattagcagcgaaacggggctgaaatggcactgtcagtgcatgatttgcaagggcacggacaaatgcaatgaaaatttcttcccaaatgaaacaatcaaagatttgctgccgccatgccatggacaggaaaacagaaccaaccgaacgaatttttcttcatggctgagtgatgaaccggcaaaagatgagaatggcattgtgagttggcaactgttgcgcaaatgaaaagggtattattggcactatgtattgataggtgggacaaaacggcacaaccaatgacggtacaaccgatgaaggcacaaccgatgacggcacaaatgtgacggatgggacagaaactagcacaacttctacaccggaaagcatcaccattccgactgttgagcaaaaacctagccaccctcttagcacggtaggcaataaaaatttggcgttttttttcgtcagtaattcaaaaacccaccatttaagactgaacaaagcaacaacacgtcccagaagtctgagcaaaaacggaaaagtaaatttgtttgaacaaaaacacggaatatttgggaatgtccaagaacgcgctgcggatgagccgaacggaactggcactgatcagggaaaggagcaacagcatggcgctgaacatggacatgaatcattggaaagcagcattgatcagggagctgcgcagaaggaaaacggaatcgatcaggcaaaagaatccttaattaaaaataaatgatcagagtgtacagcaggcaactggagctaagccggatgccattgaccagggcaatgatcaaggctctgaacagaagctgagaggcgctgaacatggacctgaaaagatgcaaaacaacgttgatcagggagctgtgcccaagcaaaacggcactgatcaggcaaaagaatcataataattaaaagtaaatgatcggagtttaacagggaactgaagctaagcgtggtgccattgatcatggcaatgatcaagcctctgctggaccgaagataagaggcaccgaacatggacatgaaaagatgcaaaacaacgttgatcagggagctgtgcccaagcaaaacggcactgatcaggcaaaagatcataataattcaagtaaatgatcggaatgttcaacagggaactgaagctaagcggggtgccattgatcatggcactgatcaagcctctgctggaccgaagatgagaggcaccgaacatggacatgaaaagatgcaaaacaacgttgatcagggagctgtgcccaagcaaaacggcactgatcaggcaaaagatcataataattcaagtaaatgatcggaatgttcaacagggaactgaagctaagcggggtgccattgatcatggcactgatcaagcctctgctggaccgaagatgagaggcaccgaacatggacatgaaaagatgcaaaacaactctggtggaggtcgtgtggctaagaaaaatggcactgatgagggatcggaaccgaagccgaccggcatttctgatcaggtaagtctcatgacgaacaattcaggtacacgaattttaactgcttcacacagcgtgc

SEQ ID NO: 4832 - DNA, 1882 bp, Heterodera glycines
  misc_feature (21)..(21): n is a, c, g, or t
  misc_feature (1847)..(1847): n is a, c, g, or t
aaacatatatgaaaaattaanaattcaaaaagccttattatataaatgtttgcttttgtcttgatttgttaaaattacatattttgtttgaaatctgtgcctgaataaaaatcattttaattaaaatttgagacagaaaaatggtcttatcttgcagctgagcttgtttcttccatggtccattcccgcactcgtttaaaaatcatttatgcactcaaatccttggctaatgactgtctgcccctatccgtaccgttagcattctcaatttttggcacttcttttggccttttttgagttttgagcacatattttgtggggttttttggcacatattacctatatatttatttggcatttttagcacatataaaatagaacccttttagtagtgatcaaatatttttcaaaacaaaatcaattgctttcaaaaatgcgaaaaattcaatttcattatcgttcttttgcttattaaacctaattaaattaattacactacaattcagaaaaataataattatatttgtgaaagaaaaagattgatattaatggcttgaaacattacataaattattatttattattaattattgatgtgcttccgcctatctcgaaataaacaaaaacgttgcataaataatatgtctattataatattattttatattttttacaaatatttgtgcgaagaaatagaatcattttaattgattatacacttccgctaacaaacgtcaaattattaaatttatagaaaatgaataaatagtctatatattattttattgattatctatttccgcctatctaaaatataaatacacaaaataacagctatgttaaatatatttccaattacctatatgtctaaaaacagtatttaatatttgttgttttccctgaaaatttcagttttttcttcacttgtttatttcaatgcgttattcaacatctttttttgcttttatttttattatttttatccaacatattcaatgttagtggagaaagttaaaaaattaaatgcttattttaaaattattttaaatgttcttactaatggtaattaagaaaaccaattaaaaaaattatctcatttgtgtgctaactttgttattaaggttttcctccgacaaatgaccgaagtccctcagcttctccttggcgcttaataaaatttctttcgcgagcattcagtcacgaaaaacatggaagtaagtgttaaaaaataattcattttaagccaataaataacctggatttagtcaattacatattttttaggatttaaaatatttaagttgacttaaaaaatatatttagatatttatttaggttcatcatcaacaccgacttcaaatgctgcaaatccagctcgggcttctagtgctccagttcaagccccaactccaagtcctgcagttgcagctcaagcttcaactgctgcagttccagcttcaagtgctgctgttccagcttcaactgctgcagttccagcttcaagtgctgctgttccagcttcaactgctgcagttccagcttcaagtgctgctgttccagcttctacttcaagtggtacaacagttcagcaaaattctgcgtcaatcaaaggaaaagaaattgatgaagcacagagttcgccggaatgctcaatttgtcttgagaaacttaatgaaggcaatcagtctgaagcattgccttgtgccgtgagtatctttttaatagacaatttagtatcttgaataattttttttaaattttagcacgtgtttcatcagcactgtttgtctaaatggtatttagcgtttagctttatgagtttgtcaatggcatgaaacccatttggncaaatgggttgtaagcccttcacatggtccatttg

SEQ ID NO: 4833 - DNA, 1318 bp, Heterodera glycines
ctaaaaaattctactacgtttcatctaaaacttaaagtctattttaaatatttgaaaaaaaatttaagaatttttttatgttttctatagaaaaaaccattctgatttttttgagaaaagcacttatgttttaattgtaaatttaaaaaatatatatatatattacgaaactccatttacgaattactatgacagagaaaaaaatattgtttacttttcatatttttacactttttttttgcaaaggttatccacgaaagattcatgtccaatctgtcgtgctgtcattgggcagaaaaataaaactgatcaaccaaacaatccctcatcaagccacactcacaatgaatataatggaagtcagtaccaatcatttgaaggcatttcatcttgggatgaacacaatggatattttggaagatcatttgaagagctcgtctttgagcgcatttgaccttgagtgattcctaaacaaagataaaaacattcattgttttatccatcttatgttgaatatatatttaaaataattttgtagaatttgatttattactttgtcgaattttgtaactttctttacatttttgagccttttatgaattttcaattttttatcttctttttttttgcttttgatattttatctttttttcatgtcttttcaaaaaattgctttcaaaaattcgaaaaatccaaactcaaacacttttataaattgcttaattacataaacaattttctgggaaatatttaagcgctaaaaacttattgctggccaatttttaattaaatattttcgagaatagattaatattttttgatgatttatttatgctaatctatgggtataaacaaaataaatgcataaataattcgtctattacaatgattatttgctatttgttactaaaatatttgtgcgaataaatacaatcatttttaaacgatttatacttccgctaatctaggtatataaataatatttgatcgaatatgcagtgtattcaagaagttttattgattatctattttatccttaattttaaaaagcatgtttgtttgaattttttaatgaatttatttaattttagcatttttatagaataatctaaaaaattctcataaataaatcaaatttaagaaagaaaattaaaaatttttaatatttactttaattttgcccaatttttaaattttgtgaagtcataattatttcaactgaagatgtttccattgtagtgcttgctttctattgatgttaatgattccatattttaaaggttttttccttttaaatattaattttaattaaattatt

SEQ ID NO: 4834 - DNA, 2155 bp, Heterodera glycines
  misc_feature (2100)..(2100): n is a, c, g, or t
  misc_feature (2119)..(2119): n is a, c, g, or t
  misc_feature (2139)..(2139): n is a, c, g, or t
agaaaaatagtggtaaaaatggtcaactgctgcattggcggatcagagaggggtcacaaagagttcgcacagcatcgaatatttccttcattttaggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaatgcatttaaaaataaaaaaattattgaatttgcttctgaattttttaattttaaatagaaaattactttttcgaaaattttacacaaataagaggcgaagaaattcaacgaaatttttattaggatcccccccccccccttgataaattagagctccccctgaaataaaatccccccgtttcaggggatgaaaaataaagccctcggcggctatcttttagcgattactgtaatcaaataaaatttaattaataaatattaaaaatttacggctttaccttttgctactttttcaccttcatcatgctgcttttcattgctaacattttgttcatcatcgctggactgttgttttggaaatgatgcatcaacaattatgaaaatttgatttttggtcaaatattcaattaaatattcattctcaaactgacaagcttcaacgagtaccaaaatttttttttgggccataacatgactcaacaataaaagtatattcacgattttttatttcaaaaaattttgaaaacaaaagggtcccctcccccctttggttttttgataaaattcaaaatctttcactttttttgttgttttttttgtcattcgtaccatctgttaaaaaaacaaattctgtatcaaaacaaacaaaacaaaaaaaaatgttgaccaaaaaaaagtgaaattttcaaaagaatactctttttaagtagcgcccaatttgttaacagagttccgccagaaaatgaccaatttttgagattttgagccaatttttaagaaaacaaatgttttggggacccgcggagccgaaaagcgccgccggaggaaaaatagaaattttgactgttttttacagattttctctgaaattttgggtattttcactcaataaaacgaaataaatttgaattttttcaaaatcgaattagtaattcaaatattcgcttcaataaaaaacgataattcaaaacattcattaaaattttgcatttttttattttcaaatcccaaaataagcacgtaatgctgaaataagcacaaatcttagaaataagcacacttgggagccctgcggattacggaagccataattgagaaattcgccgtaattacggatttccataattgaaaatccagttacggccagccagccctgcttcccaagcacttgtccatctatctgatcgatttgcacacagggttcggatcgaaaaattttcaaaatcagaacatcgggtccaaaaaatcagattttggggtcgaaaatcagaacattttgcaaaattgcttcagatcgttatttttacaatttattcgatcaaaaatgtattaaatattatatttttcacctcccatgatcatctttaaaaattttggtgaggaaattaacaaatcgtaaatttcagtgttcagtgcactcgggatcaaaaaatcagatttttaagaatttttacggcgcatttttccaaaaaacttttgagaaatgggcgctgggggagggtccggcggtgccgataggcgccaccggaaaattttttgtaatttcgttctgatttgttaacagattttcaccaaaaaatgccaagtcgccagaagaaagattagttttgcataccgacaaactgatcaacgaactgatcgccaaaatcgacctgaaaaatgaaaacgtaatataaaaaaacagctctcactcaagaaaactaactcaattcacaacaacttcacactttaattcaagtaaaacagaacattacagcagacaaacacaccanaagaaggagaccaaccaancaacactcatgaatgagganagggcataagtcagtt

SEQ ID NO: 4835 - DNA, 926 bp, Heterodera glycines
ttttcccaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgttgatgaaaaaaaatatgggtagtgttcttaaacatatgaccaccccaaaaagggagtgcagttggtaaaatggtttgtaactaataataacattttgacaggggatagtgaatggtatcattataaagcccacaaaaaatgctacaagaaatataaaacatatatacacaatatagtcatattgagattttataatcaatttaaattaaatttggtagaaaattttgagtgttcctaaacatatgaccatgactgtatcatctttttcaattctaaggtcgtttttgtcgcattttgtgctgattggtgtccttttagtagaaaattgaagccagtttttgaaggtgggatttgttgatttgataaatcaaattaattttaaaatttttagaagcagcaatcaaatggcacgataataacccaaacacgtaatgtctcgcttatcatttggattcgttttttagtatgataatttatattttagcagtgtcgtttgggctttcgttgattcagtgaaacaagcggatgttgcggataaatattttgtgaataaatacccaacaatgaaggcatgttaagcattaccagaattggtgcattagtccaatgtttaggtttttattaacggtgagttgatcaaaaatgaatacaggtattcaacatgaaattaatgattcaaaaaatacttaaattcgttaggagtacgagatcagtggaggcgttgacagattttgtcaagaaacagctcgaggtcagcat

SEQ ID NO: 4836 - DNA, 5358 bp, Heterodera glycines
attccaacagtaaaaggggaaggaaataaatccccaacatctgtaaattatttagcatgtttttgttcgaaaatatgagtgatttgcatgagcctggaaaattgcggcaggttaactcttttttctgtttttatttttgaaattttccgtttattttcagtttgtgatggatatgcattctggagaattgcacaaaaaattccatgaaactttggacgagaaaattgcagagctgcagaaaaaagcgttggagcagctcgatgcggaatttggagaagcaccggccggtagcaacagtggcgaagggcgggcgcctgcggcgatgccgaaagtggacacaacgccagtgccatccattttcaaggaactcaaaccatcggttggttgttcattaatccaatcattgtgattggaaaagaccaatttccttttgtttcaaggagaagcgttatactattctgcaaaagacggaattgtgacacttttggcactgtgataatggactaatcaattggacactaattgctcgctttcctccttttttcgcagcttgggtattcaactcgatttaattcgttcaaattttctagtttttattttttacttttttattgttaaaaagttcggttccggttcattgtcagtggcacttattatttatatttattgttcaatgtgattgtgaggcataatgttgttaaattaaaatgtgaaatgatgaagcaaaaaaaattatttatttgttttattttttcattattttttaacttgtggtcaaagttttagaaagtatgccctctcggcatgctcctaaagcgaaacaagttggccttgctgacaatgaggatcatcagccactgaatcggcagcaatcactgtcgccgaaggatgaacaattacaacaaactcaacagttaatggaccgaatttcggacaaggtaatgttaaggtgcgcaattcacaaattcaggttgtatttaatatgttttaagctcgagcgtgtccagccaaagcatcaaaaggtcgccgagtccattcgtgcaattcgttctcagggcgttcgtctgatgggccctggttccaaaatgagtcaaaacgtcaaggcaaaaatggtcgcattgtatcaaacagctcaaaaacagtgcgagtcggaacattcgtatttggaacaagttttggctgatatccaagtaagttgctcatggtatttttaataaattaacatggcgtgacatttgactaggttttcaaaaaatcaggggattgaatatatttgttatatagattctcttttattttccctggatatatgaaattttttaaatctcaaattttataagtaaaaaaaaatcaaaccctatctaaagccgtaatttaaaaaataaagaagtaagcagcaaatgggggaatttgttgaaaatgctttaatcaaatggctaacatttaaaaaatgcttttaaatttctttttggcagcgtgtgcggcagcttcatttgagacagcgaatggccgacaaactttcgcgtggttctctaatggttcttctggcccaacatgctgccggactccccctttacatcggatccatcgacggtcatccaccgccactcgtaatttattttcttattcatttactttcctgtttatcttctttgactcatttttaattgaaaaccaaagtttttggacctaattgtaacattggttttcccttttggcttttcaggttggcgccattccacaaaatccaggcgattgcatttcggaaggtgagtttgtcgctgcttttgttgaagaaatctggattctggctgaagttagggtacaatttcagttttcgcctttatctaaagcatatttaatttggtctcagaagcaaatctccgccagcaaatacgaggtgaaggacgtggatgatgatgacgatgatggtgagaagctgcaagttgtgcctccaactcgtctgattccgctgccccattttcgtgccgatccgaggcgccatgcccacgctcttttccccgtcggtgccattgtccttgccctttacccccagacgacctgtttctacaaaggcattgtggagagttctccgacgggtccaaacgatgattatatgtgagtccacaaattgtcattttgagaaatatcattttaacactttgttttaggattgcatttgaagataacacttttccgtccgggtattcgccaactttgccagttccgcaactttatgtgttaacgcattgtgaagtgacgccgcagcaccgaaagcgcaaaaaatccccattatccgatttgactgatgaagcatcgtcagactgatgacacccatattttgattcgttctcaacttcccacttttatcttccattgccaaattgtcccttttacaatatggaactataatttaattaaagcatacaaaacactaaatggatttgctatttatcaagcctttccttactagcaaaattttcttaaagacgttgagaatagagtaactctgaaacgcccacgagttattgtcccataatggcctcccttcctttcaatgaaatgtatgttaattttgggttagcattcgaagacgaacaaccaacaattatttcgactttaataatgaaagtgtgcatttgcgtcgcgcatcaaatcatttgccattaaaaagtcagacgacatgggcagcagaatttgttttcggagagtttttctcacaattttcattgtttcgtacacattcgcattaacggagggggaggaggaagaagttgcggactacggtagggagggaactcaaagtggtggtactgtagcaggagtagaaatggttttaaatagttgcgaccgatgtgaaacattcccattttgagatggtcaatcctccgattttccgtcctcaccaatcggccgtttccgtcgcttcgacaacgcaattcgatacatcggactgggcaaaaggaacggcgcactgcggagaatgtcacgagactcaatggcacatttattacagaacggacggcacctttcgttgattggcctcggccgaaagtgaagcgaaacgcaaaggacggacaaaagagagaaatggggagagaaatcacgcaacggaagaacacaaaaacattgcatctgaacattttcaaaccaaaaatcattagggtgcataaatgtttgatttggaactcacttcagccgattcttaatgggctgaaattttgaatttgcactattgcctgggcgttgcaaaattatagcgcaccctctacaaccaagtcccatgggggtgttaaaattttgatcactcagatcaccctgaaggagtgatctgatcacctcgaaactaaaaaccattctgaaaagactgaagggaaattcgtctaaaatttcttcaaatttatgtaaatataaatgtgcagcctaattatcattcattatcaacagcagagatggcaaaatgattgagtgaaaagaaaaggcacttccgctgggttttgacttcgtctttccttcctttcattggtaatttgatctgttccccctcattcgtagtcttcctcctcctcctctccgtcctccgcttcgtccgcgttcactttttccaaactccgtctcaattccttcagtctgatcaaaacactgagttggccgagccgcgggttgtcctcttgcaagtgattcagccaagaagaagcgaagtcgttggaattcaccccaaaaatggccatcgcgagaatggtttggtcggactgttggtgcaaattcgtgcggtaatcggaatggccttcccacagccttttgtgaagctcatcctcggtgaagattttgtgagaagaaacacactaaaaaagaaaataaaagttaaacgtccgaattccgcgaataaataataataattcgctttgaccaattcggttatttcctcgtcccgctcaaccgatgcagcactgctcaaaacgacgtaattcaactgacaatgagaaaaaattattgatggaaaaaatattgaaaaaaatgtataaaataagagagaaaatgaaaaatgagacttaattcaaaaatgcagagtgaggctgtttaatgcgaccaacatactaacagttgctaaaacagaaaccgagattttcaaatcatccgggccgggttgacatattcaaaagcagctggtttccgggtccggcctgctggtcaaacccaatttccaaattgccgtgaccggaaccagtttcagggttgataaaaatttaaattctcataatattttcaaccggaataattttttaaaaagtgtaaggtgttttcaacagataataaaaagataaaaaaattatgtaaatggactcgacgacccgataagaaaaaaacaaaactgacctagatttaaatttttcgattctgatgtcactatctgtcactagaaaccactattttggctacttcgtcactaaaatagttaaaaatcactattttggagttttgtcactatttcgacattttttgggaaattccttaacaaaaatgcaataaaaccaaaaaatacacacctaagaatcgacaaaaaaattcaaaaagcactcctaagaaatgaaaaaaattttctcaaagaggtattttcgtggcaagaattttaattttaaaaattatttttttatgtacctattttgtttttttgcccttaaaaatcccagccctactcatttggaatgcaatcagtgaataaaaattatttttgctcaatttttggctgaaaattatgtcactattcgtcactattttggactttttgccactattttggcatttttattcactattttagttaattatttcgagatttttcgtcattaaaagtcccagccctatatatcaccacaacttgccatgtgatcctggacccaaactcggctcggcccatccacgtggcaagtgctttggtccggcaaattggcaattatcctcttctgcagcggactttgcccgctcacaatccaattgtgatgttcgggccctttttcagcgaaatatgcctggagtaaattactagtcagtattaatctgacatttgtacgactcactttgaaacttgatatttgtgttcccgaatctcggcacatcattttcagcgctatctgtgccaattccacgccctccaactttttgtgttccacgacccttcggtccaaatacctttaaaaccaaagaaaagataaaataaaatgttttaatttccatcccacttgtttgtgtgtttgagttttggcatccaatagagttgacgcttcgattttctggtggcgtaattccatggtccgaaaatgcttgataccaaatcatgaatctccttgtccggttgaa

SEQ ID NO: 4837 - DNA, 1693 bp, Heterodera glycines
cagttcgattgtgcaaccttgctgttggggatagtgccagaagattttctaaagagactaattttccattgtttttttaaattttatttcacctgaattatattcgtcggtagcaaatcgccttttgggaaaatattgagcaacgccttgtaaatgtcaaggtccttgtgaagattatattctttgatgtttttcagtgctgcctcaataaactcgacgtgtccaacgcctctctttccgcgcgatttttgaaatatttctaaaattcctttgtaaaattataaagacatgattcagtgaaagaaccgaccgatttgcttcaaaaaggcttctttggtcttctcatttcttggcattttgcggaagttttctttccatattatcggctgtcttggattataagtattcctaaaaccatcagcactgcttgacgaggaagcgaaggaacgaaccaaaggaaaaacactttctgacagactttgtgcacgaataaacatactatagctataatatgagaaaactaggaaaattatagtaataacctaaaaaaaaaagaattttattaccagggcttctttttttatgtaaatacatcttttttcctggattctctatagcctaattagtaggaaaaacactttattttttgtgtttgcgaacaaaaaccaggacttttatttacatattttgcgatttttctacatatttttatacatattttggactttttcgcatttttcgtacatattttgcaatttttaaggaattttttattaaatgcccaaaaaaaaatctaaaagtacacaatttttttcaaaaattttgagaatttatagaaatttcttgcgaaaatttaaaattttttcttgaaaatgttcccaaaaaaatatttttcaaaattctgataccaaaaattaatttttaaaataataaatgttgatttctaagcctatttattaggtcatttttatggcattttatgcgtatttactctttacgaagaattttttttcaaaaaaataacctttaaaagattttatttacatattacatatttggggatttttgtacatatttaatacatattttagcatttcttatacatattttatttacatatttcgcgatttttcttacataaaaaagaagccatgtttattactaacttttgaggataattttttttttttttttgtataaattttgtttgattgcagctgcgcagacagctttatgtacaagcaaagaaaggcaataaaaattgcaaacctaaatgctatgtacaaattttcttccaaatttatattatataaatttaatttaagttatattatatatctatatataggtattttatatggttaacaacgagaaaatctgtcacgagtttcgtgacaaatgcagggttgactcagtcgtacggtgttcggggagatgtgacatcgaattgggagaggtgaccaagcacaatgtcatggtgatttttcattttcaaatatgaatttttttttttgttaaacagtcttaatctatcaaatttagcaattaaagcgtcttaatttgtccgtcttcccggtattccatttttgtctaatatttccttctttcccattaccccagtacttattttaaaattcataggtgttttacaatgacaagttttacaaagaagtagtcaatactggtgagctcg

SEQ ID NO: 4838 - DNA, 1849 bp, Heterodera glycines
agtccaactttcggcccaacgaagtgcaccggtgctgccggggttgaattctgttcaccgaccaatgcgcggccggaaagtgttccaacacgaccgttcagttgtgctgcattcagcggttcctccaggcacagttttagcaaaaatacacacagaaaaatcagtcaaattggccaccaaaacaaacggaaaacttccgatttttgccatccgccgaattggccaaactttgccacccctcaggcaaaaatgacttgctgttcggacgagcgtcaggcggacgcggacgttggcgaccacttctcgcgctgctgtttcgaacattttgtggacggggaagtgagttggccatacggtagtgggcaaatgtgtcggtgtacagtattttgataacaaaggatccctgctgccccagggcatatgccgctgagcaatggcgttccgttcacgagctgtgcctgcccaacgtggagatggacttgaccggggtcaaagtgccgtcgccgctcgttggcaccactttaattgtcggttttttcggggaaaacttggcattttgcctgccaattagggttaaactctcggcttggccctctttttcagactgagttcgacttcagcaaaacggacagatggcgcttcgagtgccgttacggttcccacgtgcaacagtacagtttcttcgaagcatccgccagtgcagagaacagtgaccaacagcagcaacggaacgaagcggaggacgaataaatgaaaaatggcattttgaaaagggcaaatgcctttttgattgactcaattggatgaaaagtgaacggaaaccatgccaaaaattggcggacggttcaatttgtacaattttatttccaaaatgacaaaggaattatggcaatttattgctttattatgtatggtttctacagttcgtagtcaaaagtattgcagcaaacatttggggcatcaataagtcatcacgtcgaattcgttctgcaggccaacgattgtcgcagtcgccgcttcgaccctcgcgcgttcggccgccttctgaaaacggagcgggtgagaataaagagccaaaaacagagacaattaattaagcacaaaacagcggcacaattaaatcccgtcccaagaaaaatgttcctttttcccatttttgaccatcgctttcacccgtttcgttgcctcttccaaaagtgaacacagttcgttgatctcctcggctgccttcatgaaaagcttttcatctgttttttgggaaaagttttaccattttaattttacaaagcccccttttctcaccggcatttgccttgtggaaaagcgctgctgccataaattttgcgcttttttccgaagtttcgcggagaattctgtcggacgagaaaatccgttcgttcaattgcttcacctcgccaatggcttaagcattttggatttcgtagtttttcaagcagtgaattgtgttgctcaccagatgccttcgtttccttgcagtattccaacgctttgtgatgaaccgaaaaatctttgcaaacactcaaagtgctaaaatgggaataccaacttaaaacggacggcacaaattcatagtattcatagtacttgagcagagtctctccaaagtttgtcttcggctcggctcgcgctccgttcggcacattcggtgtccccggcgcgactcccttttggccattgacgtaaaccatttggctatttaaaaaaatttatttacctaagcgcaaaagcgtgaagccgacaataaaatgggaaaaacaaattaataaaatggtaaatgttttgagaactttaaaaattctgtaaattagcatttatgtatttgcgtttg

SEQ ID NO: 4839 - DNA, 4442 bp, Heterodera glycines
  misc_feature (21)..(21): n is a, c, g, or t
  misc_feature (60)..(60): n is a, c, g, or t
  misc_feature (70)..(70): n is a, c, g, or t
  misc_feature (80)..(80): n is a, c, g, or t
  misc_feature (97)..(98): n is a, c, g, or t
ttttttcaaaaaatacacccntaagaatcgaccggaaaattttcaaaaatgcacccctancaaatttaanaatttctcanaattcgtttccaaattnnatattgacaagaatttttgattttaaaaattatttatctcaatactgatttggtttaattttgttactttttggataaaattttgtcattttacacccctaaattcggaagtttttagcaactatttacccatttttagcaactattttggggttttttagaaactaaaaattaattattttggcagtttttagcaactataaatgttatccctatttataattcgctttaatttaaaacgaatcggtgaacagattttaaatgtttttcattttcgtgtttttgatacttttctatttcttttcgtacttacttacttaattaactaattgttttttgctttcgtattttattttggtttcgtttcgttcgtttttttcgcatttcgtatttcgtattttcttttcacttcgcaactgttctaatggaagtgttttcgcgaaaagtgtttatcggtgggtgtctttcgttcgtctcttcttgtcctcctttattttcatttactaattttcaggtggtcttccgattgacatcactgagacggagttgaagcaggcttttcataagtgcgtttctcgtcggtcggctttcattcattgattcatttgcttttttctctgctttaggttcggttcgttgctagtcgattggcccaaccgatcatccgattcacactttgttaaaaaagaacattgtaagcgctgtcatttggcggactgttacggcgaaacagcaaaattcagtgcatgaaaagggcacaatttctgtatgttttcagatagtggcgctgccagcagagtcaccggctacgcatttctcatctttttggaggaggcgtcggtgcagcgtctgatcgctaagtgctactcggagggcgaccgtttctacatgctgatgtccagtcagactgttcgcgagaagcccgttcaggtgcggccgtggcgcctcgccgacatggactacatgccgcgcccgtcggcccacttggacccgcgccgcaccgtaagagaccaccgattgacaccgctaggaccaaaaccgtcccattccaagattttcatcggcggtgtgccacgaccaaccaaagcgagtaatgagtgattggcacgcaatttgcgataaatacaccagtttaggcgagttggcatttgtgctcgaagccgccttcggtccggtttgctacgcgggcattgacgtcgacccggaaatgaaatatccgaagggtaatttgtcatttagaaacattggtttttcatttcccgcttatagcaaataacgatgtttttctctcaggggctgctcgcgtaactttcagcactttcaaatcgtacgccgctgccatggccggtcgcttcgtccaaattccgcactcggacaataccaaacgcgtaagttggctctcctcaagtgaagaaatttgttttggatcattgtttcgacttttaattcgaaaattgccgggctttgaacttttaagtgatcaaaccatttgttcattggatctattgtctctgtccttcttcaggtggagatcaagccgtacttggtcaacgatcagatgtgcgacaattgccatggcaaactctgtcaggaccgttacgcgccgtacttttgtggcgacgtcgcgtgtcttcagtattactgtgaaatctgctgggaccgcctgtaattaattaattgcgcattccttgcccaaaaagccttaatttcccctctttcagtcattacgggtcgggcaatcgttcgcgcgaaatgcataagccatttgtgcgaatgggcgaacagatcaaagtgagtgcgttcattcagaggaaaacaaataaaaaatgccgttatttttctttttggctggtacaatttttcagtattaatttcccacttttcgtcttaattcccaattgtttaatttgctcccttttttgatttttcagatcaaaattccgcagagggaattctaatgtgataataaaaataagtaataatgtcaagtaataatttgcatttgttgtacaatatgatatttaagagcaaatatggccaacttttaagaatcttaataatttatgtaaaattaattgtaattttcatgttgtcttctttgaataaatgttgtaattgtttcatttataccggttttattgggttttctcatttcaaattgaatatccatgcttttattgattgattagaacagttcaattcgaagttataacttttgtgtcgttttgcctctgtctctcttcttttcgccgtttctcagcaaatgctcgatgtaccgtaggctgcctgttggccatagccaccgtaacccgatgagccgtaactgttcaaaatggccaaatgtttgacggatggctttgatccttccccaccctccgtacgatgatggcagactgtactgttgctgaccgtagcccgagctgccatatccaccgtagcccgagcttccataaccactgaaacggtgcaacgatggctaattagttcattagccctttaagcatggttaattaaccaatcgactcatactggacaaataatttattggctgacagtgtctgccttttctttgtccaattacctgcttccgtaggggctgtactgttgttgaccgtagccgccgtacccagaagtaccgtagccgccagaaccgtagctgagaatgtgtgggaattgatagctaactttatttgcatttactcacctgctgctgtacgggctgtactgctgctgaccgtaacccgttgagccgtacccgctaccgtagcccgacatgctgccgtatcctccggcaccaccgtatccaccgtaacttgccgccccatatctattttaaagtgatttctgagacggagtcaaatgtgaagaaaataaccctccgtatgatgatgggctgtattgctgctgctgcccgtaaccgccaccataaccaccgtatcctgctgaaccgtaccctccaccgtaagggtcacagccaatttgggcgttgacatggccaggaaaatggccaaaaatgaccagcaaaaagaggctaaaggcaaaagtgaagaatagcgagataggaattaaggcagattatactacggtagtttaattgtacaccatttacggttggaaatttactacggtaggtcatttccacgagagaaatttgtggagaaatggatacaaaaaccgaccaattggagacgaagcggaagaaagtggccgtgtgtgaactgttggcgaacattttgtgattttttgttcttcgcttttgcttcggtcgctgccttgtgctgccaatgctttctccgcggcgttttatgcgtccggcgcgaatgaaaaaaaacgaggaaaatttgccgattgcccccggggaattgggcggcggatcagcctaatccgcgcgcaaaaataactccgtttggccctccgttcgctgcgcttccttccgcccacccttccgttgcgtctctccgtccgtccgactgtttgccatttgttctgtttttccctttttctgtttgttttccctcgcgcttaatccgcttaatcttttgcacatcgaacaaattattttatttatttatttattatttatttgtttatcatttgctcttttttattttcagacgatttcgtcaaacaatgggcgaattgaagaactaaaaaacgaattgcttaagcaatcgtcggaggatggaaagtcactttggttcaccaatcaaacaaccaaaagcaaacccaagaaattcactaggcatttttctataaaaatttcccttttttgtgccggtctcggaactcaaaatttgaaagcctcgttggcggcgggggcgattaaaagagttgtggggaagcagcagcttttttactgttcgaagcagcagcttttttactgttcatctctaagtttctatttaaaattgcaatttttattcggtttttagatttttcccaagaagcagcagatttgatttaataaattccatcacgtcaattacattttcattttatttatttcttcttggccctgtcaatgatcactgttttgagactaactaaaaaccaacctcaatattaatgataagcgcataataaaatttatgagtgagttataaaaccaaagcttatgcattcaaatatgtaaaatccttaaaacataccatgctcatcatatgaaatgtaaaggataacaaccccgtaaatcctctaaaagtgattgaaaaaagactatttaattactgttgtacttggcatagtaagagatcaaacctaacacagtgatcagcaaccgatcggacttctcaactgcccctccctttcgatattctgtctgttctgctcctcctcctccccttc

SEQ ID NO: 4840 - DNA, 1594 bp, Heterodera glycines
gttataaaaccgaagcttagccattcaaaaatgtgaaagttttagaacataaaatgctcatcagatgagagggaaaggagaagaagcccgtaaagcaacaaaaagtgaatggaaaaagacaaattaattaatgggggaattgggaagggaagtgatcagtccgaagagagtgatcagcagccgttcggccttctcagctgcccctccctttcgatattctgtctgttctgctcctcctcctccccttcgcagtccgtcggcgccaatggcacttcggcggcaattagcgtcagaggcggcggcggaaccctcacaaattcttcgtagggaggcggggctaaaagagtttgagtttggcattttgccacttttgaaaagtgccatttatccgcccatttgcccaccttccgtcggaatggcgcagttcgtctgctgctgctgtttccgctgctgctctgctaccgtggcggcttcacgatgccgttgacagtacggcacttggtgcacgcgttggttccgctgcgtttggtgcgcggcgttcacgggaaatggtcgcgggatgagccgattgttctgctgttgggtgtgctgctggtggtggagcaattgagagtgaaagtgcgaatggcgaatggcaccgactgaagcgaaaaaagtgtcaaaaatgaaagtaatggcaaaattagccccaccccgggagcattaatttattaaatggtcaaaggatcaaatgagcgtccctaattaatttaatagtaggggctaatagaagtacagacaaaacggacgacaaacgaaaaatttggcacttgtttccgaattcttatataaaagcataggtaattaaatcagagattggattcataaacagcgaactcaattacctctaacatttttggattaaataatttgttggattttttcagacgaccaatttgagggacggtgttgacctcccaaacattcaatcgttcaactaagtcaattagtgctagtgtgcccattggtttgttttctgtttacggaattcggccgagtccaaagagccgccgagggacgagcgaccggcgcccgactttcgccggtggagcatcggacagaagcgagtgcgacggcacagaaaggagccgaggaggacgagaaagacgagcagtgcgagtgaggccaacaccaactcggcgaggtgactaaacgcaccgaaaaccaattaaaaaaagtcatcccttttttgtttattccaatttttagatcatttcctaaactttttcgcgcctttaggtagtgtacattcattcaagatgtaactattaagtgtaatggtggcacaacatggtcacagaaatttcaattctctgaagggattttccctttttgaggggaaatttaatgtcagaaagtgctgttggagcgcctttcttttatggcctcggtcatgtcttgacgaaaaaagacaacaggggaaaatttgagtcattttttgttggaaaagtacataaaacagttaacgtgccaaacaagtcggccagagaaaagaaaaagagaggggaaaaataaaataaaatttgcaaaataaatgtacgaaatgaaaaattca

SEQ ID NO: 4841 - DNA, 1227 bp, Heterodera glycines
  misc_feature (1209)..(1209): n is a, c, g, or t
aaagggcaacaagctgagaaagggcacagaaaatgcaaaaaaagggacaaatcacccggagggggggggattaggggacaattagcgaacaaatgaattaagcagtccttcccaatccaaatgagtccccaaaagtctgtccgaatccccccacaattccctccttctcaccgctctgttcgggcccgtctttgaagtccggacagcttttggtcggtttgctcaacggtttgttgccgtcgtttgctccgattgaactgcccgagggaggacaaatgtcggcggatgccaaaagtgaatttgtggcgacaaatgccagcgcagcagcggaggaacacagaaaattgggaggaaaaggcatttgtgggacaaattgggacaaaaagccttaaaaatgaaaggaaatggaggaacaaatgatgggaaaaatgtacaaaaacaccaaagcaacataagagtttgagcaaaagcgaataaatttggacggaaaaggaaattttaatcaaaaagaaagttttttgtgtcgtcggaccgatcactttacaattgccatttgaaaaatgcttttgtattgttatgactttgagctgaaacatttggcggatctcaacggcgtcacattttttgttgagccgtgggaaagcgaaggaaaagcgaatgaaaatgaaaagtgcgcaatttccgtcgattaaatggcgaaaaaaaaattaaaaaatgaacggacaaaacgaggaaaattgaacaaagatacatacataagaacgaagggggggggggggaaaatgaggagcgctttttgggaccaaaagcttttctgcctcccgcttcacctttctctctctctctctttgccttctctccgatcattcggtggcttttcagcaacaaaatggtcgctaatgatcgctttgaatacttatttatttattcctttttttctatgaaaaatttaagaatggagagaatgggaatattgggaggggaggaccgggggatgggcggcacaaattaaaccgacagaaaagggaaagggcagcgggggacagcacaattcaatccatcggcggggattgaattcttaatgagcagccgcggggggggagaagcgaagggatggccaaaagcaacgccaaatttccatttttccgtctttgccaagtgaaatttcggcgggaagaagaatttcgtgaagttttcttcttccgctgntcgtcgcccacactttga

SEQ ID NO: 4842 - DNA, 4298 bp, Heterodera glycines
tcgatgaccgtgccaacaactaccccgtcttctacgacctgggcccgtattttgacaccatgcccaccgtcgatttcttgtgccaggcttcgtcattgagccgtatcaatggcactgttggattagagccgattcttcattggattagtcaacagcaaggattcatcaaatacttcaccatgtatccttccgctggagggactcaaatctcagaagtggatttcagccactttctgctggtaatcaacattaaatgtgtcatgttcaagagcgtagtctgaccactaacttcggcggcgcgggggggggggggggctaaattcacacccctcaattttttatctcatgcctcaattaaatttaccgcgctcttatccacaaaattttttttttaaagtattagtccggcagtgccgatagcaccccggtgaaaaaatttgaaatttgtcgctcggtggtgccaatgggcgccaccgagataaaattttttgagaattgaattgaaatttgtttagaaaaacatatttttttcaaaattttcggcttaacagggctataattacctctgaccgccatcccttggctatttgttgtttgatctttttccgtagaaatccaaaattttcgacaatttttcaaaatttacttcttttttgctttaattttcatttttccttaaagcattttacactttgtacatctttatcagagattcttcaattctcgcggtgccccacctgcaagttacaacgccatgttcaaacacggtgttgttgctgacgatgtcaacgaattttccatcgaaaaatgcgagcattccctgaagttgaaggcctgcgtgactgcagatggtaccacggattgggctctgaagagcttatctgcctacgatgaagctttatcgaatgtgctcgtaatcgtccaagcgtgccccgtcaaaagaaaaataattttggaggaaagcgaaaacctttgattttgttgatatgtcctgcaaggacggatgatgatgcgtatttaaatgtttttaaaaatttgattttcacattcacattatgttttttttgatttctctattcaattttgttgtcactttaattaggcgaaggaatgcgtaaaaataagagacctttgccgtttttcttggtgtaattaataggactgcttggcacatttttttgtcatttcattacttttgttttctcgaaattgttttttaagtaaacttttcggattaggcttgctaacgaattggcaatggtcaagaatttcgattacgaaggccacacttttttacgaatttatgaatgctagtcgcaacgaaaaaatcgaaattttggttgaaaaatttatatgggaggggaggggcgaattgggggtgtggagggaatagcggccattttaaacaattaatctttttatattacctaattgaaatactgtatcactgacgcatttttaccatctaaagcatactgtatcactgactcattttctattgcaccgctcggatatttgacagaaatgaaatgtgactattttacaaatatttttatgattattttctcatttttaagggcattggatcgaccttttttggataaaatttacaaatttagggggagagtagtgattttggtgctcagtgcatggcgctcagtcggccgttgtccgccaaaatgacacaaatttttgtttcattttttggtgtcattcccttgcccatcgtccgttcttttcttcaccattatctccaattttcctcccatccattaaaagtggccattattatgtcatttttatcgagtcggaggaacgcctcgggggaaaatgtcggagggcggggagagaattaatcgcctcgggggaaatgaaaaagggaaaagaattaatagtgccaaggcaaaacggcgaaggcttgcccaacaacagaagggcaaaagtcatgttttgttgtgcttatggcgtcatttctttttttaattaataatttttatatttatttaataaataatagaatattttttctccatccgatttcttttaattttatttatataatattcattaaaaaggtaatatttttagtatagattaaatggatagtcaaatttctgaggacaaattaatgctttttaatttacgcattaattggaaaaaatttgatgatcagacaagggaaagtatcagatcagtgatcgaaaaggcattgagcttaacgcaaagacaaaggtgagctaattgaccaatttgtaatgcattaatcactgcccgggggttatttaagggaatcactttattattgaatttatcgatgctcgattttaaatgattgatcagaaagcgaaattcaatgcaactggcgaatcactagaataataaaatcgggcagcagatgtcgtttccttcaaatgagaattttgattttataaagcctaaaatgttaaatatatattaaaacgcgcaattctgctcaactttttttgggctattttaaaatttattaataaaatttagttttatttgcaacgacatttggttcgatgtttttgagttcttcggccgtgccgaactcggccttctgctgatcgcacggctcagcaaacggttcaatgcgttggtggacagtcacttttcgatgacattgtcagggaatgggcataaatatttaaatttaagcataattgcttaaggatccctcatttgacatttgattatgcgatgattcttcgtgcggaggacggcaccggtgccatatttaaagtgcggcacaaaggaagtaatttgcgtgatgaaatggaagaggtgccaatggacagcattccgtttaggaaaatcattaagaaaatccacaaaattgccatttggtatgttttgtctaacgagcaaaaaaatttttaattggcctaatttgaaattggccagttggaaagggtccgccgcccaacctcaattagcaattactgttaaatatcaaacaattagcatctcattaaggccttgccatgaatttggcaatgcccgatagcgcttgtttttgaattcaaaaaggtttgacacattataatgcgctgattattgtggccataacttttttgaaacttggccatttactttaaaatttctatgataattaacggcgggacgaactgggccccgctaattgggcccataatttaatttagtaaatgtgtaaatctcaaatgtttacaaagtcaaaatggggttaagaaataagcccccgggggatagatttcccccctacccaaaaaacggataagtaccgattatggtttcaaatccgccccaatccgttcagttacactgatcgctctgtgttcacttttttgcgagccattaaacatgcgtttgactcgcgcactcaatttgaagtgtgcgcggtaattgagcaaagttgggacataatcataaaagaactttggccgctagtgtaagtgcaaatttaaaaattataaattttcagaatatcattaaaataaataaataaataatgcattttcaggccaatgtttcttggctgcatcagtatttcttggaaaggcatcccaaaaattgagtgtttgacatttgaggccaactgacattttgggatatgtacagtgtaccgaaaattaaatgatttgaaactaaaaaattaattaaaaatataaattaaaatcctttggatttaatgctgaacaatcggatatgtaaaaatgttgctcatgttcaagcgcaaatcgtacgcctcagaatttaaatgaataggtcaaaattctgtgccaagcaactaattgctaaatgaccaacaccacatagaattattggcaacagaattattggcattctggggcacacttcactcaccatacaaaatggcccaaacttaagtttttgtgaaaatgcgggattaatcctacgggaacctttcccgcaaaagttttaaattccaattccgcaaattttgtcggcttttcccccaaaaaacaatgtcctcaaatgtcgaatgttcaaatttcaaatcctcaaaatccgcgctgcgcttggaatgattttcccgtctctctgttggattgtgctgagcttcgcatgatttcgtccgctcatttgccaatgccttatgctgttgttgatgatgcctttcatcgaacaaatgtggcactgtttaattggcttcatttgccgcgcgcggacggccgccccaaatatttccactggtgctccgagttggatgccaacgaaagcatcaagcaactgaaggaggtggagggagggcactcaccgagacggggcattaa

SEQ ID NO: 4843 - DNA, 3992 bp, Heterodera glycines
  misc_feature (60)..(60): n is a, c, g, or t
  misc_feature (100)..(100): n is a, c, g, or t
  misc_feature (3875)..(3875): n is a, c, g, or t
aaaacagacagaaaatgtttttaagttaatttaaaattagcgccataaactttaattaanatgaatagcccattgtttgtttttttggctcttccatttntaattttccactttcaatgccttccgtggcaattgtgaagatcattattttcaattttttttttgtatactcgtgggtttcctataaagaaaatatgattcctcatagttttttttaaattgatacatattttatcattttttaaatgaaaatcctaccaattgagcttaataatcgcaaaaaccaaccttttttttgttgaaaatctgttaacaaattgcacccaaatttttaaaatttcccccggcggcgcctatcggcaccgccggacccattctttcccaaaagttttttgaaaaagcgctccgaaaaaagtgatgtgaaaagcaaatctgaatttctattaatattcgatgatttagtccaaaaatgattaattatttgaaataattgaagaaaatttgtttgaaaattttcattaatttaatttattataaaaaaccaaataattttgtattattttcacttgatataaattaaaatttgaatttttttttaaatttttaaaatttcccggttggtcccggttcccggtttttcttgcggtcccggtcccggtcccgaaaaaaaatcgaggtcccggtcccggcttctcaggtcccggcaagtcccggttttggcaaaaattcccggtcccgtggcaccagggctggacgtaactgattttcagttacggccatccgtaatccgtcattacggcgattttttcagttacggccatccgtaatccgtcatgacgggggtcaaaaaaggccgtaatttggcgtaatccgtaatacgtaattttcaacaaaaattttttaatttaaaaaatccaatttaaaaattgttaagattaatttatgatcagaatatctgcttgttttttgaggtgaaaatcccaaaatagtttgtttcgcggtgtgctttttccaaaaaactggggaatgtggggggggggggggtcaggcggcgccgaaaggcgccgccggaaaaattttttaaaaattttatgcaatttgctataagattttgtctaaaaatgactaagattttggagctaatatttaaaaataattaggaatttttggggcgggcagtgccgataagcgccgccgaggaaaatttttttcagaattttaacgaattttgttaaaaaatagcaaatttttagcatttcctcttttcccctttgctagcctcccccccccctttatgtatgttaataatactacaaattaccaagaataagtcagattaaatcgaaatatgggtagccttttaataaaaatagaaaaaaaaaattcattttataaaaaataatcttgcaagaaatccgtaatccgtaactccaaaaaggccgtaatttccgtaatccgtaatacgtaatccgtaattacacgtccagccctgacccggacctacctttaaaaaaaccggtccgggtatcgggtaccaggtcttgaaaaaacagggtatccgggtctggccctaccaaaaaaattttttttttttgtgggtttttatttttgcatacactgtaactcattattaagcaatgaaattatattcagaaattcatcaacgacacatcgccggccaattattttgtcgttatgccaaaggacaaataccgcgcatcggaggatgaaagccttaacagcaacaatggcttttccattgtgaatgagaaaacgcaagaattgctgcaatttggacaattttggtgcaaccgttggatgttaattcggaatcaaattagttgggactgggcgggttttgtcatgaaaatatttaatgatgacgtctcgtcctactacaaagatcgtttcatatttgcactgaatgatgagcagtatgatgatcccgaatgaatcaaaatgacattaattgagcaattttggattattaaacacccttttcaccgtggttttatttgaattgaattttgtctcacattaacttttgctgaccaaaacttccgaattgaatctgattatgagcgtgagaaaaagttttactttctaaacggggtcaattaatataaaaagattattccacaatgtattgtatcaatacggtcacgatatacttaaaaaactgtttgattgagacatgggatggaaaattggagttaattaatggtgaacaaatgaacggacgatgggcgtgttagtttttttaattaaaattgttttttatttttattgttacgctttatcttttgaaagcttttgatagtccattccaaagaataaatacataatgtttttcaaaattttcctcatttcggccacctcaaaattcgtactttactcacatttaactgctttttttcattgttgtttattgtaaatatttctctatttttgtgcataaaacttaactgtaacaaggtaaacaaagaaaaaaaacattgaaattttggagataaggttaagaaacgaacggatgatgggcaagagaacgaaaccaaaaaatgaagccaaaatttgtggaattttggcggacaaaacgccgactgagcgccaaacattgagcaccagaatcatacctcaaccaaatttgcaatttttatgtcaaaaacggttgattcaaagcccttaaaaagctagaaaataattctagtttttgttccaaatttgcaatttgtcccccgcccaaaaaatgatcaatttggaggacttttaggaacataaattgagaaatcgaatgggtttgacggcatttagaagcaatttggcataaatttaaaaaaaaagaagctaaaagtaagttcaaaagcaattaagaggaaaaggaatgaatggatgggatagaaaattggagataattttaagaaacgaacggacgattgacattgaattctttttaattttatttttaatttaaaaatgattaatttaatatttattttatgctttttcttgtgtaagctttcgccattccaatggtagaacaagaaattcttttctgttgtccaattttatgacaataaaattttgcagcgtcaaaactgaacaattaaaatggtcgtcgcttcactgaaattgtgcaaaaaattatttaattgtcattttatttgttaaatttcatttattaccaatttaattatcatttttctttttaaaaaatttaataaaactttcaacacaaaattcattttcaaaaaatttctgattctttgatttctgagacgaaaaattattagtattttttttttgtcttatttttagcgaattttattccgaacgaataattagctgatcaataaagcggaaagctatagtaggcagcaaaaaaacaacaacaaggtaatagccctaatgggaaaaataatgatttgaatttttcgattttttgcatttaattatttatattatatttttcattttttttttttttctaaaattgctcagaaccttaaaaatttttgtaaaaatggttttttattctatgaaatattgtaaaaaataaatatgttaaattgttgtttccatctttttgcctttaaatttttttggaatgcctttgcagcaaaaaaaaatgtcctttaatacacatataaaatttatttccctaataaattttcttatcttttaaattgcaaaaaaaaaaaaaggttatagttctaatgggaaagaagtaataatgttttttggatttttcgattttttgaatgaattatttttccaattatttttcaactaattttatttatttatttatttttctatacccagaatatatataataaattattttcaattttttcaatttaaataattaaatttgnaaatgccttgcagcaaaaaaaaatgtccttaaaaatataaaatttatttccctaataaatttcttatctttaaaattgcaaaaaaaaaaaaaaaaattaaaaatttttttgctgctt

SEQ ID NO: 4844 - DNA, 3302 bp, Heterodera glycines
tgttcatttgtatcgattggattgagggggggggggttaatgggtttaaacgctgtgagaaatgccgagagagggaagggacttccgttgccttatcatttgttggtgcccaaacatttacgaccagtacagttgcatcaatgccaacatgtaatttagcatctatcgattcattagatttcactaaatttgacaccgattaataggcgcgagtgaatgtcagcactcgtatcaaagcgctgattgtgagccgttttgttttatcccttccccattgatcgcttcttttctcctcctccccttaccgtttttgtttccttttcctttgtccatagctttaaacatttgattgatttgctcatttccctcatccagtcaatctctatctctgttttattagcaataccatacaatataataccgtaatagtcaattttacttttatacgttaatattgtaactttaatttgcactgttttgctgttagttgtgtaaattgtgttacgacagatgcctttttggttcgactactttttaattggtacttataaatttttctagtgtatttaaatgctgaaccgaagtccgaattataattgtaaacctttattactttttataataatacaatttatttgtccattaattagttaattagtcacccgccatttcccccctctttcgaggctaattcgtcctctccaccgccgtttcttccaaaatttgtccccctttggtaagcacttgacttccgtcccattctttggcattcccgtccaatggccataatcgtccgaccctttgggacggtcgccccggacgcgcgcgaatgaatgtttcacgggctttccgtttgcgtcgcattccacgaaaatgcgctgtcgcttcgcttttttcagttgaggtactgaattgaaatgaattgaaaggaaaaatattgttggaaagagccgttggagagcgttaaaaaggcacttaaaacggaaatagttgtgtttttcacgcacttttcacaatgacttggcgaactccgatggtttgccccgcgtcactctttgcgatgcattggtaaatgccttcgtcctttttctcgacttcgcgaattgcgagcgatgtgccgagcaattggtactctgaacgaacaaatcacagatggccaccccttcgtttggcaaagttttggcacttcgtccgtcgccggaaatgtccgccgccgctgtgtcgtcggctttctcccacgagaccaacggttcgggaatgcccgtcgcgttgcactgcaaaacgaccatttgtccgctttcgacttcgatttgctcgcgttcaggcaaaatggacggagggacttttccgggagaataatttagcacgaataaatgaaatgtttgcttccaactcacttaacaccaccaaatccactgttttgttggcttttccggcccaattatccgcttcgcacgtgtaaacccccgcgtgttgcggctgcacctccccaaacactgccgtcgatcgccgtgtgtccgccgattggactgagccgccaatgccttcgttagcggtgaaagccgtaggtgcaactgatcaaaacgaaatataggccaaaaatgggagaaaaataacatttggtcagtggctgatcgtctcgaagccaacgatctttggcggtggaattcccaccgcttcgcaccacaattcggctgtcgcgcctttctccacgatgacacgcccgcgggcacgcgcttcgtcctcccttattttcggcgcgactaaattttgcagtgtccgtctgtcccatttccgttcgactttaaatgtggccttttcctccaatttcttggcaacttctcagttggctcttcctttttaatgatggcattttccttttccttccgctgattcggccatttcttacggactttggccacgtgcctttcccttctccgaattgtcccgcctaattccctctcacctccaacatggactatcactgtcgacgaagcatttcccgctttgtttttcattgtgcacgtgtaatttccgccctgagcccgcgtcactttgccaatgcttttcgtcggtccctcccccgccaaagcccgtccgttgtaagtccattggatttgctctccaatttcttttcccgtgccaattacgccgcatggaataagcaaagggccgccctcagtgacatttattgttaaaataccctttgaattagttaattaattgccattttaaaggtccctcgcctcctttctcgaccacctttctcgaaagggtcggcgcccgaataatgccaattccgaattccaattggtcaatgcccgcgttgttaacggcggagcagcggaagaggcgagtgccttcgtgagaaaggccaaaaaggtgcagcgtttgtccgtattcggagagttcgtattgggcatttcttttcaaaaccgtgccaatcggatgaaaatgctttaaattcgcttggattcgcatttgctttttctcctctcaccgatgagtttgtgctctcggcactccaaatgacttgtggtgtcggatagcctcgtgcggtgcaactcaaagtgccatttccgccccggaggacggccatttgtcgtgccgattcgcttgtcagcttgggcggtattaacacttccagggtaaatgcttgttggtcggtgcccgcttcattggtcgcttcacacacgtaaatgccagagtcggagctgcgcgtgtcgatcactttcagacgacttccctccagaacatatcgaacgcccacttcgacaagaacgccgtttcgttgcttgaggcaaacgaatcatttggccaagaaatcaaatcgtttatcagccgttgcttacccaactgatcagtggcgcgggttcgcccgaagcgacacagtccaacacggccactttgccctccaccgcctgctccgtgccccccttggcaatgatcggcgcttggaacacgtccagccgatactccacgctgtcgttgcccacgtgattggtcgcttcgcatcggtaaactccgcgatcagacaaagaaatgttttggatcagcagcgatcggttgccctcgcccagctgaacgttggcatcttccttcaaagatttctcgtcctttgtccaacgaatgttcggcggcggttttcctatgacgtcacagaaaaaggtgagggaacggcccaacggaagtctcggattcaattcggcactttcgcgactgatcgccggaggcactgaaaagagataattaattaagcaaaatgacatcaccaagcaaatgggatgaaaaatttactgaga

SEQ ID NO: 4845 - DNA, 1265 bp, Heterodera glycines
aagtgctttcgttgggcctaacggtagtgtcgctttttgtctgtgcgtgcgcttcagtttcggccctcccaaagtgttgtggcctccattggccccgtcctttccaattccgtcggatctgctgaaatttcgccctgacaacgctcactcgcggcttatgcccgccggtcacaaaagcgggcgcgtaagcgtggacgactttagcgccagccgatgggtgcgcgactgtcgcgcggtccaacgtcagcgagtcgtacagccattgccgttttctgggaaacccgaacctccgaccggaaaaggcggaccctcttcgaactccgtgcagaagtcgtcgcatgctgaaggcgtactccgcgtagatgggcctcgagaaaccttcccgggcgcgggagggaccacgagaatgccgaaactgtttcctgagtttagtaggccgacggaagggctcttcggcccattcctcgtcgtcccttcggctacccctccccagcgaaaatcgctcggcgcgttcccgcgactgttgcgcttttcgtctgagtttgtttttgtgcgagtgctccaaattccgacaaaattcactgtccgaattcgtacaaaaaatgtccacgtcgaatttgtgaaaggaatggccagccctattcgaagcgacgcatttgtattggcccgcgtcggccagcgaagggctgcgcagggcgagcgatctctcgccgcggatctgttggccagggaatgattggtccattttgcgactccacctcaatgtgcgggtccgtctccggctccaacggtcgtccgtcttttgtccatgcgacgcgcaagtcgcccccctcccccggggccccccttttcaatggacagatcaattcgaagggttcgccctctcttcgcgacactctctccgccgtgccattttccatctcaggaggcactgaatgcaaaatcgcaatgttctccactgatcaagcccattcattaccaagcacttccaagtgaaactcctcgcgcactttgcccactttgttggcgacttcacaggaaaatgtgccccgatcagagagagtgactcgccgaatttcgagtgtctgattcccctaaattttgccggtcattcattgctgatcgaccgattgccaatctgatcatctgctggtcgacctgttctagcataattcgctgctgtccttcatccaccaacgtgctttcgcctttcctccaagtgatcgtcggctcgggaatgccaaatgccggacattccatggaaa

SEQ ID NO: 4846 - DNA, 3553 bp, Heterodera glycines
ctccacgaccattgttctgtcattttctgattctttttcccttttcccaattttgtgatctttccttctctttttccatttgttgatcgcttattggcacttttcccaatttcgatcattattgttatttcagcaaattactattttcccctattttccaatcattttgatccctttccattttctgatcacttattgccccctctctccccccccccaatttccgatcctttttaatcccctcctcttctctccgcacctttgggtgacaaaatgacgttgcttttgtccgccaatggtcttcctgccttcaaccatttcactttcggcgttggctttccctccggcaaacattccattctcgctgtgtccccttcgaccactttcacttcgtagttcgatggcaatgggacaattcgcggatgcatttgaaccaaaaagggaagcgggggagtaactaaaaataaaagtggcactttgggcaatacctcgacgaagaaatcggcgttggcactgcccgcttcgtttgtggcgttgcaagtgtatctgatcagtggtcggattggccaaatgatcccaattggagtttgcttctcctcacctccccccgtcggtctctctcaattctctcagtatcattttccctccctccggtggtccctcctccgttgtgtttgtcttttttattcgctcttcttcttttgatcttccttcttcgtccgttttgtgccacgtaatttgtggtgttggcactccattggccgggcattccaacgtcaaattggcaccctcggtcacccgaatgaagcgctctccctcggtaatggtggggggaactgaagcaaaatgggagcaaaggagaagatggaatgggtaatcggaatcattttggacaaggaatgcgattgggttaagtcgtctttcccaaaatgccattatcgtctttcccaaaattcccttctcttcacccccgctttttcctttttcccactgacccatcactgtcagttggatgttctgtcgcacttctccgcctttgttgctcgctttgcatgtgtatcttcctccgtgctcctttctcgtgctgtaaatgtgcaaattgtgcgcgtggggaggtgtaaaagcgaagtgaacgccgcggttggcgagcagttcgcttccgcccttttgccattgcactttcggcgtcggtgtgcccaaaactttgcattccaatcgctgctcactcccctcgatcactttgaattcggtggcaaaatcgacaatttgtggcggttctgaaacggacagaaaaatgaagcagaagggaagcagaattttaaaattcaatgagagagagagataaagagcgatagagaatgggaaagagagagtttacgcaggagagtgagagagaaagaaagtgcaaggaagagtttttcgcctgtcacattatccatcccatacgatcagtttaaaatttcgcaaaattgataaatgtaccgatcacttccacaaaagtgtccatttccgtcctgccgattttgttggtcgcaacacacgaatatcggccagcatcggaactccgctgcactctttcgattcgcagttgtgtcgaattgttcagcaactgaattctccccccttctgatgcatccaccgtttgtccgtcgtgcgtccatttgattctgaaatgccatccctttttggctcctcaaattcggctgtttactcgggcattggaattccgtttggttggcactccaattgcaccgtttggcccgttaacacttccaaagtgccgtaatgatcggcgattgaaggaggcactgaacggtttggcacattttttcacaatataacgaaacgtttggaccaaaccgagcacaatcacagaaaaggtggcattagccacgccagcggcattcaccgcaacacaagtgaaaacaccggcatcggaaggacgaacacgtacaagatgaagtcgttgagcacttggagaaagctgaagtggagaaagtaaaaagtggagaggaaggcaatgaaaagatggcaaaagagtgaaaaggaccaatgcccatttgggcatttttcgctaccattttgggattcgttttgccatccgtccccctccccctcccctttcctccttcaccatcaccacttccacctgaatgtttccgtcgttgtgctgctgttgctccgtgattggcactccgtttttggcccaatggaaaagtgccgtcgcgtcggcgggggcgtcgatggccattcgcaggggacactccaacatttgcgtgtccctctccgccatttccacggtcaattcgctctccgacatttccggcgccccttcgcatgtcaaacgttcaaatttcgaaaatttcctcattcattaactcactgagcagtgacacgacaatgtctttctccgcccgcccctgcaaattttgcgcaacgcacgaaaatcggccgacgaagcgttggtcgacccgttcaatgagcaactgctgactgttggcaattgtttaatttaatgggccacgaaaataaatattaaacacaaaaaggggtggaccaaacaaacgaattaattaattaattaatgaaatgcctacccatcgtctagcaaatgaaagtgccgcccctccaattccaaaggaactccgtcctaaacaatgctttttattttgtctttaaatcttgaaaataattaatttatttattttatttcgcttcctatttttggttttttcactggcgaatggcaattagcaattgttgcaatatttgagtttaaaacacttcggttttagagaaaagccatcccagcgtatcattaattatttcttatttatttaattaattaatttttattttccatcgaaaaaccaattgcccgcccaaccgaccgccaatccaatcgctttttccaaaccgaaaaacgcggggaacggaaagggaaatgaaaggcaaacaaacaaacaaacactggtgcaaacactgcagaaatgagaaaatgcgatgctgaatttaatgataacgcaaaggcatatcataatttgttttgccaaaagtgaaggaatgaaaattctgagaaaatgcaaaaaatgaattaattttggcattttcagtattttatgtttaaatttcagtgttttggtgcgttggattgaattgtttcaaatgtcatttgttagtttgtcttttcgttttggcattactccataatttgtggccaatttgctgaatttaatttgttggcgatcatttgagggtcggccgactcaaacggagctcattaaattaaattaagtgaaattgaattggtcaaattcgaattgcgaattggacagtcatttcgccaattctcacattctaaccaatttaaatttgaattctttcgcttcgcttattttttggcatctttcacttttttcatttatttatcaattcacaaattttaatttcacttttttttaaacttttgacctttttgttcaaaatattttatataattatcattatcattttccggtgaatgaaaagagaagggaaatgggggggggggggg

SEQ ID NO: 4847 - DNA, 2138 bp, Heterodera glycines
cctctccccggcctatcattcactttttctcccactccaattccctcccttctttggctcatccgacttttctttctttctttctccccttcttcagaatggggagaagaagccttaattgggcccatccatcggtgtaataaaatgaaaatggggagggggaggggaggaaaggccattaccaaatacataaggacaaaatgtgttgtgccatcgacggacggtggaaagcaattagcacaattaaaggagaaggcaaaccgagcgaaattcgatggcaacggtggagaagcaaaggaaaagctgacatttgaaaaagtcgaactcattccgaaacgctttatgcaagaaaagtgacaacccaaaacaaatgtacgaatttggcatttgccattcgccgcacctctcaaaaatttgccggaatttttaatattctccgctgctaaacccgtcaggtggcccgccacttcttcctatgtttcccctcattctcctcccgacaacctcctcttctcgctgtcaattgtcttgaatagcaaatgagttgggagaccactgccggagggcagaggccactgcttttcattcgctctcccttctctcctcactctctctctctctcaccccactttctctctcttttctctctcgctttttctcactatttccccaatttccctcactctcctctctttctttcattcctctctatcactttctttgcttctctgttttgactctcttttctctctgccaattttgaaattctcttctccgcccattccctcaaattgccttaggcttttctgctcggatggttgggatgtgcctttgcctccctctgtccctcccccattttccctctcattttttcatttgtccgatcatcgtaaaatggcatttttccaaaactaaaaacatctgctgctgtgtgtttagtttggtccacccttttgcttttcctgctttacttttccttttttgatcagtgtcattccttccgccatttcccttaattttcccgcggctcttccaaatgaaagccggcgccgaatgataaaagccgaagtgtcgctctgttatttgtgctcatcgacaaatgccgccgacttcttggccaaatgcctttgtaagcaccgcaaacgaaagaaatgaacggcgaattgcgccaacccaaagcagcagcaccagcagcagaaacagaggcaggcacagaagggttgcatcgtcaccagcagcaccgatcatttcgtccggcgcttctccatcgtcttcggcccctctctttggccatcgtcgtcctcccccgtcgccttggccatcgtccccatcgtcgtccccccgatttccccccttttctcgggtctctgctcataatcgcctcctccccctcccgcttctccttctgctaattcttccgatggccttctcctcccttctcattcattctgcaaatgccctccaccatcggcacgaacacccgcaaaaatgttcaattgagggcgaaatttgcacaacaattaatgctcatgtgtgccgaaatgggacgtaagtgaaaaatgggggaatttgttggagaaagggacagaggggagagaaatgcgaccccaattaggcgaaatgcaaagacagacagacagaaacaatgattaatgacggatggcagagactggagactcccatgtctttgagaagatttgaaatatgtagggtaggtatttggtttaatccaaccaaaacaaaaccgagagccaaaagcggcctaactgagaattgataaacccaattaaaacccggtcattaactgccctaatttgagactaaaaacacagcatcgattggcttattcattagtcattgtctgcctaacggctggcaaatcaaaaaccgggattagaaaatggacgcctttgtccctacatggattcccagccaaatctcgatttaaccaatttcaacaaaaacttcgttcagctgtgtgtccgcttgcactcttcgcggcatgaaagagtgccattgcgacgtggaggaggacaacttttgctttttgtgctgcggcagtgcgaatgatcgttgtttgccggcacatgagcacgacattctcaggtgagaaattgtaaaatcgaaaaaggaagagg

SEQ ID NO: 4848 - DNA, 1312 bp, Heterodera glycines
taataataaccaagggaatcaaatcttttcttttttaacagagctctctggggaacagtttgtccaacaatgtctgagggttttaaaatgatctccgctttcgtccctcgcttccttcttctccctctgcccttctgtaacgaagaagacgccttgtccagcagcgttttcatgccttctcttccctctgcgagtagcgcttccttcacatcgccgcctctggcagcctcgccaagcactcgtgcgccgcgctcaagcccttctttgccaacttcagctgctatgtttgttgcgtagggcttcgccgcagcgatcatagggcggagatagcgccaaagattacgcagtaccgctcccactcccgctcccttctgtcttgggattccaagaaagtagccatagccacgctggaaggtcggggatccctcaaagtaggaaatgcttccaccctgctgatgattctccaaccgcaagttcgacccgttgaatataactcggaccatcgtatcagaaggttacgacctttttaaactgaagagtcagcacaacttgaccaaattcaaaaggcacttctcttaaaccaaaaaatggaaatattttgaaaatctcaacactaccgtccggtcagcgtacgaatctcaacgtccagcacgtccacctctctagccacaattttgtggaataacggtgactgaaagtccttctctaccacactgcctgacgtgccctcaaccgcaatcacttggaggagattggcgaaggtgttgccaaaaatcatgctttcgatgattccactgtttaggtatatgcacagatgactgacaccaccggccaagtcaacagcgtacttggcttggtcttcgttatgaatttcttgctgctgctcgtagcccaacacgtaggccagctgatccgtcaaagtgatgtgtgatattttgtcgctgaaaatccttagcgtaaagcgtccaagctcgtccgcgaagtagaatcggaatcccttgaccagctctatcagctcgttcttctcctctcttgtcttcagctcataattttcgtcgaacacttcgctctcaaagatttcccggaactctgcaatgttttgctgaatgtttgctgatgggttgaactccggcgagtcccatggcagttccggatgtcggacaatgtacttgtgcactgcattcacaaagtgatagtcatccttttcgtgcagataatgaacgtcgggggtcgggtccttgccatggaccagtcgcatgtagcctccacgccacggcttcagctcttttagcagctccaactctcgctgctt

SEQ ID NO: 4849 - DNA, 984 bp, Heterodera glycines
tctctctctctctctctatgcttttttacgttataaacacattctcaaaaacataatcttatagttattttttcattgctttacactgtatgaatcatctcatcgaatagcagtccaaattcgtttttgtataaatttacgaaaaattgttttgggaaaatgcattttttggggagatgactcatgccaaattgttttgccccaattcctaatttattttttcattttatttttattactctcccattattattgaatacaaacaaaaatttcaaatgaatttattttcgtttttcttggctttctccatctctttactgctgtttttcccggtgtttggctcaggtattttttattttgtgttttttaacttttttatttaatgtttttttaaaacaattaatttcaaagccctccaatgcaaattgggtcgtgccacctatttggaagaagtcacctcccctggaccatgcccaaatgcttccgacgaatattgcattgccgtcacctgtcgcaaaggtcagccagagtccttggcaaaacgtttgaaacacagccaaattaaaaaaaaattgccactaattaattaagaaaacagatttgaattggtactaaattaagtttaagaaattcattttaattgacactaatgaagttgaagaaatatctttattggaactaatgaagttgaagaaaacacattttaattggcacttattaagtttaagaaattcattttaaatggcactattaaattgaaaaaacagatttgaatttacacaaattaattaagaaaaaagaattgaattaacactatattaaaattgaagaaaatacaatattttaacgaattaagtttaagaaaatcgatttgaactggcactaatgatgtttaagagatacgtatgaattgtactaattaattatgttgaagaaacacatttgaactgacactaacaatgaaatacctataaaatcgcacta

SEQ ID NO: 4850 - DNA, 6291 bp, Heterodera glycines
aaaccatttgaactgacactaacaatgaaaatacctataaatcggcactaattaatttttgctgtttctagcggacaaaagtgtcatttacaccctttggggctgtatgcagaacaatgacaaagcatcgtgcgacaatgaagccaaagagatgactgaagggattaccaagaaaacgggcgtttcatgtgattgccaatttggagagaaaggcaaagaaatgggcaatcaacagttcattttgccaccaattgcaccaattgtggaaaacgtgacggacataaacgcgttgaaaaaccgtaagaaatttaggaacgcaaattatagggtgtcgtcatgacaacccgtataaaaggcactcgtacactgttgtacaaaggcaactcgtaccattgcctagcttaggtatagacttccggctctggcctaagctttagactagcctaggcttcttgggtctaggcttaggcttgcttgtctctaggtttaggcttaagcctaggctttgttttgtaaaatatgagttgccttttgtacgagttgccaatgatatagatgtcaacaacattcataagaaaatttccataaaaaatatttaccgaaaaccattttattaagattcgatagtaaataaacattaaaaaaaattaaataagaatttctagttttaaataaaaatgttttttaagattcttgaagaaaaatttattagaatttttttttaattaaccatttctttttttgatggggattatgagacgaatttatgaaactccctagcggaatttacgaatcctcattttgaggcattgatattcactttttacagggcttgaatgcaaaatcggagttttccgtgaaaacggaatcgggcagatccacatcggcttctgtggggcggacgctacgcattgcttcgcggcgagttgtaagatcggtaagggtagcagtcttcaaagaattaagttcagacttgagaattaattatgttttaaaagcaaattcatttttttaaaatgtgatcagtcaattctctgaaaccgaaatttcgaaaaattataattttttggtgaaaaggcagcgtaagaatcgtgatcagtgagtgatctgtgtgattaaagagtctcgaaaagcccatggaaccttttttgacattcttttcaagtcttaaaatatattttgttaaattttttaattctaaatttttcaaattagatataattatttgggtttttaacagattgatgcattgataaaaatttaggaacaattatttgaatgaattttttatctatcctataatttttggtatacaaattgtgccaatttttatagggtttttttggcttttatttattgatgaattctttggtaaaattaaattcattatttaattgctgttcatttaattaatgctgttcattttgttgcagccagtggtgtgatcgacacttggggctgtcagccgtccaatgactattgctcaaaagttggcaaattgtgccatttttgcaaactaggcaaaaaggacgagaaacactcgaatatgaacttcatgattccgacatttttgaaaaaaaatgcaacgcgtgtgaccaaaggcattgtaagctcgacggttttggcaccgctgccggagggcaccaccactacgacgacgacgacgacggtttctacgactactacatccacggcttccaagacgatttcgacgccctctgcgaatttggtgaccgacatttcggatgaaatgtccgaaacaacggttgacggtaaaactgagtcccggccgtttcacccccaaagttttttgttcaattaatcattttattggggcggaggagcaataaaaaagccgagattaaaacgctgaccgaaccgaaatgtccatgccataattagcaaaaattgttcataataattgctcttttaatgttccagaaaacgtttccatttgtgccaacattccgaccgtgtcgattgcatttggtacattatgacaacaatggcacataaaaaatgattatttttgagcaaaaaatagtgcagataggaatcgggggaccgaccaaggataaaaagcgcactttttggggcttaattttaagttgtaaagtctgaatcggtctgaaacactttcgattgaagacatatggtcatcaaaagttccttctttggtaaaaattaggacatcgtcgacataggcaagagaaatgtcctcgagacctgaaattggtaacggatacctgtccggaattgttacttcgttcagtttcctgaagtccaagcacggacgaatgccaccgtctttcttttgaacaatcaccaaaggcgtaacccatggtgtgtcggactcaaccattacgccggatgccaggagttattcaatgtgctttttcagttcttatctgtacctgtacggcactctccggggtggtgaggaaattggctcatctgtcgttgtggtgatgtgatgttctgcttctgaaaacatacccaaatcgtattgactttggctgaaagtgtccgaatattcctcaatcagaagtttcagcctcttaagttcatcatctgtggcaactgtttttgaataactcacaatgaaggatggatcgattttggttttattctgatcatcaagtgcaatgacttgtgtttggttggcctctctaagaagtccggaagagtcgcaaatgacttcattggcatatgccaaatgcattcctttccaaagacgtttggattccattgatggattaattaatgccaactttatctgtattttgcccgcaggcgaaacgctgttcaacactgacatgccctttctgattaggctgttgtcggttctgtcgattaccaatgggtttgatgggctcgaaagtgtctcaattctggcattgatcattatttctgaatccctggggacccaaatattttcatccgcacaaattcggatgtcgttaagcaaaaacgaagattggtggcaaaatttgacttttgaatcccccaccgaaaattcctttttcgaataatcaaaattttgaatttcctccacgtcggtttaggaattgggcttttcttgcattgcaattgttggccaaatgtccgactctattgcagaaatagcaaaccgggttgttagaccaatttctctggctcatgtgctcctgtctccctcttgcccagtcacgtcacgattgctgttgcctcggcctcccctgtagttggcacgttgtcgctgaacatcatcagcagtgaagggcctgaacccccaagtgttattgcgttgctgccttccaaagttgcgatcattttcggcatttggatttgaatttgattgctcattttcggatttgtccttcagcgcattaatcaggtgagagaggcgagtgacatcatctcctttagaggcaagaaatagagcctcaagctcttctgcttgggctttgaccaattccaaattcttggcttgtgtaaggccaacaaggcgaatgagaaagctcatatttggcttgagtctgtccaaaaattcctcacaaactttctctttgcgctgatccccagatagtgatggatttgatgactcaactagcgaagtcatacgccttaaaaattggccaaccgtttcatcctcacgctgtcggcacagtgcaagggttctcttcgccaattcccgtcgttgaggcgaatccaatttggctctcaaggcttccaaggcgctggtgagagtcacgatttggtcagcctcgagctccttgaaaagtgtcctcggcgtgtccttgagtgctaatttgagacgtgtgactttctctccttcagtcagatttttcccggacaccgataagtagtccttgaatcgctcggcccaatcatcgaaggcgtataccgattcttctccgaataactccaaatttgaatttatcgataatgagttgctcaacatgttgatgccaagaaagatcgggttgggccggcaggattgttggaagaggtcccgacgcctttctgtgtttgcgttgccgtaccgccacctgtgcttgaaaagccacggtctgtgcccttgttatccttcaacggcgtttcaaattgtgaggagtcgtcctgctcgcgcaccgtgctgctgcatctgttccatcattcgctcgttcaagctcgtcgattcggtcaaccaacgtttcaatttgggccttgacggtctcaaaattggaattggcatttgagacgacctccgagacccattttgtctttttgtccatacaacggttaagaaccctaatggaacggttcattccgtcttccaatttgaccaattcgttatgggcggcctctaagtcagagaccttcaccgccgtttttcttttcccgaccaaaatttcctattaatgaccgaaattgtcatttcactcacctcctcctcatttctcaactcatatactgtattgtgcccgcaggcagaagtgctgcgacgaacccctttagggttgtcgggaatatccattgctttagtcgtggagagagtaagattaattgcttttgattgcttaacaaaattaaaaatgaaattattttagccaaatatttgagctcaaatatctctcataaaataaatgattgcatgtttgcctattcctttctgactgaaaatgcgatagatcataaatgaatggccaatgaaagcagtaaaagaatttccgcgaatgtcgctctttttgaatgaatgtgtaataaacatcgccaatgttctcacgtaaattatgtgaactgatcgcatctccgctaaatgaagagcgccgccgtggcctccgttcccacggccgagtaattaatggcggataacaagaaaatttttgcaatctttgaactttgaaatggccgaacattggactcatacaaaaaataactcaaaattaattcgaagtcattaatttggccaaaattgtaagtgagtaaatttggcattctcatgattggccagaaactttgaacagtccaataaagaattcacgtgcattaatttgttcggtactctttacacaattttctgaatctctaattatgaatttttttttaactttggcacactgatcataaatcatgtaaattatctctggtgattaactcaaattaaaattctgatcattaacatttttaaagtgcacgtaattaaattttaatctttaactcaaatttaattctgatcagtctcttttaaaagtgatcactaagcgcttgactgtattgtgcccgcaggcgggtacccaaaacattctctcctccggcgccattactttgcccgcaggcactgcagctgctgtcgtcgtcgatcactcctcattgtcgtcgtcgatgaaccgtttgccgaaatggcaaaacaaaccatccggtgctaccagtgagggaggcgcgtgggtcccccagacgactcaccgcttccgaataaatggggaggacgatttgggaggacggatcccgggccctgggatcgatggttaaatcccccaaattgcctcagtgttaaaagactaatttattctccggataaaataggtgatcgaaatattccatggacggacgagatgagaaaagtgaattaatcgatcggtggtaaatccgatgactccgacgactaactgatcgctggggaaaggaaaagtgtgaagagaacggaaaaggggcggggatgaaagagataagaaaagcgatagtggaaagatggaaagtccggctgctgagggaaatgaaattgttttgagggtgggccaatcccttacaagattgacgaatgcgatagaaaaagaagcgaaacaaggagagagagagagaagaaagagagagagagagtaagacattgagacagagataaatggagagagaaaaaagagaaagagagggagagagaaagaaaaaaatatagagagagaaaagaaagaaagagagagagagagagagaagagagggaaagaggagagatacaaagagataaaagagagaaagaaaagaaaaaagagaggtgaaagagattgagtaaggagggtgggcagacagaaagacagaaagaaagagatagagacatagataaaaagaaatatattggacaaagaaaattttatttattaaaattgaatatttcaacgacttacgtgtcctcaaaaacttttattttggcgcctctgcaattgaattgattatccgtttctaagtaatgaattttcacttttgccgtacaatttttgcttgccccggtgatgcatccgtcaataagggcgagaatgccgaaaatggaaaaaaaat

SEQ ID NO: 4851 - DNA, 1229 bp, Heterodera glycines
attaaataaagaaccgaacgaaaaacaactttttttagcatttgctctccattcttcgtcaagccgtttcagaagcttttcccgatgcgattgctcagggctcttcccaagtgatcggtaaatgtgaaataaccctctatttgatggatttccccaaacttttcaggaatggtcggatacccaaatgtgggcaaaagtatgacaatcaatcgactgctcggcaccaaaaaaacggcggtgtcctcgacgccgggcaaaacgaaacatttccaaacactgatcattgacgagggggtaaataaatatgaacatttatactttggtcatcatttttacaaaagttttgccgagaattaataactattttttccttttcagttggttttatgtgactgtcctggccttgtgatgccgcagtttggcattagcgatgccgacatgattttgaatggtacaatttttgttttgttttttcggacaacaattccgttttaaattcccactttttcaggcattttgccaattgcccacatgcgcgactatttcggacccatccaattgctgtgcgaacgcgtgccccgccaatacttccaacaacgctactccgtcctgttgcccaagagcattgggtctttgaacgggcacgacctgttgaccgcagtggcattcctcaagggcttcatgaatgcctctggcattcccgtacgtcatgcctttggcacttcaaatgcatttctttttcccctcaaggattgttcgcgtgccgctcgtctgatcctcgccgatgtcatcgatggttcactgaaatgggtcgccgcgccttcgaatgtttcacagcgacaatttgatcaatggacttttaagactattgagctttcaaaggcacatcaacaagagcaacaacggcagcaggtggttgggttggagcatgggaggccaaaccagataaaattgcggatttattgcaaggacgacggtcccgggggggcgggtgaggggaagtgggtttcgcatggttggggcattggggataaacaaaagaaaactaactgaaaaacataagcaagtaaaagcaagtacctcccccttgggtcccggaaaatgagtcagtgaaaattttcatgtcataataacaagttccttgggttttcgaggtctaggacccggtatccatttcggccaattaaaacgaaagtccaattttcgaatttatttgatagcatttttgg

SEQ ID NO: 4852 - DNA, 1609 bp, Heterodera glycines
  misc_feature (23)..(23): n is a, c, g, or t
  misc_feature (1592)..(1593): n is a, c, g, or t
cattttgccacttaaacacaccngagtcaaaaaacgacatttgtgtcaatagagagagatcaattccatttgaattgaattgtaaataaacttcactggttgcgatttctcacaaaagaattttcttttggcagttttttgtccaaataatcgcccacttcaaaaatatttaaatatatattaaaattaatttgaattcacacaaaaataaatatttaaaattggacaaaatgaaattagagtcaattaagcaaaacaaaaaacatttgccacctcatttagcaaattatgtgctcaatcattgatgagtcacccgtcgcaattggcaatggcggcacagaaacacagctggtcagtgagtatggtggttcaacagaagaggcaatcaaaagcataagcacattcaatatacaaatacagcaaaagtgccaaataaataattaaattacccataattaaattaccgtatttttctaattatccctccggggggattattaagcaaattcagctgaatacctggcaacattttatttgacaatggtcttttaagttagctctagaggtttaaaaagaatttttttcgaaaaattaaaaattccatttatcccccagggaggataaatggagacagtgcataattagagtaaatacggtacccaaaattaaattcattttaaaatgcctgccaattacagtggaataatgatttttttaaaatataattaattcaaataaaatttattttctattttctccatcacttttacctctgacagaattattgtgcatttttaattttcaattttattcactataaaatgctaattttaataatttccccattagtcaactccattccgtggcgttttggacgtgcgctttgagcccggccaaactttgacagtgaagggaatcgtcggggagaaggcgcgccaattcagcgtcaatttgcacagtcggacggccgacttcagcggcagcgacgtgccgttgcgcgtcgcggcacgcgtcgaccgggcaaaggtcgcgccgttgggagcacccgccaaaacagaaaccaaataccgtatttcagtttttaaaccccctgaaaaggggggggggctctattttaggggtgggggtgtattgtatgtaacacgataatattcagaatatttttctcaaattttcaattatgttagctctaggaaatcgagactatggcataatttctaaaattggtgctaatttcacacactgaagagggagagagtacgctgagactgatcaatgagattggcccggttgatcgataagacagaaacaaacggacgataatcgagcggaatccgtcgagaataattattaattgtctccattttcatccgtcctctcagattggcctcaattcgatggtgaacaaaatgtgggggaaggaacagcggaaggggcactcgttgaagcccggcaagcccatcgacttgcgaatccgggcgcatgacaaggaatttcaggcgggtggcccatcggagggggggggggggtaaaaatataaaaataaaacataaaaattaaacaaatttaaatatttatttaaaaaatgaccnntgcaggcccatgcaag

SEQ ID NO: 4853 - DNA, 5094 bp, Heterodera glycines
  misc_feature (68)..(68): n is a, c, g, or t
ggggggggggggggtaaaaaaaaaaaaaaaaaaaaaaactacataatattaacaattaaatattattntaaaaaattagggatagcattgtaaatggtgtcccacgcttacaagaaagaaaaagcctcttgcagatcataatcgacggcaaagcgttcaaacggtacgcctaccaatcgccgcttcagtccatcacccatttgtccattgacggcgacttggccatacagcatattgtgccgactttttttgaatttaattacgttttgccactttagcattggggcgggaaagtttacgtgagttataatattggattggattatgcttaattgattaatgtaacctgaatttgtccattttaattctgattttaaattgctttgagcctgtcccctatgaaacgggccttccccacggcttcccaattggcaaatgcctgaaaatgtccggcactccgtcgctgagaaagggcgggcgctttgaagtcaatttgttgcgcaaaaatggtcacattgcgttgcatttaaacgcgcgttttgacgaaaaagtctatcgaaaatgtttttttttgtgccaaaatttgaatttttgccccaggcggtggtgcgcaattcgctcgaggcaaatgaatggggaaatgaggaaagggagggcaaaatgccattcgaaaggggccattgcttcgatttggccatcacaaatgaagccaatcattttggggtacgtcgggattataatttaactttttattgtctaattaagatgattaatttaatctctttttcagattttcgtcaatgggcaacattttgccaattttgtgcatcggtcaaagcccgaagacatttttggcctgctaattcagggagacatcgaagtttgtcaagcaaaagcaatttactaatttgtaattattcatataattaatttagctgaccggactggaaatggaatgactgacctaattaccgtcattatgaaaaaaacttttggccaatctcaaccaaaataaattgggaaatatattcataaattaatgaccacaatttgttgacatatcttttaatcattaattaattggcaaaatactgactaattttcacacactttgtaactatttaatttttcttttgaattaattcgggctgggatttcccaactttggaataatttattcaaatttttaattacacagtaaaaattaatgggtgaacaaatggaatgaaagtgcactttaaaattcagaaattatgcaaaatattatcgcaagtggaaattgggcaacttctgaacaaattggcaaagtgtcaatgggcacggcaagaacaaaaagaaaataataatccgcttttaaatgaattaagaaaagtgttacatataaaatgtcagagatttggcttgggaaaaatgaatgttttcagcagagttcgaaccactcaaaaagataaagtaaaaaatgaatttgaattgacaaaaattgtaattttttaggatttgaactctgacaaaatatttaaaaaagtaatggcaaataaaaatgagcaataatggccaaatgaacaaaacaaaaaagacaatggcatcgttttgctgaatgagtcagtgacaaatgttttggcttggtttgtttatttttgtgactttttcttggcacggtcatttttgttttcattgaattaggcactttttgttgctgccggcgctgctccgacgctttgcttttgacgccattcgattgggcccatttttcttggcctaaattttcaatttaggcacaaagtcggaaggagctaaaatatgcaaaattgaatggttggcccgatttggacgcataaaatgccattggacatataaagtgcaattgaaccaagaactcttttgtaaatgcaataaacaaaacattccgaccccaaaacttcaccaaaatccccaaccaaattctcaaaatccccaaatctccgccgtccgtcccccccccccttcggtttgcctcggaagttgcgctgtcctcgctcggaaaagtgttcacaatgcgcacaagttcgtggaacgcggcgtccacattcaccggcggatctttcgccgacgtttcgatgtacggcacgcccaactcggcagccaattgccggccctgctgttcactgactgaaaatttgggggaaatgccaaaacaaaattaggcatttggaaaaagcaaatcaaaaagcggcaaatgcaaaatttggttacctttcctctggttgatcaggtcaacctaaagaaacaaaaggcatttggttttagtctattagctttgttttttgtactaattacgactaattagtccctctccctttttaattaccctttccctctgtcattttctctttttaattcccttctctgctcactttgttgcccaccaacagcaccggatattcgctggtgtccttcacccgcaacacttgctggtacaatttgcgcgcctcctgaaaaaacggaaaatttagcaaaaaattaaatttaaattaaaaaaagaaaaagagaatgcctgaaaactttgctcgtccgtcaccgaatacaccaacaaaaagccgcgcccattgcgcatatatctgaaaatatttaaaatttatgaaaaaattgtatttaaaattcagaaaacgcaaaaacgcactgttctcgcattgcggaaaactcctcctgtccagcagtgtcaagcacttcaattaaattaaattcgaatgaataaagcaattaaattgaaatggctttgcaactgaccgtcgagaatgacccattggccatcaatttcgcaatgttgaatgtactgatcctcaatggtcgggtcgtaataatccacaaattgcttctgaaatggagaaacgaattgaaagattttgcgagggatttttacaatttttaatgaaaattttacggaaaaaagtgaaaaaaggacgaaaacttggtattattaggccaaaaaaggtgacaaaaaggacgaaaaatggtgtaaaatcggcctgacaatggccaatttgtctctccgtccgtttgtccgtcctatgcccccacctgcctggaagaattgaatggtcagcgacgatttgccaacaccgccctcgccaatcacaacaagcctaaaggagagagagggtgggacggcaattggcttggtgccattggattggttcgtttgtttattacttgtaagtgggaagttgctggtcttggtcagtgccgggcggacgcttcgcgccactggccattttttgtcaagaacaaagttatgataagttgaatataagtatttaaaaaggccttaaattcgaaaagaatgcccattaagattaattatttaattaaacaaatattcggcattagctagcaattagctaagtgccggctgctgttggcaatatgtttttttaatatttaaatgaaaattcgaataattaatttattttgatttaattaattctaaaaatgatctgtcagttcccattaagattcaccgcagacaaaaagttattaaacgaatttagctaaataaagtcataaaaatagaatcttttgcctttttggtcatttttttcatttttgaaactttttaatccaaaataatccaattaaattatccaaataaattttaaatttggtcagtaatatcccaccaaatcttgaaattttctgttttcattttatggacatttgaatcacattaaaataaataaataatcccttaaaaatactgtaaattcaaaattggctctcgatcaagttaataatgtgtatggggagggggtgagcatttgtttgctgctgacattgatccgtcgcctctgatcaccgtcgtccgcaatgcctttcccgctccccattttccgcctccgttcaccgccaaccaaaataatcgccgctttcgcttcactgactcacccattgctcctctgttggtggtcagcagtcagcgaatgttctgtggcggtgattaactgatcagagccgaatgaatgagtcattattctcccataaatcgggggagagaattctctgataaatgagagagagagagagagatagagagatagagcatgttaaaagctttcgaatgataaaagctatagtggaaaaacgagctggcgtcgaaacgagcgcgccgaaacgcgtgggtcccaataaatcttaggaaaaacgctaaaataattgaaaatagttttttcaatttttttagattttaggtgcttcaggaaaaaaataggtaaaaacctaaaaaaccgtatccctaattccgatataatttgattttcgacaaaaatacagaactctcggcacactttagattttgattaaatctctttagatcgtgttgaatttatcatttttggtttattcggtttctcaaaagcttttctatttaaaaagaaaaattattttaaattttatttgaaaatgatggaatgtcccgatgacttttgagctttctgcgtcacatgccaacccttttaatattaaaatacaatgagagagacgcggcaaaatgagcgaagtttccccacccaaattccttgttcaaatctttagtctttcaaaagtattcattcgaccttcatcagtgaatgggaagaatttttccgaaaaaccgtcgtttttaacacaattttgaaatgggacaaatgaaatgattgatgataaatgcatcttttaaattaattactctcatcaatcacagcaattaattaccacgagtaagaatctgcaaaaaggtcgcggttgattagcgctataaaatttgaatttttaattggccattttagccgtagatttcatctgccattacattttcatttttttctctcctaatcgggtgcgccaaaactagtcatcccaacacaacacacaaacctttgagttgtgccgaaaaaaaaacggactgatcgcaacaatttgggagggaaatcggcgacagggaaatgtaatcaaaagaatgacgttttgattagtaaataatgatcaatgatggtgattatgatgatggagcgtaattacatatgctcaacaaataaaaattaaaaaggataataatatttattcctttatcccccccccccc

SEQ ID NO: 4854 - DNA, 1744 bp, Heterodera glycines
cggggcacaaaacgtacactcactcaatacacaatacacacaatttgatcactcactgatccaacaacgattctctcctttctgtgtgatcagaagaaaaaaagcattttaatcattttgagaaaactgatgcaatccttaactttttgctctgcctaaaaactttttgcgaaagcatttgaacaccgcttaagctattatagcttttcattcagtcaattatcagtcacattttaataaattcactttgatcattttggtcaaatactcgatcacttgatctgttatgcctttcatgattgcttcttcatgctcattttgattcattgctttttcagagaatgtccgttaacaaagcaacggtcggtgccattgctctgtccggctccaccctgttggtgtgcctgtttggcattgcgtccatttacagtgacattcaagccatttggaacgagttggacatggaggttggtccgcagcaacagatgatcaagccacctttaaaatgaccatcattaagatggaccagtttaaaatgcaagcggacgacctgtggaaggacatgctgaagatgggtgccgggacggccgcgaatcgggcacgtcgcgaggcgtatgggggctatcaggtgagatacccaaaaaaactgaactttaccgttctggagactcgagaaagggtcaacaaaaaataaataaaatgaatcagacacactttgaaatgaacatttggcatttttaggcttccggcagccaaccacaaccatcccccggcgccttgtcttcaccgcaaggagtcgaagtgccgcccgccgttatgccgggattcgccccgggcgtatcgccttcggtcaacagtgtgttctcgcccactgctggcagcaacaatgtattctccccgttcgccccgactggcagcaacagcatcaacaacgggctgccaatgccttttggccagtcaccggacggacccaacggcggtggcactttccctggcggcttcatcaccccggccggctcgggcccaggatgcagtaggattttggatttttgaatacaaattgggataccggtatagtgggaaaaggaaaggaaaagccgagaaaagtcatgggaaccgccatccaatgcttttcttaaaatggttcgggtgtgcttcgatccctcactctttcgtcgcccttcccacactttttcttggccacgaaatgcccccctttggccattgtttttgcctaacttcgaatcaccaattgatattttgttggcactttcttgacttgtttttctcagagtgcaagtcgcgaaacacgtgccctgcgggccccgctggtccgccgggcgacattggaccctcgggcgtgcccggcatcccgggaaaagacggcattcccggacaggcggccgaagactcgcaaaacgcaccgctcaaaggctgcttcgtaagtgccaacacgggagggaaaatatcatgtgtacaaatgttaatttttacgcatggttcagaattgtcccgccgggcccaccggaacgccaggcaccgccggaaggcccggcattcgcggaatgtgagcaatacaaattcataaaaagggcataattacacagtgtgtcaacaaaatgcggagcaaaatctgagcgacataagttaaacaaattgttaactaagaatgccaaatttcggcaaaaaaaaactaaatcatattttgtctataaatattttaaaatattttatttattaatgt

SEQ ID NO: 4855 - DNA, 4134 bp, Heterodera glycines
  misc_feature (27)..(27): n is a, c, g, or t
  misc_feature (50)..(50): n is a, c, g, or t
  misc_feature (62)..(62): n is a, c, g, or t
  misc_feature (112)..(112): n is a, c, g, or t
  misc_feature (4083)..(4083): n is a, c, g, or t
catggacaatcagaaatataacatttnaaggtttgaataaatttgtaaanaatgaggctttntgatccaaaatgaggcttttttgcatgcgaaatgaggcttctgaaatttntaatctgggagccctggaattacctaatgtaatttgtcggtggtgggcggagcgtttgattgtcgacttactggctatcaaagatacctaccaaggattagggtacttatatggttcgtacgccacaaatttaaaatttttaatcatcttacctatgttgcttagaaagacacttatatggttttcaaggacgcggaacacgattatggcatctatttagaccaatttcgaaccccgaaattattgaaaaaatttgaattttcgactttggggattttgactgtaggtcgaatccgtctcaggagttcgaaattagtctaaatagatgtcataattagagaccggattttgaggcatatgcctttttttgctaacttgctacggcctaatatgcacgaaaaacgagtttttaacttggtttgaagcttctagcttgaactttggtgcctttttttgccttttttgcgattttgtgccttatgccgggcacgaaattttggtgccttttttgccttttggtgccttttttcatgcctttctcaggatttttgggaaaaaaatggaaaattttttaattttttgcaatttttaagtaaagctatcattaaccagcttgtagtgaactagcgctgcaaaacgagcgatgtcgccgttgttttcattgctgtttgcccagtgcacgaattccttcatttgtgccgggacttccttcgctgcagtcggtttcttctcaagcactagaagatcattcgacctatacactcctgctgcgtggggctccctactgcccaagatatgcttgtgaagaagatggattgcctcaaaaatggggataaacggcggagaaaagctcctggcattatatgacggaaaatttcttcgaccaagatgtatcaagaaaataaggatccggaaaaaacctaagtattagagcagattcaccttttcgcttatctcctttttttgcatttcatagtccgtcaaaatcccaaaaaagtgctcgtcatctttgaataggcttctttccgatggtctcggatgcattaatctgcttccagcctcacgatcagttaaattccccatatgtgcgctgatttcttcgtcattccaatttgggtcaaattcattggccatttaaattctaaaaaactatttaccttacttagttaagttattaatttttgtcagatccattttcactcatttctctatcaactttactccaactgcattggtattttaatgtaattgaaatttaaaaagattttattcgaaattaatggccaaaatttgtaatctctaacattaaaataagcaatttaaatttcttcatgaactgctcgcttcagctgatgcgccccgttctactccccattttcagtacacatcggcagtctgaaaaattgaattttatccacataactattttatttttatttcatttttgtcacttaattatgtcatttaagaaatttttatttttgcagtgccattaattgggactttataacaaacattccaagcaacaaaagcaaagggcgttatttttattcaataattaatttcgtttttgaaaaaaaaatgtttgtctaactttttatttatgtattttctctttcagcatggaaaattcgctgagaactgatgtgctgctacctcatcacccaatttgcagttttggcccttgcccacttgcaacattcctcggtaaaagccggatgtggggtggactccatttttttgcgaaaaaaccaaaaaaatttacataaaatcttcaggcaaagaaaagacaaaaattggtatcgaaaagtttgtttattttctgtttcacactgctgctctgcatttcacttctcacaaaaacattatcatttttcatgctgtgatttcatacccattttttatgctcgaaattccgacaaatttgatttttttttttaacttacatatttaagtaaattttcgtatgttttcatttttccaaaatgtagataaagaaaattcggccctactgtcgaaatagttggaacgtcataactttttttcttcgttcatcacttttaaattggtatcatttgaaagctcttcataatctgtacaaaaaatcaaaaataagcaaaaatacattaaaaatctgaaagaaaaacgtatgtatgacgttccaaatttactgggacagagtgggcgggaaagagttggtcggatttgtagggcaactgaaacattttttattgttatttacgctcaaacctaaaaattcaaatttaacaattatatcggaattccgagcgtaatcaagcattataattacaacagaaaacagctagttttttcaagggatttttcttaaatcgagattaacttttttttcgtgtatcatcgtcaaattttattttttggcatttttaagccattttgaaactgtaatgtctgttggcataatgtccacttctgttaaagtccatttaatccagtcgcaatttgccgggattctgacaactaaacgaaatggactattttaactgaaaaaaatgaaaatttgaattttggatgaaaatttttccatctattttccgatcaatcgaaatggtttaccaaattttgctgctgctttccgggttccatccaagccgagtccaattttcttcgtccaaaattgcttttccaaaaattcggggcaccgagcgcaacatctggagcctacaaacagttcacgaaattttgttcaaaataaatttggcatttactattttttttaataaatttcattatcaaatttttaaatggatctgacaaaaaatgaaaataaaaatttaaaaaatgggcttggcgggggagaacaaggtatggacgacgtcagacatctgttgtcagaaaactaatttttttgctgtgacattcatacttatatacaggttttgagatgaaattcgaataaaattcaaatgttgaactgcaataaccaaaggaaaattaatccgatctttttttgaagtgtaaaagcagaattgaaccaaacattctgaaaaaaatcaaaacccgcaatgttctgaaatgaacaatagaaaatcaaaatgttccggattaaaaacattatggaaacaacaaccagaaaacaaaaccattctgaaatgaacccaaccatctaaaaatctagaacacatcaaataagcattctgaaattatgtaacgaacaatcaaaaacccgaaacaattctgaaacgaaaaatcggaaacattttaaaacgaaaaatcgaaaccattctggaagaaaaacccgaaacaattctgaaaagaaaaaacaaaaccattttgaaacgaaaaatcgaaaccattctggaagaaaaacccgaaacaattctgaaaagaaaaaacgaaacctttctgaaaaagaaaaatcaaaaccattctggaagaaaaacccgaaacaattctgaaaagaaaaaacgaaacctttctgaaaaagaaaaatcaaaaccattctgaaacgaaaaacccaaaacaattctgaaaataaaatcaaaaccattctgaaaaagaaaaatcaaaaccataattgaaaagaaaatcaaaaccattctgaaaaggaaaatcaaacaattctgaaaagaaaaaacaaaaccactctgaaaatgaaaaatcaaaaccattctgaaaaggaaaatcaaacaattctgaaaagaaaaaacaaaaccactctgaaaatgaaaaatcaaaaccattctgaaacgaaaaacccaaaacaattctgaaaataaaatcaaaaccattctgaaaaagaaaaatcaaaaccattctgaaacgaaaaacaaaaccattctgaaacgaaaaatcaaaacaattctgaaacaaaaaatcaaaaccattctgaaaagaaaatcaaaaccattctgaaaaggaaaatcaaaccattctgaaaataaaatcaaaaccattctgaaaaagaaagctcctccttagtgcttcagtgngaggtccctataagagaattagactaaaaatggaaaaatttgaacttttga

SEQ ID NO: 4856 - DNA, 5803 bp, Heterodera glycines
  misc_feature (5478)..(5478): n is a, c, g, or t
ttgtctcaacttgccaaaaattcatttccacataattagacgcccttttcgctgctttgactcgcttctttttctgctgctgctgcaggtggagacaaaggcctgaaaattcaatgaaatttgaatattattttcaaaacaaaaggaaaagctgtcaccctaaatggacaagaggaggagggttagaaaaaaatttacaaaattgaaaaaaaaaatgatttgatgataccaaaataaaaaatcccattgtttaaaaattttaatttcggaaatcttcttaattgacgaatctactgataaattttgttttgttttcttcaacttaataaaaaaaacttcacatcttgatcagtgcgcttttttggttttcgccaaaaatttaacctctcccccagtcaggtccattttcttgccttttttttgctcacccaaggcaatttttgcaggcactaaaattgaaatagacattgatcaatctgttcgcaaaatttccatcttttttcttctgctgctgctgttgtttctgaaccgcctccgccctctcctccccaacaatagtaattggacatcacttcaacagccaagaatgagaagagccaatatccgattctttcttcaatgtcagcttttctttagtctgttcattcaccaattcaaatggctcaattggcgcagagacgaaaaaagtaaagtagacagtgtaactgacagaagtgcgggcacggacaaaaacctaaacaaaaaaccaaaattcgtacattgtcaaatatgaaattgtaacgacaaactgacctccttgaaactgttgagccattcaaagtttgtggatgccatcatttcccagcaatgcaatgactttggttggccatcttttctcggattgtgcaaccatttggccaacgcttggccggcagaagtcgcatttggcccatcaaaatcatcatcagcaagcacatcgggaaacagatcaccaggtaggattgaattcaactgatcaagatcggatagaattgttggcgaaatgagtcgacgcaaattgtccaaaaattcggcaccgtcaaaaccaaattggcgaatgtttgtcgcaaaaaatggccatatttcacggacaacatcatccaaaattggcttgttatcttcgtttttttcccaaacaatgattttcaatttggtgcctttgtcccaaatctgctgattggaacggagaaattcgatgacgaagtgatcaatgtacctgaaaaggggaaactgttgaaggaatacgaaaaaaataacacaatcagtttgaatttactgaatctgaagttgcttatagctggaaaagatgattttgttgggcagcggacggtccggcaatggaaatccctccgatttgccttcaacaaaaagttttggcatttcatcagtgtccttgcgaatttcaattgctttccaaatcgtaaattgcgttttgccgtcaaaatgtttgtccaccagcgcatcaaaacgtggcgaaagcaatgccattttgaggccaagttgagcacggtcaaacgatgggaaaatgtccatccacacgtcgttgcacacccaactgaaacatgaaaaaatagtgaaatgaaaatttgcgacatttttttaatgattgcttaccgtcgattcattttttgctgcaattagcaaactttgctctttatccaattgatttgtgtgtcacaaaggacaaattgctgaaatatggagacaattaagaaaaatgagagaacgattaatagcacacaaaaataataaacgatgaaaaaatgaaagaacaaagaataaatttgacaaatctccgtctgtttttttgcacaaaaatctgtcttttattaggaaacttactggctcggcagcttcgcggcctcgccccttctcttgacattttcttatggcacaacatatagcattttcctcgtcatgtcttagcgttttccttgtcatatttcttagcatttcctcatcttttcttggcattttcttatggttagaaggtacgggctcggccgcttcgcggcctcggaccattcacttggcattttcttatggcacaacatttagccttctccttttttcttgtttattggcactttcatatggtacaacattcatagcatttcttaggtcagtggtctctaaaacattagagacacactaatgggcatctcaaaacaatacaacaacagagaattctttttgacaaaatttaacacttgtgtggtctctaaaacattagagacacagtaatgggcatctcaagacaatacaacaacggagaattctttttgacaaaatttaacacttgtgtgggtttctaaaacattagagacacactaatgtgcatctcaaaacaatacaacaacagagaattctttttgacaaaattcaacacttgtgtgggtttctaaaacattagagacacagtaatgtgcatctcaaaacaatacaacaacagagaattctttttgacaaaattcaacacttgtgtgggtttctaaaacttgagaggcacatcactgtgtatctcaaagcaatacaataaaaatgaattttttaacaaatttcacacttgtttaggtttctaataacatagaagcacattattgtgatcccaaaacaatcatttatcaaattttaacaattttctaacaaattacaatttcaatgtatgtttaaatatgattataaaaaagaaaataatatccgtatttgataatatgtgaagatcaaaaatataattaaataaccaagcatcacaaaaaatcaacataataaccgtaactgaaaaggtctgagtcgcaaatcaaatcaaaacaacgaacaacaaacgaaagactacccatttttttgcgacttcttaatttggtcaaaagtttctgaactacgacgtttaactggagtcgtcaagatttcctcaaaattaacgcgaccaactccaattttaatagatgcaacttcgcagtgaatttgaagacattcatctataaaaagactaaattcaaacctcatttaaatctttagacaaaaaagtctttaccttgcactttaacaaaaaaaattggcgaggtttatctgcatgtttttgctgaaagaaccaaggtgctccaccaatttttctccactaacatataagtcagccctttttcctttcgtgtcagcaaccactgcagcaagttgttttccgattggtgcaaacgacgaagccagagcacaattcattgcttaataaaaatgcaatttcaaaaaccttaacgacacataatgtgcatctcataaaaataaactaacaatgaaatacactaaaaaaattcttgtttacaaaatcccacacagatgtgatcaacaaaacatgatagcacaataatgtgcaaaatttttttgacagcttttctcgtgctaactatgtcataaaacatctttaaaacatgttttgaatttttcaattaaaattaattaaatcattaaacttactataaagacaacccggtatcaatttctcaaaagattccacaagctttggagcaaactgaacaacttcaatttttgtgaagttcgtaaccacaaattcatatggcaaaggagtgtggtaaaccgaacagccatcaaagcgctcaacaacaaatcgctgagctctcaacaaagacattttgacaacctaaatgtttccaatttttgcgtccataacaaaacctttatttacaattccaagcgaacaaatccttgaaaaatttaacgaaacgtttttgaattcagtgacagcaacattttcgccagaggaacacgtcaacaatgcagtcattttcttctcggaaggcataatgctcacaatctgcccacaaaagcttctaaaaaatttcattttaataaaactcatttaatcataacttacgcaagctgagttccgcatggaattgccctgagtttttccaatgtgctaagcattagaaagtggccgaccggcagtgcagcaatggaaatgtgcaacgaatagaagaccgaccggcagggagttttggcaatgaaaaagtgcaaaaaaaaaagccgaccggcaggcagttgtaacaacaaaattatttttaaaaatagacaatttctggcttaaatgcaaattaagaaatttttataaatgacaacattttgacataaacatctctcatgcaaaaagaacaaatgatttggtggaaaaaatcattttacttattattttagaaacaaaaacaaataaacaaacaaaaaagctaaatacaaaatcaaaaaacacaataatgtggttgactgacataaaccgcacaccacactattgtctaacaaaaaccactcaccacactaatgtggttgactgacaaaaacacacactattgtctaacaaagacaacacaccacattaatctgattgactgacataaaccgcacaccacactaatgtctgacataaaccacacatcacactaatgtgattttctaacttgaaccacaattcttctcaaagcaattcaaaatattgcaaccaatagtcaaattaaaacattcaaattagtttagaatgaacaacttacacgtttcccataagtcatgagtcaatctttcacgctaaactgtataacatcagcatttgagaaccataaccaaatttcaattcaacagcatgtgtaaaggcagtccaacaaaacaatttgccttcttcattcggaattttactttctaaagttttgcatattaattaggcttgacatagcaaaattccaatcccaaacaaactcccggcaacctgacatacacaaactcagtcagagcaattttgatgaccgacagttgcccgaccggtagatttagttgcagaacagcttcaaaaacaaaaataaaacgctgaatggccgaccggcagagtgccgggttttaaaaaatattgccgaaccggcagaacattaaacctgcagaaaattaattttaaaatcaaaacaatttggcaaaataacaaataaacaaaaaggaaagcataattataaagtaaacattaagcacaaataaaagcataatacttggttcatgaaaagaacacaaaatcaaaacaacaaacaaattttgagaaataagaatcatgaaaactaaattctaaaattagacagagacaaaaataaaaaatgcttttttcttacataatcatttacacaaacgataaagaaactttttcttatacaaataacagaataaaacaaaaacacaaatgaaaagcaaaaaaaaaacctttttgagttcttttttataaaagcataaacaaaatccaaaatgaaaaaaaacaaaaccaaacatttccatttttcaaatgcttttttaacgcaaaacataacaaaacgccaaacacaacattcaaacccagccacagacatacactcatctttattatataggattagtcgcgtttttaaattactttcttcgaagaatgtttaaaaacggattttngggtaatagttcaaatccatcaatttcgtttagtcaaaggaaacggagagcgtggacacatacagattgactatcagctcacaatgtccagccgggcaacaacatcatccgctttggaagtgacgcctatgtccgtgtcgaaacatgtcactgaacaaaattgagaaaggtctttttatttgggctcgttaattccatgaactttcgcttttttaataatcctattttgcaaattttattctggagtatttttgtacaatttaatattttccttttccggctttcattcagccaacatttccactttctatcttataacaatccc

SEQ ID NO: 4857 - DNA, 1585 bp, Heterodera glycines
taattacatttggctaatttttcaggactttttttgatttatttagtgcttttttggtatttttataagactttttggttattttttcataacttttttgcattttttgtgactttttggcgttttttatgactttttcgtgactttttggcgatttttcttgactttttaagtcgacttttttgagatttttcgtgacttaaattcccatccctagtgatcagcgaccctcaaatccccataaaatgtgttttcacgactttttagaagaaaaaattttttattccaaaaaggggggggcaccagcttcactattaccaaaaatcctagtcatactagtccaattattataaagaaaatgagtggaggttcgagtgtgctttacaacactaatattttgttttttcgtctgtttcatattacattatttcccatgatttttttgtttttgtttccagattaaaacatattttaaatttttgtcgttcaataatgcataaggggtgcagcaaagttccatccacctccgatgttcggtcaccatctgtgaaacggaagcgtatgatcagcaatttggagattgaagaggatgaggagattaccacctctgatgaggagcgcgaggcgactgccaatgctaacaaagagccaggttcatatttgtttagccaaaaacataaaaaattacggcacttttggtgtcggggcacccctgaaaaatgccaaaacgtgaaacccttttcattttttttaataataattcgtaaaaactttttctcttatccccgaactcataaaattcaatttttttttaaaggttcaaagtagagttgatcgggactgggaccaaaacacggacaaatgagtaccaaggtcccggttttgaccgggaccgggaaattcccggttttcccagccaaaaagtcccggttttgcccaaaattcccggtcacgctcaactctagttcaaagtaaaatgaattaaattatagtacttccaactcagaaaatgatgacgaagacgaggaggaggagagtgaagatgaggaagaaacgcctcttccggaagcgcttgcagtgacgcgctcacggcgtgcaaatgccggccgacgaatggccgaactgatggcacagcaaacgaacgaaaaggacgatttctacggcactttgtacggcggatttgaagaggtttttcttttttcgaaaaccatattttaatggaaccaaatggcgaagccaatttttttttgaccccaacattttctcataaacagcagtgggcgtcgccggggcaaaaaaaatttttttttttttttgagaatttcagaaaatttgttttcgtatcggggcaagtgcccccattcacccacctctctggatatcggagcagctcgggtaatagtaccgatggtatcacaccttttttgaaattttttaaaaaaatttcaaaagtcataaaaatatttattataaggttttcggggtcgctgagcacgaatatggcatccatttcacccaattccgaacccctgatccgaattcgaacagaaatcgaaaactcaaatttttcgaaattcacatttat

SEQ ID NO: 4858 - DNA, 3938 bp, Heterodera glycines
ctgctgcacagcagcacgcgtctgttcactgtatgcccctcccacccgccgctgcccgcgtagaaagacagtcagacagtgcactatttcccacctttccctccctctactttttttcaaattcatttttaacgcaaaactcaaacaaaacgccacacaaattcaaacactggacacacacatacacacactcaactttattatataagactagcggggtcagcgccttcggcgcatcccccgctaggcagtacgattgtgttatagaattatgaatgataaaatcgactggctcggccgcttcgcgccctcgcatcattttcttggcttttctccaatctctgggactcaacccaccagcaattcaatctctgggactcaattctccggcattccaaacattgggacttaacccaccaactttcaattacattccaatcgctgggactcgacccatcagcattccaatctctgggactcaaatctgcggcattctaaacattgggactcaacccaccaactttcaatgacattccaatcgctgggactcaacccaccagcatttcaatctctgggactcaaatctccggcattacaaacactgggactcaacccaccaactttcaatgacattccaatcactgaaactcaacccaccaactttcaatgacattccaatcgctgggactcaacccaccagcatttcaatctctgggactcaaatctccggcattccaaacacggactcaacccactaactttcaatgacattccaatctctaggattcaacccatcagcatttcaatcactgggactcaattctcctgcatttcaatcactgggactcaattctcctgcatttcaatcactggcactcaacccaccaacattccaatcactgggactcaaatctccggcattacaaacactgggactcaacccaccaactttcaatgacattccaatcgctgaaactcaacccaccagcatttcaatctctgggactcaattctcctgcatttcaatcactgggactcaattctcctgcatttcaatcactggcactcaacccaccaacattccaatcactgggactcaaatctccggcattacaaacactgggactcaacccaccaactttcaatgacattccaatcgctgggactcaacccaccagcatttcaatctctgggactcaattctcctgcatttcaatcactgggactcaaccgcagcaaatttctttagcatttttaactttttgtgtgccttgggatgttgaacagttggggagggctcggccgcttcgcggcctcgtacgggggccttcgccccccccccacaattttttgcgccaaaggtaccatcatttaatcactgggacttaacgcaccaacattccaatcactgggactcaacccaccaacattccaatcactgggactcaactctccagcattcaatcactgggacttaacccaccaacattccaatcagtgagattcaatccaccagcatttcaatcagtgggactcaatccaccaacattccaatcaacgggactcaatccaccagcatttcaatcagtgggactcaacccaccagcattccaatcagtgggactcaaccctccaacattcaatcactgggactcaaccctccagcatttcaatcactgggactcaattctcccgaattcaaatcactgaactcaatctcatcaatccttcagcaacacaattaccgggactcagttctccgacatttcaatcaccggaactcaacctcagtaacggaatacagaactatttaaaaggaatccagaaattgaaatataacccataataaatcaaaacactatggtgtataattattgcccccaccccataaattcaaattaaaactgacctgtttaaaactttccacctaaatttgatcccgcaagtggcacgtcaatatcccaattgcatataaatattccactcgaacacaggcaaaacatgagatgtagcatttatattgctttttctatccatcaaaggatttttctttcattttttattactatcataacatgctttttattcaaaacaaatatcaaaaaccaaatcagattcttttcatattataagcaaggaaaagtacaaaaaacgtttttaagtaacaaacctttttcattcaagcgaattataatgcatttttttaatcaaacaattctccattatcgtttacataagcaaaacaaaagctttaatatcaaaatcacatcaattaacaaaaaaaaaaatttagacaaaaaaataatgataaacacaaattttttcttacacacaaaaacagaaccttcatataccggattttccactcaaacaatgtgctcattattttattaattattttatataataaaagatgggttataaataaggaagggatgcgagacaaatttcccattatctctccctttcctttcttttactctcttttcttttccattgcaatttactctctttttttcccattccctccttctcccacacacacgcacgcgtccaacagactgctgctgcacagcagccacagcagcacgcgtctgttcactgtctgcccctcccatctgccgctgcccgcatagacagacagtcatacagtgcactatttcccaccatccctccctctaacctctacatcctaggaggagaaatcttttaccttctttttctgtgctatttcttttgccttcttcttcttcttaactatttattttcgtctcttttctttatattctcttctttttcaaaacaatttcttttcatctcttttcaaactcatttttaacgcaaaactcaaacaaaacgccacacaaattcaaacacggacacatacatacatacatacatacaaacactcaactttattatataggactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaatagatgggttgaattttttttatgagtattatgtaaggatattttcgacaaaacataaccaattccgagtttcatgaggcatcaacttcattcttttcttgt

SEQ ID NO: 4859 - DNA, 1794 bp, Heterodera glycines
tgccattgggtgaggaggttgtggtggcggttgtttttgccacattatctgcttctgagaatgccaaccatttgaacatcaattcgtcgaacaccaacattggatcattttttgcttccaaaaatgccatcgaattgaattcccttttaaatgtttaaaattgaatattgaattttataaattttttaaatattttatgggttttcattattgtgttcaaaagaaaattttaataaggtggcaatttcaatttgtttattgaagatttaattaaaaaattaattgcccttaattagtgattgaaattatttaaacattttactaacattggtttgtcaattaaatcatttcggtcagcacgataatcggaaacatgcgcaccaaacttgtcaaagtcaaactctgttcataaaaatataaatatttttttattttaatttaattgtcctactttgtccattaattaaaactgagagatgggaaggctcttaaaatgataaatgattattaacaacaattaaaactttcaaaaaattacttgttttgtgctgaacaatttctatcacattttctttggtacaaacaaaacaaaaaagaataaaagtaattattataataaaaatgtaattcattttaaataaataaaatttgaatatttatttttacggcttttttcttttttatataataaaacacatataaaaagcaggaaatgttgaaatgccaacgatggctgtcattaatgcacttccgcaatttttaattttacgaaaacaaattacagacaatatttgacatcagcagataagaaatcgatagcagtaggaaaggtccggaaacagagttaatttttaaaatattaattaattttttttgcaatggaattaactctggctaaagcagacgtaattttgtctaattttgtggcttagaattaaatttttaaatttttttttattttattgaaatccccaaatgtcgggtccctaaatgtcgggttgccaaatgtccgtggttttctaagtgtcttttgctcaaatgtcgtccggtccccaaatgtcgggaccccaaatgtcgggatccacaaaagtcgggtccccaaatgtcgggtccccaaatgtcgggtccccaagttgcaaatccccaaaagtcgcatcacggtaggaaaagcaatgatatttaaataaattttagacgggaaagggtaaaaaaaacggaaaattaatgaaaaacgaaaaataattaacggaagcagcaaaaataaatcgtagacaaatttattaatacaatcgtaaagtaaacaaaataaggacggaactgttaagcaaatagtgaataaaattagactaaaatgaataataataaaaaagggaaaagcgtcaaagcgtaaaataaataataaaaaaagcatttttaattaaattttccagaaactcaggcggaaaacccggtacatataaaagccgaacggatttcatcctttaattgaatattcattaaataacaaccatttattttatcaattccgaaaaaaaacaaaaaatgtttacaaaatcttttaaaattatttcttttttactgccattaattttgagtccaactgcatttgggtgcattttcagtcaatcagcaacggcagagaactgtttacggaagtacgacgcatcaatgtgcagaagtgtgtgatcgagttgcgcgacatggaatttttggcacatctgatggccaaagggtggtacattcgctgctccgcccaaacgcttgtcatcccggaagagtgagcgaaggccaagc

SEQ ID NO: 4860 - DNA, 1962 bp, Heterodera glycines
  misc_feature (43)..(43): n is a, c, g, or t
gatcagtccaaattggcactcagcggtgaacagatgcgtcacntgcacgccaagctggaaaacttcgactacgtggcgaggaagtgcacaaaaaagacctgtagctcatcagcaaactgtcgaaacctgtcgccgagctcgaaatcatacaatggacaaattagcgagaatcgagggcggtggtggcgctaatgatttcagaagaaaatcagacgaaagtgatcgatcagtcaatccgatgctattttctatatgtttgttcttaattgtacatatggatccattatgatactattttcatgtgattttatatttgataaagggaatttaagtggcaatagtgaagctgccccccccccctccaatcctccaatttttgacagacttttttttgtgtccaatgacctaacttgattagtgctaatacattaaaattggaaaggcccaacattactctaaccatgtgccggattttatttgaacaggaagccgaaaattcaaatttttcgaatttaaatttccgtgcagaaaacaacatctttggtgttgcagtcaacgaaaattttcaacaaaaactgcccataacttttgtcaaagtcaacaaaaataaacattcttgataacattcgatagctctaagagttctgcgttatggtggtaacatgtgctgtctccgtgatgtctgcgtgtcgtctcgcgtccaattcgaggcggtgggctggactttggccattagtgttgtccggaagcgcatgtcgcttaagtcacactctgcagtagagagcggtattttgagaaaatacggatcaggattacggactaggcatacatacggattacggagctacggactaaaaatccggaaaatccgtactctgtaaaaatccgtatccaagaaaaatacggatccgtatacggatacggatttttaaaaaatttttcttttttgataaagattgatttattaaatacaaatcttgaaaatttttttataaattctaagcaacaaaattcaaaaaatacaaaactcgagacaaattgaaagtgggagttaaatattttagtatttaatcatacatggacaaggtgaaggaggcggataagaaatatgctttatgaaatacgaaataccccctccccctcctccgaggccaaaattttttacgaaaaaaatgctcaaaaatttgcctgacatgtctatttttttcttgcttttcaccacactttttttgcggcacgctatttcaaaaaactgttttgagaaccggcagggggacgggatccggcggtgccggtatgcgccgccgggaaaattttttaaaatttgattgcaatatgttaacagatttacaccagaaaaatgagcaaacttgtgatttttaaacatttcatgaaattcgttgacaaattttcataaaaaatatctataggtttgaaaaatttacaaatccaagtctgtaaaaaatttaataaatgaaaaacgaaatgtatttcttaaaaaaatttacaaattgaaaaaaaatgaaatagaatttcgtaagatttcaacgaaatgcaattcaataacataaaggttttgagtttttggcaccaaaattttgctattttccaatttagtaattttccaatatttaccagtctttttcgattttttgccgaaaattttacgaaatagttccgccaatttcaaagtattggtgaattgactgcacaaaatttaaaaatttattcaatttcaccttaaaaaacgtcaaaaaaataatccgtaatccgtagcataattttatacggatcaggatcaggatacggacttgatatcgatacggattacggacttacgaattaaaaatccggaaaatccgtagtccgtataaatccgtatcggcccaaaaaaatacggattacggactacggatccgtaaaaatccgtatacgaatccggtccgtacccgctctctactc

SEQ ID NO: 4861 - DNA, 1067 bp, Heterodera glycines
actaatttccattttcgaaactctcaaatcctcattttaagaaaaattatctttgccccataaaactgcaaaattaggaaaaacctatgataaagaactatgctataaacccagctttgtctaaaattgaataggcttaattttattttttaaatttttttgctctatttatttgttttttaatttgcatattttatataaataattttttaatttaattttttgcaaaagttaaagccaaaaaattgcacctttccggtcgaaattcgtcagcatcgtcaccccataactccttatttcgatgaaaagtgtacaagtcaattgtcactccggtccctttttccaccaaaatttggcccaatgtcgtcgtctgtgaacaaacacgcgtcacaacgccaaaatagaaaaaaaaaacagattaaaaacagtaaatttaatgatgacggaaaaaagttttacgattttttttcaaaaatggggtgttaatttaaaatagagacacttgataaaaacgaacaaaatctcaacaactaccaaaaataaacagataaaacaaactaaataagaaagaacaaatcttttttcacatttctgtttattttgcgaacagaaatatgtcttttaggcagagttatgttgaattttctaagttttcaggagaaattaagggtcaaaaggcttaaatcgcctctaacatttgcccaaccgaatcaaactaacagcaatcagcactaagataacgtacagacatcctttaagcattttttattcattttatgccataaaaaggcattaaacacaaaatttttgcgggtgaaaaaatacgaaaatctgagtaaattcgaaaaaaaattctagggggttgggaaaaatttttcatagaagatgaatatgacgaacagaaagagcacaaaattctctacaaaatggcctttgaatgaggtctctacgtcgcgtctccgcgaaggcgcgtcttgttgaaaatggatgtctcaaaaatgaggaaaaatggcttgaattgagtcattttttggatagtcggtatttacaaggcacccctcagcgaa

SEQ ID NO: 4862 - DNA, 1056 bp, Heterodera glycines
cagtttacgccccataaatttttttttatatatttatataatttttaaaactaacataaagcttttatgcggtaaaactgttcaaatcgtccatattgtagattattaataaagctaaaagcagcaagagaaaatatttcatttttccagtaaaataaattttttagggtgtcacaaaaattacagcggacaattgaaaagacgcgccaacacggcggaatcacttcgctggccgcaaagagtcacgggtcgaccgcagccggcaccgcttcgagcatttcgtttacacctgtccatgggttggaaattgtgacgccaatgcaaaaggaggaggcgtctgggaaggcttcgacttatttcactccgtccaccaatttcatcgcccccacaaagccggccattaaaaaagtgaagcaacaaatgcaaaaaatggagtgataaaaatacgacgccgaattttgaaatttaattcttcgataataaattatttcgtaaattggttttaaatttttactttaattattttcaaatgaaaatattgatttaaacatttaaaaaaatttcccagtgattaatcattgcaagagacggggagggggagagggctgcattggcatttgtgccattcattatctgacgaaaatgaaaagtggacggggggggggggggtggtgagcaaatgatgatgataaatgtttatttatgttatttggcacagaagatgattcattttcattgtgtttcgttgacatatttttctccggaacaaaaaaatgattagtataaaattggtccttcctccgtcgccccaccattcccctacaaatttccgtaccaggtgttttcgacagtgattggtttcgacaaaattataatttttgtcaaaatataccaatcgctttcacttgtgctatacaaacatttattgtgcactcaaaaacacaacaaatttcctagataagattcttgaatcgcgtgggaaagtcccgctaacaaataccggttttgagtgctaaagatgcgaagctgcaggctcttgtagcagaattcgaaaat

SEQ ID NO: 4863 - DNA, 2192 bp, Heterodera glycines
  misc_feature (36)..(36): n is a, c, g, or t
tggatcagaatttgggctttgatgaaatcccggacncaaaattcacttatcaattctatcttgtccgtctaaaatgtggcgattgcctcataaaatggcttaataaatcagataatctttttaaattttcccggaaggtctataattttgcttggaaaaaaaaattgaacttcagactgaagatgttttaaaaaaaatcggaattcttccagatgtgtcaacgcagaagacccactgacaaaagacccacaaaatttaaccgggctttcacccagttgtccttcaccgttcggttacatccttcgggtgcgcacgaaatccaccaaatttgtttagaacatttaattttatcagaactctattaacaaataattgcactcacttcgctcgagcatacggtatcaatttcttcttgggccctcaactgtacatcagggtgacatgccaaataatagctgacaaatcccaacgaattggcggtggtgtcaaagcgaaaattcgttaaaaaaatttaaaaaaaatagaaaatttatttacccagccaaaagaaacaaaagcaattgcattccaatttcatcaacagtgttgatccggttgatcttaaaatttgtgttccatttaattttattatcaaaaattaattaaaatcagagttggcaagtttttttttaaataagtaaggcaatcaaattaaagatgaacatccaaaaaaaaagaaagaaatttcatatataatttaacattaatttctcttaaattatggaaggaaaagataaaataagcataattaaatcaagggcacccattggaaaaacccgctttcaagtacagttgtaccgatttccaagtatataattgtcaaattttacaaatccaagtacaccataaaaataaagagaaagggttaatttttattcaaaatggtttgtattttccgttagaatgatttttccgtttttttttttgattttttcacaaaatgggcattttttacttttcatgtgctcactgatatgcgtatttgttaaacttctataaaaactctgattttaaaccaataagaaaaaatgataaaaatttattgcatttggcccaccccaccacctttgtgacagctttgttgaacacgcaaaactggttcttgtactcaatgttctcctcatccgtgaccgcatccaaaaacagatcaatgaaatcgacttgtcgtttctgatcactttcgaattgattattgttgccattattttgatgttgttgttcatggtgatgttgtctcgttcgacgtcgttccttaaccgcttccctgattttgttgtccatcagtgcgaacgggtcatgccggattttgccggtctgtcgaatgaacggcttgatcaccttggcaccaagccacgggaacaaggtggccaaatactcaaaccttggttaaattttttatgaagaaccacttgaaaaaagcaaaatttttaattcatttttacccaacccctagcggatttaaggaactgtttcatccagagatatgttttttatgatctggtaaatccgtatcatttaccaattgttttggaaccgcagaaatgcggcaacggcccatttggcgtcctccgaatggaattgtcgcgactcgcgttggcccattgcgacgcgtgtaatcacatcaaaggtcatctccacaaaataactaaaatttatttaaaatataaattttaatactaaattaatacacaataaataatttatgttatttcatatttattgtttcccaaataaaatattggaataaaataaacaatttaatctattcgaatttcaaaaaatttgtgctgggattagttggttaaataatgaaaaaattttaacttaagtaatgttctataaattaaaaaaaatttttattaatatttcctttaattaaaatattaccggtgtaaatttattggcacatttggctgcgctttgcgctctttctccatcagttcaatggccactttcaccgagtcgtccattgttggcattaacttcaaaaagcaacaacattcatcttaataatcattttttaataatttaatttattttacctttttcaaattgctaactgaaaatgccggatttgcggttgccctgaggcgcttccatcgcgccccgcgggcattgaacaaatgcatgcgtggctccttgtcaacatcgcc

SEQ ID NO: 4864 - DNA, 2265 bp, Heterodera glycines
cgaggggggggggggtcgcaaattttgaaaatcttcttagcaaattcattaaaaagtccaaaaattttccccggcggcgtctggcggctccgccgaaccccaaaattcctatttttcttaaaaattggctcaaaatcgcaaaaatttgccttttttggtgaaaaaatgttaacaaatcacacccaaagttcaaaaaaaaaatttcccggcggcgcctgccggcaccgccggcccccctgttcccgaaaagttttttggaaaaagcacgccgaaaacaaacgttttttgaaaagtaaaaaaaggtcatcggcggccgaccccccttcgcaaaaaattttaccgacccacccccctttttaatgtatgatggcaaaccaatgaaccactgtaggtcaacaacttgtcataaaaacccaggaggggggggggggggacctttccgtattgctccgtccatttggccaattgaaagaagcgaagcttttcctcccaaaacatttcgtccaaattgccactgaacagctttccatccgggcagggaatgcctcggcgtttccaataggcggcacggtaaagccaaaaacttgaaatcgacaaatgaattaattaattttttaattaattaggtttttgagcaaaatatttgacttacaaataaaaggcgagaaataaacagaagaataagaatgaaatttgtaatagaattaaccaaaacatcggagtctgaaagttattttatttaatattttttttaaattaaaaataatgaaaattaaaatataattggactcaaattatttgaaaaattgtgactaaattaatttaattatttctgcaagtgtttagctgattttcttttttttatatatatatatgccagcattattaccttctcattaaaagtgttaattcaatgatttgtacacacatgaccaacgaatgaatgaatggataaatacttttatcagtaattgaaggaagaggaccgaaacattcaaactacaaattacaaaaaatatttatgaaaataattcaaaaatagaaaattgtttggcttttacatatgataaaaaatgataaggtatttggtcttcttaatcattatggggttattagttgtatgcactaaaaaatggcaaatatgcgcataaaatacgcactaaaaatccctcaaatatgccctaaaaacccaaaaaatgccgaaatatgcactaaaatctgcctccaaaaatgactttgaatcctcaaaaaaatgccaaaaattgtttaaaaactcagaattgtctttgaaaataccaaaacaatagttaaggagtatttttagataattgcaaaaaaaaaaaatttttttttcaaatttgacattgcattttgaatctttgagaaggacagaaacattcaaactacaaattacaaaaatgttcttgaaaataacaaaaatggaaattgtttagctttttcacactataaaattttaattattataaccaagttttgtcgcaattattaaaaattttttttaatttaaaattgtaatcttttatgaattttaaaatttagccaaattaaaaaatttataaattttctattatatttttaattttaattcccgaaaaaatgtcattcctgatgcagaggatacctagttggtatagcaatgaatgggtgctagcgcgtttgttaaaaactgccacccatgcgcgtttgttaaaactgccaatgggtttgaaaacaaaaaatgggtaaaataattaaattaatagcttggctcaaattcaaccaaattaatatttcgtggtatcattcaatagctttaattgttctctttcagaatataattttcctaaatttttaacttaagtataaaagaagttataaagcattgaacaggctatgttttttgcaatggtaatgcatatataataataaacatttaaaattttaaagtctttaaaatgaaattgaaccaaaattaatttatatattcgatagccctaagaattctctatttatatttaaaattttagaaaatttcattgagtttcaaaaaagttctgaacaaaaaatgctgacttaagattttttgcaattttgtgacaataactttttttatacttaagtaaaaatttttggaaaagcatattctgatagaatacaattaaggctattgaatgctaccaaagaattttaatttgattgaaattaagcaaagatatgaatttttatgtgttaaccattttttgttttcaaacccattggcagttt

SEQ ID NO: 4865 - DNA, 4466 bp, Heterodera glycines
tcggataaaggtaaaaatgaagtcaatttttgtcgaatttagtttttagctcagcgccaacatactttcgttgagacaaattctgtacgatatgtctatcagccgatggacaacatttacatggtaattctattgttttttgttcatttaacagttaattttcaggttttgatcaccacgaaagcatctaatattttggaggacctggagacgcttcgtctgttttcccgagtggtgggttagggttattattactaacatttgaatcagagcgcgggaaagatttgttctcccttgaagggttcgaggcataactttgaatatacacagtatgcgataaaagggtggtcaaataatggtaacgaataaactcgtaaaacccaaaaagctatagccggaaattttcttcactacaaatttcgctcctctgattgtgtgctttttttttggagggattaaatttaaatatttgtttatttgaaaaaacagcaggtggggtcatgtactacatattcatactgatggtcagtcccgtttaatttagatacccgagtattgccgttccaatgatgagtccgaaatcactgacaaggcattcgatttgattttcgcttttgacgaaattgtcgtgcttggttatcgcgaaagtgtcaacttggcacaaatacgaactttcactgagatggactcgcatgaggagcgtgtgttcaatcaaattcaaattgtacagcctttcgaaatttagccaaaatttctcacaaactttttaggctcaacaacgcgcagcccatacactgatgaaagagaaggagaaggagataaagcggcaggaaaaactgaaggaagcatttgaagggcggaattggaggtgaaacgaaagtcaacaattatttaaattattctaaaaaaggtacggctgcatccgccacggggatcagttcgtcacaggcacgaactgaacttacgtcggtcgtcaaagacaccgcgcccatttcttcactgttgggtggaacgggtggaacctctctgtttgggggattgggtcaaaaaaagcaggcggtcccatttgtgggcggaggaaaggcgttgaaattgggcgcgaaatcggcaaacgaggacgcttttctgcagcagttacggcatgagggcgaaaaagtattggataaggttaatgaaatgccaaattgtgttaataagccgaaaaacaattccactttccaggaatcggccaatgtcaccgtgtcaatgtctggttagaatttgattattgtattattgcttgacggctgcataatttattgttttttgattatacaataaatattgcattaactaaagaaagaattccgtttatttgagaatctgatgctgctgtttcgaatattggtgtaaaggctggcgctgtccacttcaaatgcgttgagaaaataaatgccgtgctaagccgaggcgggggattgaattcgtctgactcggcaaaagtgtgatggatttattggatttgcctattccattccttcttcagatatttggctccatttcgctctgtgtttccgatcccaagtttaacagtgttgccatccgagtgttgaataatatcaaacaagtgcctggttgtcgacacggtgacacttctcaggacagcaaagcagttcaaattcaagtaatatatcggtttctgtcctttttcatttttatatgatttcatctattactgtcagcgtttttcataataactccagtaagaattcccaaaattaggttcatccaaatttggacaaatcgtcatggcaatccaaatcactgctccgcctcaagtccgagcaaaaaccgtacccggtcggtgttgacgttggtgtgttgaaatggtccattaaattgcctgacgaagatgcacttccattgacacgttagagttggatgacgaatcgaattaaaaaatgaatctttcagtaaattgttggccaaacgaatcctcggagggagtgacggtgaacatcgaatacacattgcaacgcgaggatttgcagctcaaaaatgtgcgaattgtcatccctctaccgtatgtgctattcattctgatgaatcttttatttttattgtgtttagtccggcaacagctcccgtcatttccgagtgcgaaggagcgtacgaatacctaaagtctaaaggccaacttttgtggtccattccgctggttgaacggggcaacaaaacgggcactttggaattcacaacagccaacggaaatgctgatcactttttccctgtccaagtccatttcagctccaccgacagtttttccaaaataacggtcaatcattgaatatattttttatacttgcaagggtttatagtattttcaacgtcctttaggttgaaagcgttgagacaatgcaaggagatgatgttgagttcactgatgaagtgaatttgtttccagaaaaatatgagattatttaatcaagagttctgtgaaaattggtgtgatttttatttatcatgggctgtttttaaactatgcttttttaattcatttcctttcgaataaaattttatgggacatcctcttttttaatgtttttggacaaaaaaaaacgtcgttttatgggaatggtgcggtgcgtcttttttattcagagggaagtgaatcatccgtgatttctttattttgtcatatttttggtcggccacaaaacgttgcctcattattctttttatgtgttcatgatatgactcatttgatttcgttcctccgttacggtccaatcattcatccgcctcctccgatgtttctcattttcactttcccctcccccttccaatggaaggttgcaggaagctccgcctcttttctgcattcacgctacaataaatacacacattgtgtgattgcccctccccccccccccccccctctccgtagtcaaattattttgtttgttcgttcgcaattctgtctgtcccctcttcagctgtgctgctgaattttccactgtccttccgtttagttttggctttggttcctttccatttcctttcccccctttacttagcttatcccctccccctctaaaaatccctttttcattcccacaatttgattaaacatttccatttccctttgggtccgtccccaaaattccctttcccacaattcgcagctgtgccaataggaatcgattgctgttgtgaacttttggttaattgtaagttttatatgtccgaccattccatcggtccgtctccccacacaatcgcatctcttcctggataaattcgtcagcgttgtataatatgctttcaatttttaaaatctgagacacagttttttggggttttcaaaatcgaaaaatctgtttctgatatccatttagaaccctgaaccagattcgaacaaaaaatagaaaactcggtttttagactttacgctggaaaaaattgatttttttccaaaaaggggcacaccatctaaagtattaccgttggcgctaatggatccatgaaatttcgatttttttatttatcctcttattgttttaattttgattttgtttttaaggttgtttaaacttaaaattatatttgcgactatctcaaattcatacgcgctgcgaaaagaacggagaaacagggcgaacacccaagcgaactttgaaacagtggttggttttttcgttttcattttagactggtcagttcaaattaaaataagcgagtgtttcaaaatggcatttatcgccttggcttttacttggttttcacccgttgtttgatatatggtcaaagaagcgaacaattgttgctgcttcggttcgcggcttcgttctcttccctttgctatgttttgcttgcgttgggttggcttttctcccttccctttgctttggttgcgctttccgtgcgtttcccttccgctgcgctctttcgcgtcgtctcctcctcacctttcgctgtttctgctgctgtttgttttgttattttttatcaaagggcgcttcctttcttcggattccttttctgctgtcgttgttttgttgttgaattttgcgtctctttttcttctgctgcttcatcatccatttccttcccattatccgttctctctctctctctctctgtttttcctcaacttttgagtgtcgaaatgaatgggccgatccgccgatggattgcctcttcttctttctgctctgtttgtccgtgttgtgtgttcattacgctcactctcttctccctatttcactcgctcacctttttgtgtgcccttttcctcccattttcacgctttccttaactcccttcattttttctaatgctttttcttcacacattccgtttcgttgaccgggaaatggacggggcagagggtgtgaggggtggggtctttcctcgagagtgcatttaatgatgacaatggaatgtaggtggaagtgtgtgcggataatggtcattcctttctgtaa

SEQ ID NO: 4866 - DNA, 5760 bp, Heterodera glycines
  misc_feature (5753)..(5753): n is a, c, g, or t
cagcagcggcagttgttattgttggtttgagtgtagtgatgtacttggatattcttcgcgttggcgaggaagttgattgggaggggaataggggcgattgggtggcagaagggagtgggatcagtcggtctttccgctgcttttattggtcactttcgttagcccaccccccccccccccccctccttcgatcacctcatttcgttagccattataagtatttcctttcgtccgtcttcgacacattcgcttccttcccgtcacatccaatcttttcgcttttccgtcactacggccacccgcgttttgcattccctttctatcataaaattgagctgctgattcttttaatcatgtcaatggggggtggccattgaccgcttttgcatcggtggcacgcgaaaaatggaccaggcaaaacaatgcctgtcccgcttttggcattggctgcgaattcgtttaattgccttatggacttttcttaaatgggtcggccatgaaatttgttgttgcggcatatgcttacaggaggaggatgatgtggagaaaggacgcacaaagaacccttttgatcagcgtaaggaagaagatgcagaattggatcgttagcaaatttcaaattggcaaaggattggcattatgttttagaaacgcatttgcctaaataatataattttttctaatgcctacataagaattaataattttcttagaagtgacaatttcgacgacagcgatgagtgccggtactcaaaatgcgacaggacagggccacgtgcacaaagtgataatggtcggctcaggcggcgtaggcaaatcggcactgacacttcagtttttgtacgacgaggcgagtgattttagagagaagggccaattgaatgtgtaaggagacccgagaaataatttcgaaaaaatggtagtgattggagttgttttatacagttttgatcaattgtgcttatcccttttcatttaattttggactttgatattggtgtttttcatatttacacatgccaacactccctcccccctccctccgctctgtcttcactggaataatttactttcatatcacagtttgtggagaattacgaaccgaccaaagcagatgctcacagaaagcaagttgtgttggacggggaatattgtgcggtcgacattttggacacggcgggacaggaggactattcggcgataaggtcggcaaatggttaaatagtttttcggaaattacaatcacaattactctcttttatttcttaaactaattcagggacaattactatcggtcgggagaaggtttcatctgcgtcttctccatcaccgatttggattcctttgatcaactcgtcgaatttcgggagcaaattttgcgtgtcaaaaatgccgacccaaatgtttgcattttgttagtcggtaacaagtctgatttggacgcggaaaggaaagtgcctttggagcaagcgcaacaacgtgaccaattccaccaacgatggaaaggagctcttttttgcatttaggtgccgaactttggggctgtcctttcgtggagacttcggcaaaaacacgcgaaaatgtggacaaggttagccaagggcagaaagccaaccgaattcggattatcagttgtcatcgattcttatgggttttctttttgcattcgattgtgtttcattacggtctctcaaaattattcatacataatcggtttaaggtcttttatgacatcatgagggaaataaagcggaaaaaggtgggcacaatgcgagcgggcggtgccaacggcggcgatgcggcgggtgccaatggaaaacggaaagcgaaacggacatggaagggatgcaccattctttgaggggaggaggccaaaggaagcggagagaggaggcaacaatcggaaatattctgtccataatatttaagtattcactgtctggaaaagtggccaatggtcagaaagttttttggattgttcaaataaatttcactggctaaggccgtcccttcaatggccactgcgactaaaatcacacactttttgcgctttgttgttttttcgatttctttaattttattgagccttttttcatttgcttataaacaacaaataaatgcaatggttgtcatttcacttaacggtaaaagttgccattgctttccttttttatttgttttcgttttcctttacggttcctatcaaaaaaggtcgcttttatgatgatgaactccgacaattcgagtgctatcaacagcaaatccttcgatcaaatttcggagattggatcaatggccacggacggactgcttcaggacgacggagtgccggattatgcaaaaatcataatcaaacagcagcaggcactcattgccacgcttatgaacatgcaacagcagcagcaggaggtcattgaaacaaggaaaatttggcgtgattggttttatgagccgagattagtccggggaaatttctaccgacggcaattataatttgttgagaaataaataattgaaaatcggctgttcagtctcggtacgcgtcgaccatctcactttttcaacagcatcagccgcactttctctccaacaacgattcgtcctttccccctcctggcatccccacccatccgtctcctccgcccggcatccgtccacccgtctctcccgcgccagtgtcggcacctccgccgcctccaccgggctttcgtgcacccccaggcttcaacgtaagcgtcagttcccgcaagttcgaactcgactccaccaaatccgacaccggcggctcccacaaattcgacatcagagaggagctgaagaaggcatttgccttagacgacaccaacgaaaacgacagctcctccgccgagcagcagaatttgtcaccacgttcgcagaacattcgcgaggcacagaacgcgcgtctgcccatgtcgagcagtttctcgtccatcgaaaatttgcaaaatttcaccggtttaagccaacaggtgggcatttcacagcaaaaattacgaggaaatattacatacaaaagaaatgatagtgaacattcttccttccatttcctttgctttttaaggactcatcttcgcccgtctccgcgctcagtcggcagcccatcgccgcggccgttccgtctcctcagtccgcgtcgtcgtcggtgtgcgccttggcacttaattatgtgttggttgatcaaatggtgttgaattatgagcgagtgtacgagcaaaaggagaaaatggccagcgaaacgtatgactgacaatgagcgaatgatttgcatttttacgtggaacaatgggcgaccatttgaactttttcagtctcaccatggtggacagacagtcttcgcccgaacggagcatttaccaacgctttgccaacctcggcgccgtcctctacattttgcagcgacttcaccgactccaccccgacggcttcaccgtggcacaatatgtgcagtttgagaatgttcgtaacattggtacttttcgatttctaattccaatcaattctttgctcctttccccagtccccgttagttccacttataagcattttttgttgaaatatggggctttatttttatgccataacggtaaataatttttttgttagcgtcagaagcgagctcggccgacctctgagggcttttttttcaacaacactttgccatcggtggcttcgttgttggaatcggacgacgatttgctaagagtggacataaaggaagagaagttttacgtgtcggaggaggtcactcagacgcacctcttctgtctgagcaagaatttgtgtgagtgtttttagacttatttgatgtcatcatagcattttcaaaaattatttaaccaaaaatgcaacaaatagaaaattggtcaattcgggggttacgatcgttccttcctccgtgtggagagtaaccgccccttttgttctatttcaggctccaatttgttccgtcttttgcgtcgctgcagctccaacaatgccatccgcgtccagcatttgctcgaaatctctgtaaaacgattcgttgtgtccctccaccattccaaatgccatttcagtcccaattggtgcccatcggcgcccccatgcccaactccaacgctttggtcgacctgtgcaatcgcttcccgaccattttcaaattgcgttgttcgcctcaagacaattgtgagtaaatgcaattggtctgctgagtgtgtccttctcccttctcttcctcagatcgctttgacaattcggtgattatgctcaacgaacagttgctggacagcgagaatttggcgtggcgcgtcgttttggacactgacgaattttaaagggtgaattggcgaagaagcggactctgaccaaatttgccataaaatctttttgttgttttgtggagaaatggaaatttacggggataaatcatcaaaaaaaaaattgtccacgctacacgaaatttatgaggacgaaaagataaattaaaaatagagtatactcgaaaaagagaccgctatttgaatttagggatttttgggtagaaacaatgagttatcgggattgccttttcggatttgttaattggaagtgattgatggagggggggggggggaaatgtccgtgtcgtttgctatttttgccgtcccttaaaaactccgctgccatgtgtctcggatttgtgatatccgtccgtccgtccgttcatcaccaattatctttctttttcgctgttccgttgtgaagcccttttctttcccctattaatccgtcatcttttcttcatttgccttcattattagggttccttccttcttccgcatctcatttatttttcttctgtttcatttctgtgccgtttttgtttattatttttatttaaaaatggcattttcccccgggtgatttttctttttcatccctttgttttttcctttttgcccctcccattggggcttttcctctttaaatttccgtgctttttctttctttgctgttgttgtcgcaatggttgttggcatggcgtgtgagttcttcgagggccgttcggttggccatccccgggggcataattctattgactttttaaagacttggccaaatgccccacactgaatttaagcaatttaccaaaattcgctttggcattccttccattcattcgttcttttgaattccccaagttgcattttccttttaaatgtgaatgatttaatttaccataggaaatgccattgaaaagcattaatgccctccaaaacggttaatgtctttgagtggcgtcccgaaacaattaaatttgccaaatgtctgccagaattcagcacgaggctttttttgaacattttggcattgtgttggacaacgccgagggcgtttacttttccggacaggaaattgccggaaaggtcggaatataaaagtcaattaatttgcccaattggccaaacttcgccttgggcaggtggtcattgagtgccgggaaccgcgccgaatcagcgaacttttgctggaagtgaagggacgggcgcggacgcattggacaaagtcacgcaaaatgtgcagcgaaaacgaaacgtacttttgcgagcagttcaacacggaatacacgcgaaagttgccaaaaacggaggccgaaaacgacgcggggggaggaacaccacgggaaggggggaggacagtggcggaacggagaagggaaagcatcaaaatgatggtgaagaggggcaaacggaggagtgggggagacagagtgnaaggaga

SEQ ID NO: 4867 - DNA, 167 bp, Heterodera glycines
gggagtgggagagagaaagagtagggggaggggagtgggagagagaaagagtagggggaggggagtgggagagagaaagagtagagggaggggagtgggagagagaaagagtaaggggaggcgagaggggagagaaagagtagggggaggggagtgggagagagaaa

SEQ ID NO: 4868 - DNA, 3067 bp, Heterodera glycines
  misc_feature (52)..(53): n is a, c, g, or t
  misc_feature (79)..(79): n is a, c, g, or t
gagttaggaatttttctgaaaatcgatttttccagaattctggaatactttnntatttggaagatagaattccaaacanatctcattaattctcctaatttttgctatttttcaaactttattccactaaatttgaccaaaaacgaagacagttatgaattttcgaaatttcactggatttcccggggccaaatagtgacaatttttcaaaaatttgtaaccaccttccaaaaagtctgaaacgcaaaataaagcgtatatacgtattcagcacctcaaattatgccataaaaatgcattttggctaatttaggagcaaaaaaatttttcatgaaatgcaaaaccatggggtcccccctatggttttgaatttcaaaattcatttttattttataactttttaaaaactcatggtaaaaacatgagataaagcacattatattgggcttaaaattctctacaaaaaagctcttagacgattttttgataaattcaactcctgacgagttattgcgccagaactgaaattgaggcctagcaaccaaaaattttctatttccaaaaaatttttgaaaaatttttctgaaaatgacaccaatcgatagagcatgaaaaacggttgcttgaaagtggtctccgttttccccggaaaaatctgtaaaaaatcataaaattcaaaaacggaaaattttcgagggggcctagctcgaaaatttctgaaaatttcagaaatccaaaaacatggttggatagagctcgtcgagctctacaaaaaagccgcttacaccgacctcctccggtcaaaccccggcgagttattcggccggcgctgaaatggcccaaaaaagtataccatttttagccagtttttcagaaaaactggtaggccctaggggttcggtcaagaaacaaaaaatatcccaaaaagtccaaccgagtgcctttacgaggccgatttttcaattaggcctttaaaaaatttttgaattccaaaaacggcaaaaactgcttcgaaaaaagtgacttttcggcgcctggcgctcagttggccctcggatcggaaaatctatagttttcctgaatgcgccgtcaaaagttgcccccaaggtcgaaatttcgaacccctcccggcaaaccgtaaggagattttgtttttggaatgagttgccttgtttctttagttatatataaactagggtagccagttggctttaaggtagaaaaatgcttctggaacccgaatataatgcggtatttacatgagcgctgcgcgcaaaggacttcgttgctagtgcataagcgaacatgtggccagtttattaaccgtcattagcggttgggcaattatttcttgtaaataaaaattgtccaacccccagggtccaccacgcggaggaacacggaggaaaactggcaaaaaccttggaccccactcgccggggggtgaactccaaactggaatccccggcgaggagctatgctctgaagaaaacacctgaaatgaccggggggtgaactccaagctggaatccccggaaataaatatgcggcatctctcctcgcactctgaaactggcacaaaaacatcctaaataaaaaagaaatgtgacaaatatataataaaaaatatataaataaaaagtgcggcaaaaactctcctcgtcctgggtccggaaatgaaattgcgatattcactgtaaaaaatcaaatgaaactgacaaagggtaaatgtacaggccggcggaagagagtaaaaagcaaggccgccatataatacgttcctcagggcccacattgtgcccacatactatatggatccatgcctcgccgacctgccccaatcctatttaaaataacagccaacggtcaaactcacctccatccaaccatccaccttacttgaaaagcaaggggtgtgtttgcccgggattgggaattaaacgatttgtttatggctgttatttgacaaaacaaacaactaataatgctgcgaggaagacagcataaaaatattaatccaaattaagcccggaagcaataatattcctgatcaatgggtttccattatcatcaagtggtttattgggagcaaaaatccttatattatcacgactcgtagcccttgacaatgctgtgtataattgtccatgtgcaaatggctcttcagtaaaatcaattcctaatcggaatgcggtttgaccttgagccttcacaacagtcatagcaaaagcgaggcggacggggaattggaatctttcaaagcttactccgtcggggcgtttgtctttgtatgtgtgccggttacggggtataccaacaattattccgtttgcagagaagcctccacctattgtctcacattcaatcaaattatcagtcaattttttgacaagaagacgggtgccattacacagtccttttgacgtatttaaatttacgagcaacacaacaatagaacctgttttaagccgaagtaaatgggtgggcattcccattggattaagctgattaagctgcgctacgtcaaagtcagccgcatttacggcaaaggggttttcatcagtggctttatcaacagagaaatattcaacaaaattgccaagcatggattgcgaaatttgagaattatttaaattgaagtgttttctaattttcaaaaaaaattccaggcctctacctatacttggaagggctgcagaaattggcaactttttagtaccaactttgcccagttcagtccccgttgaataactcattaggctttgacctgagcgcagggtggccagcagacttattgtagagctcggtgagttcgatttttccaaattttaaaatttcgaaaattttcaaaatttttcgagctaggcctaaaaaacggttttcgggtttttgaattttagtattttttaacgaattttcccagaaaaacgaagaccacttccaagcaacagtttttcgagctctatcgactggtatttttttcggaaaattttcgattttttcccggaaatagaaaaaatttttggcctgagagggacatttgagtcccgggcccataactcgtcag

SEQ ID NO: 4869 - DNA, 4034 bp, Heterodera glycines
cgggttttcatcagtggctttatcaacagagaaatattcacaaaattgccaagcatggattgcgaaatttgagaattatttaaatcaacaatcctatttgtagtggcaagaaggaggcgtttaagcatttcactacttggcatactaaacccttgatcaaatacccaatcaatcaattcttctcgagagtctacaagcatatcttttgggatagcgaccgtgtcgccacttactcctcttccaacatcgtcaagccatttcaggaactcgatctcatttgggtttactcgcatgctttgggtcaatttgaattttgtaaaaagtgagtaaagtggggaggattgaatgcatgcggaaacttgcgctggacttccatatgagtcaattacaacaggtagtgattgcttccaatcaccagaaataatcacgcattttccaccaaaaggtaagtgccgtttctgcgaacacataagacgacaaagagcatcaatattttccaaaacagtcctctctaacattgtcatttcgtcaattattatgatatcacactctgttattctccggccaaagaaactatcaaagggaatggatggcaattttccaggttcaacatttatcccaaacttaaaggcagaatgaacagtggtgccaccagcataaaaacgggtggccgccataccagtggaagcggtgggaataattttagcgccaattctacgcaagtgataaaggatataattaagcaaataggtttttcctgttccaccgtcaccatacaaataaaacaatcttgaacatcgtgagtcaataaatgcagtctttaccaaatcaaaaaatttttgctgttcaatattcaattttccacgctcataagagcttgtgtcaatatcatttgcatcatcatcattagcgtgttgtggaaagaaaaattcatcaagcccgagctggggattattcataattgaaattgtaggggttgggagtccataatctttacactgttttcctagtcttactaaaagtttttctaaaaggaccaatgcacggtcaattctcgcaggacgttcggcatcggtacaacgcaaatcacacatatgatggagaaatttatcccaaagcagtgcgccgtcgataagacaattctctgttgctccaaaaatcaaaatgtttgccagtaattggcgcatttgtgccggaccgagtgaggcggacccctctgtcatcgttcggatccaaacatcactatcatcaataagacctcttaatcgggcagcctcaagaaatgtggagcagacatgcgggggattaacgatctttagttgctgagggtttccaggaaaatgcttagttaacaaatacaaagcaaataattcaggatttcggggtgacactgggtaaattctcccaataattggttttctctcacgggttttaggccttggattagtagaaatgacacgtttcttccaaaattttccggacctattaaatgagtattgctctggcatgcgttcgaaaaggatttttttaacgtcgggattagtttcacacattttccaatatgcggtcaagggagtttctggcaaaatgcccgcctgaagttgctgtccaattgcctcttcttggccggatttataataaactttttgctggccaggcaaatgaagtgacaatgcaataactgtatgcgataatttggcatacttgtaagacataattctactgtaggcctcaggcgacgaacgatataacattcttgcataaaaagcaggttcatcgatacttatctttccattttcttcatttgtcttaacgtacgaaaagcttgggcccttgaatggatatttgtacagatatttcaaatttgtgctttgcccatatgcatattccagattatggtgagtctcaaaatgaaccaagatatatgggttataggaggaaatacgagaattatcataaatgacttgcgctttgcctcgctttacggttaaggtttgcccgccctcttccgggctcggacgaaaatagatcgctggacgatcatcgtgaaggacagtaaacttactaaacggcttggggaatccctttttgcattttccttttttattaagacaatggggaccacagtcatggaattgaaatttcggtaataattcacgtagtttacgaataaaattggcccaatctgatttatcatttttcgctggttcttcaggtatatgcgcccatattatattatcaacattctctgggatggcaagcaaacttgtgtgataaacacgatgggcatgtggaccgccgtatttcttttggaactcacgacattcttgtccaatcattttacccaaaatattttttttgtcaatcaaataatgcaaatggcgaagtttatcctcatatatacgacatattaaatcgggtcgatctacagttttctgacctttatggaggaaattacgagaaatttcacgccaacgcggattggttgtgaaagtgagaaagaatgaagcgttgcctggttttttaaagcgtgacattattgtggtagcatcataaaatttgtgttggaaatacgctcgtgtgcctggctctgatctgcggaacataacaatactccccaagtcttctgtggagctaagaccagcattacgtgaaagccagcgaagggcattttctggaagtgtactacgcaaatttaattcgggacgacgtaaataatttgcaacattcgtatcaattcgcgccgcgtaatcaagtgtaaatttctgacttagtccgccaccggaactccaaatgttgtgaatgtttttgtgttttcttaacgccatacgatagcggatatacgacctaatagataaaaactgccgcggaccgcgtttgtcaacagaatcaaccgaactggcaacggactcattgtcatcatctgatgcatcagcatctgaatcaccagtgttctcatcagattcgacatcaatctccatggcctcattcttttcgggcttatttaacggattgtatggaattttaaggtgaaagccattatcaccatgtggaaacatcaaagggtagcaaagagaatctgtgagtggatgatgtggagggaattttttaagttttccttcgtcattggtaatccatatccctttcaaaaagggtggctgttcactttcagcccaaacggcaaacaatgaattcccctcatcgggtaaattggcttgtctcgaatgaatagaaacgtctcgaacacttgccggtgcatctcgagcctcgacgagcgttaaacggaaattaagtacagcctctgggcctttctcttttagagtattctgatattgtttatggaagtttaccaactcttgggcaagagggttatattttcgaataataaaatcaagctttttaattgtggtttcgtttactcgatcaccaccatacgctatgttctgagtcctttgcatgaaggctgtaacagggtcaagaatgtataattgcgaaaaggatggagaaaattttccgggtaaagttgagcctatttgacgagtgaattcaccatttaacaaatagcaaacatttccatcaagtgatgactcacggtatccaaccgaaacggacgcaaatgctaacaatgaattataaacattttcattagacaaaaattccttagctatcatttttcgctgagttcttcaggtatatgcgcccatattatattatcaacattctctgggatggcaagcaaacttgtgtgataaacacgatgggcatgtggaccgccgtatttcttttggaactcacgacattcttgtccaatcattttacccaaaatattttttttgtcaatcaaataatgcaaatggcgaagtttatcctcatatatacgacatattaaatcgggtcgatctacagttttctgacctttatggaggaaattacgagaaatttcacgccaacgcggattggttgtgaaagtgagaaagaatgaaagcgtgcctggtttttttaagcgtgacattattgtggtagcatcataaaat

SEQ ID NO: 4870 - DNA, 7717 bp, Heterodera glycines
tagtttaattgaaattgcggtactttgttcatttgtcccttttcaaacatcaaacacaaaatacgaaacatagcaaagggaacaatgaaaaggggccaaaagttgaaacaaatttggcagaggtccaaccacaaaaatgccaaaaaagcaattcatttcttcagttgaatatttatcacattgatagaattgttttgcctaagggatcgataagtttcgttgattaaccgtaaataaaataattaacacagaattcaccgaacacgcgaaatcaacgtcaaacttgagaattgggaagacaaattatagtaattaagtacataattcagactccttttttcatacaccacgaaatataaccaaaaaagtaaaaattgaagctcaacaacttctcgagctgaaattttaccaagagaacggttcaatatcagttggacagtgaatcagtttagaaataccattttagcggtggtcagctgggtagtgaatatacagtcactggtacttccgggttttgccacccccccccccccccctgaaatatattttttttattttcttttttctagggtaattttaagcgctgaacgttgacgtttatttctttcatgtaactcacgtaaaatacgtgacagcctcaaataaacgtcagattcgtgttcagcgcttaaaagggcgggggtttgcttttaattagctccaaaaaatctcataaaaaataaattttatgatgatttgtttggctccacattcctttagtcgatgtatcgcctcgattcaatattcattttggcataaattgcaccagattttgtctaaagattaaccaaatttagggattttaggctaattttttaagaaaataggcttcttggtgggccggcggtgccgataggcgcctctgggcgaatttggaaatttaagctctattttctaacagatattcaccaaaaaaattaaaacttttccgataaatttttgtttttcttcggtatttttattttgtaattttgaaatatattaaattttcctgatttagtcaaggaaaattgaacttttattccttttttatgggaccataaaacagtattaccgcagtttttccggaaaaaattcataaatttttttttcttttactctttacaattacttcctgtaaattggtcgagctgaaatttttactaggtaggctcttaaaaactccaaaaataggcactaaaaatggaaaataggctctaaaaagtctcaaacttaggggtgtaaaatgacaaaattcattctaaaaggtaaaaaaataagttaaatcagtattggttacagtatttttaaaatcaaaaatttgtacaaaaaaaaattttagatgatttttgagaaaatttttcatttcttaggggatttattttcagaaatttttgagtcgattcttaggggtgtatttttcgtttttaactttcggcaaaacgccaaaataggcaaaaataggctctttcaaaaaattttaggctctaaaaataaaagcctagaaaataggcactaataactcgaaaagtagtttaacaacagcccaaaaaacatgtttttcgtgcgttccaggccacggggttaaattaaatcatcgaaatcgttcgaacaaaaagtcgaattcaaatttttcgaatttcacatttttggttcaaacttgtttaaatgcatgaaaacgaagttaaagtcattagtgcttgaataaaagatcatttaaaccatttttagactaaaaatgtgaaattcaaaaaatttcgaaaaaaggggggggggataaactttactattaccgagaattggctttattcgcttaattcgcgaacatctttttaaaagaacataaatttgaaagaaagaaaataggtgatcagatcgagccatcgactttcactttaaagacccagcggacgacgatgggactgctccggccggactggcatcgtcaccttccgacatgggcacgtcctctgcaaatgattgtgtttcccttggccgtttttcccccacccgtccttttctcaccggattctttgttcatttcctcgaggttgtccagcagaacagcaagagtgtaccttcaaagtttaaccatgatttaaggggagcgcaaagcaccgcaaacgaacatattcttcctcttttcaatcaactgaaaagtttaattgttgtaaattctaggacagggatttccgacccgttgttcgagcatcttttgtttggcgtatgcttcttccaactcatcctgaagcagtttcagccttttcgaagtttcgactctgctcggcttttcctttatgacttatttaaaaaattcggttgttttagtggttactttgataagtttagcgagtgcgtcatattcctgtcggttttttcggatttgttttgcctctgccaattcccttttcactgcatccattttgttgttattttgggtgatcatttcatctgatatttgcgaactaacttataaaaaatgacataattaacaaccaatttcggtgcaaagttgttcataatttgcaatttcaatttcggttatggcggaaatctgtgcttgtttttggaaagaaagttcaatttggtccaagttgattagaattttgttagtaatactaaattagaggaataaagagcataaattttgaattgaatatagccaaccttttcgtatcagcgtttgatttgctcaacataattatcaattggaataattggacaattcgccggtcatccccagtgccatccccatcggcgaccaatttcctaataattgcttcttctgccattaaataatctacaaaaagttttaagggaaaggatttgttttaaaatttcagacgaagttgtcagtatgtccgtttttcagttaagttatcactagagttcgacctttgtcatggatccaggttcaggtccaggccattttggccatttttttggcaacctggatttttgcggttgtttaaatttaattaaatttatttaaaaatatttggcattctgtcttaatattcaaaaaatgcaagggatcccgcggatcccacacaaaaaatcccttaactatatactaagtcagccgaagccccgcccctatttttgaattggcggttaaatgctgttttgttgtaataggaaaaagaaacagaaaattaaaaaatataattggagattaatagagaaaggatgggtagaagagagagtgcagtgtatgtttctctgtcggcgcggatgggaggggtagagtgggtaacgcgtgcggttgtcacgcaggattgaatgcgtgcgagtttgtttatgtgtgtgatgagtgtgtaggagtgcttgggaataaggaggtagagaagaagaggaaaacaatagagagagatgaaaaaggaagcgagagagtgtacagaatgaagagattctaaaggaaggggagagagagaggactgagagagaaagagaagaagagatagggataaagagaagataaaggagaaaaagcaagaggacaattaaagagaaagcggaagataaatagcgattgagaatggggaaatggtaacgatagaaaaagagtgggaagactgagagatgacagagagagagagagaaagagagagagagatgagaggatgggagagagacagagagagagcagggagagagaaaaagagagaagggagagagaatgagaaagcaaagagagagatagagaagagaaagagctaagagagaggtgagaggatgggagagaagagagagaaaaagagagaaggaaaagataaagaaaaaaagagaaagaaagaaagagaagagagaagcagtgagaggtagagcgaagagagagagagagagaaaaagtgagagggtggaagagagagcagagaaagagagaagggagagaaagaaatagagagagagagaaagagagagcgacgggatagagagagagaaagaaagcaggctaagggagagagagaaaatgaaatatagagagagagagagaaagagagagctaaggggagagagaaatagtgagagaaagagaaagaaaatcgagcagtgagagagagagcaaagagagagagagagacagaaagagggagaaagcaagaaagagagagggagagagagaaaagtggagaaagagagagagcgcagagagagagcagagagagagccaaaggatagagaaagagagagaagaagaagaagaaaagagggagaggaagagatcgagagagagagagagagaaagagaaaaaaagcgagcagtgagagagagagtaaagagagagagagagtaaagagagagagagaaagagggagaaagaaagaaagaaataaagagatctaatttgcgaatcccgttgcgggattagaactcaatttttttttgcggaacgggattaactgctaattaactgtaagcatcttctcaacagcacacatttgatgtcacttggaggctttaccaactttgcgaaaaatgcgcttttaacagcccaaaagcacatcgattctgcgcttcatattgaagaggaagatgaagaagaggagcaaaatgaggaagatgtagaaaaggaagagctttctatttctgatagtgtagtgatgaaaagcatttatgccgttgaggtcggtactcattgtattgacatcgaatgattgttgtttcagaatcacgaagcagatggtatggtgagtggtggggacgcagtgccccttccgagtgcagttgctgactccccttttctcgaggtcgatttgaataggacattaactccgcaatctcaatggacaaatgagtcgactggcactatggtatgcaattaaaggtaaaaaaaattatcatttatacaaaagcatcctatcgttgacactgagccgaatccgatccgagacgcacatgagccaaatcacattttccactattcaccctcatcagtatggaattagagggatccaattttttagaaacgaatcttagcactctcccgacgacgacgaaagcagtcaaaacggacagagttcgtcctctcagtcagcgcccatcagctcagccttagacgcttccttgactaatttatacaaggaaaaggtctttgctctttctcaacggtcaattaatgttctttcaattaacaggaaaacgacgaatgtgatgatgatcggagcatgccgagaagggcgtcggagagaacgctggacagatttgaggacgtgagaacgattgcatccagtgacattgaagttattcgccaaatggacgattggtcagttgacactcattttcatccaaataactcaccaccatccgaatgaacaaaaacgggttccgaatttccttctccatttaggtcggtcacgagcagttatccgaacagctcccaccagcagagcaacacacagaaaattggacaaattcggtcaataggagaacttcagcaaagccaaacaccgccagagttaactaccaaattggacacttcagaacaatctcagcgagaaatggacgagaaaattgccatattaatggccaaattggcgcatagggaccaaaagatagaagagttgggcagggccaacgaaaacctgcggacaacgaatgcaactttagtggcgaaaagcaaacaaaagtaattggaattttatttgtcgccaaaaataattttagaaatgcggcggaagcaaaacttcaaagtcaatttgctgagaaagaaaaacaactaaccgatttgctagacgaaggtaaaattgtgtcagaaaaagtttacgattgaaaaacaattcaggacggaaattatccgaatacagcggtcgtcaagcgaaagaagttcgaaagttgaagcaacagttggaacaattggacatcgtcacggctgcgagggacagcgcagttgaggaactgcaagaagcacaccaacagctgcaagagcaagagaacgcaatggaacagttgaggggtgagggaacagagcaagtcgagacgaacaaagaaaacattgttcagacgaactcgaaaattgtgagcataaagcgaggaaactccaagcacaactcgacgacaaaatgacaaatgcgaccaatttggaggggaaagtgtgcgaacaattaaccaaagttgaggcgctaactgcggaaaagagacgaatggagaagacactccaaacaacgagcagagaacgcgaagtgcgacaaaaagggagggggaaaaggagaaacagtgggacgaatgcaacacaattcaggaattggctcaggaaaacaagaaattggcagcaaaactgatgaacagaaaggcacaggatcgaataatcggagagcgagagaggggacttgaggaagagctgagacaggaaagactcaaaagcgagtccgccaatgcgcggatccgcgagttggagcaggtctttgccgttgaatgcttttccagcttttacccaacgaattcagcgcatcgaatgcattcaggacatgaacagagacattgcagttgaatatcaaacggtgggcgaagggggtgagcggtaaaaaaggggtgatgggacagtagagataagagaagaattctaaaaatattatatttaaacaaaattccattaaaaagacaaagttttcttggctctagtgcactttatgagtccaatcaattgacaatacctggtttttatacaataactgttcatgtttgaacaaaccctatatttttggtatcattcgacaacacaaagtctaacgaagctaaaacatataaaatctcaacgtttaggcaattacgaaaaaagatcttattaattaagtaattgctgattatttaggtttgtaactttcttgaaatgttaaaattctcttgttttctcgtattattacattattcagactttatgctttcgaatgatgccaaaaagatagggtttgttcgaatatgaacaacgttattgtataaaaacccgggacataattttgcatagatttcttgctattttagcaaattcacctctgctcatcacaatttcttctttggaagagaaactgcttggattggagcgtgaaaatgacattttgacgcgttcgacgagacaaatgtccgccgaattgggggcaatgaaacggaggcacgaagccgaaatgggaacaatcgaacggagtttggaagaagtgggaatgttattttgtcagagtgaattttgttaatttcaggaaaaacaacaaaatgcacaaaaaacggaggaattggcgaaggcgttcagcgaaagagcgaatattcaaacgtaaaaaagggggggggggagaaagtgaaacgaaaatttaaaaaaaaacagcatttatcattgtcctttacgccaaataagaaaactgactgttcgccgcttttcagtcgtatagaaaaactcgaagacgaattgtcgcagtcgaaaagagagcactcggaaagggtaaaccgaatggagaagagaatggaacaattggagacggatatccaagcgaaggtgtccattaacaaaacaaaagcttactttggctattcatttgctaatttcaaatagattttcagaggaatgagttaaccgaattgcaacgtaaaaactgcgaattccaacagaaaatcattgcatcgactgtggagcgaagaaacaatgccaattcactactcattgtgaacccattggaacaacagcagaaacgaattgacaacgaggacgaa

SEQ ID NO: 4871 - DNA, 2169 bp, Heterodera glycines
ggtcttttggtcctatttgatacaatttgagtattttaactcatccctaatgggtcctcatcttgtcccacagtccaccccaacgctttcccacgcaatgaacggtccaccgtcttcgtccgccggactcgcggggcgacaatggaaacaatgccggcggtggtggcctcatcgatgggccctcggcggtggtgccgctgcgcatcacttgggcgtcccgtccgcaatggtcgtcgtcagttcgaccgccgcttcttcggctggtcaaccaccgcccacctacaacaacaccaacgccgcaatgggcggcggcgtgggtcagcacagaatgggaccgcacgggcagtcgtcgtttgtacaaccgcagcaacagcaaaacacgggcggagggcaacaacagcatcaggtggacaattgaatgttcggcagggtcaattagttgttaaatttcaattttaatggcactggcaaatcccagcgaattactgaccttaaaaacgggatgaatttgttgcctaataacaacagcaacaattagggatgttcccattgcgtgtttattatcccacaattgttttttgaaagagaagattttctcttatttttcaatttgttctttttattcccattttcagccaatgctccaaggacctccgatggactctcatcatcaccagcaacaacaggggccaccactgcccatgacaattgctcagaggcagtccgctgctgtgcagcagcagcagcagcagtcgtccgccaacccaaacgccgctgggggtgccatgatggtagcgcagagtccgcttggcgccatgatgaactcggtgagcggggagggcattttttgcattggcacgagatactacgtatgaataaaattggcttaaaattttaccaattttattttcataattttagcagcagcagtcgatgaacaacgcaaacagcggaggaccaccgcaaatgcgcgggggtggcattgcgcagcagcagcaaatgctaggcgcggggggcggcgctggacagccgcaggacccggagaagcgcaagctgatccaacaacagttggtgctgctgctgcacgcacacaagtgtcagcagatcgaacgggtcggtggttacaaaatttatatattttttatcccttatttcctgggatttcatttttacaattgattattattttcccataaaatctctattttcagtctgaactgcgacaaaaccgtgcgccctgcacattgccctactgctcggtgatgaagggcgttttggagcatatggtcggctgttcggccggccggcagtgtcagtacgcgcactgcgcctcctcccggcaaatcattgcgcattggaagaactgtaacaaggacgactgtccggtgtgcaacatggtcaaacggtacaccaccggaacagcggctgaccggcgacaaggcatggcaaaacatcaagaaaattttaatttaacgcaataataaatttccgatttcttgttggtaaattgctcccatttagctgacattatgctgattgctgtcggttttccctctgtgactttacctcagcaaacaatccaaggcgcgattggccaacaggtcaatttaatgccagaaatttaaataattaagaatttttatgcgtggacttggcgcaatcaattatttccatgaaatttatgacattggctcttttccagcaaccttcaagttcggcaagtgcctgcagtggaccgtcctctgtcggcatgaacaacacttctaccggtccgtccgccgctgtcggccccacaagcgttggcagtgtcggcggtggtccgatgagttcgttcggctcaccgccgtcgacgagcagtgcggtgaacaatttgctggacgggtacacaccgaacacgttggttttttgatttttaaattatttttatatttatttttcgaatttccctaccttaggaatccctttctgtccatcaatccaccaaatcgggtcggccaaagtccccaccaaatgggcgttggcgccccctcgcaaatggtcactgttgtcggttttggcacttcgggtgacccattgccgccaccggagccgcccagccaaccgcgcgattggcacgcctccatcacacccgacttgcgcacagcggggggttggcaagctggtcaaggt

SEQ ID NO: 4872 - DNA, 1936 bp, Heterodera glycines
  misc_feature (1769)..(1769): n is a, c, g, or t
cccccccccccccccctccttatcagatccacaaatggtgcacccaactcagcgagctgttcgtcgaggagatcaacccgttgatgcgtcggatgggctatgtttgcggccagaagttgtccttcactccgctcgtccagttctgcttcggcatcaccaaaaacaatgcggcctgtgtgatcgcccgggaccagccctacttcatgtacgagagcagttcaaccggttttggagtgacggtggcggagcgatacatttgtaagcgtttaattgcttttaaacctctttaattgcgttttgttgtctttctttagactgtgtgaagtgtttcgaggcgttgcccgatgagggcattaatctcaacgagaacacgccggacccaccaaagtaaggaaacaatgtttttcagtttaaattatttctaatgcccttttcccttcccaccccatcaacatcaagctggataccaaagccgatgttccagaagatgaaaaacgaccagatcgacatggagccgtttgagcaatgccaaatctgcgaccgaaaatggcaccgaatttgcgcacttcacagcaacaaaatccacccgggcggcttcgtctgcgagcagtgtcgggtcgagaaaaacagaacgcgacaggagaacaaattcaccgccaaaagtacgttttttggatcactttggcctatcaaatccgatggaatgatcgtttatcattcaaatttgcttccagaattgccgcactacaatctgagcaggcacattgaggatcgtgtgaacaacttcctccgccggaaactcaccgattctgaccccgaggtggaagtgatcattcgcgtgctgtgcagcgcggacaaagaggtggaggtgaagccggcgatgctcaaaaagttagtgaaatctaactaacattgctaaaattgctcgaattcaaatcattattttctcagatacgcctccgagggctacacggaccgctttccctaccgttccaaggcggtgttcgcatttgaggtggtcaaagaccctgatactggtgcctcgcacgaggtgtgcttcttcggcctgtacgtgcaggagtacggcaccaactgtcagcagccgaaccagcggagggtgtacatcgcctaccttgactctgtccacttcttccaaccgcggtcgctgcgtacgtcggtgtactacgaaatactgctcggctatttggacgtaagtttgcgtgcgattttatcccatggggatgctaatgaatttttcggtcttactcttcgaatttgctatgaaatcatgttactttacaataaaattattttagtatgccaagacattgggctacacaatggcccacatttgggcatgtccaccgtccgagggcgacgactacattttccactgccacccgccggagcagaagatcccaaagcccaaacggttgcaggactggtacaaaacgatgctgaacaacggacagatggagggcactgtgtacagctacaaggacatctacaaccaggcgagagatgacgggttggacacgccaatgaagctgccctattttgaaggtacagctacaaatttcgcaaaatttgaaaatgtttaaaaatatggccaaaactggcaatttttccggtgtttttccactcagtggttctattgacaggtgattattggcctcgcatcatcgacgaatgcatcatcggggcggagaaggaggaggagcaggaaaagcggatgaagcagcaccagcagttccaatcggcggaggagnggcggcggtatcggaagggcggcggttccgcggcaaccgcctcactgtccgacgacgacactttccaaacggacgacggctttccggtggtcaaacagaaacaacagccacaacaacagcaaaaggcgagcagcaacaagaagaagacaacctgaagaagtcggcgc

SEQ ID NO: 4873 - DNA, 1758 bp, Heterodera glycines
gggagcaggacaaaacgtcgccgccaaaattttttaaaattttatctaaaaaatttatcaaaaattttttaattacctagcctggttcggaaaaaattctagaaaaattcgaaaaaaaaatttattaaaaaattcaaggaaaaaaaaattatgttttttcgattttttcttagaaatcaacaattttagtttttattaacacttagattttcagaaaagctaaaataatttttaattttcttaaaattttgaaaaatttttaattttttttgctgcgacgtttcggcggcgacgttttggggtgtacccgtgtatgataagaaatggcccccatttcagctccctctcctcctttttaggactacgacctgtgcgaccagtgccgtgccaaaacagaccatccgcacgaaatggagaagctggtgcttggcgacgaccagaagtcggcggacagtgccgcgtccgcggcgtcgcgcaacgactcggtgaagaagtgcatcacttcgttggtgcacgcgtgcatatgccgagatgccaattgtcgtcggggcacgtgccacaagatgaagaaggttagttttgggtcaaatgggacccgtctattcatttgacaatgaccgacccttccctggccaatccgtacggggcaactattttattatgttttaatttccctcattttcaaggtcattcaacacaccaaacactgcaaaaggcggcaaacggtcggctccaactgcgcggtttgcaagcagctgattgccctgtgctgttaccacgccaagcattgcacgcaatcgaagtgccaagtgcgtcttgtgatgccaccaaggctatttatggggacaatttaaagaggccaccctcgttagcggcgtttcaatatgccccgtttcatttttaattaaatgacttttcattgccattttaatttctaaaaggttttgctaagttttatggaattaatttacaaaagtaaagcttttcataggttttcaaattttcttgaaaataaaaacaaaaatgttcgatattttttactaattgtaagtgtttatgttttaatcctaaatcaaatttcgcaggtgcccttctgtctgcaaatccgacaaaaactgcaggagcagaagcgttcacagaatcgccaggcggagcggatgatgcagcgacggatgatgaaactgcaaagtgtcggcgcggcggcgatgaacggcagcggcggtgccgccaccgtcacgtcccaaatgacgtcatcagtgcccactccgtcttccgtctcgtcggcgtccatgcaacagcaacaggtggtcgttttgggcgtgtcttttgcatgtcggatgggattttttttttgagtttttctacggctgttagctgaaacctcccaaaaaaatagctttattaaaaagttggcgatcctcaactcatccccgtctattttttattgcgtatttttcttcagcaacagtcgccgtgggcacagccgcctcagtcgccacgccaacagcaaattggcgcctgcggactacagcagcagcagcagcaaaccgtttggtgcgccgccgatgcaaatgtcgggcatgatgatgtcaccaaatgcaatgccaccgcagcagcagcgactgaacggtccgatgggcgcggcagcggcgtaccatcgtaagtttcacaattggctatggccctattttcagaataaaaatcattatcacagaaatgacacaacgatgggaggccctcatcagcagatgatcaact

SEQ ID NO: 4874 - DNA, 1921 bp, Heterodera glycines
  misc_feature (1911)..(1911): n is a, c, g, or t
aaatcgctagaaaagggtttcaaaaatttgtttttaatttttttgcgagttaagcgccagtcactacaatttttgaccaatgggccgttcttcattagtttattgtagttttcttcaaaaatgccaaactgaatgccggttttttggtccataactctcgctaattgtgtccattggcagggccctgccggacttcaccgtgtgccgtccagcggagcgctgcagcagcagatgatgtcgcccaactcgcagcagcaacagcacatcactccgcctccgtatgttcgaagcgccgccgccgcgcaacagtcgcctctccaccaccagcagcagcagccgttcgttggtggaggcgttggagcagtgcaaccgccgggtcagcagcagcaacaccaagaacgctttggcaccgccggagcccaaccgcaacaagtggtacaacaacaccacaccaaacagcagcagcagcggttgtttcaacagcaacagcaaatcagaggcaaacaaaaataaaataaggaggagaagtccacgccaattggctcgactgggcaaaatcggcctgttttccattttttaccaaatgtccatgtaatttgagtttgatccgtaagtttagtgctgggccatcaagtgatgaacaataacgatatgcagctgctcatgaatcggttcaaggaggccagtcaacgggggagcaacgacgaggtggaaagatttttctcggacttgcgcaagacgccccacatgttcaacgcgtttttgaagctgaccaaaaaagtgacattttcctccctcttattctcttactcctagggcagttgtcgttttaatccccacatttgtgcccttttttgccattcccttcagcagggcgtctgtatatccggcgatccgtttcctcatcaacatcaaccgcaaggaggtgctgcaacacaaccgcagcaacagcactttgtgcagccgcagtcgtccttctaccagccgaaccaaccgcagcagaacggtggcaacattccatcgtcacagtttggcgggcccttccaacagcaaatgccgtcccacggcgccggaacggcgcaatggatgcaacccccgaaccaatcgcagcaacagtccgccgcctcccaacggaattcgtcctgacaaatgagcaataactgtttgatggatgaagcaaataaatgttttggcggatgcccaacgacgaaatgatctgattgtgagcagctgatttagttttgtttttttgtgtttcgaattatcccagctttttttgttcgcttcgaaccttaggcatcgtcattttttttgtgtgtgtgctttttgtgtactcactcttgaccatttctcatcatttttcatacatataccatttcactctatttcattttttaaattattattattattactattatattaaatcactcacttatattacagatgtcatttattcaatcgttcatttttcatttccaatttgttggtcgtaatcactcgttgtctctttctctctctcgaacaacgcttatattattattgttttacatatgttcatttaccacctattttttgttcgttttgtgcttctcattgtttctttcatttgtcacaatgtgatagtgttcggatagagtaaatattcctcttttattacgccgaaattaccaacaacaaacaaaataaataggcattaaaaattagttttacaaaagtgtgcccgccccccccctcccccttcctctgagaataataatggcttaaaagaccaactgctgctgtttggacaggttgaacttcttcttctgctggccttggtgtctcccccggttttatttgtgaatgttttgctgcaatttgatccattttacagaatcgttttgtctatatttttactccaaccaatgntatgcgacct

SEQ ID NO: 4875 - DNA, 867 bp, Heterodera glycines
ccaatacacacatataatataacatatgcattgtattcattcgtcccttatttcccaatttcgccatttgtttgtctgttcactgcccctttttctctgctgctcccccaatgtttttgcgttgcgattggccggaagccgtcgcgcgatctgtgaattttgaataatcaaccgcatcattatgaacagcgaattgatgtttaatttattttgtcttaataggaaacagttatcatttcttttgtaacaattaccgtatcccctccctccccaacggcaaattgtggtgggtactgtcgccgttggccacacaattttgtcattttgtttgcctttctcaagacgaatgctgtactttcttcgaaagggaaatagtgtggtccaaattagctgctgaagggtgattagcccgacttaattaggcaattaactaattggtgataattgcccttccctccccctttctccccctcttttgcgtgtgtctgctgctccctctccctcccccccccactcattttgctcacctcttccttttccgcctccattttttgtggtttgatcaatgatcagcccatccgttattcttcttctgatcacaaatatttctcctcccattttccttttattcaaattatttttatgcatatttcattattaaatttctccagattttattgtcacataacacacacaccaaccaacttcaaatgctaaatctcctccaaatacctgattatttgcttatttgatgccggccgtcgattggtcaattgatatgtgtttttatatacaatatgtattcattcattcatttctcaagaaagataaatttcatttcattttgaggaacacttgggcatggat

SEQ ID NO: 4876 - DNA, 6380 bp, Heterodera glycines
aacaacgagaggacgcgcaggagttggaggaccaacagatgcgacagcagtcgctgcacagcttcatcagtgcgtacaagccgcgccagcaatacaaacactcgctgaaaatggtcgcgcagacgaacggcggggcgaaagacgcgaaagcccagggcgacatccaagccatatgcgacgagcagaccgcgtactgcaaagtgctggtgaaggtggagcgaccaccaatcggcaatgagaaccaaaaatggatgctgaacgcacaagcgcacgttttgatgccggagaccgccgcatcagtggagcagctgcagacacagcccaagcagttgaagcagttcatcgcccaggcgaaagcccagtggggacagcagggacagcagacgcagcaggtgaacatccgcgtgcacggcgcccaggcgcacacgcagcaggtgcgggcggtgctacagcaacaacagggcagccaactgatcagcgcgcagcatttgcgcaacatgcaacgccgcagcgccttcctgaacaaattccaaatcgaggcaatttactcgctgaaagccaacgcccaaaatgcgatcaaccgcgtgttggagctgttcaaatcggcctacttctggaacaccaaatcccaactgatgagcggacagagtgcacagaaagacggaaaggtgacgaaggcattttaggcattttccaccgccgaattcacagatcgccgccacaattctaatcgacccggtgactcagaagagtgccaacattaccatccgaacgccggcgcaacagttgcgcatggagcagatcgaagtgccgtacaaagtgcgccctttcgctttgattcgccagcggagtgcgcaacagacgcattcgctggctcagctgttccaccaattcagcatcaaataccgcccccaatgcaccgttgacgggcgcaaagtgaacactttcggtgagtcagcgttttggtgccggacgacaaatgcaactttttttgcttaagacgacttgatctacacggcccccctctcctccaattgttactccgtcgtggccaaagactgcggctcagaccaaccccaatttgtggtgctgatgaagaaggtcgcgcagcagcagcagcagcagacgaacaaaagggcccaaaacgcggctaaggtaaacgaacccatccaaaaacaaaaaatgacagaaaatggggaggggacaaaagatacccaatgaatactgacaaacaattaaccatggctaacctgcttgaaggtgctgaaagtgatcacgccagagcagcaaatcgaatgccatccgaagacaaacgccgctggcattccaacgcaattgatttgcaaagtgaacggacaacaggtcaccggagatgagcagtgccaggacagttcttcatgtgtgcagttcaacaacaaacagcaggatgacgtgaccattcagacggaggcaatcgcagtgcgtttcaacggacgcaaggcgtggctgaaggtgtcccaggcatacaaaaacacccaatgcggactttgcggacactacgacgactcggacgaccagggggaggagctgcgcatggccaacggccagagaggtccttagcaaacccaaagcagcgactttgatgccaacccaaacaataacagattcattttttgctttcagcttccgacttggccgagttccaccgctcctacgctttggaagacgcggaagaatgcccacaacaggtgatgaacaacttctacagcgaacagcagcagcagaacagcgagcaggacacattctacgggcagttcaaccaatttgaggacgaagacgaagcggacgatgagcagcaacaacagtctgaaaaggacgaatggcagaatgagcaattcaatggccaattcgaggagcaaaacgatggccaagtcactgacggaggcaatccgttcgaaggaattttcaacgaccaacaacagcagcagaagtgttgctgctgctgtgacgacgacgaggacgaagagggcaccaacgaacagagccaatgccgacaaaactgccaaaacggcggggaatgcccagagaagtgcaacaaaaacgaccaaaagcaatgccgaaagtcatcgccaccacagccgcaacaacaacaaaattgcaaaggcagcgacgacgagcagtgcaaagggatttgcaacgacggagacgaagcatgtgccgagcagcagcagcagcagtggaaaggtgggcatgggaagggactgttggcctaatgctaatttgcatttgactgttttcagcagtttggccgattttgagaaccaaaaccccacgagcagaaccacgcggtgtgcttttccacccgcccggtcaaacactgcccgccggatgcctacccgtacaatccgatgaacggttatgagcagcagcagcagccgaagaccaagaaggtcagcttcgtgtgcatggagcgggcggagccggagacgcgtcggctgttgcgctcgttgcgacgcggacagcgcgtggtggacgtaaacgcacgcggcgcctccttcacggagaatgtgagcgagccgcatcagtgctggcgcagacgctactgatggaagaacggacgatttggtggatgacagaggagtgaccccccaacggagtagaaaagcacaaagcgtagaccaacccaaacacaaaacaataatcaccctctgctgatcaatgccattactcaaatgatcagcaccacaactccgccatttcctataacaaattgtatttttgtaatagtttagaataaaaaatttattaataatccaattatagtgtaacaatgctaattagcagaaatgctgtgaaaatcacagtagtggaggacctcttagcaatagcaaataaacaaacttttcctcctaaactgcagactttggtaataattttaataataaaatatgatcggctaattaattggctgcattgattgcccgtgttaaactgccggtgcctgtcgttgctcaattccttggccattgtccactgtgcctgcttcggctcagctggtccagtccgtttggcattgcccctcccaattccgccgccattccccccgccgttggcatttcgccgttgttcgcctcctcctccagggcccattcctcgcgcagttcgctcgacacactggcgaatctgtggcaattgttgcttgtccccaaggggtgttttgctttccctatttatttattgtacaatgagtcccaattccacggaatgttttcgtccgttgtctcatcctcggggcacagaaagcgcgagaggaaattcacatctgttgaccagagaaaacaattattgctgctgctgtgctgctcccctctctcttctaccgatttcgcccccaaattcgcctctttgtcctccgccgtctcttttggcgaagttgtggtccgatgcgtagctaatgccggacagacggcgcaaattgatttggggagcgatggccgcctgttcactgagggcaatctgcagcgattaatcaattaattgcttgcagaaggacaattagcccaataattagtccgatacattaaaattgtttcccggtgctgtcaaattttgttgctgttcaccgtccgccgattgtccgtacgtcgcctccgtttgcagcggtggtcgccgacccgggaagccaaaaaatagcatgaactattatatcactcagaagcctctcgttattgcctgaaaatggccgagtagcggtggaagagacggcgccggtgctttgggagtttccgttgccaattgcgctgcctctgacatttcaatttctgatcatttattttcattctgatcaatcaatgcctgccaatcgctgctccctgctgctgattcgttctgctgctgaccattgcccccttctgctgttgatttgcgattggacttcgcccggtgggtgcgagacgcggcggctgctgaggggggagaggggacgcgccatccgtcgaactcggcatggtttgactctgcgtcggtgccggcgcgttgcggtcggactgcgcttgcgaacgtcggaaaagacctttcgccgttcagatgcgttaccacttataatctcatggaaaacaaacgactcactggacaatggcctttttagcgtttctttgagttcgcttgttttttgttctgccgatgattcggcacctccgccgacccctttaaaaatcgcactcatcaaccgacttttcggccgttcttcgcccgccgtaatccgatcgcgttccttcacacgaacattcaaatccgaatcctctaaataaaaatatttttgtcttcatctcccattgacactgatcagaaaccctcaaaagtttgatcgggcggttcgagttgtttttgctgcggacgtccaaatcggcccacacttttggaccgactgacggggcgtgccaaatcatcggccatttagattaaagaaataaaatcaaaatttgctcgtcgtttttatgtttattcattgtcgattcttaaaatcatttctgctgctgatggtttccattggttaccattttccattgctacaaaaattgttgcctaattcagaaattagaatttactgatggcttcgaattcggcttctatgaacgaccaacagcccatcccctctttcatgaccaattttcctgtcagtggccaacaaaaagcggcacttcaattcgccttttacaacactttactcttttcgctggtaaatgctattgtttctgtctcaagaaggtcagaaatgccaacaaattcagctcggaatttgtttggccagcatttttgcggtctatcgacttttgtacttatttctgatgccaatgttatgggctttgttagtcggcactgtgcttttcccgctcaaacgaatgatcagcgaaggcttaaaaggtaaaatatacctaattgagtattaaattcaatccaattttaggttggctcgatcgtttggatggtgaaaatcggccccttttggttggcctggcatttcttcccgttcaaatcactttgcaattttctttcgccgtttatgagacggcactgaggttgtatttttgctgactttctcccatttcaattgtcttcagtttcaccggcctttgccttggcctcggttatttcgctctgaaagtcctttgccattacggcgctttctcctctttgctccttttgatcggtcgaatttacggtttcgccgattctctcatcgaaatttccactcggaattgggtcgttttccttttaattgaacttttttttattcctttttaggtttttctgctgattttctgttattctttggggcttggcggttggatttatcttcacgaaattggccaaattaacaagaaattcgcgcgtgtcctttccctccccatttggtttttcattcatttttctttcatttcccttttttaggttttttctgttggcttacctttccgatttcttcggtttttttcgtgttttcattttcattctctgctgctctcttctcgtgttgatttctgccggattaattggaacaaatgccgaaaatgaagacgaaaatcaacagaaaaagcaccaaaatgaagtggggaaaattatggattttggagggattctgagaaaagacaaatgcacggagaaataaatataaattagcatgttaaaacaggaagagaagaatgacgaagctgacaccgaaactgagcaaagtcagcgggaaaatggcaatggaacgaatgttggcactgcgctgggcggcgaagcgcggcttgaccaggtgaagcggtggatttcattaaattggtttgatttgaatttgttatcccccaaaaaggctttctcctccgacgtccatttgcgtgtcattggcggactgtgcgctttgctttgggtggttaaccacgaccttttgctgtttttcttcgtcattattccttttgccattgcctttgccgttcacttgggtaattttttaatttttgtcaaaatttcttcgcatttttaggtgcacaaattggcctttttgcgttcattttgcaacatttgacgcaatgcaaagaacaaattgtgcataagactattaaatttgtgcatgttattgtggcggggcccctgcgaaaatttgtccatttgcttttcaccagcgaccgaatggtcatttcttaagtttttctagcagaacggttgattgattcaattttccaattttttactcaatggttttcagtttacaaattcttttttcatttttgtttttccatttttcagtttgtcattggcttccgcgaccgcgtcgatttgctttcttcgctcattgtcatggccattttggccgtcggatgtctctttgcgttgcttttcaccctttttcaacttca

SEQ ID NO: 4877 - DNA, 1351 bp, Heterodera glycines
  misc_feature (99)..(99): n is a, c, g, or t
tttattatgcttactctatttgcatttgctgttttatggcaataaattcatctcattattacaattaaaaatattttttcgaattgtttttgtttgggngtttcttccactgcgaaaaaatcactcccttccccccctcatcagtctcggctttatttagtgtaaataatggcgttttcccagacggcccatccatcttttccgccccaggccatcggccaagcgacgatcgatcggccgacccggcggcgattgcttttgcttcggctttcgctcctttcccccccccccggcgccttccaattccgacgagagatttcttcactcaatgtccaattcatctgcataagtcatttttgaaatgaatgcccaattaaagccaatttcggcttttcgttggctttttttgtgctttcccccattaattacccccaattagggattgatttccatgtcccttctctttggtccccctctttttcttcactgttgccttttccttctccgttccgccgtttccgtccccgcggtgcccaaatgttcgcagcgattgttcgaagcaaagagcgacccgtcgccgggctctaacggctttagcatcgaaattcgagaagcgcccccggggatggacggggacagcgacgaattgcaggtgaaaaacgcaacaaatatttttggcattggcaaacggaacgccaacgaatgccaatcattcgaccattccgcaggcaatcaaatggaatggcacaagtgaacagcccgagggatatgtgccgggtcgaagttacgtggtcactgtgcgcggatggtcggttggatgcaattaattcattaattaatgtttttatttgagatggcacagcgaaaaaataagtgaattttcaggcgcacccaattcatcgtgcagacttttcgcggctttggcattaccgcactttttgaacagaatggaaaagctggagggaaatttgacattaagaaggtgaaatatctaattaatattaattaatttgatcagtttttgcttggatgtgtaccgtattaatccgtttttaattccaacatacggtatcatacggtattattctgttcccattcgactgctgttactcattgtttaccgtgatgttcttctttcattttcttttcagaaccgtcggacgcgtggtgagtcgcgagttgcgcccaattgtcgttccgccggtgtctcccacacgaatttgaggcccaaaaccgaagtcagcgttctgtggcgcgcgccggagagcggcgccggcggttgtgtgctcttccgcgcgaccgtaatccaatcacggcacatttggtattggaacgaaaacgaaagacaaag

SEQ ID NO: 4878 - DNA, 5250 bp, Heterodera glycines
ctttaatcgactttccgcccatggacaccgaaagttcccacatgactcgtcgaactgttctccaacagctcgcctccgtttttgaccctctcggactagtgtgcccggcacttcacgatgccaaaatgtttttccaatcactttgggaaaccaagcttgactgggatgatcctcttccgactgacaaagtgcaagaatggaacacaattgccacgacttggaaccagcaaaaggtccgtgtcccgcgccgagtcaccccgttggaagtggcctctcatcagctacatgcctttgtcgatgcaagtaaagatgcctatggagcatgcatcttcattcgggcacaacatggagtcgcgatcacggcccatctcatttttgccaagagccgagtgaagccaaaggggtcaaatctcactattccgcgcatggagctcatggggatgctgattggcattcggatgcttcaatttgccgaaaaacagctcggacttgccattcgccacaaattcatttggtgtgactccaaaccagtccttggttgggtgtcatcttctgagcagcaacctcgttttgtggagaatcggctaaaggaaatccgtgccgtcgaccaagttcgctttcgctacatatcgacagagcaaaacccagccgatgtcgcctcacgaggatgtactgtgcttgaactcacctcccatccactctggtggaacggcccaagttggcttatccatcccgaggatcgttggcccatcaccatagaagtcaagcctgccaatgatgacgtccaaaacattgctgagatcgctgccatcgtacccattgtccaaaaggacgaagcatggatttgcgccgacagattcagcgactggacttgccttcggaacgtggtggtgcttgtcctccgtgcccttcgtcgatggctcacaatgtctagcaagcccattatcggattgtgctcccgtgtttcggcctgtggaccaatccaagcaagcgattttcaactcgccgagcgtcttctgatcgaacttgcccaagttgactgtaccgatttggccaagcaaaggcccgaggtacgccttcgcactgacgaacagggattgatccgccttgagaccagactcggcaactgtacagcaagtgatgactggaaaagcccaattctgcttccggaccagtcaccaatcactctgctgataattcgagatcgtcatgagaaggtgcgacactcaggagtagaagccacgctcacttcattcctggagaaattttggtgccctaaagccaggggcacagtgaccagagaggtcaaaaaatgccttcgttgccgacgaatccaaggcccggcatttgctctgccagccatgccatccctgcccactgatcgtgttgtgcgatctgcaccctttgagcatgtcggcattgactacttgggccctacaatgacgagaatcgtgaccggtccaaccaccgcggcacataaggcctggatcgtgctgataacctgcctggctactcgtgccgtctatcttgaaccggtcctggacctaacagcctcgtcatttcttctcattctgcgccgcttcacgtgccgacgaggcgtgccaactcggatccttaccgacaacggaactcaattcgttctggcatccaaagtttctgcggctctcgaagccggcagagtgccaacttcagcactggaccgatttctggcacgagaggcaatccattggcgttttatccctcagttgtcaccttggcaagggggagtctacgaaagactcgttgccttggtcaagagctgcttcaaacgagagcttggccgcgtaatgctctcatgggaagagctggtcacatacacagccgaagttgaagcagtactcaaccaaaggccgctctgtcatgtctctgaagagcctgacggaatcctgccactccggccaattgacttcctccttccaagagcaaaacttggcattgcgttcaatgccgagactgaaaatgaagagttccgaatctcttcaaccaatcaacgagatacgctcatccaacgttggcattccgtgtcatcatcaatcgaccatttctggaatcgctggcagaaggaatacctgctgatgcttcgccagagattgcagtggaagttcaagaaacagaggaaccaaattgcgcgagagcccacggaaggagaagttgtgctaatctctgaagaaaaacttcctcgcaactgttggccgatgggacgaattgtcgagttacaacgctcacacggggagattcgaaacgccaaaattcgattggccacaggaaaagtgctaagccggcccctaaatcgtctttatcccttggaagtggcttcctctgccggacaagatgagagccaccagcagctgacaaacccgccgcttgaggaacatcacaaccgaacccaaacagcggactcaactccaatttgccaactgcgtgcccggcgcaattcacctggcccgactcattctatggtcactcgctcaaaaaccaaagcactggcctccgttctgtccattctgatgtgcctatttctgattggcgcttcccaaaccaacgccagtagcacgaccaagccaaagcgtgggaaaggacttccaattcgttgccgtggatgcgaactgacctgcacaaaaaccggcgttgacatttcaataccgaatgggattgtcaaattcttgctatgttgtgccggtggaactcagtgcatcactcaatcaggcgttcggaaatcctttcatcgtttgcccaaggaacatcttcttttcgactacgattgcgaagcaatgtactggacgaaacggggcaacaaaagaatcgggagcgtccaatgtccaggcagagatgcgtgcgagctcatcgattgttgggtgtgcctcgaacgactggcaaatcctgattgtcgtccagatgtgaccttcggactcattggtggagcgagcttcttcactttcctcttccttttctggattctgccactgatgtgccacgtcaccatgttttggatcctacagcatcttttcaccctgctcgttcgcttattgtgttgtttttggccaagccaaaatgcaccgcagagagaagaatcccctctccttgccttccaaagtctgcctactccgcgcaggcgccaaatgagtcgcagtcgttttcgtccttttccaaaacttcaaacgacgctcctgttattgaccctatgtgcctttacttcatgtgccagggcacaagttgtctcaatcactgcctctgctgagaaatgccaaaggtccgactttggctcggtgtgccatctcgagagctcgacaacagttactcttctcccatcgggtctgccggtacgtctactccttcgacatcccgacgagagagtccttggcacgcttgaaatcagcatgcgctcactgactttgcattgcctgccaaaatctgagcaatggcttcggtcctatcacattgagacagtttcggtaaaacggtgcccgagtcgtggaaattgtacacgcgagttctgcgatgaagtcaacaacggaaggaagacagaagttcatgagctgagcgaatggaccaagcatcccggattcaacagatgctcagcatcttgctccttttggtggtgcgggtgtttaaatgccggtgccagctgcatcttctaccgtccacatgccattgctaactcgccaattgtctacgagcaaatctcctgtcctacatgggaataccgcttgcgcacttcactcaaactgtcggtcaacgcaaacttcacgaaagagccgtccgtgtcgctcacacccggcattactttccgttggaaggatttgagcatcacacctattgcctcttcggttcctccggccccaatcatggcaaacaagttcctctcggatggcaataacatggcaatcagtgatgaaatccaaagtgaccttcaatgccccagtcgtgccaatgccaaacgcctcaactgcacactcagatggggctcatgtccgatgtgcctgcctgaccacgattcagcaaaaatcaactgccaatgccgagatgtcaaactcgaaccagcactcgccgatcctgagaagcgcctaccaattcagctcaaaaacttgcttctccggaacgaaaggcgggacatttttgccgaaatcacctacgcgccgattcagttgtccattcaattcgaggggcttcgaatcgctacggaagaagacctcacaaaatgccatgccatgtccaagggtcttttcgggtgctattcatgccacactggagctcatctccatttgcaatgccacaccgacttcggttcagcacttggctacgttcgctgttcggatggcacagaattcacagccctctgccacaaaacaccagaagttttgaatgtcagcctgtcattcaaccgtgccgaggtcgacatcaattgtaccattgaatgcagtggaggacggaacccattcgtgattaatggtcatctccgctatgtgccaaaacacttccaagcacctaatggaggaagctcatttgcctcgaaggccaaacccagcaactcatgcctaatttggtgcccagattggaacttcgacttttccgatgtcttttggtatttctttggcctccaaaatgctctacgaactgttggcatcatcactctggcccttttcatcgtctatgtccttttgcgttgcaaccctgcccttcgatcttggagagccataagccgagtcgtcctttgttccttgctctttggcctacgactgattcttctgcagcgggagggctgagccatctactcagcattcaaaattcagcaccaaagctgcagtttgaaggccatttttcggtgtcaagacgtgtgactgagactctcgacatttttgatgcacaaatcgggaccattcatctcgccaaaaaccaaaaatcgccaatggacttcgctataaaagccgtctctgtgccagtccattcaccattcctacaaattcccgaatcggccttccacattcaaacccaagcccaattccctccatttccaatggccacactgctatctttcctcgccaacacaatgaacatcgaggtggaacgctttggtcttgccgtgaccacatcgctgagccgttggaatgaggcccgaacaatcgttgaaggactgcatgaacgcggctacgaactcaagacgaggcatctgcacccacgtgagcgaaatgtgcgacttcacggatctgagct

SEQ ID NO: 4879 - DNA, 1185 bp, Heterodera glycines
gcaggtcgctacaacaacaaatcataacacaaaaatagaagagcatagtcacggaagtaacaatcaaataaatggatgtaaagaacaaataatatttatggtagatataaatttggtcacccgccgaggtcggatggtaaatgttttgagtttgaattgcaggaagaaacataatgatggcagtgcccaacgcgaacagtgctttacagaaattcacaaagcatttagcttggatttgggaggcggaggtggtggcgccggtgccctcgccgcgctccattcgtccggcattgtgccagaagatgttgtagttgcgccctggggcgcgctttcctcttcggccgccgccgctgtttttttgtgccatttttgttgttgttgttgttgttgttgttgctgttgcgttcatcagtgttggaaagaataatttttgctaaactatggtaagagattggcataaaaattcaccctgccgtatgggtggtctagaagatcccctgacagatgtagaacataaaaggtaactcgcccggtgggactcgaacccacgactccagcaatccgtgccgtgctctatctaaccaacagagctacgtaggtcctttatcccactttctcccgcgctccgtaccttttggcatcacacagacgcgtaccagaaaaaaaaattttgggtcgggcacccgaagagcagtgtaattttccaaatttttggcgccgtgtgaaaaaaacggtaattttccctaagattagggctctgaccggctctagtttcttgttgtttaaataatttgaaaaaaaaagttcaacgtagattttttagaaggtttctaatatagcttaccattataaatgtgcacagctttgttcactattttggttaaacgattggaaaatgtgtcaacattttgtttgtttccgtcgcttagaattccattttttgcaattttttccttgattgaattttcgtcaatttttggcatcacaatttgatgttgttcaacttttgctgtttcaattgcttcttcaaattgtttaccactgtttatttcgttacaaaaatttttgagcaaattttgctgtttgtcatccggtttaaattcaaatttggcattacacaaaatgccaaacgattggttcaacaatttgggtacttccgggttttgccacccccccccccccctg

SEQ ID NO: 4880 - DNA, 3916 bp, Heterodera glycines
  misc_feature (978)..(978): n is a, c, g, or t
tctcttcacacatttgcaagaagtattcacgtcctcaattatataaatgttttttatttctattcttaaaacttctgagttcttaaatattgtattaagttaattcctaatgatcgcttcatcaattatgacatgagccagagttcgttctcagtatctgtagtaaatttttaaaatattttcaaattcactttatttctaaatagtaattttctttgtgtataatcgttgaattaactcataaacaatttataatttgataagtgttgtttaaatgtcttgataatattaattttatttaattatattaataataaataattttttatttgattcatgagctgttatgtttttaatctcattgcgtttaatacattttttatttggtttaaaaatattaaattattataattcaaataaaaaaattaattcattttattgatttaaatgaaaaaattgcatgtccttttctggagaaatcaaaaaaatttccttcataatagttagcagcaattaatattcaataacttatcttctaaacattttttgtttaagtaagacagaagaaattttattttcttttggaaattattttgctttctttttatccattaaattatattaacttgctaacaatacagctattgttatgtaagaaattaactccatatttttaatatgcaatatgttgcctaatattcttgttctttggactcagaaatggagtcccacaatcagtgacgactatttttggtaaaccgaataagcacatgaatttatcaacaaagcaactgtgacggtggttgcagattgttcctgcaatataatggctgttgtgtctttgtccgagtgaataagaccaacaaatatttatttacgaagagacaataataataaataataaaaatggcgaatggtcggtggagagaataatgaataaaaataataaattgaagacaggagaagaagtgcacatgngggaagagtccacgcctttaaatagacaatgtgagggggaaggaacggtcgagagaatggacaaatgtaaagatcaataatcgataattgaacatgagcaaagtacatttgctttttctcaaacacctcccttttcgagattgaaacatcctcgtttcaacctggcgtgaagcgtttgaccggcttcggcacgcgctgggaacgtcggacgccaattgggcttttagccttttgcctagcctgatcaacaacaggtggagttcgctgatcgatggctgcgtgttggcgtggcggtgtcctttgatttggctcaatggccatttgttcctgaatggggggttcccaatttgaattgtcctcaaaatccaatcggcaccgaagctggttggcatgccgatggacaattcggccgagagttgggacgtggacacggtatgttggcgaattgttgagcctttttacaattgtgccctgtagccaatggctttttccaaggcgataattcaagagcaggacggaatccgttgggaggaactcaatagcttttgtgccattgttccgatcgaattgctgtgccattttggttgaatagtccttttggtgctgtttgaacttacatttttcaaatttctccgactgatcaatttgtccttttgggtggacgagtgccaatttggtgcgcagtttccgtccaaggaacaattgatctggcgaatatccggttgatctgtaggagagcagcactttttcaaggctgttcttctcgcctttgcacttcgtcatcgcccttttgaaagtgtcaacgaaacgttcgacttgtccgttggattgaggatggaatggcggcgtaaaagtgtgctttattccgaactccttacagagtgccgcaaattctgacgaatgaaattgagttccgttatccgaaacaatttcttcaggaataccgagtcggtggatgattgaacggagtgtgaagacggttgccgcggccgtcattgaattcatttggtagacctccggccatttggagaatgagtccaccaaaatgaaatagacgtgaccgtcgtagcgccggacaaatagtgaacgcgtttcggcatataatcctttcagcttggtgatcgagtccacccaagtgactttgtcgggctgggtcggactgatgctgtcgcggtatttgccgtactcctcgtcgccgagtttgccgaggagtagtctgacttttgtcgactcggggaggtccttaccatcttcctcaatcaaaactccaaaccgtttgaaccactgttcgaaagtgtttccggtttcggcgtcgtaattgaattttgaaattcggccgtcgatggaacttgccaaatttgcatggttcagactcgctgacgcggcgttttgcggtgtttggcccattagctgttggatcgcatccgattgcacacgcatggcctcaaggagttgcttaagttggtccgcgctcatgccgaaatgtttgccggcgccgaatttgagaatccacagttgaaaaaccgcttattgcggaaccgcaacctttcttaggtctgttggtttttcggcgaattaactgcaatatatgcagacctcacccgcctagggactattggttttgttgatggcgaaaaactgcagtatttgcagacctcacccgcctagggactattggttttgtggtgtgcagtccgggtgtcttcttgttggttgaagacgactgctgactgcgccaaatttgttgtgtctttgtccgagtgaataagaccaacaaatatttatttacgaagagacaataataataaataataaaaatggcgaatggtcggtggagagaataatgaataaaaataaaaattgaagacaggagaagaagtgaacattggggaagagtccagcctttaaatagatgtgagggggaaggaacggacgagagaatggacaaatgtaaagatcaataatcgataattgaacatgagcaaagtacatttgctttttctccaacaagtttcgtttttttgaacattttctcataactttcttgaaacttaatgaaattttgtgaaattttccaggttaagcctagaaataagcactaataacgcgaaaagtagcttaacaacaacagaaattaacatgtttttcgtgccactgggagctcaggaaaaaaggcaaaaacctaaaaatcgtagccttatgatgtgcttattttggtaaactttcgaaggtaccacccctgtttctttcctcattttcatttccattatttatattgttatttttgagcagtgaaatcctgaatacagttacatgcccagtactgaattattcgaatcacccgggattaatcctccaatagatttttatatactattttttcgtgctggcgcgtttcttaaaaactgccagcgcgtttcttaaaactgccaaccatgcgcgtttcttaaaactgccaaccatgcgcgtttcttaaaactgccaaccatgcgcgtttcttaaaactgccaaccatgcgcgtttcttaaaactgccaaccatgcgcgtttcttaaaactgccagcgcatttcttaaacctgccaggcgtttcttaaaactgccaaaaaagatgctaacatattatttcctattttttaatttaaatataaataaataatttatgttttcgtggtaatcgataatataaattaaattttttgtttaagttaatacgtaacagccgtggctttcatatgttagttaaaattatggaaaattgttgggcagccttaaattatagacaactacaaatatatttgccaacattaattatatatttataaaatcgaaaacgtatatacatccattataaaaaatatattaacaatttttttttaaaatgaaaataaaaatatatagttgtaatattatattatgttcttgcttaaaatttataaa

SEQ ID NO: 4881 - DNA, 1660 bp, Heterodera glycines
cttatataataaagttgattgtttgtatgtgtcactgtttgaattagtgtggcgttttgtttgagttttgcgttaaaaatgaatttgaaaaaagtagagcgagggaaaggtgggaaaatagtgcactgtctgattgtctgtctacgcgggcagcggcgggtgagaggggcatacagagaacagacgcgtgctactgtgcagcagcagtctgttggacgcgtgcgtgtgtgtgggagagggaaggagtgggaaaaaaaagagagtaaattgcaatggaaaagaaaagagagtaaaagaaaggaaagggagagataatgagaaatttctctcgcatcccttccttatttataacccatcttttattatataaaataattaataaaataatgagcacatttttgtttttgtttgagtggaaaatccggtatatgaaggttctgtttttgtgtgtaagaaaaaatttatggtttgtttatcattattttttttgtctaaattttgtttttgttaattgatttgattttgatgtgaaagcttttgttttgcttatgtaaacgataatggagaattgtttggttaaaaaaatgcattagaattcgcttgaatgaaaaaggtttgttacttaaaaacgttttttgtacttttccttgcttataatatgaaaagaatctgatttggtttttgatatttgttttgaataaaaagcatgttatgatagtaataaaaaatgaaagaaaaagcctttgatggatagaaaaagcaatataaatgctaatctcatgttttgcctgtgctcgagtggaatatttatatgcaattgggatattgacgtgccacttgcgggatcaaatttaggtggaaagttttaaacaggtcagttttaatttgaatttatggggtgggggcaataattatacaccatagtgttttgatttattatgggttatatttcaatttctggattccttttaaatagttctgtattccgttgctgaggttgagttccggtgattgaaatgtcggagaactgagtcccggtaattgtgttgatgaaggattgatgagattgagtccagtgatttgaattcgggagaatggattgagtcccagtgattgaaatgatggagggttgagtcccgttgaatggaatgttggtgggttgagtcccagtgattgaaatgctggagggttgagtcccagtgattgaatgctggagggttgagtcctgttgattggaatgttggtggattgagtcccagtgattgaaatgctggagggttgagtcccagtgattgaaacgcaggagaatagagtctcagtgattgaaatgcagaagaattgagtcccagtgattggaatgttggtgggttgagtcccactgattggaatgttggtgggttgagtcccagtgattaaatgatggtggattagcgcagaaaattgtgggggggccgaaggccccagtacgaggccgcgaagcggccgagccctccccaactgttcaacacccaaggcacacaaaaagttaaattgaaattctggtggattgagtcccggcgattgaaatgttggatgttaaggtcccactgattggaatgttggtgggttgagtcctattgtagagaaatgctggagggttgagtcccagatgattggaatg

SEQ ID NO: 4882 - DNA, 874 bp, Heterodera glycines
agggttgagtcccggtaattgaaatttgggtggattgagtcccgttgattggaatgttggtgggttgagtcccagcgattggaaagtctgatatttgagtcccggcgattgaaatgttggagggttgagtcccggtaattgaaattttggtggattgagtcccgttgattggaatgttggtgggttgagtcccagtgattgaaatactggtggattgagtcccgttgattggaatgttggtggattgagtcccagtgattgaaatgctggtggattgagtcccgttgaagttggtgggttgagtcccagtgtttagaatgccggagatttgagtccattgtttggaatgccggagatttgagtcccagtgattgaaatgcagaagaattgagtcccagtgattgaatgctggtgggttgagtcccattgattggaatgttggtgggttgagtcccagtgattgaaatgcagaagaattgagtcccagtgattgaaatgctggtgggttgagtcccactgattggaatgttggtgggttgagtcctgttgattggaatgttggtgggttgagtcccactgattgtaatgttggtgggttgagtcctgttgattggaatgttggtggattgagtcccactgattggaatgttggtgggttgagtcccagtgattgaaatgcagaagaattgagtcccattgattggaatgttggtgggttgagtcccagtgattgaaatgctggtgggttgagtcccactgattggaatgttggtgggttgagtcctgttgattggaatgttggtgggttgagtcctgttgattggaatgttggtgggttgagtcccagtgattgaaatgcagaagaattgagtcc

SEQ ID NO: 4883 - DNA, 3274 bp, Heterodera glycines
ctgactccgtgcattttccatgcctctaagtttggtcagcggggccgaaattctcaatcattccgtttccgtcagtgtcccaatgttccaacccttcagccaccataatttggacttgcggccacacctcaatgtattcatcgtcacttcatttgttcgccaaaaatggaattgcgagacttgcgcaaggaattggcgatctctcccgaggactgtgcaaaaggttcgataggaacaaagcacgaacttaagattcaaatccttccattcgctggtgtcgtgcattcggtagacatttgttttaagccatggctcttccgctgtaaaagagcaattaattaatggggcaattgggtgggggagtgcctgggttgccaaggtcatgcggcactctgttcttcgttttcaccggcgaatggactccactcatgtgatatttcactgttttggggtcgaaatggcagatctgatcatcttaaatgaggacatccgcgaagaaaaagcggactcactgaagtccgtctgaagagagtgttccaattgggggaacaaatggccaagcgcaaacgaagcgtaaaagtgaacgtcgtaagtgttgagcatgcgatattcccaagctgaagaagagtttgtgcggaatgcgctcgccctttgcccttcccttctcacattccaaatagccaaagcgaccaaaacgacggaaatgggcggccgagtaatcggacagttgcgtttcctgctgacgccattcggaatcgtaacacatccaaacggtgccccccgcggtgagaaagtacagctcgttgaacagcgcggatttgaaccaattgggaagggcactgacaatgggcgaccaatcaaattggtcggataaaataaatacgaatggaaatgctcacggattgctcagaattgggccctgccatttgtcaatctccgcctcccattggacgtaattggcgagagcgtattcacacaatgcgacagcgccgctttgctggtcggattgatcgaaaaattgggaataccatctgagaaaagggacaaaataaagcagacatttaacaaaaaataaatggcaaagtgttgcttcgcagtttcagtctctgagatcaaagaccaatgaaaggaatcgctttgtttcgcattcgtcccttcagcaactcgccatcggagcattgggacgagttgagtacacaattgaatgcaattcaacccagaaacccttttcttcccaactcatttcgtaccttcgaaaagtgcgtttgccaccgccaaattgaacaaagggccttaaaaatgaaaagcaaattaatccacaaattcttcgccctttcccaaacatatgccaaatgagtgcaaatgccatctcctggtcacaatcagtcgcactgtttgctgccactttcgtacgctgtgacaaggcaactccgaaagcgccgttcttttttggctgatctactaaaattaaaaaagtacacactttgaaaattgtgaattgataaaccaatttcagcgagtgtttctccggatgccattgaattccacaagcaaaagccatccccggagggatcgaaagagcgagtggcggacatcgccgtagttggacgagggagggcacccaaggcgaaggtgcagggcattccgaacaccgactggtggagaaggacaccttccgctgacattggcaaatggcatttacgaagggggaagccaatggaatttgagccgacctttgctcgttttgaagagatttgaattgcattccgtggcgggtgtgacgtcattgacgtcaattgcattacgaaaggtaaaagtgacggaaacattcagcggataatcggagttattgacaatgcgaaaagtgaacaaagtgcaaggcaacgaggaattctgaaggaaaagctgaaacgatgaagggaaaagcgaagggaaacgcgccatgtaatcaccgggcaaaacgggcgaaagttgacgcatcaaaacgaccactttttgttcgggcaattcgaatttcatccacgcgcgcggataaagagcactggaaaaaagaaaacaaaatgaattttgcgcattagggaaggcaaatttaaaattcaaaattaacgctaattgaccgataagtgacatcatttggagaaagggaaaactcccaggaagacaactcatcagaggcagcaaaagaagggaccgcactgagcgcagtctgacggatgagagagccatcggcggaagacaaagtgaggacgaattggtcagcctaacaaagggacgacaaagcgaaggtcagacagtcacagtctttgtttgccttaatcggctcgttgtgttgctggacgaggccaggcctcaagttgaagcgacaaaaggcgccacgaaagtcccgactgattgagcccgaaccaatcgcaccgcaggggagcgcggtgtaagggaaatgacggaaagggcggaaaatatcgatgaaaagacgctcccgactgaaaacattgcgaagccaaaagaacgcgtaacgacacaaaaaagggatcagttggagaacctaagggagaagaaaacgcattcccaacggatattaataaaaaaaagccaattcttatttttaacacctgagaaaattttggacgatcgaacggcgtccgctcctccgccgcctcactgtccgcccgtacaaaccatccgaaacgcccacccaatgcgccaaaatcgaactcctcttcctccattccattctccattcgagacttagggcgttaagccaaaagaacttttgaaggcttgttagtgttaccaactcttattgtgattctttgaaattatatgtaattaataccagtcgaaattgactgttagattatttgcaattatagggaaaagtaaacactcatttcctcctttaaacaatgaactaagttacaaagaatgatttacattgttactataaattaattaaaagtggactaatgacagaatgaacaaatggaatgtcacagatcattagagtgggaagggactgttgttaggaggcgaggcaggcgatgctcgtcacttcagcgtcaattgtattcaaggcacccgccaaccgataactgattctgagtcgtagacgaggctaaagaaaaaccggtcaaagtacttacgcaaaaaattaaacaaataaatgctaccgctttcgaatttgccagccgccgcaaattcgccttttggcttatcgtggacaaagcattggcttaaaggctcgtcgaattcgccggaagcaattcaatttgataag

SEQ ID NO: 4884 - DNA, 1170 bp, Heterodera glycines
aaaagaaaacaaaaagaattttgcgcattagggaaggcaaatttaaaattcaaaataacgctattgaccgataagtgacatcattggagaaagggaaaactcccaggaagacaactcatcagaggcagcaaaagaagggaccgcactgagcgcagtctgacggatgagagagccatcggcggaagacaaagtgaggacgaattggtcagcctaacaaagggacgacaaagcgaaggtcagacagtcacagtctttgtttgccttaatcggctcgttgtgttgctggacgaggccaggcctcaagttgaagcgacaaaaggcgccacgaaagtcccgactgattgagcccgaaccaatcgcaccgcaggggagcgcggtgtaagggaaatgacggaaagggcggaaaatatcgatgaaaagacgctcccgactgaaaacattgcgaagccaaaagaacgcgtaacgacacaaaaaagggatcagttggagaacctaagggagaagaaaacgcattcccaacggatattaataaaaaaagccaattcttatttttaacacctgagaaaattttggacgatcgaacggcgtccgctcctccgccgcctcactgtccgcccgtacaaaccatccgaaacgcccacccaatgcgccaaaatcgaactcctcttcctccattccattctccattcgagacttagggcgttaagccagaagaacttttgaaggcttgttagtgttaccaactcttattgtgattctttgaaattatatgtaattaataccagtcgacaatgactgttagattatttgcaattatagggaaaagtaaacaatcatttcctcctttaaacaatgaactaagttacaaagaatgatttacattgttactataaattaattaaaagtggactaatgacagaatgaacaaatggaatgtcacagatcattagagtgggaagggactgttgttaggaggcgaggcaggcgatgctcgtcacttcagcgtcaattgtattcaaggcacccgccaaccgataactgattctgagtcgtagacgaggctaaagaaaaaccggccaaagtacttaggcaaaaaattaaacaaataaatgctaccgctttcgaatttgccagccgccgcaaattcgccttttggcttatcgtggacaa

SEQ ID NO: 4885 - DNA, 4712 bp, Heterodera glycines
tgcaggtcagcttgaatttcaaaaaggtaacaaaaagatgtctgactgttagagcacctccaaattcatgtgtgccgaatattgtcgtattaacgcatgaatttgttcggcgtgcgagtcgaatcgcgtgctaagtttggcaagtgcagttagtccatactcacgggttggcacagtgagctgtggatgaggcatcaaaagttcgaacaattccaccacttcatcctcgctcacctaacataacgaattaaaaccaaatacaaaataaaatcgtacttttatatttgcctcctccgtatttcccggagtgacaagcaaatcaccgaattcgccaatgctccaaaatgcgatttgcattaagggctgagcatttactatgtgttcccgtttggaggcatgaaacaattggacggttgcgtaatgctgcagttcctgctgggaagagatgagctgaatcatcgcactgacaacttcatcaggtacatggttagctgcctaaaaaaacaaaaagtaggaagcaaaaggaatgtccgatcataccaattgcagcacgtttatcattgtgtccaaatgccaaacaagactcggggagaagcgctccgtcgcaacgtacattttagaagaacactcagctttgaaatcggagtcggcagtttcgaggaaaattataatctgaatccgatatgaaagaatgaatagaaaaataggaattagtaaacaaaaaaggacctccttggacatgctcgcgatgttcgtttggttcataagggcaaagcaaagttcaagagccctcctaaaaagtctgcttattccaactacttttatcagttactttttgatggaaatgtcggcatccttcagacattccaccacagtggtgcgatgcctttgcactgcttggaaatcaattgcaacagttttgagcagagtgttaagtgcaacatatcgaatgtttttgtcggtgttaagcaaaaaacgacccaaaatgttcacggccaaaactcgcaagccgctttcactgaatttggtcatttttacgtactgttagccttgctatttcatgcccacctttttgtttccattatagtcaatactgtttcatataaaatggcattgccaacatttttcgtcgtttccgtattcgtcgccacctgtgccaaaatgtcattcatctcttcactgacccgtgggtcatctctgcccaaaatcctcaatagcctgagaattttgaccttaaattcaaaattagctaattgtaagaaatctatgtgaaaagaaagacctgcaaaaatgggtcacttataccagcgacgtcatgctcagcagaatactcattcatcagcaagtttttgagtatgcgcaccaaattaggcaccatccaaaatgtaaaaccgaatttatttggttgttaaatcaataaagaacctttttgaagtgaatgcgtacatcggcactcaaatcgcacatttccgagacgagtgtaatgcccgccattagtacacctttaaaccctcaaaaatgcaaaagcctatggtaaaagtggcatttaccgtggtgtttttcgttgagcaatgagcgtgtgctggagataaacatttcaataaggtcggggacctttcggacgatacgaaacgcacacagagcggcctcaataccagcaaatagaggaaatgtccaaacatttcctacctttttcttgaggtaggtgttagtcgacttcaataaaagcttctcaacttcgcttgccaaatctcgacacatttccgccgaacaaattgagccaagagtacataaagccaaaccggcgacgaattgttccggatcatttaaatggctatgaaaagatataacgaagaaaaaagaaatatttaaaacccctttaagcaatttgtaacaagtaaatgaatttcggaacgctcatccaacaaaagcatggcgcccaaataaccaattcgaacgtcagtgaatcgtttatccttgctgcccaccaatttaacacattcaacctttcgatttggaaggattgaaacggatttcgtcttaaaaatgaatgtttacttgtccgaaatgtgcaggataaccaagcatgtgaatatagagaagtttagccatattccttaatttaattttcgatcgaatgcgaaactccgtgcaattgcctgcatttgtatttgttgtcgtcgtccctgaaggaatctctgatgtttgcactttctttctccaccactgcccgttcctcggccgctgttcgtgccgctcggacttgacgaatcaaatcacgcaagcgcatcgacgcacccaatgtccttaaaatgttaaagtcatgcctatcaattataggtttgtgacaattaattcacaccttcctagtcttgatttgacttcatcaattttctcaattgtcatttcaacaacatttgccattttgttgcactgattattctaaatttcgataattagtgatgcaaataaaaaaaattattttgcttccgaaaatgtttaaaaattcgaaaacacttgcctataaaatttataaataaatttggtttaatgtcccttcccgtcaaaccaatgtttgctcaattttgttcctactgtagttcaaaaaaattcaaaattttatttgtctatcggatacacagtaaggccttttgaaaattcaactgcataaattatgaagtttaatatgactcaatggataattattcaaatataaaataacagcgccttgggggcgccgctttgcggcgccaaccgctctgttttattctcaaataaattaaaatcttgataaaatttttggtgtgcggacatttcgcctactggacatctcgcctactgacatttcgcctattcgacatttcgtctactaacccaaaatcggacgtttgcctactggacatttcgactactgaatatctcgcctactaacctaaaatggatctttcgacaatgaatttcatcaaatatatattctaaattaatttatatttagctatttataatgctaatgaaatttagcctaaaaaagcaaagaaatatttataaaagtccaaagaaacatagaaagtgaagtataaaatcatagttcagtttttaatctgtatcattagcttcttaatcactctccatttccacggatgtgaagccccaccacaaagccctgcaaacgagtccgaccagggtttgccaatccttcgtccgattcataggcggcctcgtcaaggattcgcaccacattttgttccttgatgtaccgttgtcattgtttagtcgtttgtggaagtgttaagcatatccgagacccaattgtttggaaaagctctccttttttacatcatcactttgtctaagttcaaatcgttgttgtatgaacatttcggcgctagttgcaaagaggaaacttttgaaattttttttcactttttttggtcaaattttttttttgttttttttacacataatgatgaatattaagtattaacagcacaattatggtgaataaaatgtatattcacgatttttatccaaaaaaaatttacaaaacaaaagggtcccccctatggtttttgataaaattcaaaatctatcactttataactagcgccaaatttgcttaataggcccaaataattgtcatattcttgatcagctacctttaaaacccccgggtacttggtttcaggactttttaaacaaaaaaaaaatttgaccaaaaaaaaagttgaaaaaaatttcaaaagtttcctctttgcaactagcgccaacatttccatttgaggctctgtggctgcactctcaaaattcagtacgctgtcttcatttgtatgaatgcggggctttttattgtttttgaagactcgcaagtatttatgaacaacaataaaataattcagaaaagcaagcaaaatatgaagtttcaaacaaatttattcaataacgactataataaagaaggttgagcaacaacgtatttaagacaatcggaggatttcgcgcaactctcttctgctgtctcgatcacacaaattccagacggtgaccaaacccagtccggccaatgcaccaacaccgccagcacgcagcccatgaggcaatccgcggaaaagtccgccagcgattggtccggcgataaaagaattaagcaagtcatcggctcgtgacagcttcagccccaactcagtgaccgaatagagaaacatggcagtcccagcagtttgtgcgtatccgctgccatgcttagtggcggcattcagcatccgagtgtaccacggattccaagccttgaaattatttttttcatttttatataataactcacaatcagtccacaaaccaaagttctgttctgtggatttcctaactcgccgaacattccacgaacacttccaactccgaatcctccgataaccgaacaaccgatgtaaccgagagcgaactcaaattttccccgaccagactcataaccttcaggcatgatgatttgtggttggctctccttgaaaattgacggatccaactggaaaaatacggatccttctgggaatatcatttttcgtaaagctacttaaataaaacaaaaatcaacattgattacagtatacacattagaaaaacggtaatttgttaaaaaatcattaaaaaggttattcttttcatagacacggcggcacccccacaaagtgtccagcccatcgaatgtccaaaagagt

SEQ ID NO: 4886 - DNA, 5160 bp, Heterodera glycines
ttacttttgtatgttttttaatttactttataaatttaatattttaaaacaatttattgtttttttttttgtaatttatatttcaaatttttatagatatttgaggtgttgtataagttttgttatttaaaaattcttaacaattcaagtaataaagcaaatttacgaataattgcttaggaccaatgtcatggaaattcgtacaataggcagtcgtactatgggcaggttagttcgtacaaatcttttttttgcactttcaataaagctagtattttctctcaaaaaaaaaatcagaatcgattttcaagcctagaaaaaaagttttttaaattttttttgcttttttcaaaattttttcacttttttttcttcacttgtaaattcattctgtttttttttactgcattctaatgcaatttaaaatgaggtggtttttgtttgggttttttgtcaagaaaaaaattgaaaaatatttttaaatgagcaattagcagtttaactcagggttgcgatctcaaaattttgaaagtcctcaattcagagataaaaaatactcatttgccactaaaatacctgaaaaaaatcctcattttttaaagcataaaaaatgcaaataaaatcaattaagagtcatatttttcatttgaaacaatcaatgtcatcaatttcttgtcatttataagcattttacggaagtctgagcacgaaaaatcgaagttgcacttcactcgggccaacgctttcaccgtgcatccgttaaatttttcgcttttagatttgctcttttcgtggcgcggttttccaaaaaacttttcggaaacatcgggagggggggtccggcagtgccgataggcgctgccggaaaaaatttggaattttgagtgcgattgttaacaaattttgtcaaaaaaatgattttgactgaggatttttcgaaaaaatgtttaaaatttgaagaaaaagttcgaacattttgccaaatatacctaatttttaaaaaaatcatgcggttttgtcacttgtttaacaaaagaccacaaaaatcctcaaatttctcaaaaggtcacaaaaatatgcaaatcctcatttttcaaaaaaatcctctttgaccctctaaaagaccacaaaatgagtaaaaatactcagatatcgcatctctggtttaactcatttaacaaatgaatttcttgatgctaatacaaacatcagcagacatataaatcaggagatggagttccgaggcactaaaaattttcggaagtcggaactcggaattccgaggccccaaaaattttcggaagtcggaactcggaattccgaggccccaaaaattttcggaagtcggaactcggaattccgatgccccaaaaattttcggaagtcggaactccgacccaaaaaaggtcggaagtcggaactcggaatttttgaaaaattttacagaaattttaaaatatttcataagttaactttaaagttataaatcaaaattactaaatataaatgtatttatgtattaaaaaattaatattaaaaattaataatcaaattcaacaattgataaattggactgcaaaaaaatcaatttcctaacattgtctcccttaatccggtttcgcaaatccgtacaaatgagcccggctttagaaaacaatctttcgctttcaactgatccacaaggtgcgctcagaaattttgggcaacacgacaaagaagaggccattttccatgttcttctttcaacttccagtaatagaaaatacaaacagaaattaaaaacagaaattaaaaattctcaagaaaattaagtttttttgagtccggcggtgccgataggtgccgtcggaaaaaaattgaaaatttctatgcaatttattaacataaattgtacaaaaattgctaattttttgaaaaaaaaactcaaaaaaagaggcgagtttaattaaaaataaaaatttaattttatttttcaattgcaatttcattaattatccacgttttttaaaggttttgccagcacatcagcttattttgaagagcgcttgagtgaaaatttaaatttgtgattggcgtcgacccagcggggtgccgaaaagcaatttaaattaatggggaataataaaaaattaattagaaattatttcttatttataataaattacagcgttccaaatttatatttcttcacggatttgcaattcgtctcgttcccaaaatttgacacaacaaattctgatcaatttgcaaaaatgcctccgatttaagcaaatcgtccttttcgtcatttttccaacaagaaggtgcattggcgcctttggcgaaaaaacttaccttggaatacaaaaccaaaaaaaagcaaacaaaattttaaaaaaaaatttgttttaattaaaaaaataaaaaaagatttaaaaaaatttacggtgctcacaatcagcaaaatttaaatccgatccgtcaagagaattgaattttcttaccaaaatattaaactttaattcgtgactaatattaatcaaaaataatatttaattaatttatatatgatttccgcccgattagttattgtgaattcatcagctgtcaaaaaccatttaggaattaatcatctattttctgaattttttgagtttaattttctgcaaaagttgggcgaaaagtagaaaatttaaaaattgaaaataatttatgaaaatggaatttaagaaagtttataaattatgtgtgaaatttacatttataatgaccgatttccaaatctcactatttttaattaaataattaataataaaatttatttttcaacttgaacactcgcctctttttcatctccgtttttgtccataaaatgaaggttggaggtttaaccagtagactaaatgtttctaatagatcaaattatttttctcacgagaatacgagaacacgagacgagcaacatccctgatgtttagaaagaaaaatcaatgcggttatttaaaaaaatctaagtttggtgtcgtattttctcaaaatgtttcgagttttcagtaaaaattttggcatttaagcatgctctaaattattttggaatatctaatcagaatatttcttatagaaattaatataatattttttgaaattgatttgcctttctcttcagaaactaatttgtacgctgatgagaacttttttcgggtctgccgtaaatggctctttctattttcaatttttaaataaaaatggggccgtttatgaaattcatttgatttatagcataaattcctcattagtttatatttatcctccgtttttgcttttttcaccaccaaatcaatgaccaatttcactttgtccccgcttttgtcgtacaatccattggcagggtccatcaatttcttaattacatatgatgagtgggaagcaaattttgaacagtgctgttcgagaacgggacgacgattttctgctgaacacaatgccattttgatagatttcgcgccagcccaacggagtgccaaaaaaataacttaaatttaatgtagaataattatttattatttgttgggtcagggtcgttttcgtacggtccgttttcgtacgagaacaagtttttggctatacttttttatttatcaatcaaatccaacgctgttgtttattcgatagccttaagtgtcctctattagcctgtaaaatttcgaataatttcgttaaggttcaaaaaaagttatgatcagaagaattcaaaaaaccagattttccaacttttttggctcgaactttttttaaactaaacgaaattttttggaattttgcaggctaattggcatctgaagtgctctcgaatgacaccaagaatattgaatttggttgacaaagaaaaaagttatagtccaaaaacatgtgctcgtacgaaaacggcccgtatgaaacggcctggcccgttatttgtttgtcaaattcctgtgttctaaattgaaatttgtcacgttccaaaatttcgcataacattttttgatcggtttgcaaaaatgccttcaatttggtcaaattttcgtatttttattaatttacatcaaacacttgtacaaaatactaaaaaatcaaaaattttactcgtttcaactttaaaccgattcaaaattaaaaaatgaacaaaatggggctctcctaaccttttataaggatgaaatccgtacaaaattggtatcattcgacagctcttgacgagtcacattttttagccttgaatagtgaataatgcgctaaaagccagcgcacactcgactacggcggccaacagtaggtggggcgccgctcaatcgggtgcccaccagggatggatggagttccgaggcactaaaaattttcggaagtcggaactcggaattccgaggccccaaaaattttcggaagtcggaactcggaattccgaggccccaaaaattttcggaatcggaactccgacccaaaaaaggtcggaagtcggaactcggaatttttgaaaaattttacagaaattttaaaatatttcataagttaactttaaagttataaatcaaaattactaaatataaatgtatttatgtattaaaaaattaatattaaaaattaataatcaaattcaacaattgataaattggactgcaaaaaaatcaatttcctaacattgtctcccttaatccggtttcgcaaatccgtacaaatgagcccggctttagaaaacaatctttcgctttcaactgatccacaaggtgcgctcagaaattttgggcaacacgacaaagaagaggccattttccatgttcttctttcaacttccagtaatagaaaatacaaacagaaattaaaaacagaaattaaaaattctcaagaaaattaagtttttttgagtccggcggtgccgataggtgccgtcggaaaaaaattgaaaatttctatgcaatttattaacataaattgtacaaaaattgctaattttttgaaaaaaaaaactcaaaaaaagaggcgagtttaattaaaaataaaaatttaattttatttttcaattgcaatttcattaattatccacgttttttaaaggttttgccagcacatcagcttattttgaagagcgcttccgatgtttttgaaaattagggtccgttttgacgccaaaaaagaaagaccggaaaa

SEQ ID NO: 4887 - DNA, 4581 bp, Heterodera glycines
atgaacagtagagaaagaattatcttgggttctttcttctccaacccgaacaaatatagaaaagaaaattcagggtcgggtagcaaaaccctacaagatttgtctgtatggctagagaaatttaaaaaaggtcggtggaaaaaccctcgttcaatgaaattaatttcttagaaatgtaaaaagataggccttaaacccaaaaaaaaacaaagttttatttagttttgcagtctccattccatattttcagagtttttaaaaaatttttactaatttttttaattttttcccgaaatcgcaaatatcccactgcgaattatacataatttcactgaactttccccccccccccccattagtccaattctacggcacaattgctgctcggaggctcttttcagcttaaagtccattcggagggatcggacattgacacgctttgcattgcgccgcaacagttcggacacgacgacttttttggcacacaaagcgaatgcgaagggccggaaaagggagggagaagcaacgaacaaacgggcggaaaatcgctgttttgtctgttttccaaggcgagaaacgcaaaaaaaattattgtcggatggcatcagcccaattaaatttaatttactttaattaggcactaattgattgcccgtttatgccaacttttcgccgcttccaacttcccttttcagctccccgccgtgcgttcgttgcgtcgcattccctccgcgcgcgtgccaacccttcgcctcgtcctacgttccgacttcgaatttgacatagtttttgcctcaatccctggcgtccagacaatttccatagaagaaaagggcgaacactccgcgcacattgccaaattaatcgaaagattggcggacaaaatcaaaacggacggaccaccggccgaagacggcgaagtcgcgagacgaatgttgcgctcattggccggtaaatgaagcgaatgaaaggccatggccgaccaaagactgatcagcaaaaacaacagaatgatcagccatttatctgatcactcttaattggcgctgaatgccaacaattagtgagtgttccttccatgatttaggcttccactccaacctgaaactgctcgaaatggcgccaaatgttgacatgttccgcaaatttgtgctgctgcttaagcgatgggcgaaaagttcgttcggatttatgccaaaaactgaaattaatccgataaatgaatccgaccctttcgtttgttgttgcaggcaatttcatttatggcaatgcgttgggctttctgaatggcatttcgctgtgtgtgatggcaatgaaagtgctttttctgtttccgtccgcttcgcttccgttccttttggaacgctttttcctcatttattccctttggtagcatttcgcttttccgcattaattgcccacttttaatttgaaaggccttttccgctgccaattcaactcggaaaattcagtccggatttgctcaattggagcccggaggaggagcttcgtcaacttatgccacactttggcttcggcttcaggtccaagctgagcatgcccatcataacgccaggatatcctgaacagaatgccacgttcaatgtcaatttcaaaacagcgcaaataatcaaaacagcgatcaaaaatagtaaatttattcaatttattttttatattttactaaatatgaattagcactgattgaattgaacaagtcgaccaacaaatcggcagaagaaaaatggagggatattcttcataagcagcgaaaattcagcgaaatgatccgtttttcataatcaaatttcaatttaatttttttattgttttttagtactcagaattcttttcggttgtttgctttgcgtcggattgggatttaagtgaagaattctgtggctttgtgagcactcgtcttcgcaatcagttgctgatcagcagtcccaatctgtgccacgtgcggactctgagggaatgcccggaaggaattgtgcaaaattacggagaaaaaatgtactttaaaatatgggattaaaactaaatatttaatattaattatttgcaataaggccatagaaaattttattttttgactattttttcattttttttaccaatttagcagttattctgtttaagcacttattttgcacttttagatatcaattttgagattttaagcacctaaaaatccgggccctagtaattaatattaaaataatactttttttgctatgatttaaagaccaaaacaatcgatttgcaaaagttggctgatcggaatggacggacaaaataatttgggaaacgaatcgaaggaaatgcgaaatcgaaacttggaaaaagagttggacgaacaaattgtgaatggatacaaaaaaatgttgaagaaaaattctgagaaagcccaactaaattcagcagaaataaaattgagaatttttttccaaaaaattgaaaatgaaaaaaaaaaattaaaagaaatggacgaatttatttatttggaagcgaaatttgtgagcaaagaacagctgaagaaggaaaactgggaaagagaagagaatgaataattactgctgatcatttgagcatattttgctgatgtgttgtcattatgatctatgcttaattaaaggattaattaattaattgaacggaaaagctgattataaaaaggaaaacgtggaaaaatcaaaaagtgaaatgaaactttaaaaaatatttgaataaatttcttaattgaggtaaaaaatattatgcttttttattaaaaactcgaaaaggctaataataacaataaaatcattttgaagaaaaataatatttatggattcccacttttaaataatcgcgaaatataaaaaaagacatcaaaattccccccaaaaattaccaatttcgtgggttttctatctttaagttggattatataatggagaagaatattttaggtactttcccattcttctgtgaccacagaatgagatgaaataaaaagtgagcaaaagggggaagagcattttaccttttgcaaattgatatttattatgtggcattttatttttccatcctttatggttaattctgcggtcacagaaggggaaagtaccgaatatttattagaatagacaaccaattattagttaattaatcactttgttcaactgtgcattaatatttatgtttaattgctctaaatttgcttcatttttttacaattttctgtatttgaaacatttgaatctttttgttctttggtgtgttttctcctctaagaaactcaatcaatcccaaaatcagatcagaacagtccgtcttcttctccttctctgccgcctcaagggctcttccaacgaattatcatttgaatctcagcagcctaaaattgttttgaaaatgccaacgttgggttggatcaaatgccaattttgcactgaccagccacttccagtcgtccatgtcgattggtcgctgggatttgaaccagtcgttcacgtcgtcaatgtatcggtccactttggtgatcgcttcctccatgcattgcttcattagcgtgttgccctgcgggtctttcgggcatccccccaggctgttaattgccttccgaatttgccaatgggtgtcctttctcatcagattgtcccaattcgattgaagagaactgaaataaccatccatccatttaattaccaactctttgtttttaatccctttatccccccaattagtcccttagcctaattaattaagattgcccacctcagtgtgctcatgtccattgttcccattcctcgtgacgcatttctcagctgtgccatcactttggccattgcccccgtcaccatttcgtcggtcgctcgagctcttttgaccacattcagttgctcttccactacgtcaagtgcctgaatgcgtcggtcgacttccgtcgatagttcggcaggctttggcttcagtccttccaaaactttgggcaaaagcttcagcagtcgtccgatcacttcttctttgacgtcctccaactcctccgccgccaccattcgctcggccttaagcttcaacagcaaatcttttggtgaattgggccaattcgtaaatcaaagccaagtcgaaggcacaggcgttgcttttttcaactgaataattaatcataaaaatgccaatgtttttgctgctgaccaagtcgcagttcgggctgtgagttcagtcccacgtcgttcagtgcctttttgtattcgacgaaagcattggccaccgacggagtggcgagcaccgaattcagtctttcgtgcctcgggtcaaatgccttcagtacgtagcacaatcgctgcacactcctttcgtctttcctggcagtgttcagacttccaaagtaagccaacgatttgtccaaaaaaacggaggcatcgatgaaatcaattcgcagaattagggtatctgtgagggtaaatggataaacatttctttgatcatttgttgtcattccctcccctcccagtgccgttccttagcctattacctcccccccccccctcacactatctatgcccattcccccttgtgctattaccattctat

SEQ ID NO: 4888 - DNA, 1870 bp, Heterodera glycines
tcgtcgtccaaaatgttcactcgactccttcgccgcgagcgcaacacggaagtgggctgtccaagtccgagtcggtgtccgactcgagccaacttctttcccgcacgtcttttcgggagaaagtcatcggttggcgccaccggtcatcttcttgaatccaaatcctgggcgtcgactggagtcgcgtcggactgggaaaatgtacaaattgatcagtcagctcaaatttgattgcctctttggaatgtcctctaattaccccttctgataattaattacctctggttgttgccttgaggcaaatggcccctttctaatgccaatccgtcctccttcggccacgtcctgcgttttgcaatcgcttgtgggtcttgccttggtggcatcatcgccgcccttcgcgccgcctcatccgctctttttttgtcgtatttgtcgatcttttggcgcatttttgggtccgtaaccagcacattgcccagcttttccatcagttccatcagtttactcggtgccaacactctttctctggctggcatattagtaacataattaggtttccgttttaattgtttccaattatccgtcccgtaattttaaactttgtcaggttggcatacctttgttcaccccaaggtaatcctctctgagaggctccactctgtacgatctgagcagcttttccaacccctgccccgccggcaacggcactctgaatctgttcttcattctgtccaggccgtccaagctgatcttgtaacggtcctcgccctgcttagtcccggctccgaaaattgacatgtcccaagtgttgacggaattaaaaaatgccctggccacttcattggccaattgcgaaccggtgaacggcaaagttcggccggacaaaacaaacgcaattggcaaagaaaggaaaaagagggggagaaaaggggaggaaaatgaagaaaaacgcatggaaaaggaacgaactgtgggaaataaaaatattaattataaataataaaataataataataataaattaaggaatgtttgttattcgaattggcaaatgaatgaatgttatttattgctttcattcattatatgcatcattaagccaacaattttttgttggtttacgtggattttggcaggaaaagccatgggaggggcgcgcggaagtaaagcgaaaggcacggcatttcatttgccaacgcacagccaaacgaagacgcgccaaaattgtttaattaaaaattaaaacaaatttcgctcttttttaatgatgacatcttttggcaaattatcctcttccgtctttatcattaattaactaataaataataataaattgcaattcgtccgttcttttctcaatgctaatggtgtcgcgtgcgtcgcagtgccgtggcatgtgccaattttctatacgcactttggccaattgccgtctctggcgtttcggccaccggcggtttccggcggtccttcgtccggcggaagtccattgaaacgttccgagcacagacaatactccgtgggagcgcataaaaagcgctcaaatgcaaaaattcctggtttttgtttacctggagggcctggagggcccgtgctgcccgaatttccgatttggccttgaagtccgggtgggccttgcagccccatggggccagagattcctgaaactggccatcgtgaaaacgccgcggttttctccctcgtggccctcatctcctgaaagtcaaattcaaaatgaaatttcactgattgtccgcgagccttggagtccgtcacggccgggcatcccttcctctcctgaaatattgtggttttatgttcaaagaacgagtctgaccttttggtcccttctctccgcggttccgcg

SEQ ID NO: 4889 - DNA, 925 bp, Heterodera glycines
tctctctcggtctctctgtctctctctctctcactctctctctctcgcactctctatctctctttctctctctctctctttctctctctctctctcgctctctctctttctcgctctctctctctctctctctcgctctctctcgctctctctctctctctcgctctctttctctctctctctctctctctttctcgctctctctctctctcgtctcgctctctctctttctctctctctctgtctctctctctctctctctctctctctctctgtctctctctctctcgctctctctctctctgtctctctctctctctcgatctctctctctctctctctgtctctctctctctctctctgtatctctctctctctctctctttctctctctctctctctctctctctttctgttcttagcttttcccttttatagcatttttggtgatgaaattaaaaaaacgaacgacaacgaagtgaatgaatgctgcgcattccgaacaacagcagcaggagagaaaaagcggattgattataaaactgctgagggagtgaacatgttgaggaaaaaacaaaaaacaacggcaatttgcgggaggaagggaaggaatggtcggattttgggactgactgatgagacgaacgctgaagcgaaagcagataagctttattcttattagcccatttcaatcggagacgaatttgagagaacgtgggaagagggagaatgaagcggggacaaaagagcaaataatcgggagggagataaagcatcttttggaggctgacgaattgttattttctggaggataaaaaatgggagccaagcaagtaaccgatgatgagttcataatggactggccaatttgatttcacagtggggatagtcaaataactaaagagtttatttactaacaccaata

SEQ ID NO: 4890 - DNA, 6752 bp, Heterodera glycines
ctatggataaaattgattcacccaaatgaatataaaaattgatcaatgcagaaattatagaaaaaagtaaatatcgaataaaattatataaaaaagtaatgtaataactgcaaaaatttatattatatagcatacattggataccagaaaaatggaaaccgcccaaaaattggatactataggggataaaaacaatttaataataataaccaaagatcgccagtagttagtatccagatatcgtcgtcatgattaattgctttttggtgacagctgccctttgaggcgtgccgccgcgcgcgggtttaccgcacgaacgcgtgcctgtggcacgggttcgcgcgggagggggaggggtgcgagagtgaggcggcgcgcggttttaccgcgcgtgtggcacacgggcggggggaaggcggcgtcgcttttgaagtgctggtggagtggaaactttttttgacaaggagggtggcaaaaaaaaaaaaaaaaaacttttgatgtatggggagggggctcaaactttttgtggaaaaaaattttaccaatggaatgtgttgcggggaaggggtgggtgattaatgatttgttgtatggaagggggggggtgctgatggtcagcggcgcagcagcgatgaacggcgcggggaattagagaaagagaagagagtgcatgcaaaagtgagagagtgaaacggtgagaggtagggagagatagagagagaagaaacaaacagtgggtgagagagtagagagacagacagtcagagaaaaattttgtgcacaaagtgagtgcatagaataaaaatggcgacatggcttactaatgaagaaggggggggggcgctgaccaatgcattgacatattgattcgatactccaaataaattgggctcattttagcataattataccattaaatttataatggaattgttttatttatttatttattgttagataatacagtattactttcatggcaccacgacgcaagagaaaggcggctcaattggtcgggcaggacgaagcggtggtgagcggaccgagcgcacaggtgaattgtgttcaccatcaaattttcacatttaaatttcatatgctttttatttcacagttgccaacgaatgacggacaacaattggcatcagcagcaccagtgacaaacaatggcaccgtccaacaagcggaaaacgacggaactgacgcggtggcggcagcagcagcagcaattgatggcaccggcggacaagtacaatttttgtcttttcgttagctaagggggggggggcttttggtttacaaaattcaccggatggtatatgaaaaaaaaaaacttgttaatttggaaaaaatttgggtcagtgttgcttaataaattctcattatatttaaatcttttcagcaattggcggcaaacaacaatggcggacaacacgcggaagcagcagtaatcgatggcactgggatgcccaacggacaacaaattgaggcggcagcggatgaaaatgacgacacaattgggcaagcggtaatttttcacaagcttttccaaaaaaattattcctttaatttgaaggggaacaaattgttgcggcgggcggtggccaatcaatgcatttcatcgtccggctcgcgcagcacagtctcgcgcacggcgtcgcccgcactttcttcgacttcgtccaatgcctcccgaagacagaggaagaattacaacaaaagtggacgcgtaccggtaagaaaaaatttgcaaattcaagccaaacacacacacacacacattcacttcctagataaatgtgaatgccgattgccccaatgttccgcccggtgtactgccgaacccaaaaactcgccagtaccaggtcaagagcgttttggcgcaattcactcatgcatcggggaggaaatgctatttcttggagtggctcggtgagtttgatgatgaaattgaaagaaaaaatgtgtgaatgaaaaggtggacggatggataaggaaattgaaaatttattgtaaaattccaaacgtgtgccgagttaacctggtttagcttcgccacttttggaacggaataatttgagggtgtgggccgagttaacacagtttagcttcgctacctctcttgctatttcactttaaattttctttttctttttccattaaccaatccattttcttctctcatttttttctcgcaattataggctttcgcggtcgcaactcatggtgtttgtcggaggacaccgactgtacagagtacattgaaagatttgggacagtggcaacagtcgacgcggtactctctgcgctattgggtgaaagcgtcccagcttcgatagctgatgagctccaggccaatcctaaatttggacaaggtgtggagagtgaggggaattaaaaattgcataattttttgtcagtgttggcaaagttggatgacattgaagatgaattcatattgaggacaactcagtataatattttgttcgcaaaagggcttatggaaagccccgagggcaaaaccataattgaggatgtaagcacacaaatgcacttttttaatttaaattatatatttcctaaggcgaagagtaaactgggacgcttcgtggcaaaatgtatgagctgatgagtgaactggccggccgaattgaacattttcaccatttaaatttcaccatttaatttcaccaataaaatttcaccatttctcatcatttaaatttcaccatttaattttaccatttatttcaccatttattttcatcatttaaaaataaattttttcgtacatttaatcaaaatataatatggcaaaaagaactgacaaatatttaatgctgcatgtaaaatgtggtgcacactcgacaatagggacatttatcaggactgggtgaaatttttaagtgaataagcaaacactgacggcacagtcccacatgcccacaggccccaaagaattgagccatccccacaatacacaaacacatccccccaatattcgggtacaacaatgtgtcggggaaatggacaggtgccaaagggttcccccaacgaaacactgccttcgtttcgctgccagtttgaagtgcggcttccatcgggttgcgcgctgccgttgcattgagctgctgttctctggtcggcggaccaaattcgcggctgatgcgaccgtagggttgtcccatgcgcatcctttcacaattccgttccctcagttttttcgcacaccctgcaccgggccgaatggcactcgccgcatccttcaacagaacaatttggttcaaaaatttttttgacaaaactatattacttgctattccaaacaacgaaggtgcaattgtagatttgcggcgcgacattttatatttttagagggtttgtgtaataagacaatgaatggtccttccactcgctttgtccctatccatgtgccccccccccctcagtgtctttgccagattcaaattcggcaagccaattaatcatttcatcttaaccaacacacaaaaaaggaaattgagggactgtctcaaaaaaatatatgtttattatgcagaataaatatcaaaattatggattgcatcatcaaaatccattattgtcttttggtcaaagttcactttttcttcattggcgccaaaaggtcggttgcgcggcagttggcccacacgcattcctcacacatctcaaagccgaaggcaaaacggtccccctccaggcgcttcactttctgctggttgttgtacagacgattccaatcatctcaaaattttaattaaaatttaatgaaattgttagtaaatattaccatggcacaaataggtggtcagcaaaaatttgccttttgccaatttccacaactctcggtcgtccactttgcgtttcttcgttgccaactcatccttcggctcaacatttttgggcgtctcttcatgtggcttgggcgactcgggaccaattattttatgttgctcagcagaaacagcagcagcagtagtaagaggagcaacgcgtcttttcattttgacaaaaattgttaaaatgattttgtgtttttggcagacaaactgttttggcttttagtgggcgtgtctaaaaccgtgactcttttcaaatggtgtaggcgtggccacacttttacgcatataaaagtgaaattcttcaacctcatcccactttcattctcctgccatggttcttgtaagcacattttgcgctcagcttctcaactgccctgtcaagtcattgcgcgaccggctcaaccacccagaggatcgggcgcttgtgctgaaacacatcattggacgcaaagcgcgcaccacctacaacgaccgtaatgggatgaccaaaactttcttcgtcactggaatttcggcacaaggcgccgcatttcttcctgcatatgggcaattgcgcaacccgttcaacatcaatgtggcggcacatttttatacacggcaccgcataaagcttcacttcccgtatgcaccgtgcataattgaacgcttttcggggggaggggaggatcggcactacccaatggaacttcttgagctgattgatgacaacatggacatggacatcaacaacaacaacgagcattggctgggccgtcttttcactgaaattgacgacaaacaatcgtcgtcaaactcatccgacacaacaatgcgcctagtatttgagggagacatggatgaagacagcggacgcaatgaatgctcacagagtactgtaccgttatattagttttgtttttgctcactaattatgcatttttcttccttaaaatgaccacttccatctattaatttgaaattgcattttccattccttaatttttcaaaaattgtgtcttctttagcttaattatgcacttttttacctaaaaatgacatcttctaatgcttaattatttcataattgcatcttccattcattaataatgcacaaatttttattaaaaactaataaaatggcataaaatgtacacaatttgaggtacaaaagaaacagtcatatgtgtgtgtgtgtgtgtgtgtgagagagagagagagagataatgtacaaattacaatgtgtgtccaaaattcagcacattgaaatcggccccgatgattccctttcccacaaatgggcgatagcatttttgcataggcatggaaaccacccgacccccctccctgatgtttggacgaaggaagttggggtatgtgatgattatcggctcgtattcaccacttgtcgcgtaccggaccacctcctctttgaagttttcatagcgcatcccctggttgttgatcacatcataatttagcgtcagcccgcgcacttttagcacatgttccaattgggctcccgtctccgcgcccttgcgtcgcagacaaagaccgtactaaaaggtggtaaaattgaaaagtaaacaaaaatgaactgaaaatgcacttgttttgctccgccactgcaaaattccacaatgtcgtggtcggggtattcgtcggtgaactggcccaagtgggggccagttttcagcgggcaccgctcctccgggtggacgaggatgaggctgtcagtgtctaaaataaatgtttgtgcacaaaatttttttttttgtagtttgacttaccagtgtacaacagatccgagcccggtgatctgaccaccttctgcattgccttgagcagaacgaggcgcgctgctgaggtggtccatagagagatgactgaagtactttaacaatttattgtgagtgtgtgtgtctcaccaatgtttgagcatgagtgctcatccacccagtccttcttctgcagataggtgatgagtatgtgctgctcatccaactcgtcgattgatgtcacttcgatggatttgttgtccaggtactccgccaaagtcgctgggtcgtcagtgatgagtgtttgagcgagcccaaagttgcgaagcgaaaatcgaccccctaattttttaaaaatatataataataatggacgacagtactcacataagttgttcaaacacaacttggccagggaccgcttccctttgttgaccgccattttggttgggtcgatggtgatgtcgaactgctctgcgcactctcggacaaactgttgttccttctccgcatcgcctctgatgctgttgtcaaatccactggcctggatcttctgggccataaactcagcaatgtacgggcggaagagcttgtcgtcactttgctcatactcgaggacacggaagacctttgtgacgaggtaaccctcgtccaacgcctcgttgagctcaatcgaggtgcacgtgctcacccacccccgctgtctgtcattgtgctcgcagtggtagtcgttgtgcactcctcctgtcgggtgctctttggcgcaagtgatgcacagggggaagcaaagccgctctccaactttcactggcagaacggggacgtcgacgcgtcggggcggcacaacccacactttgagcagtgccaaagggtaggggttgtccgctgcactgcgccaatccacttcctggttcaacacatgcacgtttggctgtccgatggggtaacgggttgtgaagctgtgaaggaaacaatgttaatttgttacaactttaactgtgctcactttatgtacgggtagagcgatgtgaagtcataataggagattttctctcccggtccagccttgcgcagcagcttcagtggtccagttcgccctcccataaacgcgtcgcggatcaccagcggcccatca

SEQ ID NO: 4891 - DNA, 2566 bp, Heterodera glycines
aaatttcaaacaaggaaatctggcaaaaatcgtattgctagaaaaacaatttttaccatttcaaaaattcgctagaaaaaatttcaaaatgtttttccaaagtattcgtggtgggaaacgttgtgggggaggacgagctgctccaaacagaaacggagttgcgcttcattctttttggttcatttaagcaaagcggattttgctcggatgcgtctgatcggccagttcaacaacgcgtttctcattgtccgtcttcgatcggacgtgttcatcattgatcaacatgcggcggatgagaaatacaattttgagcgtttgttggcacacaatgtgatcaaatcgcaaacactgatccgcccgaaacgcctacgccttggcaatgtcaacgcggcactgatgcgcgacaatttgcacgtgttccatgccaacggattcgattttcaattttacaacggagcgacaagcgaaaatgccaaatggtgctgggaaaacggagcggcggcggccggcaacaaagacgatgccattgtcattgaagacactgagaacaatgatggtgtgcgattattgatggcttttgcgtcatagaaaattggggcgttaaaagatacgaaaatgggagcagttcgttccccctccggccggttcctacccctcttccccctggatcagcccccccccctcccccgaaaaatgtattaaaatttttaatgattttttcaaaagtttgagtttttttttataagaattttaatataaaattttttggaagtttctaagatattcgggcggatagcgcacaccaaggcaaaatataatgacaaaaaatgcggctctaatatactgccaactttttctgtattgtcttacaattagtgccattttgtgatgtccgctcatacacaaaaatgcttgaacgattcatatataaatgttcgaaatcaacactaatcattttttcagttgaacccatccttcttaatgacgatgattatgatgacaatgacgaacaggagaggggtgaggacgagttggacaaacttggcactgttttgttgactgccgtgccggtgctccatggctggcagttggaccgtgatggtcagtcagagatcagaagcaatgattttttggaatttggaatgccgattttggacatttttgcagacattgaccaattgttgtcaatgctctctgaactgcccggcattgtgcaccgtccaagcaaagtgcgcaaaatttttgcttccaaggcatgtcggcactcggttatgtttggaaaggcattgacacaacgtgaaatggaaacggtggggagacagactcattttttgatcatttaaaaaagccgcttaatttttcagataattttcaacatgggctccatggaccagccatgggtaaaacaattgaaattgaaataataatttaaaataattgcatttctaaattttcccaaagaattgtccgcacggcaggcccaccatccgccatttttgtacggttgagagaattatgagttgaatgatttttctcgagtaatctttgcttttattctcgattacatgttttaattgttaccatattctttttttttgtttatacttttcaacttaaaattttgacaattgtacaatttggtgcatttgcataataattttgcaacattttctcctttttttaatgtgtgggcttcgtttatttatgcttatccttcaaaaatatagatatatataatgtttaatgttttcgtactcaattgtttaaaaatacgaattaaaaaacaaaacaaaaattttattcactttttaactaaaataaatcggccaacaaaactaatacatatgtacattaagtataataatattctgaacatatattcatttgtgctctgattatgtgcaaacaaagaatacacataatacataatatctgacaaaggaaatgagggcggggggaggctcatcaatttacggccatttcacgtcattatgcgcggctttcttccctttgtttgcccacaataaacaaaatggccatccatcactttttggacatgtcgagagtgattgagtcttgtggcccctgaatcattctcatctctttgtgtcttaaaagtgttcagccgaaatgcattttgatccaatttagccccactacgaaattagggaagatatcgaaatctttttcaggaatggaaacatccggatttatccacctctcaatgaagcaccccttcgccccctcccccatcgctccttctatttcgagaatttgatttaaaaaacaaataaacgaaatgggccaatttttcgcgcattcgaataaaaaaaaaccacgaaaaaaagcaaattaattttaagaaatttaattcttcttttcaattatttttggacggactcaattagttgtaaaaaaaaagaatttttttttctcaaaaaataagactgaatttttttttttctctagaaaaacctaaaaaaattttgctatttttttccaagtttattccaaattttttgaaagaaaaaatttagtaattttttaggtttttctcgagaaggaa

SEQ ID NO: 4892 - DNA, 1754 bp, Heterodera glycines
atttttggtcgaaaattgcttccacccacttccccttgcttctgctgctgctatgttcacattcccaccaccttcgccctcccttatcttttgttcctcattcactcattcattcattaattgaatgaatgaatgaatgaattgcaccccccacctcatatgatgtccccgctttttgttttttctacgaattccattccattcaaatcatttttgattggggcaatgtgataattgtgatcaatgattgtaagaaacagtccgagtacagcgagattttcagttttgtaaaaaaatcttgaatttctgctgttcccactgtgcttcaatgtcgggatcggaactgctggtcgtaatgacatatgtatacctgaaaacttgaagtttcccaatcccgccggtcccgcaaaatttaagtgaaaaccaatgaaaaataaggccgaactatttattgggtacactaataattaatcatttaaaaatgttttcaacttctaataaccccttttaagcattggaattctaaaatttgcctaaattccagtattggtttaaaaaattatggctttttagttccattctctttttctactgtccattcatcggttgactgactgtccaaccttccaccatccggccttcagattacgatatcttcagttcattactgtacattagagatcgatcttgacctggatccaggcctggatttttcctggaaaactgggtccaggccatttttcggcaaatggatttttcctggacctagtttttctattgccccttttttggttttagtccaatcaatgtcttcatcatcttcctctaaaagcactgtccaattgtcggcatgggaacaattcaaccaccaaaagcagctccaacaacgaccttcgaccaccgttggcaatgtgttcataatgccatcgtcgtcgtcccccaattttgcacgcacacaacggcatcgctttgtgccgttggcgctgcccgggatacgctatgcgcagctggtgcttggcactttgtacctgtcgatcatcctcggctggtcagtgattgcattgctcattgattcaacagcactgtttgttgataaatagttttcaaaatgcacttgtaaggaattgtcgaattctcatgacccacgcgccaccggaatgtttggaatttttaattaatctattaagaaattgaatagaatttttaatcgaaagcgaaatcaagggctaacagcgagaacagagactgctttaggcagatgtgattgcttttgtgatctggttttttcgtaaattttttaaaatttgtatctaaggccttgaaaatctgagtgtttctctccctggtacgacccaagacaagacacctaaattcaagatcactcgaaccataaggggttcaaaatagcccagtattgacagtcgtttttttaatcggggcacagcttttttggaaacaattcccttcgttcgagaccaaaggtttgacacgaaaaatctcgaacaaaattttgcaacccagaaaatattcccactgaacagcgttgtaattctgtctattgttagtgtgatctgcttcaacccggccatcactgtgatgatggacatttccacttcaccgttgttcaacaacggctctttgaccaatcaatcagcgcaagattttgctccatcgtttttgccgttggctgatcggcgtttcattacacaaatttgcagaaagctttctgttggccgggtgggttttaattcaag

SEQ ID NO: 4893 - DNA, 3762 bp, Heterodera glycines
ttcaacccggccatccctgggaggatgacatttccactccccgttgtcaacaacggctctttgacaatcaatcagcgcaagattttctccatcgtttttgccgttgcctgatcggcgttcaaattacacaaatttgcagaaaagctttctgttgcccggttggtttttaattcaagtcatattgtaaaatggaaataaatagtcaaccaaaacttactgtatccgctctctctctctctttctctacttaacacatagtcaagccttttctatgttttctctttcgctctcgctttctaacgcaccttttaactctagtcaaagcttactgtatccactctctacagtatctgctctaatgatcaatttattttcaggaacatttggggcgtgccttcttcaaattttgcccgttggctatgccatgcaaatttttggtagaaaaaaaattttatttcttacatatttattcatcttttctttttaaggtgctaaacgcacacaactttttattggcattgcagtttcacttgccacgggattggtgggctattaatattatttgttggccgagaaacgcgcatagaatttttggctctattccaatttatttgtcagatcagtcactcagtttcatttggccataacttttttttctgacttaatcctgtttatacattcttggtatcaaacgaaagtttaaattgtctacaaaagagcaaataccgtattttctctaattatatgcctgtctccattaatctacccgtctacaattatccccacctttcgaagtaggtttaaaaataatatacccctggccttgaccaggaaaaaaaaattatggccaaagaaactgagtggcttaaactgaataaagccatggtttatcatgttgcgataccgtagccttgtagaaactaatgatggtcttgaagcacgaatctcgggctcaactcttttgtcttaaatctctggaatttttttcgattttcggtacattttttgcatttttttgctcttatgcagatgccgcttgccgcttcaacgaacttttatgcattattcgttgctcggatggtcaacgggttggccatcaccaaccttttcccggtggttggcgcaatttgcacaaattgggcaccgctcaaggaacgaggtgatgagcagtgcaatactgtgtttccgttacagtatctatcaacgtattagaggcgcggacggcatcgggatcccgacggggactttcccgggattctaattacgatctatcacaactcaatttgaaaaaatgttaggatcagattcccgataaaatgtggacccggcaaaaaccgggagttgggtttcactccggttatcttatcctagccggattctcaatccttgtcccaactttttcaaaagtacgtgcctaactaaatgttcgtggatttattgtccatgaagctgtgcgcaataattaaacattcaaatctcaggcgtttttttggccattttgtccggctacattcaattgtcggtgatcatttccatgccaatttccgggtttttggtcgataaatgtatactcatttgtttatttttttaatctaattttaattatataattagttggatggccatccgtgttttatgtccatgcattcatcggtctttcactgtccctttggtgggcactcttttaccgcgacgacccaatggcacacccactgattgggcacgcggaattggcactgatccgacatgggaaacggccggcaacagtggccaaagacggcacttctaaacatagccaagtagatttgatttgaagtactcggcacttttgagaattggccaaatgttcgcttatttggagtccagttttgaagtgggtgtctcataaggaaagtgccgttgggttttgccaaaattgacaaaaaaaaacaaatttttagccgccctatcgtcaaattttctcatctgcttcaatttgggccattttttgcgctgtgtttggcaattttctcattgtccaagtgatctgaaaaatattgtaagtggaaataataccattccatttttttaagtttttcaacactttccttccgatgtttctcgtctcatcattgcattattcacatgctgagactggtctgctttcagctttgccactcattttacaagtaaaaatatacaatagtttcacaaatttatagttggtgtaattattttttgatttaatttaaaaaattattttgtagtataacgaatatatttaattaatttaagaacgattgggaattcacaaaattacagaattgtaaaaataattaattttacgagcgtttagagggttaaaacctaatcgggccaaaatcctttccccgatttcctaatttaattaaattttgatttcaaattgaaataaattaagttttttgtcaaatggttgactggcttcatcactgatcatttgccatctgttaaggacattaacaaggtggaattgaaaataaacagctaatattatatggatatggccccttttaaaatcagagattttgaagtgctaataataaataattattgaaaaaatgcgtattcgaccttaaaatatcggtttttacgggttaatgaattgtggattttgcaaattttaatgagatttataaaatataaattttcaaaaaatttaccaatgctttgttctttttcggtccgtttctgcaattcggctgcattttttgggtaatatttttttttacttttttaaaatttaataatctttaagttctgcactcttttttctgcttgcctcactcttttctccagatatgtttccccgttggaccgtcgttctttgtttaacattggccattggtaattagtaattactaattacaatggaattgctactacatagagaccagaaatttcaaatgtgcgggtcccgctgcgggattgggattaaaattttgcggacggtcggacagaatcccgcgggattaatccagcaatcccaaatctcgtattttttcctaaaaatacgggattgcggactgggatcccgaaaatctcgcgccggtctctaattgtgcctactcatgactcattagcccatgtcaggggctaatgtcgaaaaaagtgccataaaagtcgcaaaaatttgtggcactagggctgcacatagacttatgtaatttccacctcgaaaagcattgcttggcatgaacagcggcggcttcttcaaatcggtggtgctcgtgtcggcacagttcagccccactgttatggccgctgttcaattcactctctgtgccaccattttcattttttcatttgttgtgccggcaatgaccaaaaatggtggtcattttgaggtaaaagcgggagaaatgattggctccttctttggatgctcacttcctcaaaaattttccaagggggctaatttttgatgattttaagtaattttcgcaaataaattatattaaaatttccaaaaaatttcctcggcaatgcccaacggcaacatcggaccccaattataccatgtttttgatatttggccccaaaatgcaaaacttggtaatttcttggcgaaaacggctacaatttcctcctttttttccccacggctgaaaattttaaaataacactggagaaattttttttcttggaatttttccccaaagagcaaataaaaaagtcttcggatttctccaatcggaaaatagaaattttgtctatcggcctgagcgaaatgataaatcaaat

SEQ ID NO: 4894 - DNA, 2414 bp, Heterodera glycines
  misc_feature (73)..(74): n is a, c, g, or t
acacaaatgccatcgaaaaaactgctcacagatccgtcctctctcggaaccgtcggcgcaaaagtgtcaaccnnagcggagtctttttccaaaaattgagtgcctcaaaaattgagcagaagaacagcagagtgcgggacggcacacgcagatgccgaccacaaaccggcaaatccgcagaagacagacgcaaatcaacgcaaattgacatttgtccagaaaaaattgggaaaatgggtgtttttataccgtctaggccccacaaatttccataaaaaaatttcggtttataggtgattttgagtggttgttggtcacgaattcggcacctgttgcgacccatttttggtcatttaaatgattataaatacttgataattttttttcgaataaggaaaatttttaaacctaaaattttttagcacaaaaaaattaaatgttagcgatcaattttgagaaaatttttcaattcttaggggatgttttttctaaattttttcgggtaatttcttagggatgtattttcccgattttattgttttttgagatgcgaagatggccaagcgaaaaattaaattcatttcttatcctttattcatcaaccgtcgaattaagtttttttataagtcatttttttatagtttttttttaaaaatttttttaggccaaaaagtaaataaatttattaaaaagaaaatttaatctaattgtttctgaaaaaagttatttagactagcccgggcaaatttcgttcttctttttttttttgcatttttaaaatccctttagcttttcgctagcccggacaaatgttctcacctcttttctcttcgtctttaatgtccctttagttttcgactagcccggacagattttctcacctcttctctttttaaagtccctttagtcttcgactagcccggacagaaatttaaaatgtcagacttctttacttgcgtgtacacgtctttgtttctagccctcaggccagggagatctcccacaaacttctgccggcttacccaattctcagcttcgtcgtcaatgatgggtcgtttcccaaaatgggaaccatccggtgctaccagtgagggatgcgcactgtgccccagaccaactatgcaccgtttatcccggatggagtttgggagggaatggggaaaagccaaggcgcctttgaccaagccccgaacccccaaacgactcattgactgttaaagatgtgtttattcattcgatgttggatttaaacgaagtgagaaatcggaataataattgaagtctcttccatcaccactgactgactgattgatcactggggaaagagaaatgcgaagagaatgggcggagaaacattacaatgagaaaaggaaaaacgtgtgaaaatggataaatgtgattgaattgataatggccaataaggaataattaaatgagggaaatgcgtcgaataatccttacaatgctgtgcttttctcaattgttatataaaattggtgcacattatacatacataatacatactttagaaagaattgttatatggagagaaataaattctgtttttctctgttaaaagagatattgaaatagtacgccgaaatgagaggtgtatttttctctgcactctctatttattgcttcattttcggcactatctatttattggtttcatctctcatttttgggacggagtaaacaggggacggcacgcggaatttgtttcaccgacacggcacagccgcaccttcgaatgccaacagatgagcatttgaccaccgcaattgccatttttttatgcttttctcgtatttgaaaattttgttcaaccaatttttcgtttgattgcccttttcttaatgagcataattaatttttttttttgttagccccgtcccctccgaattttcttcgccttcgccactcccgcgctttcctttgctggtaattgcagtacggccacaattccgcgacacaaccgcactccaattgaaggaccaactccggcacaactgcagaggtgcacagatcaaaggctatggtctaataaataattgagaaataattaggccgccggatcgaagccgcgaagtgcgcactgatcaaaaaagtacgagtttgggtgtgcgagagttttgggtttcgagggtcaatgttcggtttttatattcttgattgatgtgtgaacctccaaatctccaaaatcaattaaaatagtaatattatacaaaatgggtgttattgaagcaatatttttagggaaatggcgcatttcttcgctttcggtcccattgaggaattcggcttcagtttgcatgccgaaaggggcaaagccacttcttcagtgccgttgacaaaggcagcatcgccgatgagtccgtccgattgaccgattccattctttgcatttcatt

SEQ ID NO: 4895 - DNA, 3406 bp, Heterodera glycines
  misc_feature (3005)..(3005): n is a, c, g, or t
cagaggtcgcccagatcaaagggtatgttctaatttatattggagaaattattaggcccctggatcgaagtcgcgaagtgcgcggtgatcaaaaaaagtacgagtttgggtctgcgagagttttgggtttcgggggggggggggggggcaatgttcggtttttatattcttgattaatgtgtgaacctccaaaatcaattaaaacagtaatattatacaaaatgggtgctactgaagcaataatttttaggggaatggcgcatttcttcgctttcggtcccattgaggaattcggcttcgatttgcatgccgaaaggggcaaaagccacttcatcggtgccgttgacaaaggcggcatcgccgatgagtccgtccgattgaccgtttccattctttgcatttcattcggtttgtttagtgccggcctcgaaacatggcaaagaattgtcggcgataacggttgtttggtctccgtacaagcaaaaaatcgtcgctaaacttggccccactccttttgtaaaattgctgcctcgaaatttgtggtcaaacttttgctgcaatcagcaataaaagatattagcggcccaattttttcgacaccaatcaaaatataaacctcaaaatttttgtccaattcaatataagcgaattttatgttttttttttgataagcggattcaaattacaatactttctcgaatccattttaactggatctaccaagtataaaaactgaaaaaaggaaagtataattgtggagaaatgtcagatcgatcagatcaaaaatctattgtcttgaacaaactcagtttttgaaaacaatactaagttgaaaaagtccggcgtaatttgaagaaaaaaaagtatttttaatgttctattttgattggggtagaaaaaatcgggccgtcaatgctcaaaaatggccttagaaatggccgcaaatgtgaagcaaaagtcggaccgcaaaattagtgacacgataaaattaagggaaccaaaaggcgcgaacgaatgcaaacgatcatttcggtggatgaaagtcgcgagccggcgacccctcagcagaaaaagcgcaaacaaaagcagcaagcggtagaacaattgcttgtggaagtgccggaagaagagcatcagcaaagcggaagaaagccggcgggagggaaaggcgaaattggcgaagaaacggaggggacgggcggaaaggaggggacggggcagcacttggaggaagaggcacaacttcggcaaattggcccaacaaccgacacaacgccaagagatgccgaacagacggggatgagttttgttggcaaagtgaacacattggaccagaagattgggccggaggcgaagcggctgcaaattctgttggaactcacgcacaaccggcacaacagggcgaatctgaacgcaaaacagctgcacgtggtcaatgaaatgttcaacttgttcatgtacaatcacacatttgttgtttacctttcattcattcgttattatctttggcaggtcgcgctggtccaaaattgtggccacaaacagccaatttctgaacacactgaccaacccggaaccgttgctgtcaaagaggaaggccaaccaacagggcacggaaaaggagggcaccgttgctagaatggcccaacaattgtccgtttggctaagagtgtctgccaaatacgtcgacgaattgccccctcaacgccgccaagaggaaaagctgaggaaaaccgcacaaattgcacggcaattcagcgaacagcaaaaccaaatgagccaaataaaacgaatggtaaggcaaaaggaggaaaagcggacaaaaggaaaaaacgaaacaatgtcaggcgaaattaactgggaaagaggaaggccaattggaagcattggagggacaaatggtcgaactgttgggccgaattgacacggagagacgcgaagcagagcagagtgaaaggcaaagtgccactagcagacgggtaaaagattaaagcgatgaaaatgaaaaagaggggaaggattggcaaaaaaaaagtggaaaatcaggcacaatttgtgagaaaataaggccaaaacggaagaaataagaggacacagctgactcagtgatgatgttggaagatgcgcatttgaaattcacattcttatcagccaaccaccactgttcaaaatgggaaaaaatgactcgccccccgacgaattggcaaatttcccgcgtgccctcgtcgcttcaaacatttcgcctccgccaatggatgaagcggaatgcttaaggcaattgttttgctttttgaaatgttatttgaaagtctttggcaattaaggcaatcatttgttctcatggaagaagcggaattggccaaaagagaaaatgagaaaagtgagaggggggaatgggagcaatggctgagggagaaggagagtcagctgccgggggatttggacagtttgtcggcgcaattggaaaactgtgacaagtgatcgaatgccaaatttggccatttcaaaacaaaaatttgacagaatgttcgcccaactcggaagaagactcaccgaatcggacgccgaaatggtcgaaccgattaagaaattgcagagaacggcggagacaaagcgcacccattgcatggacaacataaacaaaacgcaggcaaacagaaaacattggcataaaactgacaaatgagagcaaatggattaagttggccatacacaaagcagtggaagaggaggagacgggggacaaattcaggcgagaaatggtctttgaaaagacgaaattcggaagagacattggcgagggacacggaagaaaaggtaaaggcatgaaacagcggcagggagaagcaaagggaggggaagggtggacagcagtgaattgacagaaaaagccaaaccaagaaatgacaccgacgagagtctcgaacccgagaaaccctcgagaaagtcaatccttccatattatcttttccggtgatctgatcctttatttcctccgtttttgngctgtccttcgatctctttggacgcttattccccttccgtcgcaatattccttttctgctgctcattccgcatcctaatagctttgcttttattcagctgcccttagctaatttcttcgcacctttggggcaatgaaatgcatttcgctgttctcccgtcccatcagaggcccaagttacgaaataaaaaaatggcaaatcaaggagaggagagatgaaaaagtgtaaatctctgaagaaagaatcgttcaccgtacaataaatgatcaaaagggtacagtggagagtaacaaaaataggtgccaggggggggcaaaaaatatgggtgccagggggggcaaaaatagagtgccaatggggcgggagggaaacaaaaaaaaggggccagggggggggggggg

SEQ ID NO: 4896 - DNA, 574 bp, Heterodera glycines
taaaactgacgaaaggagaaagacggcaaaagggggaggagaaaaagatggaaagtgtgaagaagagagaagtggaaaatgggagagagagaggtgaaggtagagagacggcaaaaggtggaggagaaagtgatggaaagtgtgaagaagagagaagtggcaaatgggagagggagctgaggagaggaaaggagatagacgacaaaagggggaggggaaagtgatggaaaatgggaggatgagagatgtaccaaatgggagagggatgcggagaagaaatgagagagacggcaaaagggagaggagaaagtgatgtaaaggtgtctaaaatcgggttaaaatctcagttttttcaattcctgatcgcctaaacagcattatacatgtgatagaagtgattgtacctgataatttgattgtctgtaactttttgaaaaaaccattaattattcaaaaaacataagtaatgtcctaatatactagtagattactatttcttaattttaatgctgtttaggctagcagggctttaaaaaattcaacttaaaatccgattttttacataggcgcattt

SEQ ID NO: 4897 - DNA, 678 bp, Heterodera glycines
tttccgttttcattttgaaagaaaattattttttcttttcttctactcttggaaagaatagcaaatcgaagatcaatcagccataagcccaaaggaacagaagaagccgagggcaaatgttctccttttttgttcaatttgttcgcttaataaattcgtttttcataatccaaaaataatttgcaaaggcaattccatcgtaaacaaaggacagctggccaaacgaacaaacgcgacaaatggccaaacattttctgcagagagtgagggcggggggcacttcgcacttggcaattttcagggggcggcacgaacgcatttcacaattattctaatggcatttgcttaatccattgcaggaaagcgtcccattatgaagagacactcttttttattatgcttctttaatttgtgggggcggaatgtccggtggttataagaatcaatcaccaccaccaatgattcttaaggaattttaaaatgggattaagaaacggaaatgattattcatttgccatttaattcagcagatattggcaatttgaccgaagatccaaccccattacgacagaaaccaacggcggaagagattaatgaccaaatagggagggggggggggggacggaaggaccaaaggggggggggagagggaggggagataattatgagaacaaacca

SEQ ID NO: 4898 - DNA, 2630 bp, Heterodera glycines
cgccgttttaggcaatttttctttctttctcttcggccttctccacgtgatgctcttctgctccctttaccaagtgatcagccaacccgcaattaggagctctatttccgcgttaagtcgtggattgtgactacattaatcagcggacagcgactcattcccttccaaagtctcgaggaactcatccctttgctggagagcgggcggtacaaattcgccgctcttccaacaaatcattggttttgtcttcgctttgcttttttcgaaaaccgatccaaagccccccccccccacgcccgactcaaaaggttttttgaaacggtcgaaagttccaacgacccgcggcacattcgaattcgaaatgcgatgcgcaaatatccgcttgaggtttacgaggacgagtcgcaagtgatggagctcgttcaggtcttactgttggccttcaaacatgcgatgcccatttctgttttagtccggcactcacgtggccatcgtccaaggcggcaataccctcgaatgggtggccaattcgttttgtgaggtcgttttcgtgaggggcggaatgccggaaaaggccatccatttcgcattcgcaaagggctcaccgtttgtaaaaatgttcaacgaagttccaaacatttggccaaattggacaaatcaccaacagcgattaaggcaattggacatgaggcggtgtttatgcacagaaagcgatggaaatacgaatattacacggagaagcagagagagcgcttttgtttggagagcgacagagagagaaagcgcttcaaacctttgggtgggtggcgaagactaaatcctcctaacgcaacaaaacggcctactcagaattggccactcataagcgtaccaagcgtgactttccttgtggcttaatccctttttggtattccgtccatggcttgtttgtcggcctcccttaccaagcgtgactttcctttaggcttaatccctttccttggtccttgcgttgtgcttctcttcggcaatgtcatcgctttggttgcgttttctatggaaacaatcgttcacttttttacgcgccacaacataaggaaatcggaagaatgtccgagaaaacaaatggaagaagcaatccgtgccgaaaacctttgcactgacaacgaactctttgaaatgcaacgaagaaaagaaaaatgaacgcaaagattgtatgattatctgattatgtacattgataactgccatttaagagggattaagtttcaaaattgccgctgacaataaaagtccataaatttaagtcaattaattggttttactttcgccaatttggcaagaccattttgaagaataaaaggcaaaaattcttgagaatgagcgagtatttgaagaggatcctgtccatgtccatctgctgttggttgctcagatatgaatctttttccgctttcgccattctccgctctctccgattgattcttcccctctctctcccccccccccactttttctaattgctttattcactcataattttccctcatttattctcttatattttcccaatttccccctcccctttttcttttatttaaatcgttctgagaatgcgccgtcgtaatctgttcaagatgttcttcaacaagtatttgtttctgtttgccgctttccttgcctctgattatgtgctctattcgaaattgtcaaaatttttgttggatgaaaatttggatttggaggaattaaacgcgaagacattccatcgggtgaccattgaccaactaattgccaatgtcagccgcagcactccgttggatttgctgaccaaaattccgagtcggaacgacatcgacccggaggagaaaagcgcgttcgcatatcagaaggtgaagcaacaaaaaggtggggttgctgatcagagtgatcagaggcgagttgagctgatcagtagtgatcagaataaaaaaatgtgtgtaaaatgggagtgtcaatggaggaacggtaattagtgtaactttatctgctgcaggcagtgtgcaattcgttgacgcggattcgaggagatcgcaacaatttccaaatttgttatcctcctaaaagaaatctcaccggacaattggcaagtgaatgaagcaaccgaaaatcaaagtgcggagaatgttttaggcgtatttcataaatgggaaaagggacattccatttgagaggaatttcaaaacgatgctgaaccaagggacgaagctgaaagtgttcacgaaggtgtgctcagaggtcggaacacacattgacaaaacttttttgaacagaagaaccaatggacgacggaagacggacaatgggaggagggggcggacgttgtggaggatgtgaacgtgaagatttacacggaggaggaggaggacgagcacggacagagccagacgggcatcaaggacctgatcgactcgcaggacgattaccatctgatggaattcctcaaattcgaaatgagcagtcagttgagggagggggaagggcgggtgctaaacgttcgttaaaccaccaattgagccatttttgaacttaaatccgtcataacgtaattctactcgaagagcgcccgggtgaacggatttttggtgtgtgttagagagcttcagagtgtt

SEQ ID NO: 4899 - DNA, 4802 bp, Heterodera glycines
taataaaatgatgtgatgaatgaagactgaatgtggaccagcaaaagtgagtgacaaaatgatggctatttatggacgatgctgagagatggtattgacacgaattgggtacagtaaatggcgtacatttgaatattgagtgatatacacaacatttacaaaaatttttttataagattttacaagttaaataagaacccatcattttgtctcagttttgattctccccccccccgcaaagacttgaccgatcccatcgttttctccataaatatccccgtgttcgcctcccatatgctcatccgtctcgatcacttctcctacaacgaatttcgatatctgatcaaaagactcgcctatgccctttattttccgtattcagtgagcacaatcgaaattcaagctgataaaacgcatttctttcctcagattgaaagtgatcggaaacttcgagtgcatttcgtgtcgctaatgcacaaatattccatggacagatataatgtcattggattaatggaaactaaatgggccgaaaaagcaatgagtgaatgaaagagagaggaaagaaaagttcaaccgaattaaaagattcgatttatccaattgtttgttgaacattgattatgcaaaaatatgctatttcattagtaaatgggctgtgggtgagggggtgccatcagtggagaagccgaattggggccaagactgattcgtccggcctgttgctgcatcagctggggcggaaggggcgcggattggtcggacacaaatggcgggggttgggcagcggccccattgaaaaacacctgttgggacagggagcggatcagatcgatcaaaatgggaaacataataaatgaaaaagtgccaaaataggaaaaaggaaacggcaccaaaatcgggtaaaatgaatatagaaaggttaatcacccacctgctgttgctgccgatttggcaattccattggagggaatcggtcccatggaaagttaaagtcgagctcgtggaactctgcgggaagggggggggggagattcgttgagggttcgctaacgcagcggctgaacccaccgtccaaactcagcttttggttgttgtcccggtcgaactgccgaaacacttccggcagttgtgccacactccgctgcaatgttccattgatgtaagtgcttagttcgtccacgctgagttcaccgtctcggttttcgtcgttcttctgaaatgccattttgcttgggggcattgcccctgaggcgatcgctttgcctgcagcgtgaacttcgatgcctccagcatggccgtcttccgctgctcgtccaaacggcggacaaacgcgtcgaattccgccttggtcactttcccatcgcctgtttttctaacattttctccttatggcttttcctccctacgatttgtgtcaatgtcgttgaattcagtccgcaccgattccacgtaaaagcgatcgcgtttcatgtaatcgtccagcgaaatttcgttgtcccgatcggtgtcaatgcgacggaacatttcatctgatcattggatcactcactcaattcccttctcttcgctgtgcttcctcggcttacctttgctttcgggctttatcccaacgaattgcgaattgccttcgcttgccaccgcttcttccgtcggcgttggcggcgattgtctggccacttttgtggttggcctcgtcccttccggcgtcgttgcctcgggggggcgaattatttgcgattgggcggtgggggacgactgagttgtggcgagggatgaggacggatttggggagggaattgaagcattttgcgcgaaacattcaaatggcaaaattgcaataagcaaaaggaccgaaagaaacatctgccgaaaaaggaattttgggaaaaaagggaaaaatacgaaaggaaatcgggggggggggggatttggcaattgataaataattaagtaattattacattataaaataatcatttgcgaaaagtgaacgcttcgaatatgctgtaaattgcttttaactgtgcttataagcgcacttttgctaccgtaccgtgttttgttttgctacggtatttgtgcttaattttgcattcgctcgccgtcggcgacggattattcccacggaaatttatccgatcagagagaatacacacaaaaactcgtcggaacattggagggaaacaaagccaccaattcgaatattttgcccaccgatgggtcccccaaaatcggatcaatccgaaggatcaatcggcggaacgaatccgaccaatgccttcgtctttttgcggctctgtctcaatgaatggatacattttaattcaaatcgaaattggcagtcgtttttttcccttggccaaatgtattgttttatttttccatgccttcgccccaatgcgtccgccactccttccgtttgttttttcgcttcctttgctttttttcctctttccccgtctttcgtccggttgggcacctctcgacgtgatcaatccccagcccatacaaacaaacaattaaccggacagaagaaagggaagcgaatggatgaataatgcttttgtgtccctaaagactccccgaaggaacttctgttagtgtttgtttttgtattcccgaacaaaaaggcaaaagaagtcattgttttatgataataaaaccgtaatgaataaacaaattcttaaatataacaaaaaatataaggcgaaggcattctgaatattcttaaaataatttggatatgtttaagttgggaatggattataaaggcattattggaataattagctaattaatgttgccaaaggcaatcaacgcggtgtcatcagcgcttttccgccatcgattttcagcagctgtcccgtggtgaaggtggcatcccgtgccaagaacagaatgctgctggccacctcctccggcgttccgactcggccgagtgcgtgagtttgggcaccgcgacgaacaaactgaaagtcgaagaaaaaagaataattgaagggcattttgagcaagactcacatcactgtactgctcctcgggcattcccgaacgcaaatgcaattcggtgacgattagtgcagggcttaaataagacaaacactggtcattgacccgttgggtccctcgcccacttgacggcattgactcggatgcctttcggtgccaattccatggaaaggcattccgtaaatttgtcaacggcagcttttgaaatgcaatagtaagtcacagcaggaaactgaacgaggaaaaataaacgctaatttttacaaataaatgaccaattttgaataaattaaaaagcaaaaggggggacactttcggtttccaaatttttttgtaggaaaatggtctaatcgtgaaacttgcttctggaggttttcaggttgctaatcacgaaaatgacataaatccctgacattttaacaaaaaaaaatttggataaagaattagtcaaaattgatgttagattcgtggtcaacaaccccgaaaaactaccggagcaaattaaaaaatgaattggcaatagaatttaaatataaaacggcaaattgaaaggaatggctaacgaaccgcgcaaatgccagcgatgctactcactaaaccaaataattaggcaattgcaattaatgcaaaagaaacaaccgttcacaatgcttcctttcgtcttctccaaatacggaacaaccaattgacttagtctgatcatactgaagagggaaatgagtgaaattgaagccaaaatattaagtaactgacaaatgagtaattcaaaaatggatggtctgatttttgattttattgctcaaaaatagagatcgacattttgaaaaatgcctggacctggacctggattccatgttggacctggatttcctggacaaaaatccaggaaaatccaggtccaggaaaaatccaggctcctcgagacctggatccaggcctggacctggatttttttaaactcattttaaaaatcaaaaaaatgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctggacctggattttttttcacatttgacctggaccctggatttcctggacaaaaatccaggaaaatccaggtccaggaaaaatccaggttgtcaaaaaatgacctggacctggatccaggaaaaatccaggcctggatccaggtccaggtcgaactctactcaaaaacataattagcaataaaatcaaattttcaaaaataaatttttgtttctttttcatgaaatctgcaggattattcattcattcgctcgttttgccttaccttttcacattcacattcatcaaaccatccaaaactgaagtcggagtgttttcggctcctccggacgcaataacaccggcacaattaaccttcaattagtaaagaacatccttttctaattaggtatttatttattcaaaggtctgaccaaaacatcgattcgtccaaagctttcatccgttcgtttcacaatgttttgaagcgttttctcctcacaaacgtcgccaattattgtcagaacctaagagagagagaagtgtgcccagttttcagcgtttacttccttttttcgacctgttctcgggtcagtccgccctctgccaaacaattcgaggccactccctccaacgctttttcattacggccacaaa

SEQ ID NO: 4900 - DNA, 1057 bp, Heterodera glycines
  misc_feature (30)..(30): n is a, c, g, or t
  misc_feature (72)..(72): n is a, c, g, or t
  misc_feature (119)..(119): n is a, c, g, or t
atagattagaaacaaattaaataatattantgtaaaattaaaaaattaaatattcaaatttcgtaaagaatnttatttagattttttaaaataattattttcataatgaaaaggtgatntaaaattgaaaaaatttctttaatgaatttttgaattaaatatattttagacaaatttgttaacagagtttgaaccaaaaagggttaaaaaaaccgaattttgggtaataatggtttaaattttgaaaattggaattattctataaaaaaattatgaaactttatttttatttaaaattttttaaagtttatgttctcaatgaaaaaattatatttatcaaactctgaattttttcctttctctcaacttttgatctcgaatttttatttttgctctcgcatcccgcttcaagatgtgatcaaaataattttatacgaattgtacacaatgtttgtttaaattaacgatgataattcttcgaccataaattctgaattgtatttttattttattttttttgcgcgccaaaactgaatagaatgtaattaagaaattaattaaatggcctttttaaaattttattgcctcttcgctagtttgggtttttttcaaaaatgtttactaatcatcttttgggattgtctttcttttcgcttattcctaagtgagtgtcgtcagcctctgtttttcgtccgcgttgtccacgtcttccaaaaataacttgtcgtccccccctccgacttcttccatttggcccaatggttctcttggcgattgtgtccgtgccatttcctccttcagaaacatgtgccataattggaaaacaatgtctgtggtgatcaaatcgcccgcattggacgcttaacaaataaaaaatgggaggtaaacaatttataataattattaaattaattaccaattaaacggagcagaaaaacaccatcggaacgtaaaaaactgttgacgaactttccaattgcacgcttttctgagggattggaagtgattgtgtcgtttttgggagtaaaatttacgatgaatttgaattacccattgg

SEQ ID NO: 4901 - DNA, 4205 bp, Heterodera glycines
ttttcttctccattgttcaaggccgtccctccctattatgaattttgtatttaattgggggctccttccccaacttttccaaaatttgatctgctgatccgttcagcgactaatttggtgtccctccgttcattaaataatttctccaaaatttactcgccatttccccgattcttcattctctccctccctttttaaacttttctacccacaattcccagaaggtccctttacaaaacaaaaacagctaaagacgggaaagaatgcgtaaaaattggagagaaacaaaaaaacacaaaacgcctccagcaaggcaacagatcagaggaaaagggaggaaagaacgaaaaagtgatcggagggggggggggggagagtttcatcgaagtaagttaagtgcatgttctccctttcgcatttccaattaactccccaaaatgtcccaattcttctcgaatgactccccccccaaatcaccctcaggtcttctcaaccattaacaataatatacattattagtatgagatcaaaagaagcgcaaccccacccctttaagataatgcgactctcgccctctctgtcactaccttttataatagatttatttaagaggatatgtattttaaatatcatcttctatttttttttttttgattttgtgaaattctctaaatttaaaacaacttttgaaaatatttaaaactaaccaaaattggtatatcgtaaaattgatgtacataaaaataaaaacatataacaaaaatcaaaaaattcaaaatgaaaaataatctgataaaaagattaaatattgtctgaataagatataaagaaaaatttaattaaatggaaaattcattggcaccaaaccagagttgccacccgaatcccgaaactcgaattccgacatttttctcgacccgaaacccgaatcctaaccagatgcttctgctgggtcgtgattcgggacaaaataagaatgtatattaaaatttttgtgaaacaattgtgttcaagtaaatcaattattatctgggctcgtaatgtgatttagttttattatcatgttgtctcgtcttttattcatttctttgtgctttaaaaattattttttagatcacatagaaattttaataataatttatgaatttctttaattgaaattttttcaaataaatacttagttttatttacacaaaaattagaattaattcattatatatattcgaaaaaaatcattcaattttttaagtcaatgttatgtattttataatattatattatgtatatattgtattttttattaataaattcactaatattatggagttgctttaaaactaataaatgaaatattaattattgtccaatattattttaaaaatcaattgtttatattacaatattacatatacaaattgtatttataattttctgttggtttaaatatatttttgattactttccagtttcaattagcttcatggaaaagtatgttattttaatttgattaagtataattatgacttttgttatttcgaaacaaattatttattcaacaaaccaatataaatatgtaattgaatcaaaattaaaaaacataaaaccaaatttgttagaaaaaagcgtctagaaatatttgttttccattatagtatgctagatgtaaaacaaaaattctgtttattcattaatttaacttagtaataaatgcccgaaatagtggcaaaataaaacttttttaattcaaaaattaaaatattggcatagttacatattttacagccgtaattcgaataaatattttttcaaagccaataaataagaatttataatcaataatcaaatcggatttatttattttttttgtattttataattatagctaaagtaataaaattttctttttgcattaatttttaatgaattaatttaaattttataaagttatacatcttaatgaagtcaataatacttttaaaaaatacttgatatggtccaatatttcttataaatattaatatttacagaaaaaataatacttaaatttgtttagaatttctttatttttgtatttaggttccatttctaaaattttttacaaataaaggtacttagggtgtaacataagtttccgcacaactttttttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatggctgatttaaagaaaatgaaaagagatacagaggcagagaaaacgtgagtaaatagagcaaagttaggactataaaaaattataagaaaaaaattttattacttcaaaaatgaattattggagggcggaatctaaaaatggtctccaaaaacggcatttttcaagaccatcaaataacaaaatgttttaaaagtggttttggaaattccgaatttaattaaactatataaattgaccacgctgagtccgaatatggctttagatttggtctctgggttctcaacaaacctgtacagctccaacttcatgcatggagttggagcagtacaagctcagagttaaaagataggtcagatttaaggccatattcggattctactggtctaatttgtacagaaaaccttcttttttgttatatcaggttacttttttgaccataaaaaatcgagaaaaattagtgggccaattttcaatttttgcatggtcgggaaaaaatactaaaaaaattgaataagcaaataaaaaatgaaacaatggcatgaaatgaaagaagactttctgacgaacaaaataaaaaaagaattattaaaataactgcagaaattacggagttatgaatttttgaatttgtcaaaaaaaaattgtgcggaaacttatgttacaccctaagtatttagaaaatcccgaattttctaaatttttttaaaacaatcataaaatttgtacaatttgaactcgtactcctagaggtttttggccttttaagatggaaggaatcatgttaggtagtttggttttttgttcgggttttttggaaagaagaaaatgtctttgccaaatatataacactacatatcttcatatttcctttctctgttatgagtagagacaaaatgctgaaataggtactaaaatgggtgctgaaaaagtgcaaataggtggtaaaaacgcccaaaatactcaaaataggtgttaaaaattggaaaaatccagtgtttttatgcactaaaattcaaaaagtgactcatttttgatcaatttcgcccgcacagttgcaacttgtcaagaaaacaaataaataaattttggagacgcatttttgggaaaattttttatttcttatggtttattttctgaaaatttggtcaaattttagggggtatatttttctgaaatttttgggatcgattcttatgggtgtatttttcgttttggctcttgtggagtttaggtcacatacacattttttttaattaatagcgaatgaaaagaaaaaaacagcaagcagattttgaaacggagaggcaatgaagccatacaaaatagccatttcatgcatttgaattgatttggaataaatgttaatttagttgaaaatatttgactttttgtttgaattcgggtcaggggttcgaaatgagtcgaaatggatgccggattcgtgatcattagggctataaattatatgcactaaaaaatgccaaatatgcgcataaaatatgcactaaaaatccttcaacctaaaaacccgaaaaatgcccaaatatgcactaaaatatgccttaaaactgccaaaaatggcttttaaccatcaaaaaatgccaaaaattgtgtaaaaattcagaattgactttaaaaactccaaaacaatggctaatgagcttttttttagacaattgcaaaaaattttaatttcaaaatttatatatgcaattttgaatttttttttttaaattttattttatgctcaaattaaattacttttttttgtatcttgtatcaaaattttttttccaaagttcttacaaaaagttcaaaattttttcgattttcaggggtatattttttaaaattcacaaaaagtcgatccttaaggg

SEQ ID NO: 4902 - DNA, 5764 bp, Heterodera glycines
tagaaacacaaaaatggcaaaatatgcatttcttctcctcacactagaaaatatgcttttatatgcactaaaaggcttcacctaaccaaaaaaatttaacgtagaaaggctattttgagcccctttcttcatagcatatgcgcagaaaaaatatgcaaaagcatataatttatagccctagtgatcattgaccgcaaaaacctcaagtcgcttcttttattctgaaacgtaaaaatgtgtaaaagtattgcaccaaatattttcttcaaaaatccaattttcaaaaataaatggttgcaaaaatgttttgcttatgctaaacgaagcgtcaattagtgcactataattttattggtcttcgagaaaattggtcatgacccaaacaaacccctctatggcggtgcaaaagtaatgcaccaaaatctttaacagaccaaaactcaattttatatagagacaaaaatctgacgaaattcattctaaaacgaaaagcagtaaaacattgaaatttttgaaaattgttcagtcccgatttttttctcggtgtccaaatttccagccacgacattttattaaaaatattttaattttttttagtatccatcatttgtctaaaacattcgctttttcagcctctttctcccctttccctccctcatttttaatttctttaaagttttcggccatttggtgcgactactccaacgggctcccggacatttggacagggacattacgacagtgaatgcaaattttttactgataacaacttttgcaaacatatgctaattccaataacttaatttcccaccgatttttttggttcttgataagaatatttgtaaaacatcgcttatattctctcccgttaatgcctatgggtcattcattcttaccgaaatgcattcctcctcatctctgaagagggggaaatccacgaaccccagcaaaatattcaggctcaagagcaaaatcccgaccctgacaattatgaaaaacgtttcttttttggtgaaactatccgtcaaaaacttgtactcaaggcagatggctttgaatacagctatgaagctgacagtcgcattgctgatggtttgaagtccattatctttttctttgctatctcgacttaggcattgagatttaccgttgcattcaacgacgcccgtattgtcctggtcgaaggcaattcgcgccatttaccttgaccgtgttaatcgcccttttttggcgtacttgcgcgcaattgcatatagaatgcctgatccaattgaaaaatttaatcatctattaataggatcaaaattgtatattttacgtattttatccttttttaagatttgcattcactgtccaaatgtccactgtccaaatgtccggtcaccctccaacgcctaacttcgtcccaagaacgttcagttccgtctcatctgatgccgagagttcttccaacagtgcgtcctccacctccaacaatcggacttggccaaaatgaatcggtgggcactgccgaattaggcaggggtagactatttttaacgcccaaattttaaatgtatataattttcaaactaaaaaagcgggatacacccaaaacgcgtcgccgccgaaaagtcgccagaaaaaaatccgaaaatcacgggacataacattgccgcaaaaaaatacagaaaataattttagtttttgtgaaaagccaggtattactgaaataattttctgaatttccagaaaaaccaaaaacatgaaattttttcaaattaggctagatagctaaaaaaatttggtacttatgtattaaagggtgcagattttcaaaaaaaatctgataataaaattttttggggttttagggtcggggaaaccgattctggcatccattttggcccaatctgaaccccgaacccggatttgaacaaaatgcgaaaaagccgaaaattcaaatttttcgatttatgattttttcaaaagattaaaattcgcgggaaccggaatctcgagggaaaaaccgggaatcccgttaccgttttccgtcttttttccgggacaggatttttacgtgaacgggaaaagaggtaatctctgggaatcccgtcccgctttttttcattttcccattcctgttcccggaatttttttacccattttgtgttaaaatcaggactcccaactccgctgattatcatcatttttctgcttttcatgaggtcaatgatgatttttttgagataatgattttttctgatttttgagaaatttgctgatatcgcaaattggtgactttggtggaaatctgttaaaaattcacccaatttttgaagaaattttcccagtggcgcccaccggcgccatcggcccaaggttccttcctaaagtctttttttaagaaatttaaaaatatgaaaaacacacgacagaatcatataacaattacaagaattaaactcccaaataatatgcgctttgcttgttctacactttgtttgaagcttctaacatgcttgactttttttgttaggaatcgaaatgggtctaactggacgactgattcatgatcggcggccctgaaaatctatgcattttgaactttaaaaacgaaaaaatagaataatttacagggatccgtcaactgatgggataattcataccaaattcgtcatcacgagaatttaaatttattttcgataattcttagtgggggacatttcgacgcagggacattttcagcacgacattgcaacatgtcaaccacaagtaccacttcatggcacaaagcggacaagtgacaccacactcagcatactgccgaacaatccaggccaatttacggggcccagattaaccgaccaccccatcaagcaccaaagcatggtaaacccttttctgagcgaataaaacgaaacatatgtccgtgggttttatgtgtggacagagtatctctgattttaaaaatttatttgcaaaataagcacaagtgccgtgttaaaaaatgtcaaagtttttaataagcaaattaaggaatactttttcctcgtagtgtccggtggcgtagccgattcatttttagatattataaaaaattaaattcaacaaaaacctttgtattacacaaattttttaaactttcgtttgtataagaattgtaaaatggatttgcctatagacgatcctaagtcgtgagcatttggtctcatacgcgcttaatcttaattttgattttattattgaattatagagttcaaaattgggtatttgcattttgtttgaatccgaattccgagttcattaagcccggaacggttgtcaattcgaaaggccccggctggacctggtcaccagccacattgggcggaatgcaaaccaacaccacacactttcggcatactgcccaacaccactggccagtgttgcggggctcagctcaacaggccgcccctgccattggcagaaactggtaaatcatttcctgattgagattaattaatgaaatctgatattataatattttcttagcaaaaattggtatttttaaaccaaaattttgtctcaaaaatttttgggtgaacattttccatttttaatggtatatttttaattagaaatgcttttttcatgcttattagcacgcacaatttagctaaaaaatcagcaaaatccggtctctattcattaatgtgtaatttgcaattttattttgtttgagtccgggttcgaattttcagaataggataaaatcgatatcagattcggatcctaacacgaaaatccttaaaaatctcacgaaaattttttaatttttttcagtccagcagcttgttttatcctctgaaaaacacccaaatatcggttaatttcgtttgaagcgaataactcaaagctaggtttatatgcgtttaacgttgtcttgaatttgaggcgaaaagtttctagccgttgcgaaggtgtcgtccaattatgacgacatcaccattgtccccgtgggtcgtcggtacgacgaggaggcgtgggatggcgttttctgcgcgtacatgcacgccacatggctcgccgaagtcgccggcagcgacttttttgaccacaataaggtcacggtccagatcgtgccgcgagaccaccgcccgatcagcggaccatccggcgcagctgccatgctgtgcgcattgatgtcgctagcgactgcacgcttgtgccgtgccgacggctgtcactgctgtgcgcgacgactagtggcacggctcgtgatggcggaggcgaacgccaactagtggcatgcgttgccggcggatgtgaagggtgcggtgcagtcggtgttcgtggccgacattcagggcctgctggcagaagtgctcgtttgatgggcgggatgcttttttgttttacttatcgggcgacccgggattggcgggttttaaacagagctgtgcagccctggttattttgcatacatattcattcacccatatttaaaaaaaacattataagaacgattttagctttagttggttacggtctgcactctgtgtcgtactgtaccaactaatagcatgttttaaattcaggatatgcgttttatgcattttgtagtgaaaaaatttatttcataattttgggcttatttcggtgacgaattttaagtgttagggtgaatgaataggcatgcctaacttgcgttatcacattttttgttttgttacaatttggataaaaaaaaaactcaaaatgaaaagttaaagcaaaacattaaaaaacataatccttcgttggcttttgcaattcaattttgaaatgaaagcaaacaaaaaaatatcaaaatgaaaaaaaaattcgccatccgccgttttgccatccgatttgtgacaattcgtctgcactaaaaatttcaaaatacaaaagagtaaataaatccacaattaaaacaatatggaaacatattttccggggggtcacaaggcaaggaggggtcaaaagttttggaaatttaagcttttggttatttttttcaagaaataaaggttataaaatatactccttctggcaatttataaaaaatccatgttttattttcgttgttttttctaaatttgtataatctcactgacctacacataacattggtcaccagcgtctccagctcacggcgcaacaccaacgcggaaatgtaggggacggtgaaggactggacaatctgtacgaagaaaaattcagacagtttaaaagagaattttaaaaaacattgttagtgaattttttttgccaccgctcggccgagaatttaattatttgttgtcgtaattggtttatatgtttgaccaaaaaaagcatggttcaattccctgcattttaatttatttttatttttaaacctaaaaataagcattcacgagcaaaacaaatttcataatagggttgcacccccgaacgtcggggttagaaaagtcggggttcggggttgtcggggtcagcaagtttggggtcggggttaacaaaatcgttcggggtcggggtcgacgaaattgttcgggtcggggttcggggtttttaaatttttaccttatgccatatagtcaacattttttataatttccataataaagttttatttgtttatatttatttattttttatcataaatatttttgtatgctttaatatcttgaaaattttaaaattttttattttgtcggcaacattatgtctttttggcggcgacatttctggtgcatcgaatttctatattaataaatgaaattttgcccggttttta

SEQ ID NO: 4903 - DNA, 2732 bp, Heterodera glycines
gactcgatgcgcgagaaggcggaggagacgcgtacgccatgcgaatgcgtccaatgcgaagacactcaccaaacagaggcggagaattggcattttggtgctttttggcaacctcaaaaaaaccaaatttcggaggcttcgacttttttaaagatatgaatggctgagaattggtggagtccgctttaattttaattgttaaccattccattcttgggaaagatgtcgtcggtggagcaaaaacggccagtgggaaaacgctcgcgcttattctgccagtttgtccagcaaatatttcgtgtcgctaaattatttttaacttctcgaatgtctctggcgaaatcggtggaccaaaatgcacggtgttggtgctttgatcatcactccaacgcgggaattggccgaccaaatttacaaagtgttgaacaatgtcggccaatatcaagaattttcggttgctcttctaattggcggtatgttttaacgaattacaaattctgaatgtgcaaataccattaaaaggcaaagagagggaggcttatttgttgccataattacatttctcccctctctccctccattatcaaatcgtcccattttcggcactgacgtcgactttgaaaagcagcggttgtcttccgtcaacataatcatctgtacgcccggccgtcttttacaacacatggacgagaatgaacatttcagttgtgatcagctgcaaatgttggtgatcgacgaggctgaccgaattttggacatgggatttagacatcaggtgactaaattataagtcgctgatcagcgaacattaatatcctaattctgatttttatttccgattgacgccatcattgaaaagttgccgaaagaacgccaaactctgttgttctcggccacccaaacgcgacggacggaggatttggtccgagtttcgcttcgtgaccccgtcttcgtggcggcccacgaacactccggcagtgcgacgcccgatcaattggtgcaggtgaagcggaccaaacctgaaattctgaaatgttgttttttattttcaatccattcttttttgcagagttatttcgtgtgcatggaagaagaaaaactgacatgctttggtagcctttgttatttcgataatatccgtctaaacttattgttagttaatctcctctttaatcctttcaggtcatttctgaagaacaatcggacgaagaaaacattggtttttgtcacttgctgtaaacaggtgatgaaccatcccatccgaattcttttgatttagtttttaagtgcttttcctttttaaggctcgtttcatcactgaaacattcactcatttgcggcccggcctttacttcaccggcctttggggcgacctgaaacagagcaaacgcattgaacgctttaacaagttcaacgctgtcgatggtggtgcggcgatggtgtgcacggacgtggccagccgcggcttggacttccggggcatggattgggtgctgcagatggactgtccttccacggtcgacgattacattcacaggtaatcacccttttatggtgttttttttctcttacgaagtggattttgtggaatacatttttagagttgggagaacggcacggatgaaccgaaaaggagaagcgatgcttatgcttacgccgttccaagaaccttttgttaccttttgttgctttgctcaggcaaaggaatgtccccgtcacagaagtgacgtgagttctctttaaatagattttgttattttttttccatttttaccttggttaatttcagagttgactccaacaaagtgtttgatgttcgtaataaaacaccaatttgatggttcctttcccatcggtgaagcaatttgctcagcaggtggtttatatttaaaacaaaaaatgacattttgtttttaagagtttaatcgcttatgcaaaagctctctatttttcggaattgaaggtaagcgctgaatacttaaaagttttcgttttatttattttaaaagtttttactttttgttatatcccaattaaatgcacagcagcacttttattaattctaggaagtgtttgatgtgcaaagcattgatttcgatgcactttctcaaaacgaaatggaggaggaagaaccatttctgaaggtgtcgcgaagggacgtgttcaattccatcactgaagtcgatatgaaggtaagcatttcgctgatatatagtcaagggaaaattgagaattttcaggaagaaattttggcgagaatttcttcaaagaaaccaaatggccaggacagccacgggtatggacatcgtgcattttcgacttcaggtttgtgtttggagctcgaattgggttgaaattaatttcaaattctttaaaatcggcagtgaaaaacaaaacctcaaaaaagaatattcaaataagaaatagaattttttaggtgctgcacaagaactgagcagcgcattggacgaggagatcaaagcggagaaggaactcgttcaggacaaattgggtggcacttccgcgccttcagtgcccggcttcaaaatcaccacgaaaggggccgaagtgcgactgagcaaaacgcacggaaacgaaaagtgcgcattgttttacatctcaaaattctttactattttggaatttaaaataactcggtaaaaaactcaaaatttcctggctctaatgcagtttatgagtccaatcgacttttatgagtccaaaagtatttt

SEQ ID NO: 4904 - DNA, 1494 bp, Heterodera glycines
tagtgaaattcgatcactcatatttttgctagtgagcagaagcgtaccaaactttgcagggatactcgccggtaaatgactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcactggattctataagatcattagagccaatttcttattttcaggattgaagtcattctgatcgtgaatcattcggtcgacatcgaagaggacgaggagtacgaagacgacccacaagcagaaatggagaccagaggtttctattcattttttgttttgcttgggtctaagtttcatgtttgatttgacctgaattttctaggaaaatcctcaagtgttgcctgtatagtccaattttgggctgagtgtttgaatttgtttaaaagaagctacttacaattagtacttaaaaaatctaattgataataaacccaggcataagtctaactctgattttcaatatgatcaatcattttcagtctgtgcccgtctcgttgccacacttcaccattaggtgttttttcaattccgtttttacaaaacaaatgcattatttttagcatcacaaagaacaaccagagtatgttcgaagacaatgatggctatgaaaatgatcaaacgaatgggcgttgttgggaagcgaaagcgattcgaaactgagagagaaagcgacgaagaagaggacacgaaacagcagcagaagaagggggacgcaatttgttgttgatttttaaatgctaaataaaaaaagttagtttttcgaccgggactgcaaaaaaaccgtgaccgtgaccaatttcgagttttgaaccggttcaaaagtcgtttttttggcatttccgcaactgtaaacctattttttcgtgcttaggtatctcctcgagacgaatatttgcctattttcgttgtgttccaaatcactgaaaaacgaatgcacacaattgggtcatcatcatttttgaaattcttctgctgttcgttcctccctcttttcttcccccttttcatcctcaattttttttgtcgtcaaaatttgtacaatacgcactttgctccaaagcatcaagaaaattgttcactgatgaaacctaaaggaaagaaatgacggaaatataagagaa

SEQ ID NO: 4905 - DNA, 4820 bp, Heterodera glycines
  misc_feature (4803)..(4803): n is a, c, g, or t
  misc_feature (4808)..(4808): n is a, c, g, or t
ttaattaaattttaaaaagtcgtaaaaaaactcaaaatttgtttctcctgatatttaataactcattcgaaaactcttttttggcagagttttttacgatcgaaaaactatgtaccattgccaaaaacagaaaaatttcaaacatttttaaggttttgctcagcgccattcgtttgagtctcaattcggtccatttgattttgaattttgacgagattttgttcagaatttgccattattccatcaacagaagtgaaatttcgaatcgaagtaatcagtaaatctgtagaacctgccaaagggaaattcggataaaggataaagccaattgtaaaaatgtaaaagacgacccgaagtttgttgaatgcttgtcatggcattgccaatgtcgatcacgagttccttaaaagaaagaaaatcatcacgtgggatttaatttttgtaaattcgagttgacctgcactctctgcgggagtcgagttctgccctccagcgttacttttttagttgatttttgagtggacatttcttaattcaaaaaacacatttttgcagtttaggtagtttcctttttttctttgaaaaaagctgggggaactctttcatttttttgaatattaaaaaaaaatttgtaattgaccaaaatttaaaaaattgtaaaccattagggccccctatggcttttcattgtcaccaccaaggtacctaaactaaaatgccaaaaaaggtagtaactccgttgggtatttctgcagtttagatagtgattgttatttttctgtcttttattatattcgagtttttggggaaaaaaatcgagaagactggttttgagtataccaatatatatatgtatatgaaggatctacatataattgtgacagataaaaacattctacaattttaaaattttgttttcccattagataaataaatggcaaattctgtgggtgcgcaaacaaatggcactaaaattgcttctccgtccaaatcgacaagccaagcggtgcttctcgcgcaggcaatccgcgcgaatgacaccgaactttttgcatcgatggtcaaccgattgggcaataattggcagacaattagcacaacaattaaggtacaaaacggaaagggatgcttctacaatataatacttcagtttggagccgctatttttggcaacagttctctttttttttttaccaatgctcacaaaaattttaaccattataaattatcattaaaattccaatttttggccacataatcagatttttagaaaaacgggccattttttaaatttactttaaattgtaaagctgctcatttgatgaatcagaagacccttggaattatttttgcaaattttaggagttgcccacgtccgaagtgttgccccttttgcggatgatcgacaagcatttgcaacaacacggaagagagataaaaaagtataacccaaaaagcaatgacaaataaatcccattatttttcccattttcattcagtctcgaattgtggctttcatgggtcaacaaaatcttgcgcattcacagcacacatttggccacggtatctctttttaaaagtaaattgacaatttgtaccggttaaatagctcaaaagttcaagcaaaaccaaatgggaatagaatgtgcccctaaaatatgcaaatttccaaaatccgatcgtttttcttaaattcccatttcacacgatttcaaaattctctcgggcaaatttgatcacgttttgatcaaaattccatttaacacaactgctaaaatgctattttgtattcccccgcttcgcataattttgaaacaaaacttgttggaccgggttagcccaaattacgccccagacttgcgcctatgtctaaattcgggttctaaattaagtttttcaatctctgatagcctaaacagcatttcaactgattgaaaatgattatgtctgataatttgataattaattaacttttgaaaaatctttagtttgaattcaaagacattgtgcaaatgtttagtcccggctcggtgcctttcgccaccgccagcagagccattgtgccattctttattagcaaaaattataatttttggcgcaaaccgctacaaattctatttgcgcattttcgccacggtgttgaaaattgccaaacctcacaccaacattttcattttcaggtgcccaatttgaccgatcattttgcaacgatcacccaatggatggaaaaccgcgtgcggcacattgacaaactgctccaactccagggcaaactcagcttcatgatcagcgcaatgccgcaacagagtgacctgtggagagcgcgggacgagcagccgatgatcgtttttgcagccgatgaatgccaagttgaagaggagcaacaggaagacatggacgactgactgatcagcctttttttttgtttacacatttttcatcaaaaaatttaaattgttacaacaaatgcttgcttttaattttagcatttgccgagagagtttttgaaatggcgaaaacatttcctcccataggtattattttgcctcggaaacgcggcattttgccggttatggggaaggggggggggggggaagtccatgccgcatttttgccgtttttattaacaaagcgaaaaattttttgtagccaagattcttggtcatcatgaaatgagccaaattaagtcaaaatcattctttaggattgataacgaaattaaatcatttggacacaaaaaccaaaaaaaaaaaaattttctaattttactgtcaaaatcaactactggcaggcggtgccaaagacgccgccagctaaatttttgaaatttcatcctaattccttagttgattttccaaaaaaaaaaaaccaaatttcgctgttttgtttcaatctttggcaatcctgaagaataggtcgcagggttcggttgaaattttcaaaaacaaccgctttcccggttttccctccaaaaccgggcccggcccggctcggtctctaataaatacactatttgattctttttataggtttttttatcttgaaaactgcttaaaagttgccatggcttttgccgcctttttgaactcgtgcgccgactcacacacacacacaacatgcttctcccccccccccccatccgaaaaaaattaataataaaatgaataattcaaaaggctttccattgcgattgtcccgtccgtcccttactctccctcagctgctgctgctgctgcttacgacagacttatttagataaaaactcgaaaaaaaacatataacggtctgttttttacaataatagacaaaaaagaaaaattgtccgagccgatcgctccattattagcccccccccggcgacattctctgccgaattaatgctaatgctcttttccgcctccgccccctctctctgctcttttagcgcttcccggcctattttaaaggagaagcatctgttgtttgtttgaccaccacaacagcaaagcgaaaagtccacaaaaccgggccaatcgatgctgtttatttttttattctttttttttgtcaatttcataaaaaaaaattggcaatcgcttaattgcggtccatccgctcatttgccattaattggggtttttcgattaatttaaatgaatcataaaatttgactaatatgaaaaaaaaattaatatttaatatttaccaaaatataatttggatttttgttcattaggcttttcccttggcacaaatctttcgcgttccgtggtgcctaatttaatttaagccatcgatggcatttcggccgcaacctttcaaaattccttacaatcggcggcggattcttttctctatttttggtctttgccttcaatacaaaaacaaaaacattgaaaaaacaatcatttgtttaatttgatttattcaacaatatgtaaatccgcactttcattgggcctttacactgtgtaacgttagaataaagaggtgctatgtcgaagcgacaaaaatatgggtgtttgtaataattaaatttaattattattttaattttattttccaagtaattaatcataacttagcttattaagcttagtcaaattaataaaattaagtatttagcgacagctcgaagcatcctctactatttatgaaattttcaaaaaattagtaaaaatttacaaaaagttgtgactaaaaaagtgcgaaaaatttttactcaacaattttgaccctaactttcttgaaattcaataaaattttttgaaatttagcagaacaatagaaggacatttaaaaattttattatatgcaattaaaaatggttaatatttattcaaatggcttgtatttttcaccggaatggattttttcaaacattttttgttttcactgatcattttcctcatttcaccgcatatgcctcttttacggcgcactttttccaaaaaatttccagagaacagggggaggtccggcggtgcctcaaaatctgtgaaatttgaccaattttgaaaatcgcccgaaattttgtaaaataaaaataattttaatagcaatcaatcacatctgaaagagaggattctgttgactatattataaggttttatttaaatataaaccattattacttttgtaaattaatgcccgaaaaaatattttcaagttgcgtgctggaggggtatcaccccatttcatagacccataacttttttcgtatacatcgtgataaaagtggcttttacttatctaataaaggaataatccaagttaattttgattaatccattttcattttgattcggtgcgctaattttttcngtganattaacgattct

SEQ ID NO: 4906 - DNA, 6212 bp, Heterodera glycines
ttaaatctgtaaaaggggatgttaaagcgtgtcgatggattaaaaattgaaaatagtttcagatctgttcggccataaacaattttatgcgccatgaacagatcaaatagctttcgcctattctcaagtgtcggcagttgcaggtattttaatcgattttggtatggaattggcggaaggctgcatttaaaaaatacccgtttggtgaaatatttttgacacttttctatttttttaatatttttttgaagagacggattccaaacctccggagcgtattccaataaaggcctaatataagttttatataacgtaatccaaatcttagatgatttggatttaattattcgaaacaaggaacgcatacgtaaatacgcattccttgttattttgtttacatgatcggaaaattgtaatttattatcaatgtttactcctaaatccctaattgtatccacagcatttattgtatttccatcaaatttatatgtttcttttgggttttttgaacccaaatataatacaaaagttttttgaactgaaacttttatttgccatttatttgcccattctgataaattatgcaatgctttatgcataatttctgtatctgctcttgctttatagcatatatacaatttaacatcatcagcatataattttattttcactcctgatggcaaagcatcaggaagatcgttaatataaatcaaaaatagtaaagggcccaggacagagccctgggggacaccagagccaacttttttatttgaggataaagcatccccaattttaacacgaaaagtcctattactcaaaaagctttttatccacattaaaagtttgccccgtataccaattttttccaatttgtataaaagtaagttatggggcactgagtcaaaagctttctcgaaaatcaatataaatacagtccgcattttttccattaataattgcatcataccaatcttccacaactgttattaattgatgtcgttttgctgagcggcgcaagtgtcgcggcgcaaatagtgcggcgcaaatgtccgcggcgcaaaagtcggctaaccgaccctactctgatgatgatgcagggctggatggagtcggagatgacgacgaattgttcatttattagcccctcttactgttgaattgagtttaatttttttttggaaaatgtgccaaataaattattaaaaaattatattttcccccctggcagattaatggagactggcatataaaaagagtatatacggtatataaaaatgctaaacactgccggaccaccctgttctgaaaaagcgtgccacaaaaatgatatgaaaagcaaatttaaatatctatttttttcgcaattctcaaaatctgcgtgtgatcctacaaatttaaatgcatttacaatttaaagtgcttttcatttatttaatatactttattaaaaatttattacattttaattatagctctttcaattttgtttttatttgacttcaaaaatggaccttacgcctattcatcgcatccatgtcgcatacgtgtggctgaatcacttccatgtgcagctcgttgctctggacgtttcacgtgtcgatacacgcgccgtcttttcaactcattgctcggcacttttggctggtttaagtaagtcgcaatgtctgaagtcacttctttcattttttaaaaatgctttaacatgttaaggtggcacaagtgggcctcaattgtcgttggatggacaattgctggccctcagaacgttattgcagaacgttgacgacgcaaggtcgcaagcggacgtctttcgctttcaggttggggctgcattaaatcagtgtgtgcatttagcagcaacaaattgtttttgttaagggaatgctcactgggattagccgccagttgccgctgctgcttggacttttggacaagtttgaaaaggacaccaagttaaaaaaaaaccacccgataaatttgattataaatttttaaaatttttcagtttgacgagtcaagttgggctgcagatccacatcgacaacatccgactcaacgtctttgagctctacattgatttgaagttgttgtacgaccaattgcaccttttttttgacatgcaacagtatatcccaattgtgcgctctcgtagcgctgttgacctctctcgtaacgcgcgcccgtagcgtgaaaaaaaaatattgttgtatttagccgtttgctttgttttgttgttttctatgtgtattaaagcgttttgataattcgattttgtttattgcattggatttaaggttttagccaatttaataatgtttctgtttcctatcgttttcctcaaaagagtttgttttgagtagggaatattcgcagccttttattatggatgaagcgaaaatgaataaaatttcaaattaaattttgcacacacatgaatagggatcggatttttagtgataaaaaatcccaaaataattaactaaatagtgagaaaaaaattccaaaatagtggcaaaaatagtggcgaaaaagttccaaatttaggggtgtaattttttaaatagctgttttttaatttgaaaataatttaaaattaaggaaaaagattttattcactgattgcagttacaaaatattttcttagaaaatattgaacaagaaaaaaaaatttgggggaagaatttttgtgaaatttttccaattcttagggatgtatttttgaaaatttttaggtcgattcttaggggtgtatttttgaaaattttttaggtcgattcttggggtgtatttttcgtttttattgcattttttgggaaattttacaaaaaatgccaaaatagtggcaaaaataatgacgaaacgccaaaatagtggcaaaaaattattttagtggctaacttccgaaatagttttttttagtggcgaagctccaaaatagtgattcctagtgatgaatagtgtctacgccatattttttgattatttaaaaaacaaaataaaacaaactaaaaacaaataatttgcaaaacaataaaaataacttttcacattaataactttttgggtcggggattagtaacttttgccaatgggccaatttgttgagttccaaataaaccactaatctgtaatcagggcctacggcccccaacccccccccccccttttgttaatcccctaaagtgaagtggtgaatttggggcgctgaggaatttggacgctcgcgctgatgctatcggggccaattctgtgcgatggcgtgcctttctgctgttagtctccccattggctgatcatcccctccggcactgttctcgcctaaacaatttgcccaccaaacgacgccctgccccctcgacaatccgcccaaaacgacgccctgccctcccgacgatccgcccacccaacgatgccctgccctcccgagcgagtataaaagaaatgatgagccaagacttgggacttgctttttcttcttcatttccgtctcctacctatcacttttttgtgcttcgacgaccttttcctctgctttacaaaacccaaaaaccacttatttttcattgcttttccattcgttttttcgttaataaaccctttttttgtggttaagtcttgcctctaggctttttcgctttcgttggctttaccatttccccctcgttcccattgcttctcgccccccccccgtttgctttacccatttttcacccttttgctccattggcttacagggactcagtcccattttgaacttggctttacaatttgttggcttgtcgggacccaaatcggaacccccggcccattttctccttttcctggttggcaaggcatttacccccttgtccaacacagtgggattaagagtctggtgctctcaccagactgagttctaaccgggcatagtccttttttcgtcctttcttttggctttacccccccccccccctttttttttgcttacactttgcggaaatgtccgccattatccgacaacagcttttccctttactgtcggctatttcctctgaaacaaatcggggagttaacctcgaggccttaccaaacgattcttcatctttagaggccatcagcatcacagctgaaaagctgtctcgcctaattctcctggcccagggccttttgagggaatggtccgtcatcttgggctccccggaaaaggaaataagagacggggaaaataagcttttttcccaatttctggtgggaggggcatgcccaggcgacatcattgcaaatgggtgtgaaatgcagaccaaattggatgtgaaaattgacgggatacgcgctttgtcttcgagagcgccccatcctgctgctccagcctcccctcccccgattcggccccttattaatttgccctctcttcaacttcccgatttcgatgggaatgacgggaattggccctcattttgggcagccttttcccacaccatacatgacaatacttcgttgaccgggtcccaaaaactgacttatttggtgggtcgcctcaggggcagtgcccggactttggtggatgggttttctctcactgaccataattatcccatcgtcgtagaccttttgaagggtcgttacggcgatgaggtcaagcgggccgaccggctccggagcgagctgtttcatttggtcaagcccacgggtaattccgcctcactaagggccttttccgaaaatgtcgaccgaatttgtcggcagttagaaagtttggggactaatttggacgataatccttttcttaccgtagcaattaaggaaaaactccccacagaaatcaaggcccaactttacgacaaagaaatggaggagggggcgccatggtcctcaaaacagtggagggagaggcttgcaaaagtcgtacggcttaaggaagccgtacatgctccctgggacatcccgcatagtccggcaccccaacaaatccataaacctcccccgcgcccgcctgagccaattcggcgcgccttccccgtagtgtctgaaggcccaaaaagggttaacaagcccgagtgctctttgtgcctgagagatggccataaaccatcaaactgtgtggtttatcgtactgtggagcagaggagggcgagactgtccgagcaaggacggtgttctctctgcgcccgggaggggcacaatcagaaattctgcccaggggcagccaattgtttccgatgcgggggaaggcaccatgttttggtctgtcccggcccggaccggcccccggcaaggggtagcaattcaattcctttgggtccgcgaatccctaacgaagggcataatggcaggggaacccctcacgtgactccccctcaagggaatcagccggaatcgcgtcaaattatttcggcggtcgctgaaagtggccattttccacccgtcacggagttcggtgttgaggggcaaaaccgcccgaccgcatatttaatgattaaggaaattgagatttttaacaataatggtccaactccggcttcggcccccgtcttttttgaccccgggtcccaaccaggtttcattgccaccgacctcgtctccatggtcggtccacaatgtgtacaaaacgagaatatggcagttggggggtttttgggcaattcgccaaatgaaattatgcgatttccctccccccgattttcggttcgccttcgtcgaagagacggtgcgtgggaaacggtggaacttaaccaaaccaccaaaattgttccacctgttgagtttttgaaggaagtgagttggaacccacccgcggcgaacaaattggggattacggtgaaggaacccaaaattctattgggcataagggaattttggcggtttttcctgggaaaacgggaaatttacccaggcctttttcgaattgacactgtttttggccctatttttgggggcgaaatcgaccattactccctgccgctggcccgtcccatcccagaaattccccctcttttctgtggcgcagttgcgaaacctgtaaagtcagatgagttggtgaagcaactgtggaacctagaatcgataggaatccgggatcccttggaccccaatgacgattctttggccatggctctctttaaaggttcggtcgaattcaaagaggggaggtacgaagtcggctggccgtggcgcccgggggggaaagaccgtttgtctaataatttctctcttgcttattcccgtctggcggc

SEQ ID NO: 4907 - DNA, 2037 bp, Heterodera glycines
tttttttaattttttgaaatataatcagcaaatatcatgaccatgctaaaacgataaatgggttactacgatcttggcaaactatcgttcgcaattttctcttatagggtccccccaaaaaaaaataataaaaccgtaccgatagtgaaatttcaagggcacgtcgtgcaaattttggtggctcaagatcatgctcgggaatgcgctgtccggccgcgttgagcaaattgttcggcggcactggtcgcttggtacgctttgtgtagctttcttgttctgtgaaacaatgtttttcttatgtttgactgctttttaagaatgccccccccaaaaaaatgttttaaaaaataaattggaaaatatcaggcattgggagaaaactcacatttttttgcataattttttggctctatgaccgatatttacccaaaaattttttcattgggtagaaaaaaacaccaccaaatttttcatcgagaccccaaaacttccccccccccccaaaaaaaatttgtttttttttctttaccaaacaattgacggccaacagttcgggccaaaaacagcaacagatgttcaccactgtgggagggaaaatattattattttattttaattatagcaacaaaaattaccgcgcgttcaatttgtcaaccaatttgccgttttgcagaaacaaattcagcaactgctctcgcttgaccaaattgccggtgatcagtgcacggcaaccaaacttctcccaacaatcacagtacgcagtggggctggtctttttgattctaaaatgtttaattttaaaaaaaaaaatgtaaaggggcgaaattttttggaggcacacaatgactttgtgctttggacagaatgtcatgtgttcaatacttgatcctccagccacccttcccgggaattttctaaaaattctctcggaaaatcaaatttttggtaaaatcaaaaaaaaaactaaaatcgttttaaaaaatttctagctccactccaccacccccttaatgaatggaacacaaacaaattaggtaccactcacttgcaatcatggtttcggtgacaagtgtatgcgcattcctaaaaaatataacaattatataaatagtaaatttttacaaaatttattaaaaaacaaaaaatttaaaaatttctcataccgtacaacaacacagcgtttcgaccagtccgcatgcgtagcactcaaaaatgtcctgcggtgtgtgctcctcaccggtccatgtgtatgagcaggtgtcattggcacacagcgcgaacagtgccgattcgtccgaattttccaccccaattggtgccacaatgtcaacaacatcttcaaaaaacaaaaatattttcccgctatgtgtggaatttttagtttaatttctattaaataaatcttttggtgaacaaaatgttaatttttttaagttcatatatttgtaaaaactgcgatttatttttctcaattgaaaatatttttgcattttttcctgaatttttcattaatttttgcggcgactttttgtcccggaaacattgttttttttttgtcatttcttcgttaaccttggctccagtcgcgcagctcaaccgcagtctcccacagcagcagggcggcggtgtaggcacgaaaattgatggcacattggaaggcggtttggccgtgcacgtcccgctgttgcatcaacagcacaagatgttcctgcaccgccccacttcggcacagctcacgcacaatgtcaatggcactcgctaaacaaaaaaaaatggaaattcggcaatttttcgaaatttcaaatagggaaaatatttaaaaacaaaattttttttttttaccttggcgttctttcgttgttgttggaatgaccttttttgctggtgatgatgtagcggaaagagaagccgaagcagctgcagcagcagaattgtcctcatcacccttcgaaattgcagcatccccaaggtctaaaaaaataaaaatatttattgcaaatgtaaataaaaagggttggagaacccaaacacatcact

SEQ ID NO: 4908 - DNA, 1055 bp, Heterodera glycines
  misc_feature (7)..(7): n is a, c, g, or t
taattanttgttcttaaaaaaaaagaatttacatgtaaaatattgcggttgccttcaatccgttcacatgcaatccgtttgcgctcctcagaattgacatcctcctccgacaacttttgcagaatgttacggaccgatggcaaatcgctggaaacaaaatataaggaatcaaacaaagtgacattatggcatcaaatttttccattgttaaaaaacattttgaaaaaaagaaacaaataattttggttggaaacaattaaaaaaagtcattccgaaaacaccgagcattggtatggatgagttggacatggattatttgggaatggatgacaatgagttgaatttattccaaaaattttccgtaaaattttgggattttcattttttaaatagaaaattaggcaaaaaccaccacacacaaaaacaacgcaccaattgagaatggcctgcatcagtgactcaatcattggcttcgttgtgtgccgtgtcggcgcaatcagtgccgcaaccagcatcattcggttgacatttttggcacccgcttgccccggtggcaccacagcctttgcagcacctttgctggcattggcagtaccattgttgctaatcgcggaggcaggttcttgaagaaaaacaagttcgaataatttttacaaaaaaaaaaaaaattttttttaccagtgccaatggacaacaaattcacatccgacgacgatttcagataccttaaaaattctttgtagcacattgtttcggacacataatcattacttaattttgattgtcttcaaaatttttttccttttttcatggccatatcgtcaattaattcattaccgaattcccatgccgaacagatagaagtggccaagcgcggtgtacgacagttcttggaagccgcccaccgagttgcgcaacagtggctggaaggcaccggtggagtcgcgaatcagcaacatgttctccttgagaaaatggataaagaaatttttgcaaaaaaaaacccctaataaactaaaaaacgcaattttgaaaaattaatttcccattaaaaa

SEQ ID NO: 4909 - DNA, 3260 bp, Heterodera glycines
agaatgcggaagcctgaaaagatttttttttttttttgaaatgtaaaatagaaggtactactagtaaattcacgagaaaaataaattcaattagtgagtggggcggagggttagaaaattttgcgatttttaaaataaactaaaaaaaaggcggatgggctcattggcattgaaacgtcctttttctctaattgaaaatttgattaatttcatattgaacaagtttgaaaaaattcataaaaatttggaatgccattgccggcgggcgctttccttcaagttaaatagtaaagccaggcacggaaaaatttgtaaatttttcgagagtactcacccgtcccatcaacagcaagtgaaatgatgcgccgcacgctggacggcaggcggaccggcctgaactgggcctggaaattctctggcgagcgggcggcagcggcacgcgacgcgctcgtcaccggcaacaggtcatccttgcgcatcagccgaatgtgcagtttggacaggtcaaacggagcggcggcgccagaagtgccaccaccaccaccctcgacagcagccgcttcctgttccaggcggtccagcgtggacttgaaagtgacaccgcaatacgcaccatccacctattggagggaaggataaagtgatttgattgcatattgagattggaggcaaaaaaaaataatcattttttctttcaagtatgggggttttttgggaaatttttttggcaaaaaatttgaatggcaagtttttattgaaagcggtaaaaggatttttttaagaccagcaaacggcgccataaatcctcctcaaaaatgcacatttaaaaggaataaagaacgatgtataggttaaaaaatttagttctccattgagttcgagtcaggggttcgaaatgagtgtcagaatcggtttccatgatcctgaaaaccacgtaagtccgtctcgaaaaaaaatcgtatttttttccttcaaaaaactgggtccaaccatcgataatattaccaaaattttctggtaacctaaattcttttgggtggacaccaaaaaaagcaaaaccatcatacatcattcattacaaattgtaataccatccctcaaatttagttttgtatcaaaaaaacgtacaattttcaccacgctgacatcgttcaccgactcttcatggatgaacaccacatcacggattgcccatgctgactcctttgaggttggttgctgttgttgttgttgtgaggaagaagatgcattattaactcctccacttccacttccacctcccacaccaccaccactccattactcccctcctcatccatcatcatcatcatctgctgatctgaagctgttggggcggctctttttcgattgccaactgctactaaaaaaggttgggcacccaatttgctgactgatacaattttttttttttttttgtataaatgtgtgttggtgcatccgtggcatggaagcagtgtgatcaatcaggcccgtagccagaaaaaaaaattgaagccgaagattaaaaagcagaaacttataaccgtttttcgccaaaaaacaacaacaaacaaacaaaaaatttgcctttttggattcaatttttcaataaaacatggacccagcggtaagtaaatttttgatatttttaatgcaatttgttgagaaaattgctattaaaaacttttcaaaattggaattttttttattcggggtaagggtgtaattccccctggctacgggcctgtggttaatttatgttttgcgtgtaattttttaatggggggggggggtggattttttttttgatcatttgggttttttggtcaaatgggtgaattgcaatggcaaaaagtcaaccaatttcattcacccaactatggcatgggaccgaacacaagtgggcccggacaatttcattttacaattttcttaaaaaaaggttttgaggaaatggcgggggaaattgatcgaaatcataccaaaaaaaaataaaaaaatgaaagttttttcacaaaatgtccgggacccagttggttcggccagaggtccccagctaggcccttccatttcatccaaaagaccacaaaaaagaacagtccagcatttttggtcaaaagtaattcataaaatgaatgtaaagtgtgccaaaaaaaaaaattagtgccaaggaaaatgacaacaaaaaaaaaaaaaattaacttacggctgaatgatacgcgcttttcccgatgctgctgctgttgttgctgcttgtccttgtcgtttccgattggaattgcatcgtaattgtccggtgtttgcacacggaaacggcatgtctcgttgagtgtccacgcgtcctcgtaaagtgtgccaatctgtgaaaaaaaaaattagttttttgaaagatgagaattttttttaagtaaatttctgtccgtgtatcatggcaccaaggtcagcaatcagatagagattatcataacattgccatgtaaaatattggcgaatgaaaaactaaagaaaaaattttttgtttaccattggaagaccgccggcaaagttgacagcaacggagccaaccgaataaatgggcgacgactttgtgcgcacttcagagcccaccacaatgtcattgctgctggcactggtcacctgcttcttcttcatgcgtgccttctcccacaatttgcgccgctcggtgaacggaaaaatgcctctgaaattttaaaataaccgtagaaaaaaaaaattttttttttttgtatccaaaatggaatggggagtgatggtgcatctgtattcattttttgcattattaaaaggaacacaaaccattgaataaaaaacggaaaaaaacgagaattcgatggcccatggtaaaaaaatatatatgtgattctataaaaaaaaactaattcatgaaatccctcccatggataaactgacaagtaagtaagtacccccaccacacaatcaaaattaaaaaaaaaacttatttctactaaaaatttaaaaaaattttcgaaagtttaattgtaaaatttaaaaaatttttagcgtacctccagtacagtgtgccgccctttgacagaatggccgagaaaagcgtgcagcaaaacatgcgttccactggctccggcacgtccatcaacggctcgaaaaatgtgtcggccaatttgcggccacaggaagtgtccataaatgagccaacctgacatgaggggaggtgttaaaataaataagcaaatttataattgtatttaataaatacagaa

SEQ ID NO: 4910 - DNA, 2163 bp, Heterodera glycines
caacctgtggttgcaaattggctgttgacaatatgcggaacatttgacggcacactgccctttgtccatgcccacgcgtacagttggccgttgtccgccagtgccaccaattcagcattcattgaggcaattttggtaaatttgtccactccgtccggcattgggaaattctgtttcaaaattggtgtgataaaaattttgccctgggataaccaagaggttgagggttaaaagaaatttcaaaaaatagacggttcccaataatttcgagacaacgctaatgtgccaatttggactgatttaggtgggagtggctcatttcacggggaccaatcgccccccgtatcgttgaagccgaaaaagtttaaaagaatcttcaaagtaagaattttcattaaaaaactatggatttttttttaaatttcaaataaaaattttttaatttttcgaaaatttctggaaaagaaaattaccgtctccgttttgttgccccagtattccaaggtgtcgccgaatgcaaaatgttcctgcaccgtctgcccgttgctctccccgtccttgccaccttctttgcctttttggtctataaaagtgggggaatgggtgaactaaaaacgaaatttaaaaaaaaatggcaaatttcttatcagacacatccccaaatttttcgttgaaattttcctaaattggtccccaattttttttcttattggtccaaccatcacgacgtcgggccatgtcacgggagatcacatactcgtagccatctgaaggcggcaaattttcgaatatttcttggtaataatttgatggtacccctccccactttttcgaaaatttattttaaagttttaaaaacccatttttagggggatttcggggtcgctgaacacgaatttgacatccaattccgccaagtctgcactttcaacccggattcgaacaaaagttgaaaattcaaagttgattcgttttcagatttatactctttgaatttttcgactttttgttcgaatccaaactggcgtgctgcagaattgcaaattgaatgtcatattcgtgttcacccacccccgccaaaaattatgtgaaattttttttattcaaaaaatgcacgtaaaatgcacccgtatcaccatcagaacgcaacccggcgtccaacaaggacaacaattcctcgtgcaggtacgcctcgcccgtctcgtccaagtcttccatttcgtcgtcgtcccggctcaacaagttgttcaccgcctcgttgacattcaaattggtgcgttgcaactcacgcacaatcacatcccgtgacttgccttgcaaaaccacctaaaattgacattaaaaaaaatgaggaatcacaaaattctataaatgaacccaaattttttttttaaatcgaaagcctatcgaacccaggctagaataataagaatgggttgtttttttaaattttaattttctcacaaaaacccatttaggtatgttcaaaccaaggaaaatctcaattttgcgagatgggggggggagggtgttgtgttagcggattggattgattggtaattgcggaaaaaattttttgacaccccctccgaacctggcattgcacaatgagctcctcgggcacagacgatgccgggatcattggccgattggaccggttccggtcaatgataaccccagtgcgacagaagccaccggaccggacaccaggcctggtcatcatgatacgctgaatttgacaaaaaagttataattcgctatttgtcaaacattttgatggaaaaacggaattttgaatgctagaaaaatccaggaaattttcagagtcgcaggaatgttgtccaagcaagacacagggacggtaccaggatttagacatggatgggtctactttccccggcggacacttttttttttggtccgtgccgtggaaaatttttgattttttttttaccatttttaacagattttcaccaaaaatgatacaccgtcgagaagataccggtcgcgtggacaccgaaaaggatgtttaagaacgccgaattaaatttttaaaagtaggattaaaaaccactgattttcgcggtccgatttgccgcgttcaccgccgcctgtggagagcagaacacaggatcggttgacgaagcgcccgaatttcgcgct

SEQ ID NO: 4911 - DNA, 5414 bp, Heterodera glycines
tgcagaattaaatattaattcaaataatggattccatcatcaaaatccattactgtcatatcgtcaaagttcactttttattcattggagccaaaaggtcggatatgcggcagttgttcctcacgcattcctcacacatctcaaagcagaaggcaaaccggtctcccttcaggcgcttcactttttcctggttgttgtacatacgattccaatcatttcaaaatgtatggattcaaattaaaatttgatgaaatcgttattagttattaccaaggcacaaatagctggtcagcaatacgggtcggggaataggcagcggggtcggggctcacaagggaacttcgcgaactgttagtcggaaaatgcatatgtattatataccattggatagaggagggttgacttctattttgaattttgccgatagcgaaaaacaaaagttatggggcctcaaaaatcgaaatttttggctgtgttttcacttaaaattggtggctcagttggttaaattcgcatttttggagctcggattcaaatccaacacaaaaatcaataaattttaattaatgtataatataactaaattattttaaaaattattttttaggcgaaaaaaagtcaactgtttgttgctcgtaagaaggtatatgaaaatttgtattttctaaaaatgaaattttatttccaaaaaattgacgctggaatttctgaaaatcagcaaagcagaaaatacaccccaaaactcgtgattacgaaccggaaaaactcatccagtcccggatccgaaacactaatgtcgtctcgagtggatgtgagaacaaatccacccgatcaaaacaggtcagccatcagcactaatcggtcagtcattcgtccgtcaattatttaatgggaaatgcgtgaccgatcgcccgccgccgacagtcagaagagggcggacaaggaactgctgacgacggggggtgcgcgacaattgaaactgcagcgcactctctccgtgtcccaattttttagggggggggggagagcgaaatgtgaattgtcggtttgggtagaataaattatttaacaaatttgttattaaaaaaataattcttaaactgtcacagtaaagcaaagcttttaagcgcagaaattttgaagattatacaaaaaagtgtgaatttttaaaactttaacaataaaggatagagaagccttaattagaaattagaagcggtcaatattaacaggataaaatctatcatgtgagagctgcacattctccttatccaagcaatatcttggcaaaaaatcttagacccaattgataaatcagggttttttcaaaaaatctgatcaggaattcatttggtaaagaatgtgaggtgggaagtttcgttatcaattgttaattttctttgttgaaaataaatttaaaattgctttaattaaaaaatgattatttattggactccttttccatacgaccataccacgctgaaaacacgccatcccgtccgatctggcaagttaagcaacgttaggccttcttagtactaggaactgagacgtcctgggaatcggaggtgttgtaagctttttaaattttttcgtcttaatttttatttgtaatgaaaaataatttattttttgtttaatttatctcataacttttttcaataacttagtattttgtgaaaaatctatgcttctttattataacatttatttgttgcctctgtaagtgcgaaaaaaaattaaaaggtccattcaacgtgctgatttcttagcatttattcggtggtccctttttacctaatttttaaatgaaaaaaggaaaacaaataataagactaaaataaaacagtaaattttattcattgacaaataagcaacaaacataacataatgaaaacaaatgcaaaattaaaaataaatgaaaaaagaaataattaattaaatgattaatcgcctttccgtcgtttcttcggctttcttcaaagagtggccaaattgaatttgaaacttggcccaaagttggcctcaattttgtcgccagtccacaaagaaacgcatggaaacagagaatcggtgggagttgtagtgaaaaatgagtagtcatctgtgaaattttaatttaatttgttttttaaattttgtttggcccaccaattcgtaggccattcttcgtcaaaaagatcagtcgagtatccaaatgaacgccacacccgactacatctccggtggaaaatgatggcgattgatatgccaatgccctgtctgatggcattggcacgggcacaaaatccaatggaaatggccaattggcacttccaccgtagccgcccctctgttttccaaccgccccgttgaatggaattggcatcgtgccaaatgccattttacacggtcgactgataaaattgcagccaaatgagccattgctttggtacccgtaactgttcaaatgttgtccaattggtccgtccaatggcatttccttggtggcgaatccaatcgaagcaaaactataaaaatgtattaatatttgaaaaattattaataaatgcataaaaatagtaattttaaatagcaagttatgcaaatttgaaaatttaattacctaaatgtcattttacctttccaaattggtgactttcatttcgaagtagaaaattccgggacgacaacatttcgagacggaaaatttcgcaaacacagagtgccatcctaattaaaaaaagcattaaaattaatataattaaatttcataattatttaccaaatccgttgcccttacaattgaccgtcaattggctttccccggtgatttcaatatctttgtgacaaatggtggcatcccaacaattttgtttattcgaatttggcaaatcctgatgggaattcaatttgcatttatgaaaaaaagatttccacctttgcaattttcacaaggccaaccgccggcggcggcgaatggccggcaccctttgaagtttctaaaaaaaataaataaaataattttttaacaaattcaaatccctaacaaaacgaatatccgatgagccccaaaaatccaaatatttttttttataatcgcttaaataacttttttaaaacattttcatttaattttgcacacccgcgacattattttgtcgaacataacacattttccatccagtttctgctgaacgttctcctttttatgctgttgaccaacattttccttctgctgctttgcccatgccaaaaatatatccaataattgatgatcaacaaaaactgaaatttaattgcatttggtaaacggtcagctaaatgttaattaagaattcggaaatttttaaattttacgtccgtttttttcccatttttttaccatttctgccctcctctttcttctgctgctgattttccaattgtttgatgcgttccaccaatgtattgaacacttcgacagaaactaaaatatgaaaatttaaagaaattattttttaaatgcttatttaacagtaagtctcgggatacggtattggaaatttataattaattttcaaaattctccctaccgtattttttctcgaattgctgcttttcctgctccatgttgaagacttttgccttcaattcaatgtgttccatcatccgtttctgcttttccaactctgctttgagagccctctgaataaaaaaaaaagtgaaattttctctatttagacccctcgccctctgaaatttcattgtttttttttaataatttgtctttttcattttgctcacattctcagcattcaattccccgtttttgaacaccaatttcgtttccctcaattcggagttggcaagtttttctcggcattccttaaataaaaataataatttagtccataaataatttctaatttgtgtgttcacttcataattgaaatatttttggaaaaattccatcaaaaattgcactaaaaaggtcgacccattctcctattaattttatatcagtgcttaatttaaaaaactttaaaacgaattttaaattttgaactaaattttgcaaaaatctttttctgtttttggcacattccgtgagtccggaacggaaccggacgccctctctttgtacgttttgagatggcccaccttcagcagttgctgatcagtgacgaaaaattcggctgacaattgatcacccaaaaatccgtgccaactgaacacttcatattttcccacttcttctgctgctgctgctgctgatggtggtgataaaaaatttgattagtattttatttttcaataaaaaatattaatcattttctattttacgtcttttttcaaattttttctatgtaatatttaccttgatcatttgctgaacggaaaaaagaatctggggatccgctcgatgatgacatttattcaaattaaagaaaatgtattctgctatcgaatatatattaaaaaaaaatttatgaaattgatttatttatattaaaaatatgcaaatttaaagcaaattaaattggtcaggttgcatataaatgaatgaatatttgctgttttgagctgaaaatgttcgccttttatattggtggcattagtagacaaaaagtaattaggcaaaattatttgacctatcaatcaattaaatagtctctttcaaataaataattaatccatttttggcttaagttattgagcaaaatgatatgagtgaaagatttttaatccaagctgagaaaaaaaagtaaagctaataaatactctgattggtgcttaaaatattcattaacgaaaaatgagatggatcatttttacatttaattattttttgggtataaaaattaattgttgattttccctgaccctgacatttccgtactcgcgacccttcttcgccttttaataaaattcaaaaaagtcactttttaactaggccaaatttctatgcttttttagaatttgtatttttttaaattagggcaaatttttaatcagttgcctaaacactgtgattttgtatattttaactttgttagtctttgcgatttcaaactccaaaaagtacggtgagttcgaatatgagaaaagttttggttcaataaatcatagttgatagttgattgggctcataaagtgtaatagaaaccaattaattaattgacctctatttcttagaatttgcagaaataagcacaatattttatttaaattctttcttgctgaattccaaagttgacgtaaatgtatataaacaaacttatattaaataaaaggcattttttgtactttgaatttgcaattgaacaacattttgtttttttgcgtcatttttgtcataaatcatatttattaaattaacaacaacagaggttgaaaaagcctcacactgaataaagaaaaaaaaacagactatatgtaaataaataaataaa

SEQ ID NO: 4912 - DNA, 1892 bp, Heterodera glycines
  misc_feature (225)..(225): n is a, c, g, or t
  misc_feature (1877)..(1877): n is a, c, g, or t
ttccccttttttggacaccaattttgtttcccctcaaatcggagttggcaagttttctcggcatccttaaataaaaataataattagtccataaatatttctaatttgtgtgttcacttcataattgaaatatttttggaaaaattccatcaaaaattgcactaaaaaggtcgacccgacccattgtcctattaatgttatatcagtgcttaatttaaaaaactntaaaacgaattttaaattttgaactaaattttgcaaaaatctttttctgtttttggcacattccgtgagtccggaacggaaccggacgccctctctttgtacgttttgagatggcccaccttcagcagttgctgatcagtgacgaaaaattcggctgacaattgatcacccaaaaatccgtgccaactgaacacttcatattttcccacttcttctgctgctgctgctgctgctgatggtggtgataaaaaatttgattagtattttatttttcaataaaaaatattaatcatttttctatttttcgtcttttttcaaattttttctagatattattaccttgatcatttgctgaacggaaaaaagaatctggggatccgctcgatgatgacatttattcaaattaaagaaaatgtattctgctatcgaatatatattaaaaaaaaatttatgaaattgatttatttatattaaaaatatgcaaatttaaagcaaattaaattggtcaggttgcatataaatgaatgaatatttgctgttttgagctgaaaatgttcgccttttatattggtggcattagtagacaaaaagtaattaggcaaaattatttgacctatcaatcaattaaatagtctctttcaaataaataattaatccatttttggcttaagttattgagcaaaatgatatgagtgaaagatttttaatccaagctgagaaaaaaaagtaaagctaataaatactctgattggtgcttaaaatattcattaacgaaaaatgagatggatcatttttacatttaattattttttgggtataaaaattaattgttgattttccctgaccctgacattcccgtactcgcgacccttcttcgacttttaataaaattcaaaaaagtcactttttaactagcgccaaatttctatgcttttttagaatttgtatttttttaaattagggcaaatttttaatcagttgcctaaacactgtgattttatatattttaactttgttagactttgcgatttcaaactccaaaaagtacggtgagttcgaatatgagaaaagttttggttcaataaatcatagttgatagttgattgggctcataaagtgtaatagaaaccaattaattaattgacctctattttcttagaaattgcagaaataagcacaatattttatttaaattctttcttgctgaattccaaagttgacgtaaatgtatataaacaaacttatattaaataaaaggcttttattgtactttgaatttgcaattgaacaacattttgtttttttgcgtcatttttgtcataaatcatatttattaaattaacaacaacagatgttgaaaaagcctcacactgaataaagaaaaaaaaacaacagaaatatatgtaaataaataaataaaaaaataaaagtataatttatttattcatttttgaagcatttttttgaattttccgctccttccccctgctccgctttttgcttatataacagtgaatcggcgcggtattcagtgatcaccagcggattatggccaaggatttggctgaacaatttgatgcattccgatcgctgtgcaaaatgatcagggcgactggagaggccggtggtattttttgtgaaaacgcctctanaaaaattaggaaaaa

SEQ ID NO: 4913 - DNA, 2391 bp, Heterodera glycines
taattaatttgcacctaaacgaaaattcaatggtcccatgttcaacattgaaatcatcatcaatgctcagtacggcctctgtccgtatcagtgacaatggcaagaaacggtcattgagcgaatcgcgtgaggtgttcacctgaaaagagattaatagtgttttgatgaaataattagtttaattgtttgtcaaattttgaaaaatgtttttaccaataaaaacacaaaaagatatttatcaaatcctgatctaaaggtagagaattccggaatctacttagcacaaggacagcaccaaaaactagagaccagcacaatcgatttatttaaatttattatatcttgtcgaaaaaatagacgatatcgattttttccatttttaataaaaaaaattcgatcgaatcacttgtcggtccttacaaaaagccattaatttaaaagacaaatgctatttattgctcaaacgagaatttgggaacagtaaaataaaatatgccgttgttcaatgactattcatttctttgggcaggccaaaattttgccgccaatgttaagtacgtcaaataagcgcttttttgtcggcaattttttgggatgaaccgaaattggcattcaaagattaatttatgttaataaatgtagttttttgagtttcaaaatgccaaacagatgcactgaccacaaatattggcacatgaatgtgtggccatgtgtaggcatgttcagtgattggcctcctgaaatcaccccaaatcacaatgacacggtccaaataccgtaagccatccaagcttttaagagtgtacagtaattgcgcgtcccttcgatatgcttgaagaacaactaaatgttttgtttttgtttaattatcttatcattttaaatattatttatgtatatttttatacttgtgaatttctcatcgttttgccaattttctgacaatttttgttcaaatttcgggtaaaaattggaattaatttgctgctgattaaactgtagatgagaatgtcgccaatatggttgaactttggaagttgaatccaaaaatgttgggtccatattccataaacgtttaacatcctaaaataattattaaatgcaaattttaataaaacatttattttaatttaataatttaaattatttttataattacgtcattaaaaatttgttctctttccaaattttttgtttccgtttttccattaattggcattaatttcaacaaaacatctgcggcaacaattttctccggtggtgcaacaatgagaagtcggtgccgaattgcagaaaaaattgttcgaagcaaaactttgcaaaaaaggggataaaagttcaattagataattcattaaaaattaaagtaataattaaatataattaaattaaaaaatcaatcataattgtttaattcaaaaaaacataatttttttttactttttattagatccaaaaccattttacaaaaaaaaaatttagtatttgataaaaatttttgtttaaattttaagaaataaatcaataatattaattgtccaataattaccttttgggttagcaagaaaatgcgcaaaataaaagcggcccattcttctaagctcataaattttccattcgggcacattttgaagcagagaatttaatgattgaaaatccatcgttcgatgttgaaggaaaattgcggcattgtgccattcgaataaatcaggcaaaggcaaaagcctgtagaagagatcctatggcatttaaaaaaatattaattaaatttagaaaaattataaattcattatttggcttagtaattaaattcatgctagcttttttcatctttcaatgaaaatttgatgaacattttttaatccatatgaatattgaaattatttttaaaaaggccttatttttcgtgctgagtcgatccacaaaaaaactcagtgtgggcgatccacaaaaaactcagtgattgattggtcattttccggaagcctatcgcaccactttcgggcaccaaaagtgcctgatccggaacccggaccggcccggttaagaacaattttttgttcagttttttaagggctatctcccaggccgggtccggttcttaatccattcacttggagcccgttatgggtcgggcacatctgccggaggaccctcagcctcgcccccccctgtcgatggccaacccaagctaagcttgccggtaccagcggctttttgtacatctcgatgagctctacaaaatggtatcaatggcgtcaggctatgtctactacaaatggagaaaattggcgagaagtgatgtcaaaaattgaaaaatttaaaaaatttgaaaatgacttgcgtcccgccgtacattagtattaaccggacggcaccgtgttttgtgaa

SEQ ID NO: 4914 - DNA, 1252 bp, Heterodera glycines
tggaaaaagcattggaattttttggttttctttttctcaggcaaatcaaaatgaaggggaatatcgacggaagggaaggaggcgctaaaaagtggattttaaagcagttaaaaaaatgaattcttattttcttaaataaatattaatattatttaataaaatagctaatgtgaaataattaattaatttttgtttttaaaatggaatatttgaacatttcctatttagttaatttaaatagttattaattctttttaattgatatttaaacatttttccaataaattaattgctaatgaatgaaaattataaattaattctttttaataattagtacccctcattaaaatcggatgctacaaaaatggcacgaaaattcttttttctaaactcttcagtgggtttgatgtcattcaaaaatatgatcaaactgttcattccgtcatttggaagatgctcctttaaatttataaaagtgaacgaataattattaattaattatagaattatttatttatttatttaatttaccgttaataaatttgactttttgttaatgaaatacaccaaaaaacacgctttttcaatgtccttttgccagtaattgctgcttatcatccattttgctaataattgttcttcttttggcatcaaattcgaattatttggcataaaaacgccaaattctgcgcattttctaaattaaaattattattttaataaaaaggaattgattttaaaacatacgaccaatcgaaaaagtttactgcttctttagatgcaataataaatacataattttgaactgtaaaaattttttttagaaataaaattatgattaaaaaatttacctttaaaatatttggtcgtgtaaattgttaaaaaaataattacaaaaattagcactaaagaatttaaaatcctaatttgtataagcataataaaattaaaatgttttctaaaaagtaaaatttcattaataaaaatcaatgaaaaaattaaatgattattaacaaatagttacaactgcacaaaaagtcaatttaccaaagttcattagtcttcaattaatagtaattaattatcagttacgtcatacactctaaaatagctaatgagaaaaagacacaaaaatgattttttaatatttaaaataaaaagtagttccataagtagtaaaatgaaatgtgtcagaaaatgactttcattaggaagattttagcacagaaaaggccacgtcggcgatgaaatg

SEQ ID NO: 4915 - DNA, 2338 bp, Heterodera glycines
  misc_feature (2276)..(2276): n is a, c, g, or t
  misc_feature (2278)..(2278): n is a, c, g, or t
  misc_feature (2288)..(2288): n is a, c, g, or t
atatcagattggtgattgcgtccagcaaagaaatagcttcctgaagcataaaaagaaaaaacatgcatatgggaaggatatcgaacacaagtattgtgtgtcaatgaatccccaaaattattgtatccaaaggagcgagcattgattgatcaaccaaacatcagtgataaaaatggacaaatgaagagagcggatgataaaaggggttaccaacaggtgtttttgtaaacactgaacatttgtccgcccaacgaatcgcactttctcctccaccatccgattcacagctgtgttgcccttcgttcggctcgaatctttctgagaacagctttcgcctcactgtagactttctccgcggcaacaggcgaatctaattttacataaatgaatatccgaatataaaatttgactacctccgagttcctcccatgaatcaaacactggcaaagtctgctcgtctgctgcgtacatttgcgacaggagagtgggcattgagttgttacaagtcggaaccgtcggttggaattcaatcgattcactctcttccgaaacactctttgccgtttcattttcctttgtcgcttcagtgttctcttgttcaagctctgactccgtttcgtcgtcttgaagcacttggagaatgctggcattgaccaccatgctcccctcgtcatccgaaaacgactcagaagaatacaaaggctctccatcaaacagtgaagagacaacgtcatacgcgatctttacaaaaatcatataatggatgatcatagatttaaaaaaaccgatttggccgcagcatcggactcgtctgaattctgttcttcgttaaacggagagacgaaggaagagacgatgttggtctgattgttgaacggaagcagtgaaggcaaggcaaaaaaagcggccgattgttgctggaagaccgtgtcaccgaacaaacatgattcattaatcatcgcaacctagagagatgattaaaagaaaattttgattttcgggtctattgtaatttataatttagccaattagcgccatctagaagcatccaaattaaatattttttgatttcgtttttaaaacataaaataattccttcaaacttttcatgcaaatagagaaatcttattgtttgagctatcggatgataccaagaatattcaattttgatgcttcttgaaaaattgtggtgcattaaaattgtcaacatattttatgcgcatgtcttttttgggaaatttctgatgaagatgcctaaaccgtaaaaaaaatgcgcgacaaagcatttaaatggtttttgaaccggtcaaaactcgaaaaatggacaaaacattttaaaaggtaagacctaaacaaataggaggtcattcaaaagctcatgagttatgccgaaaaaagatagaaaggaatgaaccgacgccatctgaggttttagaacttgtgcaaaacccgaaaaaaggtaaaatatttgtccgtcttttcaaattggttcaaatgctttgccgcgtagtttttttaaatcattccccactgtaaatgccaaggatgcgcttaatgggtaggcacctcaaggtcattatcatccagcttctcgtcactctgaaatcctttctcggattttgaataatccgagacatttgccaacaaatgccactgatgtttgcgttttgatgatgacatccttgcaccaacttgtatgctcactctaaaacaaatgtaacaaatgaacgagacgagcattattagtgtttgtaccttaaggtttcacaggcacaatgcaatcaatcagttgaaaatgaaataggacttcaatacccgctcgcaaaaatgatgcatccaacccttgtggtgttagcgtccacaaccttcttcaaaaataaccctgaaaacacttaatttagaatactggtaaatacagtaacgcaataaagttagattatttcagtgagaattaagcgttactaatcaaaacagtgttttaggtttttataatccccttacaaaaatatacgcttaaaggcaatggtaaagattattggtcctgaatttttttttaataagttttaagaaaatattttcaagagtaatccgaggcgcttagtacgaatctgaccttatttaggctcaatctcgtaccccgaacccggattcgaacatttgagaaaatagtttggaaattttttaagaaaaatgagggctagcatcggtattatttccaaggaattgatcgaattgtacaataatatgaagaaaaaaaaaaggaattaagatatganancggaaaaagncattgcctaatggaacaagcaatgttgtaaaaaatgtgagttttaatttt

SEQ ID NO: 4916 - DNA, 4861 bp, Heterodera glycines
  misc_feature (31)..(31): n is a, c, g, or t
tagggatcggatttttagtgataaaaaatcncaaaataattaactaaatagtgagaaaaaaattccaaaatagtggcaaaaatagtggcgaaaaagttccaaatttaggggtgtaattttttaaatagctgttttttaatttgaaaataatttaaaattaaggaaaaagattttattcactgattgcagttacaaaatattttcttagaaaatattgaacaagaaaaaaaaatttgggggaagaatttttgtgaaatttttccaattcttagggatgtatttttgaaaatttttaggtcgattcttaggggtgtatttttgaaaattttttaggtcgattcttggggtgtatttttcgtttttattgcattttttgggaaattttccaaaaaatgccaaaatagtggcaaaaataatgacgaaacgccaaaatagtggcaaaaattattttagtggctaacttccgaaatagttttttttagtggcgaagctccaaaatagtgattcctagtgatgaatagtggcactaaaaacgaaaaattttcgaaaaagaatgtgtttttcgtgcatttctcgtcgataaagccgcagaaaaaatagttaaaaaactaagaatccgatccctagtgtgaacatttgagaaaatagtttggaaatttttttcgaaaaatgagggctagcatcgctattatttccaaggaattgatcgaattgtacaataatatgaagaaaaacacaaggaattaagatatgaaaacggaaaaagacattggcctcattcaacaagcaatgtttgtaaaaaaatatgaattttaattttctgaaatattcgaatccgggttcggggtacgaaattgagcctaaagaaggccagattcgtactaagcgcctcggattacccatgaaaataattttcaaacttatttttaaaaatttttgtgggaccaataatctttaccattgccgtcattaaattatattgtagaagcaaataaataattaaatgatgtgactgggacatagataataggtaggtagaagtaagaaatgaaaaaagatatggaggagggggggatggggtcgagttggaaggcctttgggtgtgcaaatacgtgcaaaagcagagtcaactcatcagtagcagagcaccaacagacacgaagacgacgcataaagtgagaggaggggaaggaaacgcgtcaaaacagaaaacattgttcgcgctatgtgtgggggtggggaaatcaattagaagagggaagagagaaaagatggaagaaaagtgggagagtggaagagctagagaagaggacagaagacagagaacacataatccgagggataaatgcgaagtgccatcgcaagcgatgcctttttaaaacttgcaaggacagaaggaatatgtaatacataaaaggaatcgtaaaatataaatagagtttcaattttgcctcccagttaataaaagttctgtggttcagtggttttcgtaaaacaataaagggaaaaaggatggagggaggttcgagtccgtcccacggcattaatattttacttttttttgtccaattagaagatagattttagataattactatatttttgagtatttctgacaaccaaattaaatcgaaacttaatctgtccaaattaagcgggatgaactggttgtttgtaaacacaataggtagtttctttataatgtcttcttcaataaagcacaaataatttatccggtatctaataataattttagaaattttatttttggagaaaataatttaaaaatttttgtacaatttatgttaataaaatgcacttaaaattttcaaaactttcccggcgtcgctaaactgcaccgcctgaccctaaaacccttaattttcttgaaaaatttgctcaaaacacttattttcggaattttggcctcggaattccgattaacatttaaatgcttaaaaacaaagtaaatgtaaatttataatataatagtttttaacataaaatgtgcaaaatgcattgaaaataaaacccggtaaaagaaagagattacatcgaaaatatgaagaaaataagaaaggcaaataggaacgacaggctttggtattgctggctcaaagtcagtgatttgagagtattctgtgctttatgaacggataaaaggcataaattttttgaagtttgattttctatttctttgcttcgctaaatcagggggctgaagcaaagcgagttgggcaggtgtcagttggcataatgaagaagcaagcgcaatccccgaagtgccgtaaggcgtaaaaggctgaccttaaaattaaagttataacttttgtttacttaaacacacctccggtaggaagccgaacaattacagtgtaaacacccgcttggtaattcgcacatggctccaccgcacatggctcaacctgtagcttgagtttttcggattggagaaaagtgattactgtatatgctcgacaatggccgaggtctaattggactgatgaaaaaggccttgaagccatttcctcaatttcatcatgacgtcttcgaatattccgataccttttgagagagtaaaaaaattggcatcatgagaataaaataaaactgaccattcaatccgcattttgattatccaaatcaatcccgcaacaacgagaagaacaatgaaacagctgaaaataatgtaatttctaaatgtcaagtaaagcttacgctgcaaaaataacaaaaaacaaaatccaattgattggcaatgattgtgcaaatgaaatttggatctgaaaaagaattggataaaaaaattcccggtttgtttataccttaattggtgtctcgaaatcattaacccgaacgtgaaaagtcgtatttgtttctgttccgaatgcaaatccttaagcattttccaccacattaatcgccttccacccaattgatgggacaattaccgggatctgttgagctgtaagtgcgctttatccctgaagccgtgcacaactgaccggccatcaaatgctttgtgtgaggcggacggccttcgagcaactgagtggtcaggttaatggtcacttttgcgccggtgtcgccttcgcatgtgatcgagaattgaacgtccgtgtcacgctatacagtaaattaataaattatatgctttcttgagtttagcagaaggaataattgaagttcgcaaatgcattaccgaagtaaattccgacaaaattaatcggaggaccccggttttatattctgcaagaaaaaggcaaggcatactttgtaaggcacgctgaaaaagttgatctgattaacgtatttgtcccgaatgtcattgctgtccagcttaaaagtgaagatgaagtcaatggcaagttcatctaaatcataacgatgtaattcgcagaaatagaagccaagatttgtttatacatgtgcaggtgccgccgtttttcgggtctccgaaatatttaggctcgcatttgtcacaccgcggcccaattactccttttgtcgaacaaaaacagtcgccgtttagctgacaaaagaacaccaaatatggtcatttataaatctaattgttttttattaatgttactgggttgcaaagtgccgcttggccgttgcattggcattctaaaaaatgacacctaaaaacgattggaatgcgtacgaattgtaccttgacaggtcccaccattccgtgggtcgccgaagaagccgagctcacaaagttcacaatgttcacccctcgttctatgctgacatttcgtacatcgcaatcgccgataagtgacattttccgtgcaattgctgtgcccgttgcattggcattctgatgataaatcacgtttatctccctttctaaacacaattaccaataaaacttgaccgggttcgcctgtgaagtaccaacgctcagctgggcattggctcggatccaatgcgcccgaattggtcccttctacgcatttgcccaaccctgtaccagatctaataaaatggacaaatacaaaaggggaaataaaacgcggcaaaacccgtcatcgcaccagccacaacgggggccaatggactgacagtcggaacaagttttttgtaattcgcacgcgaaagggtctcaaatgtgacaaattctcctttaaaaaacaatcccaacaaatgttactcactcgtttgacatgctttgtgtgtgttcgctgccgtcacccaactttggcattgaccgtatggaaaactgaccatgtatgtgtccatcgacacacatctttgattgctcggacaccacctaaataatttcctaaaattaagcttgcgcgggatttgcgccactatacatgcactgtgagtcaatgcaggactggcaagaggacttcatgaagcaaggaaggggacaggtggcattctgttgtttgtgttggctcgaggacggcacaatgatcacgtcttggaccataatagacgaaggaacatttgaaataatcgattgtggtgaaagagtcgaggaaggattcgattgttgctgaacgttcgtagatggcgcatcgtccgccatcggcgcaagggacagccgttcggtttgcatccgattgtgctcctcgataagaatggcctcgtccgccaatgacacgcaaatgtgtttcgtgtcgatggcaaaccaagtgcagtgcggaagacgattgcatgagaagcaattggtggccaaactgcacggacgctgcacaacgacatccgtacgacgctgtttggcaccaccgaacggacagagcgaacgatcgccaagcaaaacatcagcacaattggcgtaggaaccgaggcaactcccggtggggacagagttgtcacaggacaaaagaaagctttctca

SEQ ID NO: 4917 - DNA, 2543 bp, Heterodera glycines
acctgactgctctcgcaccaaccacagcccttttgaagcagacaattgttgcagtcggtcaacaaagtgcaggtgcgcaattcgacggcatctctgaaatgatacgacttttcaagtgtgtaatcaaccagtcttgtctttacttgtctcccatggcagtccctgtacagtgttcttggtaagagaccatcgccgtttcgcccttggcaattgagagaaaggactgcctgaaggacgaattgggcagagttttggtgcacgatttgttgtggaaaacacagcgcacgccgttggacaatcgcaaacattcctccgcattggtggcctgactgtcacaattggctaaacaacgcaacagcatttacaaaagtgaatttagctgggactcacccggtgtgaacaacagcacgtcgttgagcatctccccattgaatcctccgacgatgaacatattcccaccgctcacaaacgcactgtgcccataacgtgcaattgcctcaaactctttgctgtatatttttactggccttttgcaaactgaaaatgagcaaaattttatcagcgtaatcagaggcccctccgaggggttaagcgaggtatttttttcattgtcaaccaaacccaacaatggtggtatcatgcgtaagattttcaatgttcacccactccaataaccttataaaaagaaaaaaaaattctagcaaaatgtttttagaaaaaaagatttttttcaaatttgattttttttttttgcaatttccatgttataacttttttgattaattatctgatccctgggcccgaagagcaaaaaaaaaaaaagaaagaaggaaaaggtcttcagatctcccccccccccgaaaatttttctggctacgggcttgatctgatcaccaagcaatgcttattgttagaaacagcttctaaataggctaaaataatacaaaaattgtttcagaacatcaacacaactcactcatgtcataagcataaatttgttccgagtaacagtcctttttccgagtggtcgacgactcattgtgactattcccgccgaccaaaagcataattccatccaaaataacagcagaatggcgaaacaacggtgcaccaaaactacccaaattgttcctggagaatattatacagtaaaaaaagatctttagttaacttttaattaaatggaaaccaaatttgacgcttcggttcgtaaagcaacagttcgtcgctgatagaataggagtaactgttaatcggagcattataaccgccatggattagaaccatttcctcgccattaaattcggcgaattgagctgatgcatggccaaatcggccttgaacagatgggtcaaccgcaccccaacgccaacgtccggtttctgccaaatgagcaaattgtgaaaagccataattaaaatataaaattggaatgggcacaccaaccaaatgagtaaatctgcggagtgaacatatatccttcgaaagggttatatccaaataaaatgtgcatttcgttgccgatcacatgggccgaatggccggccaaagccattggaaggtcgagcgtcgacgcattgggcgaagacagcaaattccagcggtttgtcaccatgtcgaactcccaaaattcgttggtcgtttttttctgattaatcactccgccaaaaacgtacaactttttctaaggaaatgttttcatgtatatactgatcaaagttgacaaaaccaaccttatggaggaccacggaatggtcgtaccgtggcgttggctctgtccctttcgacttaactgcgcgaaagcgccgttcgcgtacattgaagacaacaaaatcactattcatcctcgccggattgaacatgaatcctccgtggagccaaacttcgtctctgccaacaacgacggatttatgtgaagcgcgaggagggaaatgtttggcgacattttctgttagaacgaaatcccacacgggattaagcaccaattcttgacagtgttggccgtggtggtgctttgtgcagccgcattgtttgtccttgcacaacgctcggttcttaaaaaagtataatacatttggaattgcaaagtttctatttaaaaagctactaggtcgttgcataaaaaagggcgctttttgaaggaaaaaaatttatgaacaaaaaatgaaaaataacaatcataacaaagccgatcaaaaagctacttaacaaagtaattgccctgactgtctacaaccttttgccgccgagatgggagtttaacaatgccctttttgtaaaattctgtgccattctttgaacctaggtaattttcactggatccacgaccttgccatattctttaaagagcctaccctataaggaatttttgagagaaataatttagccataaattaagtctatagggtccagggaataagacgggtgacgtagcatgtcctataagttgttctcctgtcagccatgggccaatgaaatttggtgccaaaattagggacttggccataaccagaaaattgagtgtaactttattaaaagtgtaa

SEQ ID NO: 4918 - DNA, 6492 bp, Heterodera glycines
  misc_feature (6455)..(6455): n is a, c, g, or t
aagatcggtaaaaagcctgtatctgtacctgtatttcccgaatgccgtacagaaaaaatccaggctcctctaggcctggatccaggcctgtgtacctgtattttttttggtttaattacccaagtttgagcacgaaatgttaacggcttacggcgaatttaatggccgaaagcgttcccgttttgacccgtcatattccccactaaataatcagcactcattggacaaaaaacaacaactgctggacggagtggcaaaattaaatttcgacaacctcgtcaacgaccaaaccatctctgaagaaagctgggcgcaaatcgcacagctcaccacccttctcaaattggcagcaaacatcattggagactcgatggcgccacaaattgacaatgccgcggaaatggaacgtcgccgctcggtggtggcaactggtattcctgaatcggtgtccgacatcccgtcagagcgcgtggcggaagatcacaacactgttactcgcctacttgaccagctcggggtcgagtgtccggtaaccagctatcggatgggcaaccaagccccaaatggtcggcccaggcctctcaaaatcgttctggccgcgtcaaagtttcagcgcatcaccatcacacattggagcaaaaaaagagccgaactgcgaaaaattccacaaatgcaacgactcaatttgcgcgaatcgttgacacccgaacaattgtcggcccgccgtgagatgcagaaagaatgcacggccaaacgagcacaaactggtcaggactggatcatctacaatgatcgtctgattctgcgggatgatatcaaaggaaaaagcactgcgatgtttccgccgactgtttctctgatcacaaatgttcatccgacaaaaaactgacttccatttgcaatgatttgaggtttgggggctttttggaacaacaacaaacaaactcaaacaaaaataatgcccccacacctcatccacttcccaaaaaaacttccaattatgttgctcatccacctgcgatacccatgacattatctacctcatatgacgatatttctttcacattatcaccatttatttgttctagggaaaaggccgtaaatactaatctcaaaataaccccaaaagtcagatctcccacaaaaccggtacatacctaattcaaatgttaattttcaaaaaaataaaacacataattttaaaggctgtttaacaaatgcccggtctattttaaaaaactgaccttcttttagcctttctcaacactgaaaaagtcaacttcctcataattaccgaatcctggcttaagaaccaaaatttagtaattttcaactcaattttaccagacaattatcaaattttttctgccataagggccgaaaaaaaaggtggaggcgtttcaattataactgaaaaaaaatatcccatttactcctcaacaacggattccaaattcggttgtgaaattgtcgtattacgttttaaaaatttgaaaaacttttcaataattggggcctacaggcccccaacaattaatctatcgaacacaaaaaactttttttcttatttggatcaaaaaatcaatggaccgaccttaatcttaggggattttaatttgaatagcaaatgtataaaatgggataatggcaaaccaaccccactttcaaaaattggacaacactttgtaaatttcttcacaaaaaattttctaagtatgcattgtaccgggcccacccgaggaaatgaaatccttgatctttgcttgacaaatgatgccaggctggtaacagaggttgaaattaaagacagtctaataaattcagaccatgaatctctcttcataaatctatctatttccttacagaaaaccaatccaccagtaataagctatagaaaatttgacccaaaaaatattcatcaaataaattccttcttaagcttccacctaaatgactcattgcaatccgagtttgacttagagcataaatataacaggttcactagagaatccattgatgtaatggatttattttcaccaaaaataaccttcaaaaaggaaccaaaaaatgtcaattatcctatttcactccaagcttctataaaggaaaaagcaaaaatctggaaaaagctcaaagaaaacccgaataaatacaaaccattatctaattcaaatagcctacacataaaaattcagattagaaaatttcaggagcgcgaagaaaaaaatttcttgacaaaaatcccaaaaatatttacaaatttatcgaaaaagattttcaaagatgggaaaccccattaattctttatgaaaacaaaactatcatagacgacggggaaaaagcagaaatttttgccaaacattttgcattgactttccaaaattccagtaattatccacaaccgcccacaactttctcaaatagttccaatttaccgactctttcgaatatacaattcaatgtattagacgttcttgaaattttaatataccttccaaataaaaataacacttcaccagataatattagtttcaaatttcttaaaacttttcacttaatcttagctaggcacctgacagatctgtttaacttatctttatgttcgggcaaccttccaaaaatctggaaaacttcattagttttgccactcttcaaaaatggagacaaaaatttagtaaacaattaccgtcctatatctattacttgttcctgttgccgaatttttgaacgcttaatagcaaaaaaactcactgaattcttacttaaaaacaatcttatctctgaacaccagttcggattcctaaaaagtagatcaacaaccctccaattaatctcctcactggaagactggtacaatgcaatacttagaaaccaaaaaattgatataatttatttagatcttcaaaaagcctttgatcaagtcccgcatgatcttttaatatacaaactcaaaaaaacggaataacgggcaacttattaaattggcttcgggattttcttcttggaagaacctttaaagtaagaataaatcaaaaattttcaaatgaatttcctgtcaaatcaggagtcccacaagggtcagttagccctaatttcagtctttaattgggctgaaacatggggcttaaatttttcagtaaaaaaatcttccgtcttatatttaggaaaaaataacaaaaaaataccgtacacaattaaaaatgcaacaattcctgaatcaaaaattattcgtgatttaggtattttaattgacaacaaactcaaattcaacggacatgtttcaataattctccaaaaagcttatctcaaaagcagaattctttttaaaaaaattaaaaccaaatcaaccaagacttggattacagtttataaaagttttatttgatcccttttagaatacgcaaccgaaatttggaatcctcaaaccaaaaaagaaataaatcgcctggaaaaatttcagaaaaactttacaaaaaatgttttcagaaaatgctgtctcccctacatctcatacagcgaaaggctaaaatttctaaaactttccaagcttgaaaccaggaggaaatatcttgatatcataacagcctttaaaactatcaaaaatactactcaccttaacccaaaaaacctttataatttttcaaataggaaaaagtcaccttttcctattttggtaaccaaacgaaaaattaccaaaacagaacactcctttactaacagaaccacaaaacatctacaagaaatctgcaaaaattcagatatttcaatatcaaattcactgcccaccttcaagaaaaaagtaaaaaacattttacaagattaattttaagttggagatctgacattatcatgtttcccggactatcattttcttccgtggtcgaaatcgcctggcacggccaaggtgtttggcaccatcttacgttaatatttatatttgtattaattactagagttcggcgcgagattttgaggggtcctagttagagaccggaaatttcaaatttgcggatcctgttgcaggattggaattcaaaattttttacaggacaggatccggcaggattaatcctgcaaatcctgcatttaaaatctgcaggatcctgcgcaggattgcggattttaggaaatttcaaaaaattctgtattaataaaaaagtctttcaaagtataaaaaagtattcaatatatttttaaaccaaaaaatgatgaagatgaaaaattaataaactccaagcaatcggctgaatcttctttaatgcgtttaaaaagaccgatttgcataattgggtggctcataataatagcttaaattaaagtaaaataatttttatttaaatttctttgcaaaaaagccaaaatccattatgtatagggatgggatttttaggcacaaaaaatcgcgaaataggcacttaaaaaggcagaaaaatcctaaaataggcacgaaaatagtaaaaaaaaattttattaacgctttttaggtcgcaaaacacataaaaaattcaattgtataaacttttttcgaataaggataagtttttaaacgaaaaatttttattaagaaaaaattttttgaaaaaagaaagtttctgaatatttggcattctattttttaaaattttcaaaaaatcaatgcaggatcctgctgaatcctgcataaaatctaatttgcgggtcctgttgtaggattggaattcaaaattttttacaggacaggatccggcaggattaatcctgcaaatcctgtattttccaaaatatgcagaattgcggactgggatcctgcaaaatcctgcgcaggatactgtcctgcgccggtctctagtcctagtctccaatcccgcattttttgtaaatttcggggttttacgggagtaatctcgtgggcttccatcgcgttgagttcaatcccataacgggatccacaatttaaatttacaaagaacagaatgccaaataaaaaggaattaaattacaagaaattcaattataattagggatgggatttttatgtgctaaaaatcctgaaatatgtaataaaatatgtgctaaaaaatgccaaaatatgtgctaaaatatgtgttaaaaattggaaaaatcaagtgtgtttttgcataaaaattcccaaaaatctcattctttatcatttttcgcccatacaacgcaaatcaaatacatttcaaagtgtttggggtaaaattgatctttttttgattaatcatttttataaattgaaagttccagcagagaactttgaaatccaatgacgaattaatgaattcgattttgttactttctacattcgaaaaaaaattttaaaaatttgaaaattctataagaattgtgaaaaaagttgatttttaggcgtgattttcttgtatttttattgcaaatttttctcaaaaatgccaaaatatgtgcaaaatatgtgccaaaaccccgaaatatgtgccatatgtttttatgtgccaaaatgccaaaatatgtgtttttatgtttttataagtcgctctaaatcgaaaattgttcggagaaaatgtaattataattaaagccatttttatggtaacatgtgatttccttcagaaaaaagttttctgtcagtgataagaattgtttttttataaaaaacattttaatatgcataaattaaaaccatatttttgtaattatttcttacatattacagggttttttttacatattttacgaattttcttaaaaaatttggatccccaatatggtatttaaaagtgatcattaatttttaatttaagatttgactagtgatcaattgggtgagaatttttattgaaaaaataacttaataatgaataaaaatggcaaaaaggacaaaaattagaacagaagatgataaatgactaaaaatcacttatgtgtgatttaataattttacagaagttctttaccaaagtgtgataaatagggatacgatttttaggtcttagcctattttttcctgagcttccagtggcctgaaacgcacgaaaaacatatttttttggtggttgttaagctcttttcgagttattagggccttttttaggtttttatattttagaaccaaaaagcctaaaaaatttcggaaaacctattttggcgtttttccaaaattattttaaaaacgaaaaatacactaagaagcgacccgaaaaatatgaaaatttggcgatttattttgaaagtgttggagatgttggctttaatcagggtagcagactgaggctttagcctcattttgtggtttttgataggtcaatgaggctaaattttcaaaatgaggctttgaggctttttgtggttttttgagaaaaaccgcaaaataaagaattttttaatgaaaatatggtcaaaattcttatttttccccccccggggcggcgcctggtcggcaccgccggaccataaaatttgctcaaatcacaaaattntggtcatttttgtggacaaatctgttaacaatcgcat

SEQ ID NO: 4919 - DNA, 1063 bp, Heterodera glycines
  misc_feature (28)..(28): n is a, c, g, or t
  misc_feature (36)..(36): n is a, c, g, or t
tacaaaatttttcccggcggcgcctatncggcgccngtccgttccccctctgttccccaaaagtttttggaaaaagcgctgaaaaaaaatcaatttcgatttttcatactcagaatttcacaaaatgcttatttcaaataaaaaattgctcaaattgatcatggacagtcaaaaatacaacatttgaacattttaaacgtgttttgaataaatttgtaaaaatgaaaagtccaaaaatgacatattttacgattttaatttttaaaattgtgattgaattgtaaaaaagtctcggtctcgagtctcgaagaccgagaccgagactgaaaacccgagaccgagaccaaaaaagcccgagacttttctctagtcgagactcgagaccgagagtctcgagcagcactagtaatttgacctcgcaatagcttcttcgcatttaaacatgcatgggttgcacttgaatggtaattaatgaaaatgtcgtttaattgctttaaagttgctcatgccaaaatgaccgtgccgaaatgtcccagactgcaaatagattaaaaaattaataattgaaacttttttgaaaacatttacagtcgaagaatatatgttgcaatttaaatcgaggcgatacattgactaaaggaatgtggagccaaacacattattaataaaattaatttttttttttttatgagattttttggaactattaaaagcaaacccccgtccccgcgactctgaccccccgccaacccccgcccacggggctcgaaccctattttttacgatgatagatcagtttctatttaatttccaagaagtaaagtcacattcattttaaaagtgcataagaaaatgcaaaaatatttgcaaaaattgaaagaaagaagagaattttgtgagaattaatcaccgtcttttcggccaattgaaagaagagagacggcacaacaagcggaccaattaattccaatacattaaaatccttggccatttgatcaacaacaaagctttattcgcaaaaaattgaaaaacaactaaaggcgaaaaagctgaatggtaaata

SEQ ID NO: 4920 - DNA, 1625 bp, Heterodera glycines
tctcgagtccgagtctcggtaatgttcagtctcaagcatcactaattgaccacatgggatgacagggtgttgtaatttcatgagctaaaaactaccaaaaatttgcttaaaaagacaatgcatttctctgaaaatgaaataaaatcataaaaataggaataaaaatgaaaaacgatcgccgccctttgcttcaagtggaagaaaagcggacaaaacaaacggacaaagcatcactcattcatccatttttaatggtcacaaatttcgtcgcgttcttccaattctttcataaatgtttcgatgctcttcaccgcatttttgatcaaattctgcttgatattttccattttgttaaagtcttcctttaccttcttttccctttcatcattatcccctccaaatagaattaatccgtcattcaaatatttttcaaaaatacagaagcccatatgttctgttcccataaaaattttcaatttttcatctgacacatcgccaaacagtgccattttctctgcatttttctcgtattcctttggcttacatttgccctccaaatagtcaatgattcctttggcactcattcgcttttctgcatcaatgtttagcatattctatacaagttaatttattcacagagaaacccacgaaaaatttttcatagttttaggtatttttaaaaaactgggcctagatttcttgttggactcggtctgtgtgaatcccctacccacttgaaaaaggggctggactgaatatggctcaagaaaacccaaaaaatggtctttaaatttagacattcttctaggacttaccactgataggaagacaatctctggcattttgtcccataacgtaagaatatcatggatcactgtcaaataattgtaccaccaatttcccgatggccaatattcatcatattttaagtggtccctactatattcataaatgtctattggcagtgataattttgcaggatcaggcttaaactttcctccttcaaatttcaattttgcgcttcgaaacaattcgccaattttctcatccaccttttctttatagccaaacgtttttttgagggtcaattgtaaaatggtaagcccagctgaccaaatgtccatttttggagtgacctttatttaataaaatgatttaattaattagaatgatttaaattttaaaatttgattcacctcaacatcgccctttttgttatatgataaatgctaaaaataaaataaatttaaactttttataatatttattaatctctgacttcaagcagttcgggcgcggaaaagtcattagtgtcatcctttttgtttacaattattccctttttttctgcatgcaaataaagaacagacacttaaaaaagaatttaaaaataataacatttgattaacaaaactgttgaatataaaaataaaattaaataattaataaattaccatcaaaatcggtcaatttgataactttttcctcccatttaattgtcttggccctctctttctcttccctctctctttctttcctctctttctcttccctctctctttctttcctctctttttcctccttggcttttttctcggcttcgttttttctgttaaacattttaa

SEQ ID NO: 4921 - DNA, 1142 bp, Heterodera glycines
aggaaggggacaaaacgccgacaaaagtggagactaatgcgcgaaacgagtgccaatcgctgattaggggggggggggggcagggaattgattgcacggaaaccaattgtggcacaattgtggaaatgggattttgagaaaagaatctggggcccggaaataacggagctcgagactgtgtttctatggtcccggaatttttgaacaaaaataacggagtctttgtcggaagagtaacggtaaatcacgacggtgtttttcgaatttggcacagattaattttaccgatttatttttccaatgatcagtttctttgatagaatgcgcttccgccaagctcctccaatggtcagcagcagtcaaaagtagcagctgtcgcttgtcgtctcggattttccattttagggaaaaaataaccctaattagggaattggggtgaattctcaaaaagaggggggagggtgatggtgatcagtgatctgagcactgaccatcaatcaaccggtggttaatcagtgccttcattccccactttggcgtttcaatcaaaaaattccaaaaataaaagtcggctttttgtcagacgaaaagcgttggcactgtgagcagtgcggccgcgtgttcgctttgcgcagctatttgagcaaacatttgaagcagcagcaccacaacggcagcagaaagaaagggacggcggcggaggaaatggggacggtgttaccatcggacggatacgataggaccaaacggggggagggaatacagtacgatcggtgatggaataaatacggtatgggagaatcattgatggaaacagttttgcgacatttttaaggaattttatagttgacaaattatagagaattgaagaaattctcattagtgaatgtaatgctgatcaaggctttcagatgcagggctgggcgtaattatggattacggaaattacggcctttttggaccccgtcatgatggattacggcttacggatttttgggatttttccataattttgatccgtaattgggtttttggattatttttcgagacgatttcctgcaagattattgttttataaaacaattttttctgtttttatttaaaggtcttaccatatttcttgaattatttaatagaaaatt

SEQ ID NO: 4922 - DNA, 5306 bp, Heterodera glycines
aaataaagagacaattaaaattaataataatttcaaatagaataaattacttcggctcccggaaaatgcgccagtggaaattttattggcataaaaacaactcctttggattttcgaggtcattgatcacgaatccggtaccgatttgtgccaattccggaccccggactcgaattcgaacaaaaattcgaatgtccaaattttcgaatttagcatttattgttcaaaaacggcataaatgatctcttattgaaggattaatggctttcagtttgtttccgtgtatttgaaccttttccaaaatttggactttcgattttttgttcgaattcgtgtccggggttcggaattcagaatggtgttcttacagaattaatttaatattacaataaacagaattttgttttaaaatgtttgtatcgctgacgcattttccggtcactattaattctattcaaaaaataaaacatgaaatattaaaaaagaattaatttaaaaaatataagttttatttgtgtgcattcattaacagactttttggaacggaattcctcacaaatggaaaaaagaggggcgaaatttaattcgctgctataatttattcccaaaacgaatgaatgataatatttcgtatacattatttgctcaattaagtggaaattgagatgaattcaattgcaattttgaaagctttttcccctccacagaaaacgtttgagaaaacaaaattttgtaatttttagcctatgttttttcaatgaatgttaagggatttcactctcgattgactcataaaaacaggtagattttgaatttggttaccccacatttgcgcccaggacatttgcgccccagacatttgcgcctatgtccaaaatcggagtcaaacttattttttcaatccataatagcctaaacagcttaaaataagcgtttgaaagtgtttgtatgcgataatttgatcgtcaggaaatttttaaaaaataattaatttttcaaacaagcaaatcattaatcctaatgaaccaaaagaaccagtttctaaaatttaatgctgtttaagagctctaagactgaaaaatgtaagttcgaacccgattttagacataggcgcaaatgtcgggacacgttgaattttattttacgacaatttttttgtttgattcacttcgttgaattgatgatttcttcgccgaatttccatgcgatgacagtgtgccaatgctttgaatggacaagcggtggccaaatggcttttcacgccactgcaaaacaatgtgccaaaggtgttcaaatgctggttgaaggaggattattggcattttgcgtcatggattgaagccttcaaagcggtgcttacgaattgattatttggcatttttacagtcttttgggttcgctgacaaaaatattttggaaggcactttcaattcgtttttggcgacagttttttttacgaattcaaattgtgaaattttaatgctttttaatttttcacagtttttaactgtttttccatcattttagacatttgccaatgcttcttctcccgttaatttcattgtcgttattcgatctgaccaatgaattgactcgggaacaattgatgctgaaaaggaagaacgatattggccgttttcttctgatccgttacccgattgtgcgcgacccgagcaaatgggcaaaattcgaattccgtgacgcaatgatcagcccaagtgatcagcagcagaagtgaatgaatgatttattgagaagtgatcgatcaattcgaattttagggagttagataatgaatttgatgaatttctgacagtgacttcaggaaaataggaaaacggacaaaatataaaaatagaggccttattaatacggcaagaatttgttgggaaaggtcaccaaaaattgattttttaagtttaaagaaagtcaaaacaaatctttggattcttcacatttatttacacacattaggccaacaattaatcacaaatcatttgaaatgataacacagagatacaacacattgataatggtgatcaaccaacaacagacattatggtcgcttaaacgataaccgggcgacaaatactgtacatacagtgagatacaataatacaatctgtacagttggcatatatgggaatagggtcagttgaatgtatcctcctcctccttcctcttcggcggttgtcttctgcatctctcccatccatcggtcgtttgtcgtctcatttcatcgcgtgcttctgcgtccattcacgggcatttcggttgtactgctcgcggtcgttgcggtagataatcgcgatgttcatctccagcgcactgttcggattcgggtcgcagagaagcgaagagatggagagcagcactgaaatggaggggagacaatgaattaaaacggcatttccgaatttgaaaaatcccattcacacgacaaaatatcgacacttttccaaaaagtccggttttggtggtcgttttgaattggatcgttttgtcgtctcaatattttgtcggcgttttgtctgctctttcccgcgtcgctttcacctttcgaaatggtcaacgacggcgcccactgcgtcgtcttcaggacgtccagacaaatgccaccctgcttgttgacgttcggatggtaaacgggcgtttcgaatttgacaattggcggagtgaatgggtagtcgcgacggaaaacgatgtccaaatggaaggtgcctccctcgtacggcgactcgggcggtcctttgatggtggccttccagtggaacatgtctttgccgtcatccatcggtgccgcggtgcaacccgtgatcggttcctgcttcagctccgccagttcctgcaaatggatcaaaacatttaaagcattggctgatcagagagttgtcatttcgccacctgtttgatgcgtcgaagtgccattgcgaaaacggcgagcgaattgatgtgaaggacggacgaacgaacgaacgatgagaaacggcgatgaggtcgcttttgaagtgttgttgttgttgttgcacaatgaagggatgatgatgataaacgcaaatagttgtgttctaaaaaatgaaaaagcataaaaacataaataatgaaatgaattataaattttacaaatagggaaaaagcaattttttgggtttttttgattaaattccaagtttaggatgggtgatagaggccaggcaaatcctgagaaaaacaatatgctggtcgaaaatgtaaaacaaaaaggaattttggaacacaaaggattgagcaaagaagagacaaattaagcaatttggttaatacaaagattgctgctctattcaaagaaaaaaaaaacaatccgatgagaaaagcaccatttataaagagaaaaaatatttggatttgggcactggaaattttgcccctttccccgctgcgtcgtactataaaaagtccttttccctcctctttcattcattgcctatttaaacaactctcttttccgacttttccctgtgtccacgtcattcattatacctatattctccttaacgaaacacctcaacaacttttggaaaccaaacattcgttcattcattcatcggtcagtttttgcatgcttttctcctttatttcgctcaaatgttttgtttatgcgttctttttgagacaactcaaagccttaaactgaaaatgctgacaaaaaggaggttctaataatttcagcaaaatgcctttttttgttgttatttttggatgcataaataaaaattgtttgctgtctggacgcataaacttcagtagagcaagcacttaatttcatcatttctttaataaaagctaaatccctttaaacatttcagttcataatggccagacccaggggcagtggaagagacccattcaaagcacgcagtgccagggcaagacgtcgcgcgggcaacaaaagaaaggcggccgcagggactgctgcaaacgtgggttttattctgctgctgtgctattcggccttcaattgttttttcgtttcactttttggcacttttccagcagacagagcgaaggtcgaaatttcatttctccctttttcaggtgcaagctgccaacaggcgccccatttgtctgatctgcttgaagaaaatgacccaagtccgtcaggtgcgcaccatctgtgaccacgtgttccactacgtctgcttccaccgttggctcaaatatcgtctgttttgccccgtctgtctgctcaactttcgcacggaattgtatcattcgggaaacgccgtgtttgagggcgcgtacaacgatggacacgttgtgctcatacctgatggtgaacaaagcaacagtggataagtgatcggcactcatctccaattgtgatcggacaaaaacgatatctaattttgtattgtacataaataggttattcggacaataaaactgtaatgtgcatttttaaattggctgtggttttctaaattttgtggcaccgcccaactcgccgcacctttgttttatggctttctcgccgccattgaaaaaatgaatgtgaaaaatttagattcgataaatcatttaacgaaatattcttaatcagaactttttccctaaaatcgctgcaaaggaaagccgtgtgcgacttgatgggtgaaactcccattgattcgacattgaagtccttttgacaaaaggaacaataaaaaaagaacatttgcgcttatttgaaaacattctgaaataaaaatgggtatcacgaaagattcctaataccatattaataataataataaataataattctgaactatgagcaaaaaaattgacataatgccataatttaatatccaaatatgttataaaattaccaaatttcctttgattattttttccatttttgaaatgctcattttcaaagacgtccttgcatacaaggacggatcccatccctgaactaatcaaaatgtgaaattttcactttgtcactttttggctgtttcggcacttctgacttatatagaggggggatttttaaaaggatcgaaaaatgactaatttggtatcatttaaaagctctagatgagatataacggacagattttcccacagccgtcaattcggagcataaccaaaaaacttgagaaaagtgctcaaaaaacgcatgttttggattgatgggaatatgcatgcgcgggaagttcattcattgctttgattggccatccctttgacccaagggcgtagccagacccttggcttcgggggggggggaggctgaagacaaaaattcgatttttaggggtgtatttttgcttttttgaaatccc

SEQ ID NO: 4923 - DNA, 2564 bp, Heterodera glycines
aattttcagtgtccaatgccattggatttttaactttataacttaccgacccgacaacgcgcgcgtcgtcccaaaaatgattaaaaaaaaattcgtacgacattcgcgtcgaatgtcgcaccaaagcgcggcgtataattgactcccaggtagaattcgtcgctcaacagagagccaacgaagccttgaacaacaaaaatcaaaaaataattattgtttctaccggtgtccaccaagacaaagcacacgcgtccattaatatacgcgatcgtgtagatcaaacgttgggacaataaagcttggattggctccggcgttggagctggcgattcagggcggttttaattgtgaacgccctcttgccatgcgatttggatcccattctctgttaaatttcactttcgactttcgcacggaattgtatcattcgggaaacgccgtgcctgagggcgcgtacaacgatggacacgttgtgctcatacctgatggtgaacaaagcaacagtggataagtgatcggcactcatctccaattgtgatcggacaaaagcgatatctaattttgtattgtacataaatagtttattcggacaataaaactgtaatgtgcatttttaaattggctgtggttttctaaattttgtggagggcaccgcccaactcgccgcacctttgttttgtggctttctcgccgccattgaaaaaatgaatgtgaaaaatttagattcgataaatcatttaacgaaatattcttaatcagaactttttccctaaaatcgctgctaaggaaagccgaaaattctagctattttttatcgggacaacaaatttagacaattgccagttgctgatgcgagcaaccccgaaaatccatgaatgaattttcatgatttattatggaaacattttttgcaatcaaaaaggtctataggtctttaataaaattcacgtttcatcacagttaatacatattaggcgaaacaattgatcacaagtcatttgaaatgataacacagagacataacacattgataatggtgatcaaccaacaacagacaattatggtcgcttaaacagtaaccaggcgacataatactgtacatacagtgagatacaataatacaatctttacagttgggatcatatgtgggaatagggtcagttgaatgtatcctcctcctcctccctcttcggcggttgtcttctgcatcctctcccatccatcggtcgtttgtcgtgtcatctcatcgcgtggttcttcgtccattcacgggcaattcggttgtactcctcgcggttgtcgcggtacatagtcgcaatgtcctgccgcagcgcactgtccggattcgggtcacagagaagcgaagagatggagagcagcactgaaatggagggagaacaatgaattaaaacggcatttccgaatttgaaaaatcccattttcaaacgacaaaatatcacacttttccaaaaagtacagttttggctgtcgttttgaattggaccatttagtcttgtcgatattttgttggcgttttgtctgctatttcacctttcgaaatggtcaacgacggcgcccacatctgcttcagaatgtccaaacaaatgtcgcccctttctccaacgttcggatggtaaacgatcgtgtcgaatttcacagttggcggagtgaatgggtagtcgcgacggaaaacgatgtccaaatggaaggtgcctccttcgtacggcgactcgggcggtcctttgatggaggccttccaatggtacaagcgtcatccatcggtgccgcgttgtaacccgtcgtgaccagttcctgatgcagctccgccagttcctggaaattggtcaaaacatttaaagcattggttgatcagagagttgtcatttcgccacctgtttgatgcgtcgaagtgccattgcgaaaacggcgagcgaattgatgtgaaggacggacggacgaacgaacgatgagaaacggcgatgagatcgcttttgaagtgttgttgttattgcacaatgaagggatgatgatgataaacgcaaatagttctggtctaaaaaaggaaaaaacataaaaacaatacataatgaaatgaattataaatttaaaaatagggaaattgcagttatttgtaaaaaaaaatttgataaatttaggatcaaatttgtaagtataggtcacggaaactctgatgaactttcaggtctatgattataatttttggatattcggctctgatatttactgtatcagataggaagaatgactttttgtctcagagttgttaattgctttctcaatatgcgtaaaattacacgcttaacttatttatgattgactgatcaggaacgaaccggattttccaaaatcatcgaacgaaccaggaaaggagctgctatgatgctaactccagtaattctgaatttatagatcttttattaggttttagagctttactattatatttttttcgcactatcaattcataaatattttttcacaaactgctctgaattgcaccaaatgttaattataagttaaataatgctctctgatgctttttc

SEQ ID NO: 4924 - DNA, 6598 bp, Heterodera glycines
aattcccccccccgaaatgaaaatttttaaaaattttccagcaaataatggaaaattttttcgaattcccccccccccaaacgaaaatttaaaaattttatagacaatttttgtaacaaatagcactcaaattttccgtaaaacggccaaaattgggtccttttttagtgacaaagtggagtttttacccagcagtgggaaaaagttttttaagcagccgccgccgacgaccattttttccaagtgtttttttttagtttttttaaaaaactcatgattaagtgatcgtaagtggagagatcgcagcttaaatagacataaatggaaaggggagaagtgtgggatcgatcgctattggctaacagaaaataaataaatgaaaagagattaaaaatgagtgtgaaattgtgcataatgcttcgtcaatttatgttaattagaatatgtcttacacctcatacccccttttagaccgtcccaggtctcagatttgaaaccagttaaaacaaaaaatgaattatgaacttttcgcctatctccattaagaaatcaatttggttgctttcggcattcgaagtaaacaaaaaaaaaaattgttgaaaatattttagaaaaatggcagatatttggtttttgggggtgtattttcaattcttatatttttcttacatatttttttcaaaaatgccaaaataagtaccaaaccctcgaaatatgtgctatgtttttttgtgccaaaaggccaaaatatgtgtttttatgtttttataagtcgctctaaattgaaaattgattcaacatatactccaaaaaccaaataaaatttaacaaatttctaaagttcaaaaaaaatgttcgagtttcgcgttagggattctgaaattcatcaaatagagttcatattcatgatcagcggccacaaaagcccctggaaacacgtttttatcattaaatcaaaattttttatgtgggtcaaactgtataagtacccaaatcctttatccatttcgaccaattcagaaccctgggcccgaattcagacaaaaattcaaatttttcgagtttcactctgtttccttgaaattttatgacaaaattcatgatttttttaagtttggaaatttagaaaataaattcgatagggaaatgggacgttctgtaatactcatctcaatttgtcttaaaattgttgctgaatttctttctcattttacagtgtctcttcgaagttgccttcattcaactggactgttccgacaatttctctgttcaccaatttccctgtcaaacaattgaactgcgcgcccgactggtaccggagcgagtttcgtcctgctgccgctgcttctgttgctgctgattatgtggagaaaaaaataccgatgacgccgactctgttgttggcacttttgctgccgttggccttgtcaaatcggcaaatgtcgtggtccgggacaacgatggaatgtgcgcacgttttttattttgtgacttattccccacattgcagtttgttatgcaccgatgttttgatggacaccttcccatttttggacccaactcggccacaaaatggcactgatttcgccacatttcgactttttagtcgacgcgcattttgaggagaaggaaatgacaatttggaaaccaatccaaattttcaaaggccatgttgcggaagggccaaaattccgtgtgatcgatgatgccgaaggcattgttgaatttcctatgcctacgggtctgcagctgattcccgtacccaccattaattcaatctatttcagtgatctgttccccgattccattggtgatttgatgagcaaaatgaaacagcctgccaaattctgtccaaatggttacacaccccggcaaaagatgggcggcctaaacgattgaagtctattgacaacgcaacaattaattttgaatgggtcaacaatttcagagaggtcagtaaacgtcatattttcataaacatttcaatattttcatttggtttccgttttccattgtttagaatttatccgcgccaccacttctgtcagctacaaaatacaattcaaactctttgaattggtggagccttttacattagtgaacaagcggacccagaaaagctgacactgactaaagcagaagaataagacaaaagatggatggtaaaacgatgtccaattggggagacggcagcgattcgatgggatgtcgaaaagagggacgattttaacacaataatgttttggctgtcacctgattaaatcattatgaatggaaatttacctgataattgctcctcacatttatttgttgcttttttcgtttgaagacatttaatttgtttggattttgggacttttacatcaacagaagtgatgagttagaataggtatgtgctttaccacggaaacgcttgaaattgtatttaatttgaaactgcaacagtgtaattttttggcatttttttcgggatttccaaactcccgaactgtccgacccacgaaatttattttgtttgatttcagattttgtttacttattgtcagtgttgtgttgtagaaattcaaaatgatgcttgtctttcagcgatttgcatatcttttgtatttttttgaaaatttgtttcattttgtgacacatttttggtccataaattgcaaaatgtcctttttcgaggtctttgctctttgtgctcgtccatttgttgggaaggcacgcattttttttgtgctccgtcgtaacacaacaaaaggcttcggcggtgaattggcgagaagaagcaattgccgcatacacaattatccaaacggggatggagaattgtatcccaaattcaaaatctaaacaatttacttttacgattttaaagtccgaggcagcaaattaaatacagagcagaaaacaaaacgaagaaatatcataaaacaaaacgaatgaatgagggaataacaaaatatgtatttacataaaattggcagccctattaattaattatataagcaccgctccattttttgcgatcggcaaaacattggacggaaatgcggacaatttgtcgaacaaaaagaaaactaagccaaacgcggcaacggcgccgccccaacacattgcattccattttggaatttttaatacatttttgattaaataattccgacctcaactcggcctcaaattggcactgctttctcctcgtttcgatgttttagtggacaaacattttggtggaaaatgcgaattgataatttggaggccaatcaaaatttccgctgccaaacaaaattcgctttaagaacttcaaattacgtaattcaaaaaaaagcacagcaagaaagcataaatgttttttaaggtacattgaccatttcgtcatcgcatttctccgctcaaataaacaaatttttgacaacggaagaggcaccaatttgtatttaaatgtgttttatcatttcaacaggaaacgtgtccagcgaattttggatgatgtttttctcagtgaaattttgcccatttttgcgccaaacattcgtcgtttggactttccaaatgacgatcatctgcgtcatctccttcgaatcagttcgccgtcacttctcaccgatctcaatcagttgaattcaatcgattccgattatctggtgcctgctgctgccattgatgattttgatggacaaaatgcaacttctgctgaacaagttctgtccaaatggttgcacacgccgagaaaagacgggcagccgaagcgattgcgttgttgtattggttgtgcattgcaaacgaaaaaatggatgaagaaattcaagcaggtcgccccaattttctttcgacattaattctttccttgttgtaaccaaacaactgaattctaacaaaaagtcgaaagtatctcttattaaaggattgattttgcacacttgacaatgttacttttaaagaatatattaattttttttcctttgactctaattttcatcactaatttttcactcagacccccattcttaccagtgcttgtttttcccggttgccctaccgggaccgggacctgagcttttcaaaatccgggacctcggatgaccgggaattcccggcccggtcccggtcccgtggcactctactttaaatcttaaacattttttcgaaaaatcctcatttttgcaataaattttaattatatatttctttaaataattttatacaaaaaaatagattttagtttctaaaaatcgcgaaatatttgcatagatagttgctaaaaaactggtaaattcccaaaatagttgctaaaaaagttgccaaaaattggaaataactgcttttttgggtaaaatctgttaacaaatcgtattataaattacaaaatttttcccggcgtcgcctatcggcaccgccggcccccggttccccaaaagttttttggaaaaagcgcagtaaaaatgcgcaacgcagattttttcgcgtccagaaacccgaccgatgaattttcggccgacccgacccaaatcccgacccgatattttttggaaccgcggcaaccctgttataaatgacaagaaattgatgaatttgattgtttcaaacgaaaaatatgacagttgactgattttgttcgcaattttatgatgttttaaaaatgaggattttttatggctgaaatgaggattttcaaaattttgagatcgaaaccctgatttaggcgtttctccgtgccaccactgtgccagtcacattctgtcacttactttacccaactcagcgcaaattgtgccatttgaattggtcaatgaacgaactcgagaaaaactgacactgctgaagaaggaatgaggagacttatcgatatataatagtcaatgggcgatgaagcgatgcccaattggacaaatggttcagtgggaagagctgaaaatttggacaatttgaacaatgtcagcattatttttcgtggtttcactaattgcattgggtgagcagaagcaactgtattgtgtactgtattgaaaagaattttaaaaaataagtacttgaatatatcttgaaattttttccaaaaagaaggacctccatcagtaagattactgtttttattgaaaatttaattaatattttcaattttttttcaatttatatgtttttgtcggaaccgctcagtttgcgcgcatggttgggcgccagcacgtttttctactataacttttttatttattatccaattagaatacctgcaactgccgacacttgaaagcaggcgaaagctttctgatctgttcatggctcataaaataatttatggccgaacagatctagatttatttaaaattttcaaaccttctaaacgctttaacattcccttttatagacttaactcgaaatataaattaggcaaaaaatttataccttttgcggggcgggtaacaaaaatttggaaccaactcgataaaaagcttattgaaataaactcattaaatcaatttaaaaataaattaaaactatttcatttctgtaagattgaccggaaaaataaaagtcgaattattaattcattaaacaaaaagtgatttggtcattatttttattttttttattgatctcacattatattttattttttggcggcgatctcgtttttaattgtttatgcgctttcttgaggacattttaattaatgttttgccctcaatgtaagcggatttttcccttttgtggactttttctttattgacaaataaataaataaatataaaaaagttgtaaagaaaaaatttcaaaatttttgaacttttgcaattttcgtgtatttttaggtctcgaataaaataattaaaatttatctaatattttaaataaattattaaccgaaattacttagaattttataaatattttaaagtttcattggccccataaattttacaaaataaagcctaaacataggcctaagtccaagcaatttagcttgagatgaagcggatagaaatattttaaaatttgatttttattttttaatttagtccaattataattgaatttgaaatttcaaaataatctggttattattttatttaatattaggtaaattttaactattttattcgagctttaaaaaaacttttagaagaatgtttatttaagtatcaatttaattaaatgttaacatattttaaatttaaaaaaatgataaaaaatcataggaaaaaattgatttttgaactttttaggaatcgaccaaccacagttcataatcatctttcacgaaaaaaagtttcaagccccctaaaaatttttttttctgaaagttttctggttttaagccattttaaataataaaaaattttcaaattaatttttaggtaattaataaaacacacaaaaactttctttaaatgtaaatgaaattatgaaatttaaaaaaattgtttttcgaatacggacaaatttaaaccaaaaattttaattaagaaaaaataattataatttttggggatcaatttttttaaaaaaaagtttttcaattcttcgggtgtacatttatttgtttcgatttgcgaaagggccgttcaggaaaaaacaaccaaaaaaaaacgacaaagttccactg

SEQ ID NO: 4925 - DNA, 1122 bp, Heterodera glycines
  misc_feature (1108)..(1108): n is a, c, g, or t
atgtgccaagttcaaattggtgaaaaacaaatcgcgttttattatcaaagacatccctgctgaccctgaggcactcctaatgggcgtcttccaacattgtatggatgaagcaattattgacagccgtcaaagtggagttgaaccgactcatctcggatgtattgtttctagccagaacctttcttccgacatttggatccccattcggcagcttactcctgacaccattaacacaatactaaatcgcttcaacgacgttgcacagagcaaaaaacaggatgatgtgacgctgtggggtgaaccatttactgttacagtaacaacacttaaccgtaatgctctaccggcgaagcgtcaactgaaagggggagtagcccggaaattagcaccagttcaccacaatattcatccaaattgtcttattaaagttaataatttataatgtcttaattaaaaataaattttagatccaaaattttgatgatgacaattactgtttattttacgctatccaagcaaccttggttcgatcaattggtgacttggatcgtcgtcgctttcatgattacgtcaatggaaacagtgaaatgagaggaaaacttaaaaatgatgctttggaaatgatgaatgctgttaacgcaccagctggtcaaccaaattacgatgcggaagtatatgtgccaagaattgtggactggtggaatggggaaaaattcgtgggccaatggaaattcaaaacatttctcttcggatcagcaggccattacaagcctttattcaaatatggaccagaggactatgttgtgccgatcatcctttacttcgaagaggaacattttaatggtgtgcagaaaagtggcaatttgttcggcaaaccatattgtctaagttgtgaaaagacttacgatcggccaaaacgtcacattgtcaattgcaaagcccgctgcattaaatggtaataaacaattttaacaatgaattaattatttttaagctcccaattgggtccaatatttccatgcaaaccaaataatggattccgacaaaaatgcaaagagtgcaataaatttattcttcacactcatgctatcagtatcatctttcatcnggaaatttgcaaaa

SEQ ID NO: 4926 - DNA, 7276 bp, Heterodera glycines
  misc_feature (52)..(52): n is a, c, g, or t
  misc_feature (64)..(64): n is a, c, g, or t
ctacccatcggacgattacattcagccaaatgccatttaccgtaacaactgnagatcgacaagnaattgaccgacatcccctggtctccttcgtcaaatggattctatacaatttgccaaaacaatacgacaccattgcatacattttggaggacgatttgacatggttttggttttccgagaattattcatggaagggctaaatccgtcaatgatcaaaaacggcaacagattactcgaaatgaaagtaataaaaatatttttaataatatttatttttataattttttggtaaaaagtcggaagaaattaaatccaaatatatcattccgagattcttggaatttggttcctggtccattagcctcactggtcccaatgtttggcttggacgttcaagacaagccgttctttccacatttggcaaacaggccggaaaattacggctgccaaatatttcctacgaaatcaaactatttggccggtgggataaatcctgagaagcgtaaagaatttgacatttggtatgctcaaaaccaaaatcagccgtttctgcttgatgaagcattggccaggtattttttataattttttgaaataaccaaattttcagttattgtaaaaatgacgtggatattttgatggctggccttatcgccttcagaactgaatttttggagatgagcaagcgacctgctgatcccgacggaaaggcaaatcgagcaacttacacaactccacacaacggaattgacccgctcaagcattgcataacaattgcatcagcatgcatgcgtcatttccgaactaatcatttaaagcctggtcacttggctcttgttccggaaaaaggatacgatagctgcggcgacaatcaaagtgatttggcaatgagttttatgcagtggtacaccgaaaaatatgcggttcggattcaaaatgctttttcggctgaaggagagaaaaggtaattttagagtggggattctgagcaaaagttattctcaagagttggcaattttcgtttggacggttggattgagtctcaacgaaaaggactagaaatccatggctgtgtatggcatgcatgctcaaaatgttatccggatgataatgatgtaatgccttgtggcaaatctgcaggccgaattcgagagagaaacaaacagagaatggaatttatattgaccaaagtgccaaatgtggaaatcttttggcaatgtgagattgaggaaatgctgtccaaggacagggaaatgaagcagaaattcaaagaatatacgggagatggcgggccaatcaatattcgtgattgttttatgggtggaagaacaggtgcattgaagctttatcacgagttggcagcggacgaagaaatcagttattatgactttaccagtctctatccattcatcaagtaaaattgaaaattttattttccccaaaaaaagttatagttgtgtaacttattatccggttggacacccaacacttcatgttccgtgtgaggacgttgattggcggagaccagaggacaatccatatccgcttgcaattctcaaagttttcgtcattccgccacaaaaaatcgatgttccggtattgccagttaaagtggatgatcgactatgcttcccactctgcatgagttgttgcaaaaaatgccctaacggaggtgtaagggaaacatacaattgtcaacacacataagcaaagaggatggatcagtacatgcacatcattggaggtattaaatattttattatttttattaatatttttagcttaatgccgcactggaggagggatacagagtcaccatgcttttacgcgtccttgaatacaacaaaagtgacaaccaactttttcgatcatacatgagtgaatttatggcccaaaagttacatgcatcagggtttgatgaagaaattcgcggaaattctgaagccgaggaacgattcataaaggagtgccgggaaaaatttgacataaaaattgaccgagcaaagatgataccaaacaaggggaagcgagccttggccaaattagctgtgaacaatttatgtatgttgtataaaaacccaaaattttttaatgataaatttagggggtcgtttttccctccgtaattacggactctcttaaacttttataactgatgatccatcagagctgggaaattatcttgacaatcggaagatcgaagtgactgggctcgacatgttaactccggagcggattttaatcagctacaatcagaagaaggattgggttcaggaacacccctgctccaacgttgtcatttcacttttcacaacttctgcagctcggctgcacttgctaaaagcaatgcagaaagtcgcgcgaacccctggttgtactattttatacactggtaaatataatttattaatgaaaaaattaaaatttttaagatacggattcgttgatttatgttcacccaaaaggcgcaaatcctttgaagacgggtcctcacttgggtgagtttacggatgaatttccaaaggtaattgatttttgattttaaagaaataaatttaaattcagcatgacattttggaatttataagtggtggagcaaagcaatatggtctgaagcttcggaagaagggcagcgaaaatgagtttgactacgtgctcaaacttagagggataaccctaaattatgatgtgaccaaaaatcaggggctttgttacgacactttcaaaactcgcaccacttcaaaaagtatataaaccatatgttggcaaagggattgtttgctctcgtgattttcgtgtgcttgattttggttattccactcattgattcgttgtataaagttgaaaaaataaaaatttatttaaatggaaatataaattgaaaaatattaaggaatagaagaggtcaattttgggtgaaaaatggcaaaattaagagagagaaaatacaaaatggaaaaaagcttaatctaccacaaagagtagcaatcattttggctatattcatcgcgcccatcaacacttttcgaatcatcatttgaagtttgagtgtcagcaaaatttgttgaattagttgcactaatattgttgttgttaatctcggtgaaaatctgaccaagccattttgattcatcaacttcctcaattttgcataactcaagaggataaaaacgatcctcttgtccttcaggaaagcgttcgatgacacaatgaagaaatggatggcgaagtttaatacgatgtcgaacgtagaaatgtgcggccacattaacattgtaaggtctacctaatcgcccatatgccattgtagttgcagctccttgcgcagtaatacccccaaaaaccaaagttttggtgtatccatttctgtccttgtatgttgtttgaatatgctttccataaaatgctttcacaacgatttcacaatctgatggatgatttaggcgatcacggagctcagtaattcgacaattcaaaagttgtgctattttttcagtaagaaggaccatttttgcaaattaatctagaattaattaatataaaattttaaaacgaataagtccttttctagaaaaaaaaactgcaaaataattttgcgaagatgattaatgaaaaaaaaagaaattcaagcgctatttataacagtcatgaatataggttaagtaaataataacaagtataaaatcagattttcattcattttaagtcactttaatattaataaaataaaattgcattttcaattcctgatttttaaaataattttttgataatgtccgttccatcaaatgacaaccaatttccaaaaactacaaatgaatgccaagtcgatgacggtattttatttttatttattactcataacaaaaaattatgaataacttaagatgacgtcgacactgatccatcacccgaggaagttgagaaatggactcccgaggaagtgatcgagtgggagaagcgaatctttggaaaaatgcctccggaagaggagttttggcaggaaattatcgatgatggagacaaagatgtgagatattcattaaagcatattttatacgccgaaagaaaaaagcggagagatgaaatattgaagcgaaagctaatcgaatacgaagaatcactcaaatctaaggctgataattgatttaacagtttcgattgtcctattcagcacacgaatttttgttaatatattcatgaataaagaattgaaaacaaactccgctcaaattaggttaagcaaacattaaatggtataaaaactctaaatttaatataaattttcattttcattactcaaataataaaattttatattgcaaaatgcttgacaacgaaaatggtggttcaaatgaacctcagcaaataaacgaaaatgttcatgtgaagaattcttataatgttcagccctggaaacttttccgtccgaaatacatgctcacctaccgcatgtgtgaatgtaaacaaaataattaaatttcttttttaatttattttcttcagtgtgtctttccgcattgtggaacaacaaaaacaaatatataccaaatgaacgccgagcattaatcagctttgaactttgtgaaaaatgcacaattgacaattgtcgtgcgaccgaaatacttgcaccgttcaagccgaagaaataaatttggagatgatacgcagattttctcacagacaaaaaattccagttaattatttaaatctttgcatattcgtctctctctatttcaccaattcctcaattatttgcttgtttgcacgatggtgccaaataaaaaaaatgtggtattcaagaaccatttgacctctctaatttgaattcactagtggattcaccaaatatgtttgcatacgattctcggttaggggttaattgcggaacgataaaagagattacggatttacagttcaagcactgcattcgtcgaatggtcacctcggaaatttgagatatttggtgagtattgccaatgcggaaaggcttgggggtctagtaggcggaacgaacggcaagaaggttatttggcggatgccaaagcaaattagttgcttcttcttctaattttatttactttttctattttcttttaaaatatttttagatatcaattaattaaaattcattttcaattagcgacgaataaatgtccgacaacgtctcgaattcgatccaggagttaaggcggatggtcagcgaccaaaaccggatcattttcaacttgcgctcccagatgatagaccaaagagcagtcattttgcagaatttatcacggattgagagattggaatgtttcgcttcgaacgtaatttaaatttatttattggattttttaaattttataattttattttaatataataattcaacattgttaaaattaaaactattttttccagaaccgcggtggtcgtggtaactttcgtctgcggtataacccattggcggctgttgaactgaccctgctcggaaatcgtcttgaggacagggctcgtagacaccgagtggccataggcgcatcgacgtcagcatcgctggtcaggctgtgcagcagcctcagctgttagaaggcgaaaatggtgaatttatttaataaattaaattatataaattattttaataatattaaattttaatgccttcttttgggccaacaattgagcgccatatggagagatcgcgtcaccggttgctccatgacgagatggttcagagatcggtacaacagcatttccaacaccaacaataacagcttgtgttccaagctcaacagcaggaacaccgccgacgtgaagtgcagagacagttcgaggtagccgaacagttgcaagaagagattcaggcagcggaagagggggaaaatgatcaagagaatgaggatcagcatcaacagcagcaacaaggaggggaggaagcgcaacacggaggggaggaagaagtgcaacaagctgcgcagcaaaactttgagcgaacagtacgactccaattgcgcgagtctcagcgctttcacaatgggtaggcctcgtccgtgttggtgccaccgcgccaactgttctgggaaacggagtgcgtggtttgcaccgcggcgcgcccacatttttacagcaaagaatgtgggcacatttttttgtgcgctgactgcgctgtgacatcggtgatcaataaggtacaccgatgtatgttatgccgtactcccgttagcgggatatatccttttgttcgctaagttgtaaggattatggaagtaaaaaaactacttttctgaatttggaaaatttttaaaaaatttaatttacttccctaaataatttgaatgctttaactaattatgtttatagctttcaaattgtaactgaatcgaattcatgaatgattttttcaaaactgatccaattgactcataataattaatcatttcttacaatatcgtaattgactctcattttgatgacagttttcacttcattttaaaaaccaatgtctcattttctgtaattcaatatttttcaatgtaatctcatgttactttgcgtttgtcaaccttttacattaattcaattcacctctcactatatatttgtgtctatgaaaataaaataaaactcaataattgcgaaagtgaatgaaaaatttcctatttttaatttttaacaataagttttgaattaatagacaaatgtatgggatagtcttatggtaattacagtatcttataagagagtgtggggagacgtgtgacagtgaaaagcccaaagccagtgctgaagagcatcgacctcacataagtgggtgggcagagaaagagagagagagagaagcccaaagccaacgctgaaaagcaccggcctcacataagtgggtgggcagagaaagagagagagagagaagcccaaagccagtgctgaagagcatcgacctcacataagtgggtgggcagagaaagagagagagagagaagcccaaagccaacgctgaaaagcaccggcctcacaaaagtgggtgggcagaaaattttaaaatttttcgagaaaattcatatgaaaggaaaatgatgaaaagtagaaaaatttaaaaatttaaaaccataaaaatgtaaatgaattaataaaaaatttaaaaaaaacaaagaataaaagtggtaaaataggaaagaagggggaattttgcctttaaataaattcaaatgaataagtacattggaaattgagggagaattctgcttcgggtaagagattaataaaatgtgtgtgtgggtgtgccgaagaa

SEQ ID NO: 4927 - DNA, 1679 bp, Heterodera glycines
ctatgttttagagttatctggcctctgtccacttcagtattaaccccaaaattcgtccgacgcatttggcatttttcggtcccacgccattcgcccaatggcacaattgttggccaagttcaaattgatggtccgaaaggcaacaaaatctggcaaatagtgatggatgcgaagtccgaaaaagcatttggcattgatcagaagacgggcgaattgacaataagaaaggaggaagggacgagtttgaagaggaagaaaaaggtggcaaatggaggggaagaagaagcggaggaagcgaccattgtggtggcactgatcggagcagcggggggcgaattatttgacaggtgatcgactgatcgaatcattaaaaaacataccgtaacggaaaagaccgtaacacctttaccatttcctcaaatcagatgcgtcgtccgcgtgttcttctcccgccttcgtcccccctgcgtcgcttttccctccccccatttctccgtccgcctttcctccaccgcttctgatcagactgctttgcttcggttcgacatcatccgccacactgactttaaaattgtgctcagtgatcctccggtatgcctttttctctgaataatgttcgcctgtctgatcccgggtccaatgccggtccatttcccgatcaaattttgtgccgatcggtcccccgtttctctggcaatgccttggtttgcctctgatcagtagtgatctatccgtttagccgttgcccttctgcttctccgcccgttctccctccgtcctgtctctctgttcgtctctgtcccctctccgtctctcttcactctcttcgtccgtctctttgattctcttcctcctcctccttcatccttccggccgcgtttgctcccgttcctccgtctctgtgttcattttgccctcctcctcttcttttttgccctttgtccccgtcggtggcgttggttttgtgcgaaggaatgcgttgccgggccaaaatgtgctccaatttcgaaatggccgtggtccattagaaatggttgaccaacaaatggacaaggtgcttaaatactctctcattttttaattgctcctaattgccaatatcatccctaattacccctctttctgtcccttttaagctttttcggcttcatccctccagcggtgtcctttcaacccgaatttcctttgtcggccttcgtctcccttctcttttgccaattgtcgtccgttcacacaatgccacttttcatctttttgtccttttggaagagcaacaatggaagaatgccaatgtttcgtctgaatcaaatgccaaaatcgaagtgattcttccggtgatttcatccgataaaacgacgaatggaaaggaggaattgcaattgctggcgacagaatatgccaacccaaaccgaaggcgatgtgtgccgacattgaagcgattagacaacgaattgcgatcgaatgtgacggtttgtcttagggatggggactgatcagtcgaatgattctgctgatcagccctgatcaatcagttcggttttgccagatcacttcctcttgctctctgctgctctctccgttgcctttgtcttccgtcccttccgaatttgttcctctcggtaatggcatatgccttcgaatttgactcacttcatttgctgctcgtccttccgcgcctc

SEQ ID NO: 4928 - DNA, 5640 bp, Heterodera glycines
ccttttatcccttttatctctctctctcactctctctcttttttgtctgatcattcccatgttttttctcatttgatgctttctcccagtttctgcttttcctcccctcaggtccttcttctcccgtttgttctctctgctgacttttcggctccgttcggctttcatcggcttctcatcgcttttcgtgaccaaaatggcaacattttatctcagtctgatgccgttcgtttgatgcaacattttttcgtcactttctccgatttgtctgacaatgcgtggaatttgcgagttgaggagacaaattttcaagtggaagaggaaagaattttggactgtttgaaagggccgagggaagtgatcggaacagcgcagaaagtgtgggcaccgatcaaggcggacgaaaggcaatttcgagtgatcttttagatgccaaagttacccatatcttaatgctaacagttgcctccgtcttggccccgtcttcaccccaaaatgccctttttctccgattgtctctgccaacgaattgatttctccccccgtcctttcctttatgccctccggcaacttcaacgaccatttcggcttcgttcgcttctccggcatcctttttccccgtgttcgaatgatctctctccaatttctcactgctcaatcggtcactctttccttccaattcttttcccctttttctcatcccccgcactttctcagagtgctctccttctctacttctctctcgattccgcctcatctttctttctgtccgtcgatctgatcaacggaaagccaagactgaatgtgggactgacttttccgcttcaaagtcgcgtcattgaaaagtccgttaacgatgaaagtacgctttgctttggttctttccttttcatgcctttaccctctctaaatgccacagaatggtggcatttggaactgagttggacgaagggacgcgtgacattggaattggcggagtgccaaacggaggacgaaaatggggacgaatgtgctcaaaagagtcatggcgtttatctagtgcatgtccaccttcagcaagaaaacaatttgctcctacagtatgctactttctcttccccaactgtgtctctaccgtaccccttttcagtccgccctctcttcgtttctcacccttcgtcattttcggtgatctctccgttttgcctgaccttctccgtcattctgctggtcggacttcggacttttcattcgttggctgtcagcgacgaattgccatcgacggaatcgaaataattggccaagatttggccattttggaggagagattagaccaattcatggcggaggtgtttgcccattttattacaataaattgctctcttttgatcagatcaatgcaaccacttcatccatgtgtccgttcattggaagtgcgcgaaataaaaggccaaatgtttgccatggagaaaatgcccggaaggcatgtggaaaaggcatttgtatgcctgagggaagcgattcattcacttgccaatgcgaaagtcagcaagttgagtccgctaattgtgagcagggtgagaattctttgcatatttctgcttattcattaattagttaattaattactcaatttccccaaaaagttctcttcgccgcttccctccgcttcagtcctctccgttttgtgctctcttctcgcactttcaatcgtttgtccttcgtccctttgcccggcaatttggtccattctctcccccgccgtccgttgtccctccgtcgtggagaggacgaaaatattcaatttgccgatggattgaatgtgttggcattggactttcattcgtcgaattcggaaaatggaaaaggcgaagaaacacttttgtgcattgaatttgatgatttgttgctgatgatagcattagaggtgaaaacagcgaaatgtctgataataaacaaaatgaaaatgttattaattcatgcaaatggcacttttgtcaaaaaaatgccaaattctattaattgaccatttaaataataaaaggcctccgcttcagatgaatgtcaattctatgcgcttcgttctccaccggcacaccaacaacactcagccgacgccgtttccgctcagtttccaattgatcgttaacagttcgacgccgttggacatccattggcaccgattggccatgggagtgtcgccagacggaaaaatggtaaagcaatgaacggatgacagcgaaatgtgtcatgtccgtttccctccccttttgtgcagctccgtctccaacttgatgacatggctcccgtcgtccaccggtcgtccctcctcaatttcttccctctccttctccgttctcggctaaaattgctgtcgttgggttcgacatgttcttctctcaacgcgcatcaaaatttgtccgtttttcggggctgcgttcgccgctttctgatcaacaatcagttgcagcaaatccatccccagcagatggctccgtttccctctcacaaaaaggtctctcctcgctccgtctgtccgtccctttttcactgtctttccctcttttcagtctcttcggctgctaattgaggagaatcggccggaggatgcgatttcgcagctgtgcctatcagccaaatcagctgaccattccgttcttgcctcgatatttgccgtcatttctgtcctttttctgctctctttcgttctctttgccatcgtttttcgcttcaaaaagcgaaagagaaaagaaagtgccaaaagaaacagaagtgtccaaatatcatcttcttttgtgacccaaagtcaaactccgccgattattgtgccatcgcaatttaatggagaggaagaagagcagaaaatggccaaattagaaaattggcgggcgatggccgtctcaacggacactttttcctcaattggcttcagttcgtgttcgactttcccacgccactccaacataatcggtccaagtgatgccgaaggtcagttgaaaatagtctctctctattttaaaacgcccctatctataaattgccgcagattcagcatgagccgtccaattatcattcaatcgcttccaaaaaaggccaaggttcgtttatcctttgactggttaaagttcccttttgacaatgggatatctatgctcagtttctgttatgcctttttaattctcttttttcaccccaaagattgtgaaaatgaatgctacgacacgaagcgcttaacgacggcagcgaagaaattgaaaataaagaaaaatgaaatttacgggtgaagcaccaaaaagaaaaatatataaaaagaaacgggtcattaatagggctgccaattttatgtaaatacatatttttttcctggcttctccttgctctaaatagcaggaaaaacactttcttttttgtgtttgcgaacaaaaaccgggacttttatttacatatttcggggtttttatacatatttcgggattttcttacatatttgtactagagtgccacgggaccgggaatttttgccaaaaccgggaccgggacttgccgggacctgagaagccgggaccgggacctcgattttttttcgggaccgggaccgcaagaaaaaccgggaaccgggaccaaccgggaaattttaaaaattcaaaaaaattttaaaaatttaaaaaaaaattcaaattttaatttatattaagtgaaaataatacaaaattatttggttttttataataaattaaattaatgaaaattttcaaacaaattttcttcaattatttcaaacaattaatcatttttggactaaatcatcgaatattaatagaaattcagatttgattttcacatcacttttttcggagcgctttttcaaaaaacttttgggaaagaaggggtccggcggtgccgataggcgccgccgggggaaattttaaaaatttgggtgcaatttgttaacagatttttaacaaaaaaggttggtttttgcgattattaagctcaattggtaggattttcatttaaaaaatgataaaatatgtatcaatttaaaaagaaactatgaggaatcatattttctttataggaaacccacgagtatacaaaaaaaaaattgaaaataatctaatttctgcagagggattgaaacaggggaaagaagaagggaaagccaaggagactagccattaggccatttgcacacttgggcagtgttacttttaaagaatatattaattattattttttatttttccctttaactccaattttcatcactaatttttcactcagacccccattcttaccagtgcttgtttttcccggttcccggttgccctaccgggaccgggacctgagcttttcaaaacccgggaccgggaaccgggacctcggatgaccgggaattcccggcccggtcccggtcccgtggcactctaatttgtacatattttggatttttttcatatatattttcatttttttacatattttgagtattttttacggaaatttttggaaatcctcaaaaaaaaatccaaaatttcggtaaatatttttatacatattttcatttttttacatattttgaagatttatagaaaaaataagtttgaaaatgttgcctaaaaataccaaaaaaagtaatttgtatgtcattttgtggctatttcatactttacggggattttctttcccaaaaaattccattaaaaaaatttttatttacatattttgggatttttcttacatatttctttttgtacatattttttgcagccctagtcattaaaatgctgaacatttatagaatttgaattttaaaaaataattaaactttgtttgtgtgaatagcaataaaattagtactacggtagtcaaattcaaaatattcatttttattttgaatttaatttattttaaaatattttttcataatttaatttaaattctttgtctacaaattgtattacttttttttcaattaaatattaaaaaagtccatatgtacctgtatatgttcttccttgtctcatgtcctttttagatgaaattgttaatctttttgtttttattgctctccataactctgagccaatgctcattaagtgccaatgttccagccgatggagatggagtgattagtgacaatgaatttgccgaatttgagtttatggatgaagaagacccaatcagtgaccagcagtcaaatgataattaccaacagaatgggcaacagcaaaaagagcagagaaatggtgacaaaatggaccaacttaacgaccataattccaaggaagaacaaattggtaaaagagcggatgaaaatggcgcagaaaaggtgacaatgatttatgggattggaattttatttcaaaaaataatgtacaaattatgcattttactagtatgtcggtttagatcaagtgaaattgattagaggtgcatttcagtacctaatcaaacttaatttcaacatttagtcagctcggagtgaaggtgatttttcgtttcttgtcgacgaagaagaatttgatgaatttccggcgaaaacagtggaagaaatcgaccaaactcacaagggggaagtgcctgtcaacaaaccaccaaaaccattgacttttgctgagatgagccttctcggcgctagttaaaagagcactattttga

SEQ ID NO: 4929 - DNA, 2163 bp, Heterodera glycines
  misc_feature (371)..(371): n is a, c, g, or t
ttttttcaacctgtttatggtcaaaatttgttttttttgtttaaaaagtcctgaaaccaagttcccggtggttttaaaggtcgctgatcaagaatatgacaattatttgggcctattaagcaaatttggcgctagttataaagtgataaattttgtattttatcaaaaaccataggggggagggacccttttgttttgtaaatttttttttggataaaaatcgtgaatatacattttattcaccataattgtgttgttaatacttaatatccatcattatgtgtaaaaaaacaaaaaaaaaatttgaccaaaaaaaagttgaaaaaattttcaaaatagtgctcttttaaactagcgccgcccttttcttnttttcaattataattgtattttttaaggttccctcccatttccggtcaaattggtcaagctaccaaggtaaaccaaagcttggaaatgcctttgtcgcaagtaaattgtaagtccacttttagtcgaacttctcgctttgctcatcatttttgtttatgcgctgaattacgcttacggaaagtccaaaaaccattccattgctcacaaatggttcatggacaatcgtgaacgtttggagaagcaattcgcactggttggcgatgatggcacttcgcaggaaaatatgggcggttgtctgatccgcgagactgactttgcatattctgtgtggtgcacagggcgaattggttgtcgctcaatgcacagccaaataaaggtgcgttttgggttttccatgtgtcaaaatttgtttatgacaaattttcagctcttcaagcgacaagatctgcttggtatgatgatcggactcgtccgtccccggccggataacgtagtgtacaaaatcgacctggaccctgatgagatggattcatttgttcttatctttgggcagcgtaaaaatgtgcaaaaaactgtgaaggaaatgcatgatttggtttgtttattctgcaaaattattaatatttattgtttttcgctatattttagtcaacgtatgtcactgagcgtaaaaatgtggacaaagttcagctgccatcttcgatttgtgtctttgcagaaattgccgagaccattccggccataatcgacgcttcaacgctgcaattcctcaagaaatgcgagaaatacgtggagtacattcatttttccgatcaatatgctggcgcaaaacagccggagtgagtttgatcagactattatttaatataattattcggaaaatgaatttagtgatcaatatgtgcgtcttccggagacgcacccgacgttggtgttcagctacataataacagatgacaacgaagagggacatttgatggattcgatgctgctgaacttcacctttttcatgttggataaagtgcggcggtatcggctgagcaaagaggggaaggcaaaggcggacaagaaaaggcaaaatgtgcaggagaacttcctcaaactgacgcatcagcagagacaggaagcagcacaggtgaggaagacaataatttacaataaatgagacgggaaaaaggctgtttttgttcgatttatagacgcgacgtgaagaaaagacacgggagcgaaagcaacgagtgattgaagaggaggacccggatagacagaaacggttggagaggctagagcagaagcgagatgcgaaacagaagcagccgaagatgaagcaattcaaaattaagtagctgatagcgtataagcagggaacgatggcatacaacttgtaaaaatagctatgaatgccacttcgtattgttatttactcccatttctatttgtccattccttaataaatttatgttattataattgatcgtggaacgattacattcgggtaaatgtatgcacggaaaaattaggtttagtgactgttcgtcttgtttacgggagtttctggagtgataactaaaaatggaacccatttaattaaggctggcagattgaattttcaaaatctgtttttaaaaaacagtgcacaaaagcaagcaaacatgatcaaaaagctccaagaggagaagctttctctaattaaaatgctaagcattttgacgtatcagaaaaaagttacgattgggaattttctaaaatatagaaaaaatctttaatgaataagaggtctgagggatgaga

SEQ ID NO: 4930 - DNA, 2114 bp, Heterodera glycines
gcgttagcgaggtactgtaaaattattttgctatacaataaatttttgtctcgattttcagttattgcaccaacgatgttgggaatatgatggcagctctggtcgcctttcgccgggaattcttcgaaattttcacggcgccaaaggctacgttgatgggattgacgacaaggagaacccacgaccggggattgagtgttgcgtgagtgcatgaccatcgcgggggcatgcatgcggcacttccgcaccaaccacctgcccaacgagcacttggccattgtgcccgagcgcggctatgacaacgcgcagaaccaaagcctgctcgccttacgcttcttccactggtacgccaaggagcatggagtgcaagtgcagacagcccacgcggctggaggagagaagcgcattgggccctactcactggatgggtggattgaggcggaacgacgcgcaattgaagtcaatggtagctgaattttatgcacaattattttaaaatgtgctattttaaggctgcacgtggcacgggtgcaaaaagtgttaccccaacgacaacatgctgctactgggaatgcgagatccatcggatgctggagcggagcaaagaaatgcgcaaggcatttgaagactatgtcgatgacggcccgctggtgatccgcgacgcgtttatgggagggcgaactggaccggtaaagctgctgcgcaaagctgggccgggagagagaatctcctattatgacttcacatcgctctacccgtatataaagtaagcacagttaaagttataacaaattaacattgtttccttcacagcttcaccacctgctaccccattggcactcccaaagtgcatgtgttgaaccatgaagtggagtggcgcagtgcagcggacaacccctaccctttggcattgctcaaagtgtgggttgtgcctccccgacgcgtcgacgtccccgttctgccagtgaaagttggagagcggctttgcttccccctgtgcatcagtagcgccaaagagcacccgacaggaggagtggacaacgactaccactgcgagcacaatgacagacagcgggggtgggtgagcacatgcacctccattgagctcaacgaggcgttggacgtgggttacctcgtcacaaaggtcttccgcgtgttggagtattgtccgagagtgcgcagagcagttcaacatcaccatcgacccaaccaaaatggcggtcaacaaagggaagcggtccctggccaagttgtgtttgaacaacttatgtgagtactgtcgtccattattattatattttaaaaaatagggggtcgattttcgcttcgcaactttggtctcgctcaaacactcatcactgatgacccagcaactttggcggagtacctggacaacaaatccatcgaagtgacatcaatcgacgagttggacgagcagcacatcacctcagcagcgcgcctcgttctgctcatggcaatgcagaaggtggtcagatcaccgggctcggatctgttgtacactggtaagtcaaactacaaaaaattttttgtgcacaaacatttattttagacactgacagcctcatcctcgtccaccctgaggagcggtgcccgctgaaaactggcccccacttgggccagttcaccgacgaataccccgaccacgacattgtggaattttgcagtggcggagcaaaacaagtgcattttcagttcatttttgtttacttttcaattttaccacgctttagtacggtctttgtctgcgacgcaagggcgcggaggcgggagcccaattggaacatgtgctaaaagtgcgcgggctgacgctaaattatgatgtgatcaacaatcaagggatgcgctatgaaaacttcaaagagcaggtggtccggtacgcgacaagtggtgaatatgagccgataatcatcacataccccaacttccttcgtccaaacattagggagggaggtcgggtggtttccatgcctatgcaaaaatgttatcgcccgtttgtgggaaagggaattatcggggccaatttcaatgtattgaattttggacacaacattgtaatttgtacattatctatcacacacacacacacacacaca

SEQ ID NO: 4931 - DNA, 4080 bp, Heterodera glycines
aacatgtactcactggtgatcattttcgatcattcccctattagcttacttctggttatacactcaagaattcactcacttattctaattattttctcattctcgctcttactctgatcacattctgatcactcactcaattggaccaccttctgttcactcactgtcactctgattactcagtcactcgaatctctctctgctcattcactcactctgaacatctatgaattgttaagctctcaccgcttcgatcaatttctctctctctctcgctctcggatcgttcactcttactcagatcacgttctgatcacacactttcaatcggatcacctactcattcactcacgtactcactaggatcacgttcagatcacgcaataattctgatttctcgcactctttctctgtcacgacccacacattgatcattttctgatcacccactcagatctctctctctcatgtatcataaatcacatgcttattttgttcattctgatcaccctttcacacttaactttgtgatcactcactctttctctctgatcaattattgttcccaatcactttttgatctctaactcttactctgatcattttctgatcacttactctctattataactcactcacaccgatctctcaatctctctttgatcacgcacttgttcctaatcactcatgatcactcaaacatgcactcgaacacacacacacacacacacacacacacacacacacacacacacacacacacacacacacacacacacacacacacacacacacacacacacacacacacacacacacacacacacacatatatgactgtttcttttgtacctcaaattgtgtacattttatgccattttattagtttttaataaaaatttgtgcattattagtgaatggaagatgcaattatgaaataattaagcattagaagatgtcatttttaggtagaaaaagtgcataattaagctaaagaagacacaatttttgaaaaattaaggaatgaaaaatgcaatttcaaattagtagatggaagtggtcattttaaggaagaaaaatgcataattagtgagcaaaaacaaaactaatatacggtacagtactctgtgagcattcattgcgtccgctgtcttcatccatgtctccctcaaatactaggcgcattgttgtgtcggatgagtttgacgacgattgtttgtcgtcaatttcagtgaaaagacggcccagccaatgctcgttgttgttgatgtccatgtccatgttgtcatcaatcagctcaagaagttccattgggttgtgccggtcctcccctccccccgaaaagcgttcaattatgcacggtgcatacgggaagtgaagctttatgcggtgccgtgcataaaaatgcgccgccacattgatgttgaaagggttgcgcaattgcccatatgcaggaagaaatgcggcgccttgtgccgaaattccagtgacgaagaaagttttggtcaatccattacggtcgttgtaggtggtgcggactttgcgtccaatgatgtgtttcagcacaagcgcccgatcctctgggtggttgagccggtcgcgcaatgacttgacagggcagttgagaagctgagcgcaaaatgtgcttacaagaaccatggcaggagaatgaaattggaatgaggttaataaattttacttttatattcgcaaaagtgtggccacgcctacactatttgaaaagagtcacggttttagacacgcccactaaaagccaaaacattttgcctgccaaaaacccagaatcattttaccaatttttgtcaaaatgaaaagacgcgttgctcctcttactgctgctgctgtctctgctgagcaacatcaaataattggttccgagtcgcccaagccacatgaagagacgaccaaaaatgttgagccgaaggatgagttggcaacgaagaaacgcaaagtggacgaccgagagttgtggaaattggcaaaaggcaaatttttgctgaccacctatttgtgccatggtaataattaataacaatttcatcaaattttaatttaaatccataaattttgagatgattggaatcgtctgtacaacaaccagcagaaagtgaagcgcctggagggggaccgttttgccttcggctttgaaatgtgtgaggaatgcgtgtgggccaactgccgcgcaaccgaccttttggcaccaatgaagaaaaagtgaactttgcccaaaagacaataaaggattttgatgatgcaatccataattttaattaatatttaattctgcacaataaacattttttgagacagtccctcaatttccttttttgtgtttgcttcagatgaaatctggtgatgattaatttgcttgccgaatttgaatctggcaaagacactgagggggggggggcacatggatagggacaaagcgagtggaaggaccattcattgtcttattacacaaaccctctaaaaatataaaatgtcccgccgcaaatcttcaattgcaccatcgctgtttggaatagcaagtaatatagttttgtcaaaaaaattttgaaccaaattgttctgttgaaggatgcggcgagtgccatttggttcggtgcaggccgtgcaaaagtctgcgggagaggaacagagaaaaaatgcgtatgggactaccccatgggcgcatcagcatggaatttgggccgatgacgcgcctacaaatgtgttaagcaacaacggcacgaaccccattggaggcggcgcaacaagaagggcgagaaacgcggtctctttttcgatggggggacccattgggagccgtccattaccccccaaaacttttttacccatctgaggggggactctgcctctgcactgtccacactgcccagttctatgggcagtgtggacatgtaggcctatgccgaaattgtttaattcatcatttgatcctttctgaacaccccaaaaaatgtccatattgtaaagctctaactaattattacatggaacattaattgtgtcattattttcgactaattttataaatatgtaagaataaatttatttctgtttaaaattgtaaaattggtgaaaaatgtttgtaagagcacattggtgaggaatgtgttatgtaagagcaaattggtgagaaatgttaaaaatgattgaatttgttattgttagccttttcttttcattcgtcttcgctgtcactttgctctggtgccggcgcttccaaacaatttttgacaaattcgcccaactgtgcaatggcctggaaaaaaaaaatgaaatttaaaaaaaaaattttttttttaataagctaatacttttttgtacggaatgtcctgtacattgagcgatggagcaaatgaaatgttcaggtcgtcaattttcagcactgttgcggggtcccggcccaacaaattacaaacttaaagaataattttgaaaattcaaaaaaaaaaatgaccttctacgaattttggactcgccatcacttccttggcaatactctcgggaattggctcgccaagtagtccacgcaacacatcgtggacattcgccttccttgtgaagtcaatagcgagttccatacaatcacatgactcgctctgcacccaactctcttggcccctcgcacctaattaataataaacagtgtttaggactgtgataaatttaaaattgagagacagcgagaagagagagagatgaaaaggaggaacggaacttaaaacgtttgcgcggagctattcaaagacaactcggcaacaaacattcaaaccccggactgtttgattatggaggagctattcagtgacaactcatcaataaccaaacaaatagagacaaaaatatgagaagaaatgaaaaaaaaattttaattttcatcccaaccacttacgaagccagtctacgtaatatccgatcctttttgtgctatgggtgtaggtcgccaaaacagccttcacgcggtagctgcgctcccctttcagagagcgaatgatcggcggccacatccggggcgctgctggatacagtgatctcaaatttcaaaaaaaa

SEQ ID NO: 4932 - DNA, 1142 bp, Heterodera glycines
ttatgccggtccctgaccgtggacatttttgattatgccggtccctgaccgtggacatttttgattatgccggtccctgaccgtggacatttttgattatgccggtccttgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtcttgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtccctgaccgtggacatttttgattatgccggtcttgaccgtggacatttttgattatgccggtccctgaccgtggacatttttgattatgccggtcttgaccgtggacatttttgattatgccggtccctgaccgtggacatttttgattatgccggtcttgaccgtggacatttttgattatgccggtccctgaccgtggacatttttgattatgccggtccctgaccgtggacatttttgattatgccggtccctgaccgtggacatttttgattatgccggtcttgaccgtggacatttttgattatgccggtccctgaccgtggacatttttgattatgccggtcttgaccgtggacatttttgattatgccggtccctgaccgtggacatttttgattatgccggtcttgaccgtggacatttttgattatgccggtcttgaccgtggacattttt

SEQ ID NO: 4933 - DNA, 2261 bp, Heterodera glycines
aagttcttcgtaaagagcgaaataggcacaaaatgccataaaaatgacctaaaacagaaatgtttttcctactatttagaacattggagaatcgaggaaaatacaatatgtattacataaaatttgcgcctctactaattataaatttttcgtcatttaatttaattttcttttgctccacaacaatgaaaatttaaaatacaatatattaatttttttcttcaaactgtctaattcaatacatcactttggatttttttttgcctaatgttagccatttttttgtgatgacaactgattgatgaatcacccaccaacgatactgctcagaataattaattgcaattacttttgattaataaaagatcacattaaatttcccaaaaaataaaatatgaaatttttgtaatataaattaattaataaaaataatattttaaaaggtcattgaatgcaaatgtaaagttgtgacacatttgtcaccttcccccgctccccaaatatcaaatgcattttcacaaactttttgattctattaattattaaaataaaatgctttttactggtacaaaaatattttttagagtatcaatgaaaatgtccaaatttgtgattattgcacgttttctactgccaatcgtgctgttgttgatcagcagtcgtccagtctcggctagttatcaggacgatttggacgatgatgacgaggaagtggattatatggctggatacacgtaataattttgtacattatttaaaatcttttaaatctgtcaaaatgtgcgctttttctctaaaaaagagatataactttaagcaaaaacaaccaaaatttaaattcaaatttaaggaaaaaatttgaaatttgcctctttctgagtaaagttgtgatttcattttaaaaaacccattttggcggtttcacaaacataacctctgatatcctgataaaaaagtgctaaagaaacaaaaaataaatccaaaagtggtcgttttggtgaaaatttttcaatatttttgagattttaaatatttatttccattataaatggcatttttgaagggaggagcaaaagaagtgttgtacggactggctacaagcagttcaaaagctgtttccaagaatgctacactaaccagtcacagaacaatgtgtgcgtgctgaactgtcccatcgacttgggcatctgtgtggacaaaaactgcagcctgactgtgtgtgtcctcggcccaaggatttcgggtcagtgccatgagaactggctgacaaatgcgcaataaaaccggaaaaaatgccaaagatccgtaaattcgtcattgaaatacaaaaaaaaaaatataaattgcatagaaaagatttggaatatttttacatggaaaaagcaatcatttaaccttttttcatttgagtgaaaatattttgtgactcattttgcaataagattgattttttgatatcattttttaaattgaattatagaattaaacattattactggacctctcaatgttggcatgaaattctgccatttatttaacacttaataaaatcgatctgaaaaaaaatattctgatttattatattaaaaattgcatacattttttatgaataatttgttgtaaaaaagaaatttgattttgaaattgaaattaataaaaaaaaaagtatttattttaacattgaattttgagtaacgtcatagcaccatttcttgggccaaattctccaaaaagtcatttctcacaaataccaattgtgcagcgatcgatcaattcgttctgttccccccgcccctcatttgctcgcatttacatatttatttatttgtctccgtccgtccatttactaactattagcaaatgttgtcgacacgttttatgcccgggaattcccgagatcaatttgtccttttaaaattctgtcaatatcaccatttgcttatccaagatgatacagaccataatagcttttcttaaattcaatctaaaacatcaagccaaaatgctaatcacctgcttaatttgaaaagatgcgatccgcaccattccagcacaaaattcgtagattttacagttttgaagccaggattcatgatcagcaccttaaaatttgactctccaggaaatgtttttctttgttcgggttatgactagggttcgaagttgtatgcataaaaaatgccaaatatgcgcaatttaattaattccccaaaaagtcgatccttagagtgtatttttcgcttttttcgcatttttcttat

SEQ ID NO: 4934 - DNA, 2778 bp, Heterodera glycines
  misc_feature (30)..(31): n is a, c, g, or t
  misc_feature (72)..(72): n is a, c, g, or t
ctcccgaatgatttccaaaaattaaaatcnnaacgaattatggaaaagtgccaaaataagcaattatttttntaatcattaatccaatgactaattgtctttcattttcgcttatttatttttcttaatttgccttgggccacctctccaaatggtcttcagtcccatccccaagaagtgtttccccgcctcctcctattacggcccacacaatgtgttcattgactccgaatcggacttgccgtggtacttccaccgtaattactcctcctctttcaagtacagtcacttctacggtggctattggaacttcccctacagtaattatccgctaaacgctctctacaaaagtccgtggtaattggaaaaagtaatggtaaaaagcatttgatgacctcaggctcaaccgaccctaccacaacatgggcaatgccacggattggtaccgctaagagagacgaaaaggaaaagggcatttgatagccaagcgcaaatcaaagccttttaattatcccattaattaataatgttagttggtaaattgaaaattgtaaattatatttcattaatttcatttcgctgtaataaattatttgcatatttttgtgataagaaacgtccaaaaaaatttaatgcaaagaaaagaaattacagaaattcattcctttgtttacagttaataaatcaattattaaacaaattcaccaaaattaattacttcttaattgaaggctaatcatcaaaaattaacgagagcattgataaaacagcgagcaaaagggaagaaaaagatggtagaacatcaagtgccataattatcagcagagcaattcccgtcctttgattccttataattttctcaatattaaaagggttaattaatttaaatttaaaatttacattggcattttcacagtttaagcaaaaaaaaaaaaccaatggaattcaaaggcgaagaatggtcggtaaggagaaaagtaattaattaaacacaaaatggcatttgatttaatgggttttgtgcccgtccaggacaatccgataagcgaatgccgaatggccgagttggtccggcactttttcgccttgggttggatgtgcgacaacggcagcggaatggcggtccgagtgaaagacgaacggacgggcgaacatttgattctgaactcgtccaattcgttggagaaggaaattttttcggagtaattagtgccaattaagcacacgcattaatttaacatgggcaattaagaaacgatttatttgtgatgaaaatgaacggcgaaattttgaaaagcccgtcaaaatcggaccgatctccgacggcgccgttttatttactgcgcgacaatccgggtaaatgggaataacattcaattgataaaggagaaaattgcagatttggcctgtgtcattcacactcactcaaaatgggcaaatctgatcacccaactgatcagaggagacgagttcaaaatttcaaaccaggaaatgattcaggtggacaaaaagccatgctgagggggtaatttgaaaaagccatggattagtagaaattcgaagctaaatccgcaactgtgtggtgagatcagagaaactatgaaaggattaatttaagaataatttcttaaataagttacacatttaattattttgtttgttgaaaaattaaataagaattatttttaaacaatatgctatcacattgctttccttgtccatgtaataatttcgtaaattttcacttttttcctttttttttgttagggttgtgaaaatcgtctcacaaaaggccgtctggataacattgacgtgctagtggtgccaattgtgcagacagagatcaatgagcatatgctttatgtaagcacagagagaggaaaatgaaaagggagtccattaatctgattaatttgttagccaattctgctgaggacactgaatcaaaacgcgggggcaagtggcattttagtgcgtgggcacggctttttctgcttcggcagcaacagttggcaaagcaccaaaatgatgttgaaaattggcaataaatgaatttatagaaatcatttccattgtcaggttggagtgctacgagtatttgttcgaattggcatgcgaaatgcttaattacgatttgccattggtcaaaagtccaacggatgaggcgggaggagaagaagcgaatgacaaattggcacaaagggcgcaagaagcggcgtaaagaggacggacaaaatgccgaaaaataagggacaaaatgagacggacaaattaaataacaaaatgaaaaaataatatttgaattttcaataattggaggcacaagcgaaattggggttcgaaatttcgtaaaaaataaatacggacgacggaccaaacaggtagtaacagtaaaacccaaaaataattggaatttgtcggttgctgattcggtcggtctttgtccatccgtcgcacttttacaaatcaatcagctgattctaattaaatctttgatggatgaaaatagagaaatttaaataggcaaagaaataaaaataaacaaaggaatttatatgttccccgactccagttggcgaagcgggtcaactccgtcgcgccaactccgtcccagccaactccgtcccgccaactccgtcccaggccaactccgtcccgagccaactccgtcccgccaactccgtcccaagcaaaaattcaagaatttttttaaaaataaatttgagtttaacaaaattttatgaatgggaaacaaaaaatgataaattttggctttat

SEQ ID NO: 4935 - DNA, 3355 bp, Heterodera glycines
ggtagtagcagtaaacccaaaaaataaattggaatttgtcggttgttgtttcggtcggtcttgtccgttccgtcgcacttttccaaatcaatcaggagattgtaattaaatcttttgatggatgaaaatagagaaatttaaataggcaaaaagataaaaatgtacaaaaaaatttgtctgtttttttcgtgcccaaagaaacgcgaaggaaacgaaatggaattatgtcttgagaaatgagtcaaaccctaaaagagattcatcggaaaattgtgcttttttgtatgcgcttgacactaaaataagtaaatgaatcgttttttgtgtaaaaactaattcgaatcacaaagtccaaccaaaaaattgacggtatttaaggggacattttggcactttctccaatcactcactaccaaattccctcccatttttgcctcatccctcaaaatgtgccgccactttctccccattctctgctgcttctttgttcccctgttgctttctctgctgctcatcgccgtggatgcccaatttgtcgatcagttcagttccggcacaattatggagccgtggggcggaaatttggccaacggaggacttttggggtggccctattttggacggaagaagcgataaatgaagaaaaaaaagcgaaggaacggacgaagacgaaaaaggaaaagaaaataaagaaccaattaaccaattaacaagccaattgttgtatcaaattgatatgcaaataaataaaaaataagtgttttcttaactaaagagcccgaaatttgtaaattttaaaaatcaaaggcaaatgaaaccaaattatttaatttgatagaagttgttaaattggcaaggaatttaagcggcgtcctttcgcatagtttctattgtatataaaatattatcaaaaatatgaaataatatcaatcatttgccgtttcctcctcaattattccctttttggcctttgttgtcccctcattttgtccattaattttgcaattaatgccaaaatccatttgcacacaaaaaaagtgagggcgaatgcaagtaccaacaaaacaatgccaataagcgccaagtcgatgttgtacagcgaaattgtgcccatatttctcgattcgctcagcaattccggcagttttcccccattttgttcgagaaatcggatgcttttggtgagtcgttcttcggccgggaatggcttaaaggctttctatgcaaaaagaagtggtttgctaataactcactttagtgctcattaaattttgaattctttttgcccccacagcgtatcttttggtttgaaaagtggcacttttatttgattgtgccaaaattgttttgtgtttacttttcgttattgagcatttcgccaagcagcgcctcgaactgcgccgtgccttcgaccagcttcaacttgtcaaatgagcgtgcccacccgttccgttccgctgctcgtgcgttgcggtgttggtccgcaaaaaaacccatcgccagcaccggcactccgccgcgcgtcgcctccaaaagactgttgtagccgccgtgggtgatgaacagtttcagacgtgggtcagctgcaaaccgaccaattgggtaaagcagataatggacaatgaaaaatgggcaaaattatgggatgtatcgtaatgaaatgggaaaaaattatgcgcattgataccgtatgaaaacaaaagggtttaaatacgccgcaaataaacgcatcccattgcattaccgagaatggccggctgcggcgcccacggcgtcaaaaaaatgtttccgaatttcgctgcaatttccgctgaatactaaaaaccgaaatgatggctcttaattatttaatttattacattgtcccccttttctatcctcattatgaagtgataatcggagaattttgcaaaagtttcgagaaggttccgccgaaatttggccggaaggtccgatgagcgaatgatggtgcccattgaaacgaaaacaacgccttcctttcctttgctcatttcacttttaaatggctcctaaaaattaattagagctcatttgtaaaactgtacattcttaagaaagaatggaggagcggtgccacagaaaattggataatttatgcaaaaatcgtcactttttagggttttagaattaatgttgaaaaatcctagcgaagacatcccagaatgtcccgaaaaacaccgctggaaaacaactcaaaatgttgctttatcacaaaagcactctttcggtgggctgctcatttgtcagaatacctccaatttggcatttttgtccaatttgtccatgccaattccgccgatgttcaccatatttgggaagagaggtcgcggaaaatcgagcagttcgtccacactaacgaaaacaaacggcgaatttttgacaatgtcgcgaaggtcggggaaatcgtttctgttgaaagcaaaaataaaatgaattaattaaaccaaagcatttaaatgacccgaaatgttttcggaaaatattcgtcagcggatcaatgccatgccaaagataaacgtaaccgacaaaggtgcgcaaaaggttgtcaaatcgttcagagagtgacattttgtcgggcaaatccgcgtccattagcgaaggaagataagaaaaaggaaaaggaaggccgaaaagagaagcgacgtgctcttggagaggacagctgagaaggaagtcggaaaataagggaaatggtaaattaaaatttattaaaattaaaaaacgaaggaatggacaaattaacaaaaacaaattaacttaaattcattttaaaaatggttaattttaaaatttagctaacaaaaagaaattaattcaaagtaattataaacggacgaaaacaattaaaaaatggaatgggcttactaacaaaataatgaagttaaattaattttttttttaaattaaaaaacgaagaatgaatttactaacaaaaaaagaaaattattttaaattaattttaaaaagtggttaattaaaatttagttataaaattaataaaataaaaaactgaccaaaacaactttaaaagcgaaggaatggatttagaacaaattaattaattaaatattcattaaaaatgaatgattaaaatttaataaaacaacaaacaatggacctgctgatgagaatgtgaatgggaatggccagcaaatggccgagcccggcaccgcaaaagttcagctgctcctcgatgaccacgtcgaacttctgcttgcgcagcgattcaatcaaatccggattagaggtgataaattcttaaaatatttttttttttttttgtaaattcaatttcccaattaattaattattaattcactttcacacgctttgt

SEQ ID NO: 4936 - DNA, 3351 bp, Heterodera glycines
ccaagtcaggtgcatgcgcgcggcagagtcagctttggcggcaatgcgcgagccgaagcgccgaaccgaatcaagaccggaccaaagccgacacgccgaagggacacagaatcgggatcagttcccgagggtgttcatggtcagaagcaacccctcatcccaacgacccataacacctggggcatccgcccttcggaccggaactcacgcgccacaccggaaagtggctgatcggaaccggaatcgacttgcccaatctcgtgggccggccccaactgacaacggctgttctctatgccaaaattggggccaccgtccaagcaattgcccgacttatcccacgttccaagaacgacgacaacgtttcttcgagcaacggcggtgtctccgatgcctttcttctgatcatattgccagttgctgtccccgcccaaaagcatgccggtggtgccagcgcgacgaccatcactctttggtctgttgggtcggaccagggaaaccaatcgcaattcgtgagccagcgggaccggaaacccgcgaacacattgggtcgaaaccagtggaaagtgtcatgatggtacaaactgtgctcaattctgagagcaactcccgcccacccgaggcacgtgcaaaggccaagcgaaagaggccgaagcgacgacggagtcatctgaccaaacaatcggagaatcaaggggaacgatcccctggcactgatctgcgagcattcacagcaatgggtgagagcttgccggctttcctgatggtctgccccgtgatcgctgccaatgacgacaccacgcggcagtgtcgaaccgttctgctcatggatcccgggagtcaggtggattatgcccaaacgattctgacaaagcagctcgaactcccgaatgcgggatcatccccgctggtcgtgcaagtgttcggcggatcaaagaagaaagtcccgtcggccaaacatcgagtgaaactcaaacggttggatggcggatgggagcagctggaggtgtcatccgtaccgaacgtctgcacccccattcatacgaagctggtcgagccgggaacccatcccggcctgctcaagccgatggacgcgacggttcagcctcaaatcgtgatcggaattcgcaagttttgggacttggtgatcggattcaaaaaatcggccgagggggcctttcttgtcgacacagtgttcgggaccgtactttgcggagagcatttcggggcgcccttggggcaatcagtgccccgcgacaccatcctcatggcaataagcggagaagaaaacagatggaaccgcatgccagcctcatcgggagtggaagcagcggacaaatcgaaaccgtccatttacgagaacgatcgtctggggattggtcccctcaacccaacgccaaagaacccgcgcgatcggaaggaccctccgcatgtccagcccgagaagcgatgcagggtggagcagcaacggaccaaatgtgagttaccggaatcggaccaagacggaacaacagaaccgtgcgaaagaggcctcagccagtgcttgctcggggcgtctctgctgtggaaggtgatgacatgggtgactcggcacccaatccgagtttttaatcgtttgacgggtggggacattcccgagccgaccgccgatcaggtcaaaggtcaagaacgagtgcaattggccagacgagcccgcgcagccgctagagcttggagaaatgccgaacgaggacgggcatccaggcccggggccgccatggcactgcttccgctgctttgttttgtcgcccttttttcttcatcggagcccatgtcggtgatgctccgctcggaggactgcgcaagcacgccatcgggattcaaatgttccggatccgcggccatgatcatcggcccggaagtcggtgaactcagggactcagtgaacggcatcactccaaaggggattggtcccctgtgcctcttccttcaatgggaaggtggcatttcgactgtggctcgtcttggcccgcctcgccgccgcccccaatgtcgcgaaagcgacgagagaaaaaggatgggctttggatggccgggattgttcccggcggactgaaggaagcagggggcccgatgccaaacagtgattaatttatgatcaccatcccccatttttgcctccttttcccttcctttcacttcaacaatttgccttccccccccccccctctttttccgtcttatccaatttgtttaccatttcccttccttttgcttctcagcatttctcatttgcatttttgtgcccccgctcactttcatttcaaatgttttcctttgttgccccgccgcggggcatctgctctcaaatcgcttcttttgtcccaattttttgcccgtcttttctcaccattcaattcaattcattttgtaccttgggccccaatgtcatcgggtaaatgttcttcccaactttgtccccgtccgaaatgcccattcacgtgatttgcatttctcattgtccggcctatttaaccccccgccggtaatctctccggcgttcactctctttttccttcggtcatctttcccttttctttcgtccttcccttcacttggtctcccctttaacacatttttcctccaaatatgtgcccttccctttggcaataaatatttgtgtgtttgtcctttcctttggacagaggaaaattgcccttccctttgggcaatcaccaaattcggtcattcggttggggcattcggcgcccctaatcgcattcggagcgatcagcaattgtcgtgcgggattggatcactcctgatccctgcccactccctcccatcgcccttccctcctcagcgatcggagtcgggactcatcccggcaggcaattgggaggttcactcactccttaactgagtggtggtgccgttacatcacccccattttgtcggccctccccattctcggccccccttgggcattcaattcggaaaggggtcgacaaagccgagaaggagggcaaaggaagccggcgatcacccctccattgatcgcaagctttttcgacaagccctgtactaaatgtatatttacatgggtactacccttgtaaatgcacattttgtatattaataaggcaaaaaaattacgttgtgcagagcagcggcccgagctctcaaagcagccagatcgtcttcggcagcgccaaggttttcgcgggtttcgcgaagctcacttttcaacccgtgcttacgctttcgaaacttggctttggtgcggtcgagtgcacgtctgctcaacaacacctgttggaagacaatgacaaattaaagtcagatcaaagcaaaattcaagtccaattacct

SEQ ID NO: 4937 - DNA, 3051 bp, Heterodera glycines
  misc_feature (3007)..(3007): n is a, c, g, or t
  misc_feature (3036)..(3036): n is a, c, g, or t
aaaaattagaaatttttttattttgccggtaaaattttaaaaattcatccggtaaaaaaaagtaaattttttttgaaattttttgctccgtatttttttagaaatgaaaaaattgtagttatgataattaatctcttttagcacttttttcaattaaattttcttagccaaaatagaataaaactgcattctgcttcattttgttggaaaatattttcatttttggcattataacaattataaccaaaattttatttttacttgggttttattatttttatttaattcatattttgtttattttttcatttttagtcttttggctatccttaatgttttattaggttttgttttgatcatagctcgtaactgaacaaattcaagtgaatttattttttattatttacttttatttaacaatgtacattgtgactgtcttaggaatgattgatttccttataattttttttaattttaaaattcaattttggtttaaagtctcttttttaatattttataatagacactcctggtacgatgttatccaatgttaccgaggcaattcgttggtcagataaaatagcacaacgtaatcagtaaaaggtaacgaatttttttttaaatttataacattttctggtaaattatttttatttttaaatttatgtctcgtgaactatatttaatttcactttaatcattgatttcgctagcgccagtaagagtgagtccaagctggtttttaaaccagagcttccatttgttcttattcgtgctgacgcgtttgttaaaactgccacccatgcgcatttcttaaaatttctaaagatgcgcgtttctaaaactgtcagcgcgtttattaaaattgccatccttgaaaattgttcaaaaaattttcaaaaattaattttttttaaaaacaatgaaaaatttcaacgaaaaattataagagaaaattagaatttttgaagaaatatttttaaaataaaaaatgtaaaaaaaaatgataactttactcaactgcaaccaatattttatggtatcaatcaatagatttaattattttctatcaaaatattaatacttaaattttttacaaagtatataaaaaaagtttgtattaaaatttcaaaatttttagtttttgaaattctagtgtttaatagattatacaaaagtttttaaactccaaaaagaaattaaatttcaagtcattaaaatgcaattcaacgatttttttagaaaagttcataattttttatttattaatttacgaataaaaattaattttcccaggtttttataatattccaaaaatttttaaaaatatttctcaagttttcaaaatttttcaagaattttcttgaaattagggggggtggcagtttttaagaaacgcactagcaccgacattaatagagggggaggggggaaattgcgctttttcaaacagtgaatttttaataaaataatgtttgattaatgaattttgccttggaattaatgagaaataaaaccgaaaggaattttcgggaagagaattaattttggatttaaaaacattttcagcggaaaatagcaaagggattgctcaagtgaagtgaactaagaagagaacgaatgattccattaaagtttaagcgtaaacaaatcgattaaataaataaataaaagtgataaagaaaaatttagtataagcgtcaataatagtattttcatgcaatttccttctttctttaattgattaagttaagtaaaattattttaaatacaataaaataaaaatataattagggcgatttcttcgtgtccttttcccttagcactcgccgcaatatttttcccgaggcgcttttcggaatttcgtccacaaattcgaccgagcccaactgtttgtaggaggccactttttctatgaaaatgaatcttaaaagtggtgctaatttgcttacgtacccctcacaaatcgcttcaattccgactcggtcagtgtctgatccgccctcaccacaaatgccttcggcacttcccccgcgagttcgtccgccacccccacaaccgcacagtctttgatgcccgcgtgggacagcagcaaatcctcgagttcagcgggagcgacctttaaaatgaacaaatcgaagtcaaatgataccaattgacatttgctttttcaccacaattttttctatttgttcagtggggggggggggggggggggggcgtccgtttggtattatgaagagagtgcccgcgaactgttctatttcgccgattcgttggacgaccgaacggcacaatttgtgcgccaattggacaaaaggcgcgaaatgtggcaaaaaacggcggaggcgaaattggagggggcgacaaagctttgtctggtgcacaaaatgacgacaaaaacagcaaaagacgagaaattgcgaaatgccaacaaaaagtgggcacggcaaatcgacaaaataacgcaaaaggacgaaatgggcaaaccgatggtaaggcaaagcgaagagaagaaacagttgcaaaaaggcattggcattttgaaattgacccaaaaagcgttcattaaggtcccgctaattttggtggacgatgagtcaacttccgagggcatcaattgtttgaacagtgaaatttcggaaaaatttttgcaaaatttcttttcggtgtccaaccgaatttttttctgccacggtttcggcgtcgtttccgcctcggatttgaaagaacggcttcgatggattataagagataatgcgctgctcgcactcgaaaacgcgcacccccaactgatgcatttcggtgggaaaagcccaatttggacttgcggcatttcatagtgaaaaaatatcttcaactttattgtcaattattgacgggaataaaaaagcgcaatttgagtttcaaatccgaaaccctaatccgaacaaaaagccgaaaagcaccaaacttttttcataattttaatgttccaataaattactttatagtaaaaattacattntggcaaacaaaaacccaataataaattancgcttatggacaact

SEQ ID NO: 4938 - DNA, 3341 bp, Heterodera glycines
actttcatctcaaaattcgaaattagtcgaccgacggttttcgaatcgtccgaaccgaacactgacaaatgcgaacacatcgactgctccgtcattccatacccttggcagatttgtttcagcgagggaatccgtctcctcactttgtccaacagatcggtgcccaccggggcagcaccggtcataatcagtttcagtgatgagaggtcgtaacgagaaggggcggccgacttggcgagaaggacgaggattggaggcaccaagaaggcaactttgacctggaaaagagtggagacaaaacgtgtgaagccatgccaaaggcacttggtaattttggacggttctgcagaagaggtccaagtcaaaacgaccgaaaacgacgcccgaaccgccgcacaaaagggaattgaggccgagaacgaagccataaactgacaaacggacgaattacaaaatgtaattggacagcgaatagatttcttaatcgttcgattttgaaggccacaaattccgaaaataaaaaagggaaacatgggaattgtaccaattattattcaaaaattctgctcgccgctgtcagtaaagccggacataaattctaaatttttaaaatgtttccccctcaaaaaccatgatagaagggtaagtgcaacatgatgtgctctttgctccaatcccaattcggttccatctttctcagcatttgattttccaaatgactaaaaggggggggggggggggtaaatttgggaattcatcccatttctttgcctgctgaaaattcgtgccattgtgccgacgttgcgatgggaaagcatcactcccttttggagaccggtggtgccactgaaagggaaatttaagtgatagaaacactaaatacaaaagcaccacctcgaaaatggcataaacatcacgtctttttcgacatcaattttgggcaatggtcgtgacaaatcgacggaattcgatgaaccgacggcatcggaccaatgaaaaacagattgaaattgcgaatttggcaaggaaacagcggactgacaattagtggtggaaatgagcacaacgtactaaaagtggacaaagaaaggccgaaagtgaaataattgtgaaaaagcaaagttacctttaaatggggacaaagcggacgagtcgccaaaattcgttcgagcagagaatcggcacagaacaccactttgcactttgtttcattaaagatgcgggccagttcgactagaaattttcaagttggcaattgaatttgcaaaaaaccggaggagaggggggtaagaaaaaacgaaaaaatttttttattaataaaggaaaatttattcttttgatttgccaggaaattttgcaaattttgcaccatttgatgagtacacttacttaccttcattgagaagtgtgctcaccggggaaatgcacgccttttgcatggaagcggccaaaaaaatggcgaaaaaatgccaacagtttggaagaatgacacaggcgacatcgccggaggagaagccaatggaattaagaaagtgagcggcggagtgagtcttggacagaaattggccaaacgttgtaatgttggaagggttttcggcatcgacctggaaaaaaattaattcatagaaattatttctcataaattctttataaaaatcatacaaaaatggctcgttttggttgttcagcggaaaattgtctaattcgattcagaagtgtttcggtaaaaggttcggactgaatcggcactgattgaaattcagaacggacgattccatcctcgtcgggcaaatatttgtttctgttgttgcacttttcttgagaggaaaagagacactgcttttggcagtaaaaagaaaacgaattcaagaagttgttgcttttaactttaattctccactgacaaaacatttgatgacgatgagcactgtgaaaggacttttctaaatatttaaaacatttgaaataaaaactgacggaaaaaataataaacgatgacttaagagattaaggacgacgaaagcaaatgtacagataaaatgggaagggaaagacgcaatgataagtggtaattgataggtgatcaacaagcgttttttacatttacgcctcggacatttgcggtcatttcttaagggccattttcgggtatttcggcccgacatttgcggcctgctgaaaaccgaacatttgtggccaactgaatcaattaccattctgttttttaatacatttactaaacagtgattaattaattatttaattcttttaaccatttatttttgaacaacaatcaaaataggattttaataatttcaataatttttcaatcgtattttgattccttcacaaatttatttcatttcaacaatttgagcttgcttaaggctccaacctgcttaacaaaaaaaaaaaaaaatgcatgcttaagcaagcatgccacatcacaattaaaatcgatttaggtaatagttcagatggtatgagatgtttgaaaaagcatttttttaaagtctaaaaacatgtttctcattgttgaattttcgattccatgtccacgagcaaaagcatcacacacttcattggaaagattctatggtccgctttgcgggttgacaaagaaagttcgacactgaactcgatcagtgacgaaatgatcggtcaccttaacatccgaaaattgagtcgctgagtcaaacaaaataaatgggaatgaacaactacagcagttaccaatggtagcgttatgtacatcatgggttatctgctactgctgataaaactgttgatcattatttggactttttcggtcatttcctttcattttcatttaatcttttacatttgctcccctctttttcctcctccgcttcttctgctgtttctgctccgctttatgtccatttcaccgcatttgcttccttttctttttgccctccttttttcttcgtcttccgccgctggcgatgttccttctctcatcaaacggtttcgtgtcgatttggaccttcccccgaaggatcgttggtcgcccgtgctgaatgcgttcagagagagtgaagtcgttgctcgactgattcgcacggttaggtacaaaagcaccaccctcacttttacaattcctctaatttccccctgcccaattaaattttgttggatattctcagagcattccttcccgagaatgtccgctctccgctcttttggatctttggcaaattgctgcattttcttccatacgaattcgctgaagagattaaaggtttaagaagtgtgaaaattggcattttccaccgtttgaatttctctcaaagcgttacagtaacacaatggcaaataca

SEQ ID NO: 4939 - DNA, 1363 bp, Heterodera glycines
  misc_feature (7)..(8): n is a, c, g, or t
gcatgcnnctgcaggtaaaattgttagagcgatcaaacgaactctaataaatgagaatgctcagtttttttatcaccaattcagttatacggataacaaatttgtgctgttaataaatgcgccggtcggtgggccaattgagcagacaatttttgtggccaattcatcaaatgccaccactaccagcgctgatgctcatcatcatcaatttatgaccaccaattttgctttgacccgtgccgcaccgccaaatattttttgcaaatggaccacatttattacggtgttcgactcggtggagcagccgaacaaactccaaattggccacggaaacggaccatcacaccaaagtgtgcctgttcaggtcaattattttttaaaaatatatattttaagaattttcgctttttatgcacgaaaaatgaattggtttttggctttaaatttacaaaaataatttttttggtcaaattaatgcattgtaatataatattaataattattagagatcgacattttgaaaaaagcctggacctggaccttgatttcctggacaaaaatccaggaaaatccaggtccaggaaaaatccaggctcctcgagacctggatccaggcatggacctggattttttgaaatttattttaaaaatcaaaaaaatgtttgaaaaaattaattatttgcttagaagcatctgaaaatatctaattaataataataataatgtctttttaaatttatttaatctgtttttgaaaacttgaaaaaacatcggtcacttgaaaaaataaattctaaaattttgtccaggaaaatccaagttttttcctgttttgcctggacctggatttttttcacatttgacctggatcttgatttcctggacaaaaatccaggaaaatccaggtccaggaaaaatccaggttgccgaaaaatggcccggacctggacctggatccaggaaaaatccaggcctggatctaggtcaaggtcgatctctaataattatataggccaaattaatttttaataaaattacaaacttaggcttaatgtgttttctctttttagcttttataaaatatttgcttctctcctaaaaagcattttcttgaaaatgttcgtttaatttctttttttaaattaaaacattaaaaaaagctgatttaaagaaaatagaaataattaattatatttttaaaacattttttatccttaattaattaattttttgttttattagttttatttctttccatcattgacacttaacaaattaatttaatgagtaattaatgatccaaagataattctcgaaaacatagataaaattgtagttgctcgctcaaccatttatcaaaaaa

SEQ ID NO: 4940 - DNA, 3324 bp, Heterodera glycines
agaagatgatttaacagatgattgagtgaaaataaagttttataaatttgaaactcattacatccattcttaaatacaaaaactcatcaatttaatcagttaatataaaataagaattaacaattaaaaaaattttttttattaattttcttaattatgattcgaattcgattagataatataaaaaaatgttctactaaaaaataagcagcggatttttgaatttttggaagataggtcaccaatatgttatatttttttgtaattttgccactgttatgtactgtactatactgtacttgttgtttagttccaactaccgtacatgaagaggcgtgtgcatgtcggcacctgtttcagcccacttttcctggcagaacattggcaattggttgtgttggccatcgaaatttaccggcattacggcattcagttgcaagttgtgtatttgatgagcgcagttgagggcttatataaaattttgaaggtatttcaaaataattcgcaaaaaatcacaaattataaacaggcgttttttattttatttttttcaatcacaaaaaggacaaattttcaaatttacaaaaaattattttgaaattgtcaaaattttttttgattgttttattttttaaattcgtttaattttaatttgctttaggcatacagttcaaaagaacatatccaattggagccatgggcatcaattgaaattgatggacaaattgataaagagatgaacctggaacttgattggaggaatcaggcaacggcacacactgattgccttttaaaatatggagtaatttaaaaaacaataattaattaaattgatttaaataatataaaaaattaattaattataatataatacaataatgattgttttttaaaatatgatagataaaatttattttattaaaatagcaacagataatggttgtcgtaatttaaaataattattttaataacaacacgcacttaaaaatttggggtattaaaattgttattttaaacataaaaattattaattaattacaccaattgattaaccgcctattcaacatttttcaagtttaaaaatgataatatttattatttttattatatatttaaataaaataattattaattttagtattctgccgaatttttgattgttggtgatatggatgacattttgatccctgatgataaagaatattatgcagaatttattcgaaatgattatcggcataaaaagaatgctgtcgcacttttataccaaagatatacagtggatatagtcacaagtaatgccaaaaatttataaatttagtaaaaaagtccaatgaaatttattttaaaattttaaatgatttaaaattttagcccaaaattcgtcaaaattctcattgttcgatgcgttaacatcagcaaaagttgcgttttatcagcccgatgatcccaaatatgtggtgaacacttcgcgcgcggaatcgttgtggattcattggccagtgatcataaagccgaacactgcaacacgcctggtgccatcaatggaagggcgaatgttgcatttccgaaattggcactttttggaagacgaaaatgacattttggcatcggaaaattatatgcacaggaaagtggtaaaaactattatttaaatgtgtaatagcgagaatcaaaattatataatagtagttatggtccggtgccattttcattttcacgaatatgcttaagtaaaaaagaacaaaagttctagaatttttctcatgatatttattcaaaaaatgtgatgaaaaacctcgaaattatagaaataaaataaataaacaacctaattttaatcgaaattaaaatcccattcaaaatatcataaccaataaatttatttattagaaaaatgcagctctgtggcgctcagtggcactgaatgaatcatttcttagcacgaaaacggcacgacaaattagcagacgatttaaatccgacattttcaagcgcaatttcggcacatttcttaaattgccaaccaagagaatgtatgctgaaatgatggcaaaatgttatgacaaaattttttatttgcatgataaacaagtgacggattgtccgggtaagaatttcgacaaaatttgaaaaaaattatatttttaaaattaaatattttttaaaggaccacaccgatgcagaatcaaaccaattaatgggctaaactgttttattgcaaaacgtaaattaattgaacaagagttggtgcccggaattttttggtacatttcgccagagaaaggaaaatttcgcttttcaaacgaaggatgttcactttaaaattttttatccaataaaattcatatgcttacatattcccgcagtgccaatgatgccgtcgagaaaatttttgatggaaattttaatgcatgtaatagaaaaaagggattttggtttgcaattgtgctagcgaaatggataaagaatgagatatattttttgagagattaaagtatttttgagcagttattgttccaattttacaactattttgccaacttttttggcattttcggtttttttgcttgtttttcattaattttacattttcgccaacttattagaggtattaattgctaattttatggatttgctttcttctgatcagtaggattttcaattaattttatattcttgccaatttatcagaggtaatttaatttctaaaaaatggtaaataatttttttagtgttttatggatttgctttcttctgatcagtaggattttcaattaattttatatttttgccaatttatcagaggtaatttaattgctaaaaaatggtaaataatttttttagtgttttatggatttgctttcttctgatcagtaggattttcaattaattttatatttttgccaatttatcagaggtaatttaattgctaaaaaatggtaaataatttttttagtgttttatggatttgctttcttttttaggtaaaacattggatgacttttgccgttatcaaggagataagaatcattgtttagacggagtcattccatgtttatacaaaaatgatgaatgcgtaccaaatcataaattagatggtgtgacaatctcaagcagtgtaagtaagcgggaaggggtcaatgttataattattcaggtgtggatttaaatttactaaaactagcggttgaatgcgccttcggcgcatcgcaaccgctaggaagtacggttgtgttgtaaaattatgaatgataaaaccgaaaatggctcggccgcttcgcggcctcgcacccttttggcattttcttatggcactaattttta

SEQ ID NO: 4941 - DNA, 4842 bp, Heterodera glycines
cgattatctcctaaatgaactttcattgaacaaactaaaaaaataaatgattaaaaaaattaatattttatttctgttcataaagcaaaattcgatacagaaagaatatgtcgggaagtgagcaagcgaaatgatattggtgaacagttgtgctgtaatatcagtgtacagaacaagaattcgcgtgtgaataaatgacttgggattagcaaaattataagcaaatgaaggaggccaacattaatcatccgtctttttgcttttttccccgttgggccctttcatttctctgagtcggtccattaaactctgaaatggtgaagagaagttacaatgaaataagtagaaattattgtctaaatttaagccattttgaattcaagtccttttttgctgtaggattccaaaaattgtttgtttttgtgtataattaagcgaaaatcataacaaattcaccttattctgttcctgcagtaaagcaaccttcaaaaaggtaataataaatgtgcttcgttttctgctctttattcagattttaacttactcgattttcgagtgccaacacataatccggccttttgcacttacattggcacggaatatcactgaaatagaaaagaattgttcaaaaataataaattttaattatttactgacagcgaatgtaacgacagagaccgttggagttgagtgatcgaatctgtgggaagttataaaattgttaattcattccgataaaaagtgtgtttcctaaccattttgcattgaaatagtggtcagtgcggcggtgttaagcacagcgaatagcggctgcgtattgccaagggaagcgggggtcatttgctggtgttgctgcggctgggtttgatggtggacaagcagttcagcctccaccaagctgttattcggacgcagctgttgttgtgttgctataaaagaaatgcttaaaatcatagttttattaaaaccagaccaatgggaggcatttgctgcgattggttcgacgacgaagcggccgattcagttggaaccgaacaaatggtcacattgctcacgtggtccgcttgttgcggtttgatcacctgaaaacggattaatctgtttgtattttttccattgggtgttcaaattgaagggctaaaccataagaaatcactctcacaaacagtgtcaaaactctaaagttgtaggtaaccttggctaacgccttctccaggtcggccagcgatagttgcccaaccgttgcgattgtcgtcggttgtccaccgccgaccgccactgccaaatgctgaaccgtaactgtcgcagcagaagcatcgccgttcagttgttcaatgccgtagttagcgccggaagaagtcgccgacgacgacgacggcgccgtcccttcgggcgcttcgcttaaccgctgctggaccaactgctgctgcaatacgcgttgctgttcatcgtcgcgcatttgtcgctggcgaaaatcgcggtcccgcttgaacgcttcgacctgggagaaacaaatggcaacgaattttaaaattatatgtaaaagttcaaaggagtacaacaattgcacactttgtccttgatgagtttggtgatgtgccttatgtcacagtcggggatcagttgttgttccaccatttgttgcacaatctttgttaggacaacttttgaccaatttattttgacatagaaaaccattcagtcactgacctcctcggacttgtccacttcgatgtcaaatgtgaactgaaggccttcgttctccttgaatttgtactgtgctcgcttccgttcatcgatcacgtataattgcatgtgaatcttaaaattggccaagtttattatagtggaataagtaattggaaaaattaagcaaatgaaaaaagggagtcagtcgaaaaatttaaaaatttttgtttagcgacgcagatacataaatttggcaatttcattcaattcatccacagaaatcaaagagggtgggcggcattcaacggcatcacctcactgctggcactgctcaaatcctggtctctgttctgaatgtccactcgaatgccaaattgttcctcctgaaagaatatcatgaaaaattgattaaaaaatggaagacggactggcatgaaaaactcgtcgttcaacaattgccgcacattcgatcggtcctctctcttcggccgaatgcatcgttcgattatctgttcagaattgggcaatcaaaacacagtcaaacaaaggagtggagtaacaacctctttgatctccgggttttgaatgcgttcaaaacaggcaggcttcactccctaaacagaagaaagggccgatcaattcgatcgactcgcttttgctgtctttgaatcgcttaccgaaatgacctttcgatagacttgggcggggtattggcactcgcttaactcattttgcaaagcgtgcaaataaagcatcaaaacaattacctgtatgggtattccccggttaccatttccaacaaacacatgccaaatgcataaactaaacatattaaatgtgttattgtatgctttacgcataactgaccgtccacgctttcgtcgtattgttcttcgtacatttcgggcgccatgaactcgggagtgccaattacactttttgcgtgcgatttgtttttgagggtggcaagacctgaaaaggattgtcagggcgtttaggtcacgttcgaaaccattcgaaattaatattttatttcagcattcctcgacctaccgagatcaccaattttaacacttccggttgtgccagtaatgaaaatgttgtcacatttcaagtcccgatggatgaccggcgtgggacgcgtgtgcaaaaaatagagaccctgaaacgaagaaatccttgcataagtcagaccattaaagcagctattaaaccaaatgacagggaatctaaatggcattatcacctttagaatttggcggcaccacgatttgagcacttttacattgattcgtttgaaacgcttcaaatacaacttgagcgtacccgaagtcatgagttctgaatggggcaaagcataagcaaagcaattgtaagcggagggaacactaaaaagactaatgcacaaatcgacctaaataatgggaaaaaatggaaaatatttgcccaatgaatgtaaaaggaaaggacagtttggaaattgtgtgcacaaacaacctgtaatgagcacgatgtatctgcaaattgcatttttgaatcgacggccccaaacaaaataaaatggaaagccaaccaacttttttttcccgtccgtccgttcccaatagtcgtaaaatttgacaatgttcggatgttggaggcccttcagcatttcggcttcctcccgaaaccgctggcgctccgctttgttcaacttttgttcctgcaattcacaccaagcgacagcaacacctgcagaaacgaatgaattgtggagtgatgtgatgccaatgtgaacaattgcatttgcctgtttcagtgtcaagaccccggtaaacagttttgaacgaaccgcgacccaattcctcatcaaatttcaaaaatcggttatctaaagaaacgatttgtggttgacctttgagccattccctcccgctaattaccaggcgatttgtcaatgggcttttcctcgtcatagtcctcgtcgtaatcctcagcggattctcgtcgtgattccgcctctttcttgacctcgtctagctctagcgatgtctgtggcttcaaagctgtcgctggtattggcacttcttcctccactttcgcttgtgcgctcgctgtccgactcaggcgccattcccgctgaacgacttcaagtcgggacttctcctccccagaaagccacgcgtgcgacgaatcccaagcgtgggaagagctgaaattcggatagaaaatatttgtttaaagtcattttaggggttttcacggtcggagaatccgaatcctgtatccattcgacccaatcgaacccaaattcgaacaaaaaagcaaaacttgcaatttttctatttttgcatttttggtctaaaaccggcttaaatgtaaggaaacaaaaagaaatcaataatgagattttacgaaatattgttgcctttgtgtcaactatatatttaaatttttgttttcaagttttgaagtttttcatgtaaaatttcatgttacgtaaaacacattgtagctaaaaataaacgttagattcgtgatcagcatcaaaaaattagcgtagaaaaaaaatttcaggggctggctaaacccggaagtaccccatttttcattttcacgcgcggtttcgttgacacgtcgaataactgtccgtctttttttttcattatccatttaaatagaaatttaacagagaagtcaagtcaaaataaggcctgtaaaaaatagaagggataggtgtctaataaaacatattttcataaaaataacaaaaagttacacaaaatagaacatggagcaaaaaacgaaaataatttttgtagatttatgaaagactcacttatgcttttatacttctttgggtttctttttatttagtaattactaattaggtagtgagcctaaaaaacttccgtccaattaatgccgccgtctttttggttccagcgtgttagtcgttactcggcagcggtaggcattttttccccttttaaatttaaatttggcattatgtatgttataataaaacaaataataaatgaaaacgatatgctgttcgacctttgataatgatgctctcactttttttattactactttttataaattacttaaattttatcaaatatgtgaaaataaatttctcgaaaatatgggacattaagtctagactct

SEQ ID NO: 4942 - DNA, 2694 bp, Heterodera glycines
ccgactcaggcgccattcccgctgaacggcttcaagtcgggacttctcctccccagaaagccacgcgtgcgacgaatcccaagcgtgggaagagctgaaattcggatggaaaatatttagtattcgctagctcatttcatgtttagtaaggtgagccaaaaaatcggtaatagtaaagtttacccccccccccgattttcaaaaaaaaatttgtttcgaaagtcatgaaaacacgttccaaaggttttcggggtcgctgatcacgaattaggtatttaaacaaaattttgacaaaaaatgctaaattcgaaaatttgactttttgttcgaattcggatccgggattggtcaaatggatgacgaattcgtggtcagcgacccggaaaaccattggaaacattttttctagacttatttttgatgctgatcatgcatttgatgtttaaagtcattttaggggttttcacggtcggagaatccgaatcctgtatccatttcgacccaatcgaacccaaattcgaacaaaaaagcaaaacttgcaatttttctatttttgcatttttggtctaaaaccggcttaaatgtaaggaaacaaaaagaaatcaataatgagattttacgaaatattgttgcctttgtgtcaactatatatttaaatttttgttttcaagttttgaagtttttcatgtaaaatttcatgttacgtaaaacacattgtagctaaaactaaacgttagattcgtgatcagcatcaaaaattagagtagaaaaaaatttcagggggtggctaaacccggaagtaccccatttttcactttcacctcgcggtttcgttgacgcgtcgaataactgtccgtctttttctggaatcgttgcttccgccgtgttttccactgccaccactgttcgaatagccatttctgaagggtgaaccgacgcgtccaccaccgtttctgctttgctgtttggagtttgaggaagaaaagttttcattatccatttcaatagaaatttaacagagaagtgaaaataaggcctgtaaaaaacagaaggtgtatgtgtcaaacaaattatacttttgtagaaataacaaaaaattacaaaattagaacatggaggtaaaaaccaaaatttaaaataattgttgaagatttcttaaagaaccatttatgcttttattcttctttgggtttatttaatttggtagtcagtaatcctaacaaaaaagcggtcccctcgatttccgtccaattaatgccgccgtctttttggctccagcagggtgttagccgtttcctcgttactcggcagcggtggtattttttcctttttttaaaattttaatttggcattatgtttaaataaaaaataaatcgggaggggtcggtttagtctggccggtttagtctggccgttttagtctggccgttttagtcagagggtcggtttagtctggccgttttagtcagggggtcgttttagtctggttagctgttttcacccacaaattaattactttttataaatttcttttgtttgtcaatcatatacataaacataactttaaaatgtctgtttagctacaaatcaaatggaaatctccaatcaggaaataaagacaaagcgaaacaagcagaagctggaacatgagggtgcactttatgttcttcaccaactcagtgacggaccgcaaaggtgaaaaaatcaattaaatttcactaatttccatattaagaattttgatatttgctcgttcttcgacttcggaatggactggtgttatgaaaaatgtgttcgcagatggcactttcagtttggcgccgcattttcagtcaaatttatattcttctagcaaagtaaaaccctatttttcacgttttttccatagaaagcttctacaggcttttgcttgttcatattcaactgtcttccgcttcttcaacacaattcgatgtgagcaaaagtcaattgatgcggacatctcacgatgcatcgctggtgaactccctcctgcaaaagcgccaaaatatcgtgccgctgatgcgagaattcttcgacttttgcagggctacaatgccatcaacaataaccctgctcaccaaaatgaccataattatcatgccaatgtcaatgttaatcccgataacatcaaccatttgctcgttggtatttctcgaaattatgaaatgcgcccgtaatttttcaatgctttgttttttttgttgttaacacattgataaacattttttgataataaattaaacatttctcgaaaaaatcagaatataacctatgtggcacaaaaacagcttgccagactaaaacgaccccctgactaaaacgtcccctcagactaaaccggccagactaaaacggccagactaaaacggccagactaaaccggccagactaaactgacccggtccgaaaataaatagtggaagtgcggaacccgtcaattcggccccagcacgtttcggacgccccagcggatttttcgcggaactaattggttatgaaaccctccctgggctatactacctaattaggaaccaaaattatcaaatttttttttacaaaaactgcaatttccctatttttaaattaataattcatttcattatgaattgttattatgttttttccttatttagaacagaaatatttgtgtgtatcatcatcatgccttcattg

SEQ ID NO: 4943 - DNA, 1354 bp, Heterodera glycines
  misc_feature (227)..(227): n is a, c, g, or t
ctgtgcagcagcattgtgtgtgggaaaagggaagaagtgagaaaaataaagaaggaaatagtgcactgtctgactgtctggttatgcttttgaaaaatttgtcccaaaagggggatacaaacccaattagtaccctgaagggctttcgaatgataccaacaatgtttgatttggatgacaaattaaaaagttataagctgaaaacccgcttggggctcgaaaaattnctggggcccgcgaaaactctggaggtccgtggaagtgatatgctgttcgaaggtgtttctgttgaaattttcaaataaaataaaatttggcattcttcctcccgccctttctaaattttaaattttttcggttcaatacagaagcctcgtttaactcatttttacatattttaaaattaagaatcagaaatttagaaaaccaacgcaagcattacgtaaaatgggaagaaagaacctaaaaacttcaaagtcacttcgacccttagaaaatatcaatgattcggttggaaaaataggggaagacttggaggacgaagaactcgaagaagcggacgacaacgaatcgcttgaagacgaaattggagcggaatcgggagaaggtccgtcccaacaattttaatcggatttaattattccaatgttttagaaccttttgaattagaatttgttgggtataaatcggcaacaaagtcggctaaatgtttgcttttggaagcattggaggacaacacaattgcaacttcgcgctttgttctcttcaagttttcggatggcataaattaaaaggaggcaagcgatccggtggtcaagtagttagtgtgccttcctttggtgctggcttcccatgagttaaagtcccatttcttctgattattttaaagcaaatattatattgaaattattctaatttttgttttttttaatttatttttttaattaattaactttatggtattttaaattaatgataatgattttttgaattaataaaataataaatatttttaattaatagaataataaagtctaaattaaatattaaaattaatcgaataaaaattaaaaataaacaaatattaataaatatttaaataatttataaatttcaaaatgagttaattttagggttagacgaatgtcgggtatttgggcaaaactcgggtcctggatatttccgggtccagaaaagccgggtccaagtttttaaaccgggtacgggaggaacagagagtggaagaggaacagaaagtggaagagaaagtggaagaggaacagaaagtggaagaggaacagaaagtggaagagaaacagaaagtggaagagacacagaacgtgaagagaaagtg

SEQ ID NO: 4944 - DNA, 5650 bp, Heterodera glycines
  misc_feature (34)..(34): n is a, c, g, or t
  misc_feature (5599)..(5599): n is a, c, g, or t
  misc_feature (5607)..(5607): n is a, c, g, or t
  misc_feature (5618)..(5618): n is a, c, g, or t
  misc_feature (5629)..(5630): n is a, c, g, or t
caaaaaaaaatttgcaaaacaaaagggtcccccncttttgaaaaaattttcaaaaaaacccacttttaatatagcgccaaatttttggtaataaatataattaaaaattcagttctataacgaagaattgtcttcgcctcagatgccaataaattaccaagtcatgaagcaggtgtcgcttaaaccgcttattaaaaaaaaaattttttttgaagggcaccgattacagtgttcacggatgcaaggcaaaggctgagagaaatccaatttaccgatggactgttgggaaaggagccatcaacaaatttgaatttgccggtcatgacaacagtctaatggcaactgctggacaggtcgtcaatcggaaaatgagcaaaactcggtatttaacttacggatttcttataggatgggtttttgcgagttttcaattggaagacgatggatttggttggctttttcaagtcctatttcggtggactcctctgtcttgcttggagtccggacaacctttacatcgcaaccggtggagaggatgacctgctcaccgtctattccctagctgaaagtgggtggcgttagcacagttttgaaaatttaaactttagatagggtcgtatgtcgtgggcaggcgcataagtcatggatttctgaagtttttcccttttgaaataaataaaaagcgaacctctaaaggtcgccttcgattgttatgcacccgaatttatgttggaacaaactcaaattttcgacgaaaaacgctgttgtccgcctttgaagggtgagggcacctgttcatcgtttgcaactaatgaaggttttttgtgtttaatttaagtgagcctttttggaaaaaacattgaatgaatccgattttttcaaaaggccaactttcattcagctccatagttgttttttttctaatccttcccattcctcaggaaacgcctttcaaaatgggcaccatttcccttctggccatgaagaaagtgtttcttctgccccgcaaattggccatttgccttttgctaattgcgacgacctccgcacgaccaacgcaaattcgcttcaattgcttcccaacggaaaagtaacgcacagaaacggctcatcggatgatgcaaatgacgtttctcactgtcagcctcagcttctctatagggttggcactgttggccacgactgtcaggcattgttttttgtttttgtctccaaatgttcgcatttcattggccatttttttagttgtgcctttgggacctttccgaagacattttggcttctccgcccctttcccaacatcacttcgacgaaatcaccgtttctccttcaccctcaaactttgcaaatgtttcccctcgaaataccacggtcattcccattggcttcgcaaatgcattgtccacaaccgaaactgatgtgagtcatcctttttaagcttaatttagaataggaaaaaggccggcttaaggtgagaacagctgacaaaccttctgacgcaaatagcaaaagcagcggacgcttcagaaaatttcataagcgtggcttcagtttcgggtcccgtttgacgggaaatgaacggtgtgttttcctatacaattttcaaatcttgaaatgttagaggtctgacaatgagcggtgagatggtttacaattgaactttacgaactttaagtgggaagcatatatgaattcggtatcaatggatagataaagtagagtcgacttctatgaattttcaattttacagacgcagaataaaaaaagtacttaaaaatctgaatttttaggcctaattttgaggggtattccagctttttcaattattgcctacttttgcattgcctatttttcatttaatttctgtaaattgaagaatgaaataccacattttttaaatagctattaatttttaatgaaattgtttaagaaaacagcacgggaattcttcgaacggggcaaattcgaatgaaagtacattgaaaagaggcgaaaattatgcacaatttctcggaactgtgcaatgtccacgactcgaagacgtgccaatgattgagcctttgatgtgcaaaaaggtcgttgtttttcgcttcgctgcaattggcgtgtccgttccgttcagattgcacacgaaagactcggcgctttgctcttccgcgaggattgcatcggttgtcaattttaatctagcggagttttattccaatttttgctgcttaagtgactgcttgtcaggagggaatcatttgcacttgggctcgaccgaatatattggcgagacaagtgagtgaggggggggggagaagccgacttttgcggtgattggcacgcgacaattgcaggaggccgggagccacgaccaaatcatgggacaggaccaaaactgtgacgccgtttcccgggaaaactgcgatgggacgtgcgtttgacagacatgtgaagcaagcaaattccactccgggtactgttattgagtcaattcattcatacaattaaattgtccctcgtcattttccactccaatcatttttttaacttttataatttataaattactgaaacaaatacaatggcactttgttgatgagatcatttgaaattttgtgcattttgaggtatttgttattgtaattccgttaattgcttgggtaagcgtcgtcaataatgcacaaaatttgagaaatgtacaaatgtggggggggggcattggcattggcacttctcactctgttccctgccatttgtcaatttcctagaccttttcgtttttctgctgctttcctttgttttctatgcattcactttgctctttccttcctttattttcaccgcaatttgccattatttcagccaaagaaagcattttgcaggcgtcttcataagttggcaaagggggcacttcgcgagtcagaggactggcgtagcagagacccttttcatcgaactgaatttgagggatcgtatttaaggcattcagacaaaaagggagtccaaccttaagacagtacggcttatccgggccgaagggctctcgtatccgtgtcaatcctgaagatttatgataaacatattcatcaatgaaattgagaggagaaattggggaaacccctccccccccccactcgaaggtacaaaaagtggggaacaccaaaagatacgcgattgggaaaccacccctccccttccccataattctttcaaatttctcaaatgataatgaaaaggcaacggacggggaacccctctccaatttgctaattatttcatcatcatttaaaattttgcaaaagcatggaaaagggaaaaagtcaggaaactgaacgggcccaggcctgataagcaatataaactaaaggaagccaatgggtaaaacacggggataatttgtttcaatagaatgaaaaactcacggctaatggatgcgtcttccatcgacgcgacccgtctctgttgcgtgctgatggagcgacgagtgcggaagaggcaagtgcacgctgagatggtgcagacggagccgaacaatgtgctgaaaatgaagaattgacacagcagacgagccgaggcatcggacgaagtgttggaaggagcggaagttgtggaagtgaagagggaagcggaggacgacagtggcggcgcatttcccccggagggcactaaagcaaaaaaggaattgcgagactgcattctccgacaaagctttaccttctctctttgcttcgttctcattcaacgccgtttttaacctctgaattctctgagtcgattgatgttcacgcggcaaatgcacgaggtcggcggaacccatcaaagggacagtgccgaccgaagagagcgaaaggaggaaaatgaaaagcaaaggaaaagcgaggggagggcagggaaaagccatcggaaaggagtgatgtgacagttcactgaaatgatgttaaaatggtcaatgaggtgaaaatctgctgctgataaaaagcaccactgacaaatgagtgggggggaagtctttgatcggtgggacctcccgccccaaaagggaaaacggagggggcgggggttccccgggagaagtcccttcacagggaagaaagacaaatgtcattgatgacagttgacagcacactgctgctggaggggggggggggggcaaaccgaggagtggtgtccttaactttattcctaaacccaacgattgatggagaaggtgtggccataataacaattaataaaatgagatggaacaaccaaagggagcaatgagaaaatgacgaattgttagttggcactgatcaaaagaccgagaaaagggattcttatgtccaaaacaacggtcgctcattaaattgctcgacgtgtccgatcataacaaataatgaatttaattgactcgtaaataactctttctctctctctgcttactcactgctctttggcagtgtcccctctcccctcggctccgccttttccctccgtttccctcactaactgaaaatcgttgtactaatctccccaatttcaactgatggccattcattcattcccccattttatcccaaaataataacagcgatatcattcattccgttttggtgtcacatggtatttaaccttcattttcattgccaaccgccccatcccttctgtgagcagtgaaaacctaacagtcaatgattgacagtaaatgttaacgttaagaaacggtgggaactcatctttcatcagtcaattggggcggggggggggcaaaaagaggcaaacaccgcaaatatgtgcagggacagtaaacaccgagtaaagcgatggcggagattggaaagggggatgaggacagagtctataaatgggagggacagagtcagaaattcgaggaagtggtaaatcagaaacagcaaaacgcatttaagattgaatttgagccttgtgagattgtcaccagtcgccaccgattataaacggtaattttctgcactttgtgtaaagcgttttatatttccggtaaacgactgttgagcaaaaactaaactcaaaattggctgttgcttttttgtcaactgtaacaactctttcccttccctttctcttcattttgtttttgtttgtttccttttctcatcagtggccggtcgattaggacggtaaagtgatgcaaaagaaaagaactttttatgaggaaatggggggagggaggggaggtggcgatcagtctgtgtaaagtgaaagaaatttggaattggagaattgtgggcgatggattaatttgggtgcagcaggcggaagggaaatgcgcaaaaaatggggaaaggaaatgaattcattttgggcacgagagttttaaacggtattgtcgcagaaggaacggcaaaattttgtgattttgtctaacatttaaaatttatttttaataaaaaaaatatttacaaaaacaattgacaaataaccgaaacaaaatgaataagcgaaaagtgcaacattggcctgaaataaatgacatacaaacgaccgacggaggacgccgaccttaacaaataaacaaggcaataaaagggaggcgacagagtcaccttctttaatagcaaatggtgaaccgttcccgggagaatttcatttntttggggntcgtccatcgnactttttgtgnngtgaccaaacgtctttcatg

SEQ ID NO: 4945 - DNA, 4319 bp, Heterodera glycines
  misc_feature (4284)..(4284): n is a, c, g, or t
ttttctccgtaattcactttttgaaagggcaaatgacgtggactgttgccgaatccgtaaacacctcaaaaataggggcagtaaaacttaaaacacgggtgaaagtcgaaaccatgaggccaaactgtgcgtccctcctccgttttggaagggaagcgattggacaatgaaaaaatggcggaaggaccgacggaaaggaggctaaagagaaggatgggaagagcggaagaaggagcgacctgtccacgagaagcaattggaagccattcaactgttgctgttttttggcaatttcggtaagaaattcggcgggcggaaaagtgccgttgagaaaatctttgacgaaagcccctaagggacaaagggaaatcgtagcaacaaaaagcagcgccacacctcggctcggggcattttttttcaaggtgtgcggaggttcggtcactgagaggagcactccgacgcgtcccttccggtcgatgcccagccacgtgccgtgctcttccgcctgctcgtcccagcctaaaaacaatcggccgaaacattggtcaaaccgtccgatttggccatcccccccctccaatttgtcaaatgcattccctcacatgccaaaatgccatctctccagcaaagttccgaagtgacgcggtccaattcttaacaaacaacaattaaaaaatacgtttttcttaatcatttggcatttcaatgggtccgccgttggcactgactttcgtctctgttgtttagcaaaatcattttgtatttccctccaaatgattgtccctttaaaccatcggccaaagctaagaaagtcacacacattctgaagaagaaaaggggaaaatggagagaaatgtgaaggtacataaaagcacaaataaaagtaaggaaaggaaatcagtggacgaaaaacattttaacatttaatgaccgaaagtgataaacgaaaaaataaatacaaatcattgcttcacatgttcagaatcaaaaaagaaacaacaaaaagagagaggagagagagagggtttatgtaagaaagaacatcaaaataaggaaagaaagataaagcattccatcagctcaccaattgaataagccccttttgattgagattcaaaattgagtccgcgatcactttggctgatcgatttgtgtaccctccgctggtgaccattgtaatgggcaccctccgacggatcgcagcaccaaaaacgatttcgtcacgacgaaaaatggccttagaaaggaagaaaacaatgataacggatgagaaaataataaaaagatataatgaaaaggtgcccggatttcggggtgcaccccaaatttcgccgccgaaatttctttaaaaattttcagacttatttagcctagaacatgacactgattttggcaatgaaacgaatgaaaagagaaacaacaccttgggggagagactgaggccacccaaagggtcgccgatcagagaatcggtgccggcgacgaaaaggaggaagtcgggaacagagaaatcggcaaaggcggcgtccaattccatttcgagtcgacggaggtaaaaatcatcctcagcgccaaaagggagcggaacagcgcgcgaaacggactctgagaaaagggaggggtgaaaagggacggacaaacggaaaaagggcgaactcagtgcatcggagtcaccggggtaaatggacgcgttgaaaaggtcgaggatatacacgcgactgtcagaggcaaaatcagtctcatggccatttcccttaagggagggaaaaggcaaatttaagggacggaaagggaaggcacctgatgagcatcaacatcaactgaaaaaaatatatatgtgaacattaagaactttaaatgaatcgacaaatgttgggtttcaaattgtgaacaaattcccatggtgggattaaattgtgagcgaaaccaaaaaataaataatttttgagtttcattattttgaaaaacaggggaatatcaaaatttgactatcattatttctcaaataaaaataatttcaaaaaaccaaccaaccgatcattgcacttttgatcaattcattagcgaacaaaagtttaattgccaaagtgacgtcagcataaacgcaaaatccgccgccttttccctctgcgaaaaaacattttacattagttaagagaaagtggcacaatgccataacataagtacactttcttgtccaatgcatctcgccgcttctcaaatttctcacctgaggcgtggtgaaagccgccaccgatgttaatggcccagcccctaattaggctgactctcgcggctaacaccgttcctcccgtttgaattctgttgaggaaagcagtcgctgtatcagaggaaaaaagggccaaaaaaagagacacaccgcattggacgaaggatgcgacggtcgattaggcaaatgggaaaaaggaggacgaggcccacttccaaaatgcgagtcaaagtgaagcggccattcagcgagcgaaggtattttttggagtggaccagcaaaagatgctcctttttggcttcgattggtcggaggacggcactttcgacgagggcaccacttgctggaaaatgggagaaagtctaaactgaaaatgaaacaagtcgatttggggcccgacacttaaaggattaaggagggtattattgcctatcaaaaagcggaagacattgccccatttattggagtcgaaggggtgacacttctcaatgccgaaaaaggagatgttgtaatcctcggaataaacaattggacatcgttcgtcccagtcgatttcggcctcagaatcatccaaaaaagcaaaagcggaaagagcagcggaagcgcacatcggcaatgagatcagcaggtgaaaagccgaaatgaaagcaatcaaaaccagactcgtgagttgtttatttcgatattttgtacgcatatttacgaagacaaatgatgattggcaatagtctcacaatcatttgtaaaagcgctaatatataatttattgagtaacaattaataaatgtataaaagtggaagtgaccttaagttataactccaattggtaaacaattaaatttaaaggcagaaactcgggaagttgtcgaatccatcataagtcatacgttccatcattttgtcttctttgagtcggctttttttacatttggcgatttcttttcgtccgataaaacttccttttggccatttgctgaaacttatcattcaatcccgttatgttctcttatggctgggtttaccgacctttctcagcgctttcttttgcatttttcttggcactttgttgctccttccttcgctcggcttccttcttcttaagcgccccagttgggaacacatagtcaataatgcacacgatgatctgtaaacggggcaaattagtgttaatttgttctcgaattaaaaacgaaaattaaattagcaattcgcaaaatgctcacaaatccgaggacacagcccaacgcgagagtcactgtggcaaagaatgcatacgaagcccaagcgggaacaccgacattttcgacaactgaaaaaccattgcatcaaaaggtattcattcaaacatcagcccacaatgtccgtgtaagtctctgactgccatggacagtttgaagaagacggcgactacgcccatttgagagctgtccggatgtttgtaggacgggagggggtcgatgctggtccatcgtttgtcttcgatgaaagagatctaaatgcaatgttaacgaagtcgtatacgaatagccattacgaaatcatttttgtcgcgtggtcccgcgtaaagtcgaaatacgccatccttcacgctaaaagaagaaatattacttgaaccggcaaatgaattttaactgataaatggtgggcagagcagtgacaagaaatcgtccagaaagccctggattcgtggtcacgtctatttccgcaacatttatgttcaaatcccttgaccaatcagcgaatgaattccatgactgaatgatgggaaatgtaataaatcaaagtactaaaaaaatgcaacactttttggaggtctttgcaggcagggcaccacggcgcgtgacttaatttcaacgaatttcataaaaaacgcaaaaaacagacaattccatcatccattcgccgctgagaatgtttcgccaattttcctcatttagattcaaaagattcttcgattttactgcacaaaggacaaattcagtgcaaataaaaatggaaagtaaaaacagcggtgaccttgccatttaacctataaataaacgaatttaatgaancaagcgtttattgttgagtggacggatggtttaaa

SEQ ID NO: 4946 - DNA, 1175 bp, Heterodera glycines
gggaaggggaaacagcgatcaaagcgaggaaatgggtcacaagcaaacgaaaatggctgaacagaagacaattcataatttacttcgcagaagtggccaaaaagggagcccatattccgttttacaaattcaattgttaaaattcgaatttatttccaaaataaaaatcaactgatgctaaaggcatgaacaaatgcaaaaaaatcatccttgtgaacaactttcgtcaagttcgcatcgatttttcgttcatttgctaaaagaattggtggatgcgaacaatcatcccatccgtgatgataaatgcacgcgtcactcgccgccaattcctgttttcgcgagactgccatattcagcacggataaaccggctaacaaagcgagatgaaaagccaataacacaaacaaaaacttcagtagaactgtgagcaaacagagaatggaacggttgaagccatgtgtgttggacagaatgcaaagttcattgtagctcataacgccattttgctgggccatttcgctggcaacgaacccttctaatctcgccaaaactttttcaaaatcttcggattgaattgaaacatcccaacgctgtaaaaaaaaacaaaataaaatattcagtcatttcacaaattaattttcaataaaaacttactaaagaagtgagcaggcgaatttccaactcgtttagtttgggtaatgcaaggcccgaaactgatgcctggaacagaagaaaataaataaataaatagaaccattaaaaaggactaatttatcaaatttagcattaagtatttaagagaatttacaatttgcaaattcatccaattaacaaggaaatatgcttaggattttagacgaaaacctattcaaaattattagttttgcctgacgtcaaatttaacattatcataaaaaaacaagaatatataacaagtggaattgaaacataaataataattaaggaaagagaacaagcactgaattcaatgttagtgaaccaatcagaacctatggtaaatgagttaaggcgaatcctacccattcgtcgttccaaacaaattcctgcaaagtgccatcgttaaggtatttggttgccaacaccaacgaagaaacgaagagttcagttggattgaaggcgagaaatctctttcgtttgattcttttagccgcata

SEQ ID NO: 4947 - DNA, 3358 bp, Heterodera glycines
aaaaaagggttaaaaaagagtacaaaattcctcccctccatcaaattttgaaatttaaatttttacaattagttgaatttcaaataatttaattttttttttaatgttgaagattaaattgaataatttttaattcagtttcaaaatagggctgcaaccccgacgtcggggttggaagcgtcggagttcggggtcgggattaaccccgaaaatgcccaaaaatgtcggagttcggggtcggggttgcaaccctatttcaaaatttcagaaaggcaataatataatgatttcttttcaaatattttgtagcgccctttttcagaaaaaaatttctgtgaaagtaggaggcacacgcgtgccagcaatcaatccctccccctcccctcccctcgccctttccgcaaatggacagtgctggcataagcgacagagaaggggctgcagaaggtggcacggatgaattgccggcacaaaattttcaccaatttaccaccgccgcggcgacggcggcggtgggtgacggaaatggcacggggggtcactcgccgtcactgacggcggacacggaggaggacaactgcggcggggccgggtatggcgccgggcaatgcgcgcccgcggcgtcgtcatcgtcccccgccggggagcaaagacgtccattccattcgtatcgttcaccggtgccattgaaggcaaatgccaacagcaaaagccatcaacaaccgccggtgggaggcgtaagtacggcacaacaccacgcggaacaaccgtcgaaaatgcctttgatgttggacaaatacgagaaaattggcaaaatcggcgaggggtcgtacggcgtcgtgttcaaatgcaggaatagggacacaggcgaagtacgtcccgcttctgctgattggcacgaaaaaataaaaatttaaaattcagttggtggctatcaaaaagtttttcgaatccgaagacgacccggcgattaggaaaatcgccctccgagagattcgaatgcttcgggtcagttcgggtcggacaagggtttaatggtgaagcgaggacacatttaaaataccaattcaaatatttaacggtaattttctccagttttatgtggaagagtttaaactttcaatttgaaaatttgcttaaaaattttaaaattcccaatgcctttaagcaactgaaacatccaaatctggtgaatctgattgaagtgttcaagcggaacagaaagcttcacctcgtctttgagcattgcgaccgcaccgttttggacgacttggagagatttcccagtgggtcggtcggttttggtgccattaaatttgcaaatcgtccaaaatgtcagttgtcccgagtcactcaccaaacggctgatttttcaattgttttccgccattcgcttctgccattcgaggaattgcattcacagtcagttcagtccctttttggccaaaggcgaaagccccggccgatttaatttgggggggggagaagccacggagggaggcgaaaggcaaatccaaaaaaaggaaaagcggcgaattaatcgcgccacatggagaagcacgaacacagaaaaagagaccatactgataggtcataggcttaaacattttcaagctgaagaaaattaaaaagttcctttttccattaatcaaaaaataattttgtgttttgggcgtaaaatgttcaattaaccaacggcaaacgaatgaccctttgccaattgcttaaataatctaattattggtgttcaattgttcaggggacataaaacccgagaacattttgctcacctccaacgacgtcgttaagctgggcgactttggatttgcgaggataatgagtgggttactgtggttttaagttatttaatcaaaatgaatttatattctattacaaatgttgcaattacttaattaccgccccccccccctcaattagcgcaggtgttaatgaaatatacaccgattatgtggccactcgatggtaccgtgcccccgaactgctcgtcggcgacacgcactacggttccccagtggacatttgggcggtcggctgcgtttttgccgaaatgctcaccggagagccaatttggccgggaaggttagccgcgctgagttggtccaacatttaaagaatccaaaaaccaatggccgttttccaatcccatttcagatcagacgttgatcagctttacctaatcattcgaacaatgggtaaagcagcaataacaacagcagcaatgctttcataattaacagtttaattgacaattatttttcattttctcggaatgcttttcgtatgttttgcttaaggtaaaatcacttcccagcaaatgaaaatcttccacaacaacgcctatttccgcggcatttctatccccgagccggaggaacacatcggactgctgcagagattggcacagacggcgaaccccgcggtgagcgtcgattttgcagcgatggatttgctgaaggtggcggcgtaaatgggggagggcacccggtgctatgtcgttacttaaagaaccatcattatgatttgatgaaaaattatttattagctgaaaagtaaccgaatttttatttcttgatatgattcgatagccctaagtgttctctatcagtctacaaaatttcaaaaaatttcatcaagtttcaaaagagttagggccaaagatgctcgaagatcaaggttttttgagttcctctagccataactttttttaaacttaacgaaattttttgaaattttgtagacttatagagaacactaagggctatcgagtgatatcaagaattaaaaattcagttgcctttcagctaagttataaataatttttcattaaatcataatgatggtttttcaagtaacgactcagccccagggcacccattaattttaaaaatgaatttggcatttttaattagcgatgcgtcgaaatggaccccaaaatgcgatggagtgccgaggagctgttggaccacgagtattttagaagcagcgcactgatcagcagaatggccccctcaaagcagaacaatcaccaacaaatgagcaacggcaaattccaactgccccaattgggtgcgctggggttggcattctgtcccgtaccccgtgaaatgccgtatttttgtcagtctgtatcgtttcggcgccagggtcgtttcggcgtcaagccaaaaaaatcatgaatcagtgggaaatttttgagcgatttaaatttcaaaaattaaaaattttagcaaaatgtagaataacaataaactaacaaaaaaaaatctaacaaaaattcatttgtttaccgtatttactcgattgagaacccctacccgctctacaattagaagccccc

SEQ ID NO: 4948 - DNA, 1640 bp, Heterodera glycines
tcttttgcatattgtaacaaattttgtcccctttccaatggccttgctaaaattttccaaaaaaaatttcctaaccccctaggaatttttttctaaaattttcctgattttcagtgtattttagggtgtcccgatcactatgaaggagtgatctgatcaagttgctgtaaaagacttttttgatcagcatcaaaagttagaacggcaggaattttttcagaatttttggcccacaaaatattgacgtattcattgataaagtgaatcgtgttaaacatatgaccgaccacccaaaattaggggtggttgcactttgtctgctcgcatatcggccaaagaggattaattgacatatttttggtaccaatcgaaagcccattgaataagctatcgattggtataacgcatatgacatttggtcttagtaaaaaaaattatggttaaatttataaaaaaattttggggtgtgttaaacatatgaccatgactgtatgtacatatttttatgcatattttagactttttcgtacatacatatttcgcaatttttttttttacatatttagggggtttttgagaatttaaagaatttttgtgaaaatgtaccccaaaattttgactaccgtatgcatatacggtattaatttacatatttcgcgatttttcttacataaaaaaggaagccctgtaataattaaatagcagagctcggtattttcaaattatttaatttaacgctatttttttaagaaaaaaagaattgataaaacattgaaacctaaactaaaaatgcatcttcccgtttttgagaaaaaaatttacaggaacggaaaaacgaaaatgaacggggcgagattcccgtgtttcccccgttcccgccggactcttaaattatttcataaatctttggcataatgtctaaatattcaaaaaatgcagtacgagtccgcgggagcagcgcaaaaaatcaaattttaggaccccgctgcggaattggaactcaaaatttttgctggacaggatcacgcgggattaatcccgcaaagtcacctaaatcagcaattgatttaccctgaaattttaataattttaattctttcagcttttctttgtatttttctgtttttcattgtccaccagttcagtttgtggtgatgatgcagcaaggagggcacaaatattccatccaaatgaaaattgagcgaggcattcactttgtttattaaaaataccagttaatgtatcattcaaatttgcttccgtttcacttttccaggtctccaatcccaaaatttggccgatgtcttaacaaccataacggactgtgctcggttcattcgcgagtaccctttccccggctttgttcacaacgttttgtttaaattggctcaggtaattccatcacttttcgtttacccattttttccgcttgttatttaggccttccaaggcgaattgttcgggcgcaaattcgagcagtctctgaacgccattcggctgcgcattgtcaccgccatccgcgagtgcagcggcgtcaatttgggcgtcacaattccgtcggaggacatcgtccgctgcattatgaaagtgtcccattccaacgattacaaagcgcgttcgatgactctgctttttttcgc

SEQ ID NO: 4949 - DNA, 1767 bp, Heterodera glycines
ccttttccgttttggttctgcgcaaaattgccgaactgtttggctccaatagccttacccattgggtcagggccgaactgatggccgtcgtggccaacctcagggacctttcgctgacaaaacaatgtcttgaactcgaagtggcactcctcgacacatccgactacaaactgcgccccgtcatttacgagtaataacaaacatttggacggttgttgcattaactttcaaagtaggcaagtgtaattccaaataccgtatatttcgaatgcgaacccaagttcgaataaattgaattgtcttatagagagtaattggaaaatatgtcatccctctgctaaagtgcccacatttttcctttatattttcagttgtctaacgcaattggcgtcccgaggggagcaaaatgtagcggatcaagtaatatttttcaataattatgatgattcggactgattgaaacaaattttaactggaattcaatccaaagttcaaaaatgaaagtattaatttacagtgcaaagattcggtttttagaatggaaagtaacagacgtcctttaatttgttttccatttttttgcagatttccattctgttgcgtggccttgccaaggctatttcccaagaggataagccgttgctccgttgcgttttgctgaatttgtccaaattgtccgcctttccctcccattggagcacagaacacattttggtattcgttgccattttcccaacttttcatccatttcctccattttttggactctccgtgacttttacgtccaaattgaatttctcaactcaaacgccgtcctttgcgcgtggcttcaatgcctcgaggttctgtccacctccgaaaagcacaacagacttttgatcggtattctccttggttttccctttgtgtttttttattttatcaatttgcccaaactttcagaaaatcaccggtggatttctctgctgaacgatgccaactttgtgcttcgtatccatgccatcaatttgggtttgttttccctcccccgtttctttcccaatttaacttgtcctttttagcgctgaatttggtccaacagagtgccacggcaaattcactctttgggtcgtccattttcgatgcaattgtcagtgagttgtgcataaacacaaccaacacaaaacaaatccttagcgtagaaacactccgcgagtcgtcgcattcttttgttgtcaattcgccgccaactccgttctccaatccgaaactcagtcaaagggtcagaaatgtcaccaaaacgaaaacactagcgaaattaaataagagccaaggaaaatttgtcatattttcatggacatttttattcatttgcattttacattatgagttagaaccgttaaatttttaaaatgttttcccctggccctgtgtaacaaagcgatgtttcgtcttacaattagattttccttttttgtttttcagttttttgcgcttgtctccaagtttgtccgtggttcgacttgtaccgctcggctggcaaaatgtctcaacgaaactttattgccttccgccgatgagccggcgattctctccctttgctcctccaaatttccgttggaactgttggcggtcatttgcgacaaatattggacagagtgccgtacttttggttggtgttggcactttcattccctttcctttttggactttttcaagatttgtctcccctcgtcaattgctttctcttccgcccctccccccgcttttgcccaattttcccctcca

SEQ ID NO: 4950 - DNA, 2544 bp, Heterodera glycines
  misc_feature (53)..(53): n is a, c, g, or t
gctgatcgatcgcatcgacgagtccttcccgcaaatggaccattggaccgttnatcagatggcccgctccgcactccgttacggccattggcgtcacttggcactgccgttgctgcaacggattcgaacaaaagtgcaataatttaatgaggggggagggtattgttggcaatgccttctctttccatttgccagtgttttgctaattgtgcgtttctccccttcagacggaaaatttggagacaaagtcatggctaatggcgctcgcttatgtggccgactcgcagcccaccgtcttttccgtggaagaattgcaacggtccgagacacttttgcagagggcggcactctatttgaaggtgcaattatttctgaatggcattataaatcattacattagattgtaaattatgcattttaatcccttcgtttttcgcttattggtaggctttggtcccttcggaaaaggaccaacccttttggttcgccgccgattacgtctcttcgctgcttgcttcactgaagtgcgtccgttttcttttgtcctccatcgaaatggaactgttcaccgacaatgaaatggaagagagcggaagagcaccgttcattttggaagaggtcggaagcaagggccaaattggtattgggggacaagggactgggccaatttcacacggggattttcccgatgtatacagtttaaatctaaactattttgacgtttattttccatttcaattatagtaatttttttttttgaagttgaccgaagtgcacaaaaagcttggcgaagtgcgacagcaatgggtgacactgtgcagcaaatcattcgacgccgacacacaaacgctgctccaaatggctctactgattcgaatttgtctgctgttggaacagtacttggactttctgatcgctcccaaaaaggagcgtccgatgtacagaaaatattccaatggaattcaaaaaatttttcttttttttgcccttttaggcttaacgaaatccgaattgaggatttgggggaaagcacgcagaactgcattccgagtttccagaccagaaaccttttcgcgctgatctgttggctgcggggggaactgctggcatttcacaccgacatggcaaagcaacgcgaactcaaaaccgtagggacatattttacggcacttgtgcactttgccatcccccctcccaataaaaaaaatttaattttaataaatgatgacttatttttcgagaaaatattttaaaaagttaattacaatttttgaaaattttttttctgtcattttttagtgtcttgacaatctgcgcaatttgctgaggcaattggtcgattttcccctcggattgcctcgctttttcttccaaagggtgcaatttacgaaaataaaagtgagtggaaatgaattccttcggcttcatttttttctccatttttcgttgatcatttcgccccaaccgtcggacggacgcggcgtttaccgcgtgtcatcgatggaccttttgccggtgatcattgagggggtcatcgaatcgaacaacaaaaagcccatcgaaagtgtttgcgttgtgctcactttgcgcagggacaacacggcacgtcacaaaattaacaataatgagggaaatgccatggccaacgaataattatttaggcacccaccgaaaagcgacaaaacattcaattggagcagggcgacaactatttcaaggcacaatttctgctcaaaattgtgcatcaggtggagaagaaacgaaatcatttttaattaagcattttattaattaatgtaaattaatttttgatagggaaaagttccattgaattaattatcagaaaaattaaaatctaatttgacaaattggattttcaaatataaaaatatatcaattgtttatgatttctttggaacatttttaaattcggaatgtactcagtttttgagaaaattaacttttctttttgtagaaggccaccaaaataagcgcaaaggtttattttgtggattcggtcaccaaaaagcaatggtgcgacgagtcggacacggccacactgacggtggaacttgcggacggaacgcattgaaaacgatgatgatgaccaattagtttccattgtcctccgctgaattttgtcatttttcaaaatattttttaatttattttgttaaattttgatcacaattttgaaacgactctctttaaagttgcggcggattagacaaaaaaaaaactttcaaatcacataaaaatcccgtcagtttttttcgattactttttaaaattaacaaattccttcgtttgttttgttgatgccgaaaatagactttggaaagaccgtcgtggtccatcggcggagtgatcgatgcccggcaccgccggccacccgtcgcccggtggggtttttactcgccaacctcaatgccccccctccccccggcatcgtttcgccaatgccaatgattttctgccagccgaccctcccccccccccctcgcatggtcatcccctattctccccttgtgcaacccctcgaga

SEQ ID NO: 4951 - DNA, 6337 bp, Heterodera glycines
tgttgtgtccgagcaacagttaaagggaatattgatttattccaaataaataaagaacagaaaattgggaggtcaaaggacaaataataaatgcagataaattaaatgacaaatgaatggtggaaaaagcaaaggaaggggaaataattccatatttatgggcagtaaaatgggcgggaaatgtgggcatttaaaattcaaaatatccacttaaacactacaattccttcccccttctttgagcggaatgcgcctcacgaggggtcaaaaattacccttttcttccgatcgcgagttgatcggcgcaatgcctgatcaggcacacctccctcaggcgcaattttctgccgaatttcttggcgtggactcccaatcggaattggttgcggttgttgttcgtcgtccgattccgcatctgcctcactttccgattcggactcctgatcacgattgtcagctgtcgaagtcaaatcagctttgagctgatcaaaatgccggcaccaaactccacgggcggtctttacacggaacattgctgctccaatcttttctaagattcgtccctgtatccattttggcccaccatggtaatttcgcgcaaaaatcggctgtccattttcaaaattcttcgctttaccagcctttttatcataattccttttcattctttcgccgcttttactttttgccatttcgggttgattcccctgtgggtttggttggactaaatccaataatgtcctcaatcgccggttgaaaagcatttctgcgggcgaaacttctgttgatgcatgcggcgtgactcggtattgcaaaagaaattgcgaaactgccaaatccaaaccaatggaatcgcccatcatgtgccgaagtccatttttaaaagtctggacgaagcgctcagccaatccgttgcttttcgggtggtatggcggcgtcagtgtgtgttcaattccgcgtgatcggcagtagttctcaaattcagccgaggcgaattgtcgtccattgtcggtgacaatttgttgaggcaatccgtgtgtgccaaaaacaattcgaatggcctctatcgttgcattggccgtgatgttcttcattttgatcacttcaggccattttgatttggcgtcgacgatgatcagccacatgtgtcccatgaaaggaccacaaaaatccatgtgaagtcgctgccaaactctgtcaggcgtttcccacggatgcaatggaaccttcctctcctcgggtgcatcagattggcaatttctgcacctctttcgttccatttcgatgtccttgtcaattcctggccaccaaattttctgtcgagccaatgctttcatccgaacaattccagaatgggtggcatgcaaaagttctaacatttttccgtgaaattttctcggaataactgttcggtttcccaacatgatgcatccatttaccaattccaaactgtttttgttcggctcgaatggcttcagctgatcactttcgacctttttcggccatcctatttcaatgaattctttgaccttcttcaaaatttggtcttttgctgtttcactggcaatcgattttgcggtgacaggcagcgagtcgatgttttccaattgtacggctctcacttctgcactgtccaaatcaatttttgctatctccggacatggaagtcgcgatagaccatcggcatttccaaattcttttgttggacaatattcgatgtcaaagtcgaagttcattaaaatgagtgaccaccggtgcagccttctcgccgccaccacgggtatttcactttttggcccaaaaatctttttcaacggttcgtgatccgtctgtagcacgaattttcggccatacaaaaattgtttaaacttttcgactccaaaaataattccgcggccttctttttcaatttgcgaatagtttcgctccgccgcattcaatgtccgtgatgcataggcgatgatgacgccttcctttccattttgttgacttttatggaaaagaacggcaccaacgccataatcagacgcatccgttgccaagtataatggctggccgggatcataatgaacgagcacttcggttatgacaaaatttctttaatcctttgaaatgctttctgctgttcacttccccaatgccacttttcttccattctccgcaattggtttaatggctcggaaacggtagccattgcgggcacgaatttgccataataattaaccatacccaaaaaggattgaagctcctttaaattttggggcggtggcattttgcgaattgcttccagcttttcctctgaagcatggactccgtttttgtccactcggtgtcccaaatattctatgctttcacgcataaattcgcatttgtcccgtttaactctcaatccatttgccttgagccgctcaagcacctgcgtaattcggcaaagatgttctgcctgtgttggtgctgtgatcagtatatcgtcgagatacactgccactccttcaattccttgcaaaatttcgtccatgacctgctggaaaatcgccggtgctgacgctacgccaaaagggagtctcgtaaattggaacaatcctttgtgcgtgcatactgccaaacacttttttgcttcatcatccaacatcagctgcagataggcgtctttcaaatccacttttgaaaatttctgaccgccatttagcacactgaataggtcgtccggtcttggtagtggatattggtgcacgtccaaccattggttgacggtcactttgtaatcacagcagagccgaatttttccgttcggttttggtacaatgaccaaaggtgtggcccaatcactgttgttcgtcggctccagcactccctgctgtacccactgatccaaaatcttctccacttcggctttgagcgcaaatggtacaggacgagccttacaccttttcggttgcactccaggcttgaatttcaatgaaatttgacgagtgcatcggcccaattcgtctcgaaatacttcttgaaatttttcgagaattttgtccacctctttctgatcattattcgtggatccgatttggattgcgttaatgccgaatgctttgttcaaatcaatgcgcagtccgcgaatcaaatcacgaccgcacaaattcctcttatttcctttaaccacataaatatccgtgttgatttgcatgccattgtattccacatttacattggccatgccgaggacgcctttgatcggaatgcccccataagccagtagtccttgactttccttcaattcgggctttccaatatggctccaatcttggctaccgatgattgttacatctgcaccactgtccaattcgaattcggcatttcctttatgcactttgagttggatgaagctcggcggaacagtctcagttttagccgactctcgctccaaactcgaaattactggtggcttctcatcgcactgcagctgaatttgcttcacgcgattgctgcttttccatagccgactttccactctggccgggtttttgttgcctccatttgtcctgcatacaatcgcccaatgtccgactctcccgcatttggtgcatttgtcggctttgccgggacagatattagcccaatgtccgcttcttccacaacggtagcatggcttactgtcggcacttttgctattgttggttcctttggcgcgatcatatcctcctcctcttcctgaaattttggccacattgcctttcaatgatttcaatgagtccgatccaatcgcttgagcgtccacatttgattgctccagcacaactgccaattcgacggcatctttgaatttgagatctttgtccccttttttgatcagttcggcacgaattgagtcgtcgacaattccattgacaaataatgcgcttaagcacatgtcgatgctgtccttgccccactccgttttggcaataagtgaacgcaattgaatggaaaagtcgcgaatcgattggccggaatgttgcctggcggtgaacagctcgtgcctccttgccgcaattgactttgcttcgccgtaacgctcgcacatcaatgctgtaatttccgcaaaatccatatcacggatgtcgtcaggctgtgccatcattcttaactcatcataaattgggccaatttcggtgaaaagcaatagctttttcatctccgggtcggtgatccctctgagcttgatgaaaaaatcgaatctttccgcccaagaatcccatgacatttcctgtgaatatgctcctggtcctttggccgatttgattttgttgtcttgctgttgttgagccatcgctgcgacgttttaaaccgtatatcacggaaccttacacaacacgagtgtttcggtttttcggcgaatctgcgaaattgaaaagtcaacacgagacttattcaatttcccaacgaaaattgttaacacgaaacaattttcgtaaatgttgattgctgtttgtgtcgcttttatgctggctttgttcctttgctgactgcgccaatttactgttgtgtccgagcaacagttaaaggaaatattgatttattccaaataaataaagcacagaaaattgggaggtcaaaggacaaataataaatgcagataaattaaatgacaaatgaatggtggaaaaagcaaaggaaggggaaacaattccatatttatgggcagtaaaatgggcgggaaatgtgggcatttaaaattcaaaatatccacttaaacactacaattccttcccccttctttgagcggaatgcgcctcacgaggggtcaaaaattacccttttcttccgatcgcgagttgatcggcgcaatgcctgatcaggcacacctccctcaggcgcaattttctgccgaatttcttggcgtggactcccaatcggaattggttgcggttgttgttcgtcgtccgattccgcatctgcctcactttccgattcggactcctgatcacaattatcagctgtcgaagtcaaatcagctttgagctgatcaaaatgccggcaccaaactccacgggcggtctttacacggaacattgctgctccaatcttttctaagattcgtccctgcatccattttggcccaccatggtaatttcgtgcaaaaatcggctgtccattctcaaaattcttcgctttaccagcctttttatcataattccttttcattctttcgccgcttttactttttgccatttcgggttgattcccctgtgggtttggttggactaaatccaataatgtcctcaatcgccggttgaaaagcatttctgcgggcgaaacttctgttgatgcatgcggcgtgactcggtattgcaaaagaaattgcgaaactgccaaatccaaaccaatggaatcgcccatcatgtgccgaagtccatttttaaaagtctggacgaaacgctcagccaatccgttgcttttcgggtggtatggcggcgtcagtgtgtgttcaattccgcgtgatcggcagtagttctcaaattcagccgaggcgaattgtcgtccattgtcggtgacaatttgttgagcaatccgtgtgtgccaaacacaattcgaatggcctctatcgttgcattggccgtgatgttcttcattttggtcacttcaggccattttgatttggcgtcgacgatgatcagccacatgtgtcccatgaaaggaccacaaaaatccatgtgaagtcgctgccaaactctgtcaggcgttccccacggatgcaatggaaccttcctctcctcaggtgcatcagattggcaatttctgcacctctttcgttccatttcgatgtccttgtcaattcctggccaccaaattttctgtcgagccaacgctttcattcgaacaattccagaatgggtggcatgcaaaagttctaacatttttccgtgaaattttctcggaataactgttcggtttcccaacatgatgcatccatttaccaattccatttaccaattccaaactgtttttgttcggctcgaatggcttcagctgatcactttcgacctttttcggccatcctctttcaatgaattctttgaccttcttcaaaatttggtcttttgctgtttcactggcaatcgattttgcggtgacaggcagcgagtcgatgttttccaattgtacggctctcacttctgcactgtccaaatcaatttttgctatctccggacatggtagtcgcgatagaccatcggcatttccaaattcttttgttggacaatattcgatgtcaaagtcgaagttcattaaaattagtgaccaccggtgcagccttctcgccgccaccacgggtatttcactttttggcccaaaaactttttca

SEQ ID NO: 4952 - DNA, 1016 bp, Heterodera glycines
gaaattcagacattcttccaaattttaaatgtttatttcagggattcaccgggaacggatctggcgcacatttcgcggacaattaattatgctggttttttgatgtttgatgtttcatttaatcctaaacttttaatcgcactcaatactattttttctcacattcatttaaccatcgttaacggatacctaactttgtttttgtttgaaatattcatttttgccaataaatatatgcatggataactgtatcatgtggtgtagagcattgagtatttattctttatttatttgccgaattttataaaaattaaaaaaaattgttttcggcttgtgaatatttaaactatcttctaaacaactaatgctattttgaaatgacactagcctttgttgacagagaaaatttgttttgaactagagaccggcgcgggacgggatcccgcgcgggattttgcaggatcccagtccgcaatcccgcattttttggaaaatgcgggatttgcgggattaatcccgcgggatcccgtcccgcaaaaggaattgagttccaatcccgcagcgggatccgcaaatttgattttttgtgcgggattatgcgggattttattgattttttgaaaatttttctaagacagaatgccaaaaatttttaaataaattaaataataaatttaattaaagttaactcatttttcatcgcaaatttcattcaaaatttgtgaaattttcccggcggcacctatcggcaccgccggaccctaaaaatccctatttttcttgcaaaatttgctcaaaatcgcaaaattttgtaattttttggacaaaatctgttaacaaaattttcccggcggcgcctatcggcaccgcaggcccctcgtttccccaaaagttttttggaaaaagcgcgccgtaaaaaacgtgtaaatagtcaagtcattccttttcccaaaaatgttctaaaataatgaaaaatgacaaaaaaagattttgataaaataattgaataatttttt

SEQ ID NO: 4953 - DNA, 2807 bp, Heterodera glycines
tgtacagcagtgcggttggccaaaggcgacatttgtgcatcctgtggcagtgttcagtggaccgcagcaatggaaagcgggggtgagtaaagttcataaaacgggggcgggggcattcgtggagggatggaacaaaaaaaggactgtcaacatttaaaaatggaaaatggcattttctgggaatgacgggggcgggagagatcggttaacggataagcgggtactgctccaccccgacctccattcgtccaccgcattcccccgctcccactcattcatttggacattttctaacggccaatctgcaccgctccccccccccccccattatttcatactcattttaaatgaaattttgaatttaatttttaaatttcagcacaaaattcacaaaatgttcaacggtgagcaacaaaacgacggaaatgacaacgggcgagttgtgcgcaaaccgccacgccgctctcgcaatgccaacggcgacgtgccggcaagttcaaaattttaaaaattgaaaatttcattaaattttaattttaattttccccttccttttcctaaaggaaagcgacattgtgcggaaacgggcgcggcagaacagcacgagcaacagcagtggcgccactcgaggcactacgagcagtcaaagtggcggcggcggcaatgactggccggctttcggcggcggcaacaacaacaacaacagccgccgcaccggcacttcagcgctggacttggacatgctgctgatgccacagatggtcagcagcgacagttcggcaagttttttttgtgggttcttggccaggttttcggggccgctgatcataacaattgggggtttaattaagccctctcctcctctgcgctctgctcaagcggaatttgtacaaaaaatttaatttttgagtttcagcgcggttcaacgagcgctgccgctgttgtacaacaggtgccgcagggaagcaacgcgacttcggctgctgctgctgtcatgccaatgtcgtttttggacaacaataacatcaatgtgagtgtttgggggtgcaattggtccagtgacttatgttaaggcttttggcctcattaatttttggaaaataaaataaatttttaaaatttacagttgccggtggctttctcaagtggcagcgatggaagcggcggcggcggcggtgcattgacagtggcggggcacatgccgtggggggtgagcattgttttttgggggcacgcgaatgaataatgtccccattttaactccttttcccccgttttcagctgtcgacaactggtggcggaagtggtgaaggcggcagtgtccagcatttgcaaaacttggtctacatggcgggtgtgccgcagagcgcggggcaagcgcaggccgtgacaatgacgacggcggcggcagcgacttggacggccaatgtagggtttgaccaggaatttggggggttgctatccgagataatggttaacctagagacttatttttgccgactctggccccccaaaatggggatgggtggaccttgtcctgagctgtcctaattttaaaaattttcaagtcgggcacatttgtcagcggcggatgtgggggcactgtcgttgctggcggcatgttcgggcgcgcgagctgtggtggcagtgctggtggtgctagtgtatttggaggaatgcaggtagttgggggagtgaacgggaacacagttggcaaaatttagtgtgaatttaattaaaatttttcttcattttcttaggccctcccaccccacattcgtgatgccatcgagcgggttcacgcaaggcaaatgcagaagatgatcaccgttcaacccgacttcgccgacattttgccgccgtgtgccgacaacgggatgtcgagcctcggatggctcatgctggactggcaagccgacatggtcatggggtaagccagaattttggtcacttcatcaaaatgtttatgcaatgccccccattgctttttaaggcgtgtcgttggcattgttgtgttgtgtggcccattcacaacagtcagcgggctgaacggcttcgatgtgcggctgatgttcgaccacaacaacgcgcaacaagagatggctgtccactgttgggaggagtgcatgccgcgtctcgccaacaacattcagtgcggtgccgtcgtcgaattttgtcgcctgaaggtgcgcgaacaagggaaaaacaacaaaggcagcttccccttcacgctgctctacaacaacgagtcgcggcaccgcattctctccgcgtccagcaacatcagtgcgttgctgccttttttcatattccaaattgtacgcatttcacacaaacatttccaggtgcgaatttgatgagcagcagcaacacgccgatcattgtggaggcggtggaacagcagcagcatcttgcgggcagcagcatcacagctagttcccgtccatcttctgtaaccggcaccactgccattgccagcagcagccatcacagcagcatgtccatcacagcggcccaacagaacacccgaggcggcggcggcagccaagacgtgcgcgtggcaaaaaacggtaagcagcggcaaaagcattactgatcagcctatgcaaagcgctcttactgatccgatcacattaaaaattatacacaaaaataaattttttcaggcaaagggaaaatgcgaccggacgtgccatgagcagccaaagtgaaggacgaacggaccgaattgcgaccggcggccaattttgaacatggtgggtgcgcaacacgtcctcgatgccgagccccagcatgatgatgatgaa

SEQ ID NO: 4954 - DNA, 6283 bp, Heterodera glycines
ggaaaaacaacaaaggcagcttccccttcacgctgctctacaacaacgagtcgcggcaccgcattctctccgcgtccagcaacatcagtgcgttgctgccttttttcatattccaaattgtacgcatttcacacaaacatttccaggtgcgaatttgatgagcagcagcaacacgccgatcattgtggaggcagcggaacagcagcagcatcgtgcgggcggcagcaccacagctagtgcccgtccatcttctgcaaccggcaccactgccattgccagcagcagccatcacagcaacatgtccatcacagcggcccaacagaacacccgaggcggcggcggcagccaagacgtgcgcgtggcaaaaaacggtaagcagcggcaaaagcattactgatcagcctatgcaaagcgctcttactgatccgatcacattaaaaattatacacaaaataaatttttcaggcaatggaaatgcgacggacgtgcatgagcagcaaagtgaggacgacggaccgaatgcgacggcggccaatttgaacagtgtgggtgcgcagcgcgtcgtcgatgccgagcccgagcatgatgatgatgaagagggcacgagcgaaacggttagcggaaaataaaacgaaacgcaaagaaatgaaacgaaacgaaatgatccattgtgacatacacacacatacaacacacacgctcgcatttatcatgacaataaataattctgtcttttcacactttctcataaatcttttttttacaattttgctttgtaaatgtttttttgttgttgtggaaggccatgaccgttttttttggtgcatgggttccaataatgcgggcgtgttgtggcggtcatgcaattttcggaaatcaaaaaaaaaattcgttcacattttcaaaatgctcatttctctgtaggcatggctgtccacagcacgccccccgccgccatcatgtacaccggttggccgccctttttgccaccgccgccgccgtcgtcgtcttcttcacagcatttcgccgccggctgggcccagtcatggtcgtcgttcgtcgccacctccccagagggcctgttcaatcagcgcccagcgcaacctgcacaccgtcgtgcaacgaatcaacgaccttgaggcacaagtcgcgcgcgatgagcgcaacgcgcgtgaacgtcgtcagcgcgctcgtcgtcaacaactgctgttgcagcagcatcagcacatgcctttgtcgtcgtcatcgtcgccgtctccgtctcctcatcatgttgccaatgccgccgaagcggacgtcatcaccattgacgatgtcgaaccgctcgggctcgcgcagcaacaacagctccacaggggtgatgcgcggtattttgcgcacgaattgatgacactcgaagatgaagccggagcggcggagatgatcatcctcgacaatgagccactctcggtggccgaccgagagtggctcatctcaacagccttcaaaatgcggcagcttccgtcatctgtcaaaggcagcgttgaggtggacgagaatggcaacagcaacatcagttgttgcatttgccgcgactggatcgtttcggacgcggacagcgtggtccggctcgcctgccagcattttttgcaccgcaagtgttttgctcaggaagcaatgcggcggagcatttgtcctctctgccgccggcactttgtgactggcgagacaatgccgacaaacgaggacggcgggaactgagcgcgcgaaaaattcttttgacattttattttttttcatttgccaatcatttttttaaaatttttttggacatttctcaaaattttgttgccatttcaaattttctcatcacttaaataaaatttcttgttaaaaattgtaccctaacatttaattaatccatagcgagtgtgtatgtgtatgtgtgtgagagttttctgtctttaattttcgacataattaggacaatgcggaggagggaggggagggtattaagcatagggaattgtcgatttgtcattatcaataagccgtttagcgtcgcaccgtgtggccacagattgggcgggggcgaacaccgaaggaccaccaccaccaccaccaccaccaccaccaccaccaccaccaccgacaatggcactggcagcgacagcagcaatgcagaaaccgctgagaaccacgaggacgacagtgcacagctgggccgttactgcaaggtggttggcatatgggagcgcaccgagtgccgaagtcgcaacactcggtgtgaggcggttgaagtggcactgaatgggtgggcgagtgcgcggcgcccggacactttgctggcgcaatgcattgcgcatctgttggaccgagtattggccgggcgggtgcgtccgctgcgcattggcatgtcgtgccagccgccgcagttcgcctcgccctaccacatcccacaccgcgctccggagcagaacaccgccgcagcaatggccgctgagttggagcggctcgccgcgcagtcagccggcggcgtcgacctgttcagtggcactgtattgttccgcatcagcgccgtgtggccattggagcgcaacagcggtacaaaggaaggggagggaagggtggaagtgggtggggaggggggtggcagctgattttggtccacttttggcactatcatttgaccgcacaggcgcgggtgcttgtgccgcggatgagcgagaggcacggggcagtgtccggtgccgctcattcttcccggtggtgaacccggatgacgcgtggtgccttgcgcgtgccgtcgtgttggggttggccgaccggcacttccagcacctgtacggtgccgacagccgacaggcgttcacgcacctgcgcaccttttggctcgcacaacatgggcatggcggtgagcaggcggcccgtcagttgcttcaatccgccaccctgccgctggatcggcccagctacggggtggcggaagctcaacgactccagcacacactcgactcgcggctcggcgcgcagcaagtgcgactggtcatcttcgagcgggagcacggctgtcgcgtgctgtggaaggccccgaatcgggcacacttcaacatttgcctgctgctgcaaaggagtgcccactacggatacattcagcgtccacaacaactttttcgggtaaaaaattttcatttcattttgtaaagaaacgaaacgcaaagcaacaaaacgcaatgaaaaaattcaaagaaagaacgaaccgctaagaaacgaacaattaattaattaattaaatacgaaaagcaattcaacgcaaagtaaaaatttaaaaaataaacgatagtaaagttaattaaaaaccaaaaagccaagtaacgtaaaaaagaaataaatgtaaaaagaaatgagtcttaaagagctatcagaaattgagaaaaatgtagccaaaaagtgaaatgaaacgaaacaattgattaattaaatctgaaaagcaattaaaagtaaagtagaaattcaaagaaagaacggaaacgaaacaaaaaaattaattaattaaatctgaaaaaacaatcaaacgcaaagtagtaattcaaagaaagaactcaaacgaaacgaaaaaattaattaaataaatctgaaaaacattaaacgcaaagtagtaattcaaagaaagaagcataaacgaattttatttaaatttaattgttgaataacggaaatgtaaagcaaatcaaagcagagtgtaaaaaaagcatggacattcggaatcaaaaaattacacttctttctgtttctaatttcaaactatttccccaggcgaaacagtattgcgtcgagtgcgagcggcccgtgcacagacgctcgcatccgttgggctgtcgcgccgtgtgtgggctgtgtttgcgctatgatgcgctgcacttcccatgtcgccgggatgcagacacgccgcagggcgggctgttctgtgcacagtgccgctttgtgttcccgaatgcggactgttttgcgacgcaccgtcagtgcgtggacccgccaccggcgcttggtctgctcggtggcggtggtggtggtggtggtgcagtggtggaccggcgccgtggtcgcccctatcgctcaatgtgtgaggagcgccggctgtgcgcacagtgcaatgtggtggtgtgggcccgttccggcgcacaccactgtcgtcgacatccgcagcagcagcagcagcagcacgtgcgtgccattgctaccgcatcaacagctgctccaatggtaccgccggctgctgctgctaccgtagcaacggttgcagcagttggacaacaacaacaacaacaacagcaacaacatcattgtcaaaaatgcggaggtccacacgatgccagccgcacgccgcactttgtccagcccaagcagttcgctcgccagtgtcagtggcaacagcccaacaccaacggcattgctgatgatgctcaaggggagcaggacgaagacgaggaagacaatgaatcggacggtgaggaggaggagggggccgatgccacccgtggtcagcggcagcaacagcggcgcgacaacaaagcggtccggttcatcttttgggatgtggagtgtgcccaggagcgggtggtgcagcagcagcagcagcagcagcaaatgttgcaggaaagggtcgcggacgaatggccagccgaggggggcgacgattacgacgacgacgcggacgtgggtggcattggtgatggagaggcggcaccagcggcattcgaccacgctgtgttgctgaagcacgtgccggtgctggtctgtgcggaagtgatttgtgagcggtgcatcgcgcacggggtggagctggagcgggagccgttgcgccgagcaccgcgctgtcagtgtggcgtgccgtggcggggcgccaaccgtcgacgctggtgctcacgcatcggtgaacagttgttcgacgacagcggcgtcgacattggagcggatgagctcggtgtcgtcggacaacaactgccgttggacgggctgaacccgcgtcggctgcgcttcttctgcgacggggagccaggcaccgggcggggcgcgatggagcaatttgtcgactttatgctccacaccggcccaaaaggtgtgcgcaccgtgatgcttgcacataacggagtaagctttgatgcctttacaaatgcgttcataatttattgttatgctgcttttctctgtccgcttagggccgttacgacatccatctgttgctggaggagttgcagcgtcggggtgagcggccgcgaaaggcggttcagcatgggttgcgcgtgtacatgttggagttgcgcggcacgcaccagcgggagctgatctgcaaggactcgctgaactacttccactgtgcgctggccaccctgccgcgcacgtttgggctgcgcggggtgccggacaaaccgttcttcccctaccatcacatccacgcgcgcaacctggatgttgagctgccggccggcacgctgccaccacctgctgcctacgacccggacaggatgcgccccgagcaacgcgagcggttcatggagtggtacgcgcacgagctgcgccggcccgggcgccagccctttttgctccgccgcgagctgctccgctactgttggaatggtaggggcgggggggggggggggggagcacaacaaacacatacggctatacccatttatgcatttagatgtgaaaattttgcgcaccgcctgcctgcgcttccgcgagctggtgggggagtgtgcggacggcatggaaccctttctggccgcaacaacaattgccagcctggccatggctgtgttccgccagcaccacctccgccccaacacgatggtgcacacgccggagggcggattcctgcgcggacgccgagcatcggtggagtctcggcgcttcttcacgctgctggccgccgtacggcccgacctgggcccgcttcgcactgcccgctggtccatcggcgaagctgttgtggggaacagcgggcgctcctaccaccgccgccgccgcgacaacaacagcaccaacagctgtgccggcgccgacgatgacggattccggctcgactgcgtggcctaccgtcatccaccactgcgaccgttgtgcatcgagttcaacggctgctacatgcacggtgggacacacacacacacacaacacacacttacaataatgttttaatttctgagctcaattaaggttgtcgggagtgctaccccgaccggcaaatgctgttggcggggggacgcagcgcggagttgctgtgggcgcgcacccagcaacg

SEQ ID NO: 4955 - DNA, 2738 bp, Heterodera glycines
cagcttttccattgtccattcgttcaccaattcgaatggcaccatttgtattgacggcgcacgaacagtaaaacgaatttcgtaattgacggaagaaatggcattggcacgaagaaaatgctaataaaaaacgacttttttacatttccttgaattttcttaataatttttttcgaatttatctatttttttttgatttaggctaggtaactaaattttaaataatttttttaattaaaataaaaatttgcggctacgttttgtcccccccccccccccccccggaccacacctccttgaaattgttgatccaatcagtgttcgtttgtgcgttgtaattatcgcaacacaatcgcttgggttgtccatcttttctcggagagtgcaaccatttggacaatgcttggccagcagaaattgttgaaattggcccatcaaaaccatcaccaatcgcagcgggcaacagatcaaatgaatggattgaaaccaattggttaagatcgatgagaattgtcggcgaaatttgacgaagcaaatggtccaaatgatcacgacgggaaaagcccaagtggcgaatgttttcagaaaaaatgggccaaatttcacgaacaaaaatgtccaaaatccgctgggtatccatgttgagtggtgaagaaggaagccacaaatataaattggtgcctcttttgtcgaaaatttggtgatttgaacgaagaaaagcgatgacggagtgatcaatgtaactgtgaaaatggaaggaatgcttttattgtcatagctctctgatttttaattactaaatccgaaggcgcttaaaacggattttgctgggcaacggacggtcgcgcaatggaaatggcaaagatttgtcaccaatttgtacataaagtttcggttctggtcctttgtccttgcgatgaatttcgattggtctccaaattgtcaattcgcttttgccattgaaatgtttgtccaccaacgcattgaaacgtggcgaaagaagtgccaatttgaggccgagttgggcatggtcaaaacagggcaaaatgtccatccaaacgtcgttgcaaatccaactgaaataatgaaagtaaattagggcaaataagaatttttgacttttgaaattcttttaccgtcggttcattttttggtaattactaattagcacaatttggccgagttccgaatgaggtcaaacaaatagcagaataattaattaattgcgttggataaaacctggtttttagggttttcctatttttttacggattgtatttgatgaagaagcaccaaaatcacatttaacgaattttttccaaaaaatggaaaatttttgacagaaaattattcataacttcacccaaaatgaaaccaaattttaaaatattgatatcattcaataggcccaactgttttctattagcctataaagtttcaaaaagttccgttaagtttcaaaaaagttataacttgagaagctcaaaaaaccaagttttttacaacatttttggtcataactttcttgaaacttaacgaaacctttttgaaggcacgataacatttcgcctactaagccaagatctgacatttcgcctactgacacttcgcctactggacatttcgtctactaagccaaaggcttcacatccatggaaaacaaagagtgattaagaagctaatggagatgcacactttctgtgttctttgaaaaatttatttgttttttttggctaaatttgattagcattataaatatagcgaattatatgtcaaattagaatatatatttggtgaaatttgctgtcgaaagagctaggtattttaggttagcaggcgagatattcaataggcgaaatgtccagtaggcgaagtgtcagtaggcgagatgtccagtaggcgaaacgtacgcacaccctttttgaaattttgcatgctaatagaaaacaactagagctattgaatgatataaagaagtaaaaatttggttgattttaagtaaagatattgaaaaaaattgctacaattgatggttttttgaccaacatcatagcaccgaccgaagaaacggcgagcagaaaaagggaatggcacagtgaattggaatggaacgcaacagaggagaggaggaccaccaaagagaatattttgcaaaattatgaccatttgccgggcgttttaccttatccccccacccacaaatcaatcaataaaataatcaattggacggatagagagagggaaaggatgaaaatagcattggggaaggaggagagacggaagagaaagagaggaaaaggaaaaattcgaagcaagaaggaggggagaaagaggaggaaaaggatgaaaatagcattggggaaggaggagaaagagagagagagagaaaaaggaaaaattcgaagcaagatttttgccatttttatacgtccgatttatttaccaatttagacattattcatcaaaaaaggcatttgatcactgatgattatgaccggtcggtcattacttaattaattcatttcttcttctatgcccccgtgtttttttgtgtccgtttgcccctcactcatttcgccctttgtgatgctttgtcccgcttcttcgtcttctcttgctggtggtggcggagacaaaggcctaaattaagcgcaaaattcaaattcggataaaaatcaatgtttttaaattgctcacccgatgcaattagtgccacctaaaagccaaaagaacacatt

SEQ ID NO: 4956 - DNA, 3065 bp, Heterodera glycines
ctttgagcccaatttttttaagaaaaaataataattttgggggccccggcggcgggaggaaaaattggaattttggtttttttttacagattttcacggaaaattgttcatttaaaaatgccttatcgttttaattaattctatacaaaaatagttataataaaagaaaataaaaaagtacataaaattattattatgattattaaaaaattttaaagctaaaataatataattttttttgactatatggcataaggaaaaaaattgaaaaaccccgaacgatttggtcaaccccgaaccccgacttttccaaccccgacggtcggggtcgcaaccctagttcacatcattggtcccataattttcgactttttgttcaggtccggtgtttggagttggtcaaaatggatgccagattcatgatcagcgacaccgaaaagcccctaacaaatttttcatgactttcgaaaaccaaaaatcttcaaaaaggtggcactagccctactattaccggcatttgattttgtacatatacaaatttgaattttgtgcttaattaaggtcattgtctccgccaccggaagaagaaacgggacaaagcatcacaaaaggatgttctgacaaatgagtgacggacaaacgaacaaaaacaatgattcagcagcagacgaaatgaattaattgagaatgaacggccgatcataatttatcagtagggttataaattatatggactaaaaagcccgaaatatggactaaaaagctcaaaaatggccatatatggaccaaaatatggattagaaactgccaaaatatatcttttaaagcctaaaaaattcagtaaaatgtatttatattcaatatttgctaaaacagactcaaaaataagcgaaaaactgcacaaaaatggatttaacatttaaaaaattccaattttattaaattctagcttcacaattgcaagtcaaatactttcaaaatttttgtaataatctcattctgtttgcagcgaaaattttcggaagtgtggacaaaatagctaaaaaaatttcaaaatttcgaaaaaattctctttttaggggtgtattttttatttccaaaacatagatctttagtggtgtagattattcatactacatttagttattttcgagatttttatgcttcaatttaacaaatttgaagaatttgtgaaaattttgcccccaatttggaaaaatttatgtgcatatttttcactttttatgcgcatagtttaagattttatgtgcatttaattaccagccctagtaatatcatgattcattttcagatttttatttaaaattttcttattttaaaaacaaagttgtgtcaaaatgtttccatcccttccatttttggcaataatttttcgtctcccattggcacattgtctaacccatcggtccattttcgtgccttttttcaatttttgatgcctattatatgtaaatagtccttttttcgcgattttttggtgcctttttagtcgtgtctacaaataacttattgaattaataatcaattcgaccagttcacgggaagcggttaaattctgaaaatggggtgtgtcctgattttaatgacaagcactgtactgttattggaactataaattgcgtatgaaaaacttcacaccctgaatttttctttttaattgatacataccagggatggcattccgaggccctaaaaattttcgaaaatcggaattccgaccccaaaaatgtcggaattccgtgccatccctggtacatacccatgggatgcatcgagacgagagagaaaatttatattttaacggaaaacaacaacaaatcagagagtaaaaacgagcataaaaaatggtcagatcactcttattcatcaccataattcaaaatgatcgaacatttctcaaatgcattaaatcaccttcaaataattggacaccatttgcgacgtggcgacaaaggcctaaaaattcgggaaccgcccaactcgtcgcggccaactcgccgcggggccaactcgccgcgcgctttctcgccgcgaggccaactcgccgcgccttgttttttggcaatctcgccgccagaattttttcgtttaataatacattaaaagcaaactttattatgtatttaataagttatatttcatcaaagtttctctccaatttaatatgcttcaaattgaaagtcaacaaaggaagcaaaaattgcagaacgaatgattcctctatattttcgaaatttaatgtggatatctcatgactagggatgatatttttaggctctaaaaatcggaattcagcctaattgtgctacaaaaacatggcaataaaagcttcttccatttccacagttacatcgatcacttcgtcatcgcttttatttgggatgtttttgttcgtgaaatttggccaattttttcggcaaatattcgccacttgggcttttacgatggtgatgatttggacaatttgtgtcgtctcatttcaccgacaattctcactgatcttccgggggatggggtattccgaggtattttctgaaatcggaattccggctccaaaaacgtcgtaagtctgaaatttctgaaaatttccgaattttatcaaatttcggaaatcggaattccatgccatccctggtgtggccccacatttttggcaaatcactgtttttttgttttcaaattgtttagcattttcttcgtgccaatgccatttcttccgtcagttacgaaattcatttttctgttcatgtgccatcaatggaaatggtgccatttgaattgatgaacgaatggacaaatgaaaagttgacattggccaaagcaaaagaaaatgaattggacaaaagttggataatgaaacgatgcaaatttgggaagaccgcggcggttcattgggaagacggaaagtgggacaacaattgtaacaatgtgttcttttggctttttagtggcactaattgcattgggtgagcaattaaaaaaggcatttgtgtaataattagggctatcatttacatggaaatccatatttttttcctggactg

SEQ ID NO: 4957 - DNA, 1437 bp, Heterodera glycines
  misc_feature (1430)..(1430): n is a, c, g, or t
tgttcgtgaatttggccattttttcggcaaatattcgccacttgggcttttacgatggtgatgatttggacaatttgtgtcgtctcatttcaccgacaattctcactgatcttccgggggatggggtattccgaggtattttctgaaatcggaattccggctccaaaaacgtcgtaagtctgaaatttctgaaaatttccgaattttatcaaatttcggaaatcggaattccatgccatccctggtgtggccccacatttttggcaaatcactgttttttgttttcaaattatttagcattttctccgtgccaatgccatttcttccgtcagttaccaaattcatttttatgttcatgtgccgtcaatgccaatggtgccgtttgaattggtgaacgaatggacgaaggaaaagctgacattggccaaagcaaaagaaaatgaattggacaaaagttggataatgaaacgatgcaaaattgggaagacagcggcggttcattgggaagacggaaagtgggacaacaattgtaacaatgtgtccattcgtctttttagtggcactaattgcattgggtgaccaattaaaaaaggcatttgtgtaataattagggctatcatttacatggaaatccatatttttttcctggactgtgagaggtctgaaacgtacgaaaaacatgttttttaacttggtttgaaactgctaggatggatttctatatccatatttttccatatttcgcgatttatgtccatataattgaccccccaagaaattttgttttcaaaagtcattaaaatatgtttccaagggttttctgcttagctgatcactaattcgtcacccattttgaccaactccgaactccgaaaaccggacccgaactcgaacaaaaagtcaaaaactcaaatttcgtaattttgtttaaatacatgaaaacgaaataaagtcatagtgcttcaataaaaagtcatttaaaccatttttagactaaaaatggaaaatcgaaaattttgaaatttttttcgagaaaaaatgatattagtggttttaagggtcggagaatccgaatctgacattaaatgatttttcattgaagcactgatgactttcagttcgtttctatgtatttaaacaatggttgaccaataatctggaaaccaaaaatctgaattttcgacttatgcgcgggtgcttttcttttctcaaaaggcattcattcatttcacgcttttttgatgaataaaccgagttagcacacattttgttctctgttccattacaaatcacatgttcatttgatgatgcattcattcattggtccctcccccccttcctgcagaatgggcatttttttttcttccctgaaaatttggttcgcaagtcccaccgtcatttgggtacctctcctttgttagggctaccgntcctttt

SEQ ID NO: 4958 - DNA, 968 bp, Heterodera glycines
  misc_feature (914)..(914): n is a, c, g, or t
  misc_feature (941)..(941): n is a, c, g, or t
aaatttattaaaaaatttcaaaaacgaaaaatttcaaataacttctttttgtaattgtcaaaatcgccatttatttactttgacgagctgttccaaattcgcagtgtactgaaagggggcggagattatccaatggcgacaaagaaaaagatgctttttacatcctccatcattttcatcatttggtccaccaaagagccggacccactgggggaagggaggcaaattcaaattatggggaggggaggggtgccgacgtggagcggaggttggcattgacaatggccttcatccgcttaatgttcgggcgcatttcggggatctgcgggtggagaagcaatggcaaacattggccaatttggtcacctcgagccaacacgcctcgattgccttagggacaattagcaaaggcaactcataattaggccaattcttaccgaaagcagttgcagattgtacgcctcttcgttggccgcgatttgattttggttgggaaaagtcggccgaatgatttggtcattgtccccagccatcgcaattttgttcaataattctgtggccaattctgcttttccatcttcccctattttccccactgtttagaggcaaatttcgttcatagaaaggctccattttgaacagaatttggtaaaggaccatgccgagactgtacatatcggcggattgagagccaaccggcaaatgtttggtgctgagaaactcgcgaatcacctcgggtgcttgttggacatattctacagggatggcaacaacagaaagaagcgactgattaacagacaaatgccgcttaatcactttttgaccgggagagagagaaagagagggggagagagagagggcgagaaaaaagggaggggaagagagaaagggagagaagagagggggaagaaaanaagtggaggggaagagagagagaaggngagagaaagagaggaggagagagaaag

SEQ ID NO: 4959 - DNA, 1588 bp, Heterodera glycines
tttctcttcattatccctctctctatcttccccccccctccccctccttttctccacaattgccttgttcaaattctcgttctccatgatcttcagctccttcagtctcgataggtcattctttacgggaaatgatcaatgctttccccccccctccattgatttgtcactttgttgaaggaaatgcttcggttctgctggtaccgtttgaaggcgcacttcactccgttggccaacgcctgcttggccaagagtctcgagttcgctttggacccaatgctttcgtctgcgaattcaacgctaattggacgaagggattaattggccttgccgtaccgtacgagtgactttcctgcgaccgacttcgaatggacatggactttgtctgaacaatccaaggaatgtccgggcttcgtcgccctttcccttggcaaattccgaccttcgacctctgctccaaaagtctgactttctcccgtgggattcgccaggtcatttcgtacaatatgcgctcctttctgaaagcctttgctccattcgctgcttttgacttcactcactcttttttgtggaggaaatatccgagaggaatggtcactaaacggcactctttcgcccctttctttggcattacggttcacctccgaggaaaagaatgacaccgaacagaatgtagatcagcgtgtagtcgcagagattgccgtcaaagccgcacttgggcatgtccagtggcattgagccgtccccggtggagtaataatgggacatcgtttcgtgcgccaccttttcgggaagagtttggccctccctcccctccccccccaattagtgacgtgttccgagcagtcattctctgacatggcacacttcagcttgtcgcccaaccgagccgtcagttcgaccacgattttcattgtgccttcacagttcggcatttctttcctcttttggcatttcccccccccccaccatttttggtgtgataagtcgcgtaactcggcactcggattgccttgttattcatcagcacttgccccgtggcgccttaatattctctgttttattccgtttttttgtccattgccaaaaccgatgaattgtcgtgccgtcatttttttccaaatgtaaagtccgtccagaaaaacgctttggtttttcgtttcttcataagcatctcttacggccaatccgtacagaaacagcgcatcgtacagagacatataagcgaggatagcatactgtaaaagcaacggtgggcagattactgtaggacagagagacgagagatgagagagagagagagagagaggaaaaaaagaagaaaatattattggggagagaaataaagaaaaaaagataaagggaaatggaaatggaaagtgaaataagaaaaaaagataagggaaagagaatgaaaaagggttaaatgagttggacttacatacgaactgatcattccggtgacctaaacaaatccaaacattgtttcttctatcagttcataattcggaagactcaccttattcagacgcaattcgaagtcctcgatgaatttcttatcgtagccatgggcagtgatcaccaattg

SEQ ID NO: 4960 - DNA, 4104 bp, Heterodera glycines
atcagcgtgtagtcgcagagattgccgtcaaagccgcacttgggcatgtccagtggcattgagccgtccccggtggagtaataatgggacatcgtttcgtgcgccaccttttcgggaagagtttggccctccctcccccccccccaattagtgacgtgttccgagcagtcattctctgacatggcacacttcagcttgtcgcccaaccgagccgtcagttcgaccacgattttcattgtgccttcacagttcggcatttctttcctcttttggcattccccccccccccaccatttttggtgtgataagtctgacatggcacacttcagcttgtcgcccaaccgagccgtcagttcgaccacgattttcattgtgccttcacagttcggcatttctttcctcttttggcattcccccccccccaccatttttggtgtgataagtcgcgtaactcggcactcggattgccttgttattcatcagcacttgccccgtggcgccttaatattctgttttattccgtttttttgtccattgccaaaaccgatgaattgtcgcgccgtcatttttttccaaatgtaaagtccgtccagaaaaacgctttggtttttcgtttcttcataagcatctcttacggccaatccgtacagaaacagcgcatcgtacagagacatataagcgaggatagcatactgtaaaagcaacggtgggcagattactgtaggacagagagacgagagatgagagagagagagagagagagagagagagagagagagagagaggaaaaaaagaagaaaatattattggggagagaaataaagaaaaaaagataaagggaaatggaaatggaaagtgaaataagaaaaaaagataagggaaagagaatgaaaaagggttaaatgagttggacttacatacgaactgatcattccggtgacctaaacaaatccaaacattgtttcttctatcagttcataattcggaagactcaccttattcagacgcaattcgaagtcctcgatgaatttcttatcgtagccatgggcagtgatcacaattgtgtcgtcaaaggctgatctgcggagtgatttttcgtctttgtccccctcaacttttccctccatcggtgtgatggatgaacaatccgtcaatcttccccccccccttttgccaattgtccccttccgcctcccccattttcccattctttttgcctcgtttcctgcttttcaatgtttgatgcctcccacggatagtgatcatgaagctgaacatggagaggataaagcataatttactctcataattatttgctcacatgggcaagccacgggataatgtacacgtaatcgggcgttttcatgtgggagcgaagtgcagcgatcataaacgacttggcactgtgaagatccatgcccatctccagcataatgactgaaatatgccaacaaattgagttggtccttcccagaaatgacttcgcgcgcgatttcgcaagtgccgtaggcgccccgtggcaataatttcgtcgggtgtcatgtacgggtccaactcgatctccacgttgatctcgatgttggcatctttgaggtaattgcgcagggaatgcagggaaaggcgctcgaagtgcacactgggccgaaccaagccgacctttggcacgcatttgcgaataattgattataattaattaaaattaattaatttgcatttactccttcaaaaaatgttcacctgtttccaaccatacaattgtaaaaaggtcaatctgaacagatggaaaataattgacaaaacaaacgcatcgaattccaagcacattgcccgcgccatttcagtggccgaagtgagcgcaacggagccaagcgtatcgaacactttggaagaagtgaaatgtgaaaaaggaaaaacgaaatggcacgggaaggaatggcacggaggagagagaatggcatgtaagggaatggcacgggaaggaatggcacctgcgcgatcggagagagcatcgtcgcctgacaaatgggcaatgatcggcacattccaacgagagaccaatcgaccgatgattagcatttctaaaggacgaaaagagcggagaataaatttgaaatgataaaatatctggctttatgaaaatgctgttgcatttccaataaaatgtcctttttgttcgattgacttgccattgttgcagccggggccgaaataaacgcttgtctaagggggggggacgggtaaagggacggaattccgtggctttgccccactcacatttttcatgtagtgcaaataggcggcgtactcaactccgctgaatcggttgcacgattccatcgtaaacaatctgaagacattaattaggctgatcagcatggtcaattagtgctaattgggcgtactgtagccgaatttcgcgcgggagaatggccctctctttcatgtcgttgtaacacctgcaacttttgacagttcgttcatttgttctttttctgtttgttcattctttgctcacatttccaacacttgcggttcgttaatgatgctcggattgttcggctgaagatgggcgactttgatgacaatgtttgggtgggccgaaggtgcccaaacggagaggagcagaagaagcaaactgacaatgagctgtggcacgaaggccagcgaaaaaatcattggctgaggaaacggtagaagagtactgtacgagtgggagaatggccaaatttgaggtagagaaacaattttggtgtcggcaaaagaaaatgctgaaaagcagattgatgccgccgccttttgggcggagtcgactggagcttaatccgtcaattagcacacttttaatccttctcttcattcctgctatatgaagaagacgcattaacttgaaatgtgatgttttgttgaaaagcttttgctggacgatgccaaaaaggggcaaagggaagggacggcactttaaaagacattggaaataattaagccaatgaaatgataaaataagcgaatgatttttttcaatttaagtgttcgttttcctttttttgttgcctctccaatttcaaagtgcttttttgatttgatttgaccacctttgcgcttctccttctatttttgtttcagtctgtcatcaggtaattctttgcttttcgcttttccttggtcatttatcccccaccccaatttttcacctttgtccccgcgttccgttggaaattcgacctttccctttccctcccccgaaagtttcgtccccataaaatggcccccattctccgctcttttcgtcatttcccctgccgatgttctgctccgttttgtgcttttccttcggtccgtttgtcgtccattttttcctcctcagttccgtctccattatccaagttgatcccagagtgagtggatgtccgaatgtgtcccaattcgcttttaatcgcccaactgtctcaggggagaccgatcagtctgtacgatcagccgggaaactttcatcgcggccccggtgacattgccaatctgtggagcggattcacttttgggctgcctctgtaaattggccttttcctgttagggttttcttggccggtttaagatttcgaggccccatgagaaatgcgataaagccgaactcgcccaatcggtggactcggtactcaaacgacaggggccaattcatcatcccttacataatcagcggaaaattcggtgccattgcatttgtttttccaattcgaaagacaattcagacagttccgagcacatgatcatttcacgagctatgatggccattgctgagaatacgtgcatcaaattcgaacggcgcagtggcgaagcggactatgtggacttgcggaacgaacggggcgaagggttaggggggaaaagcggaagtaattagtaaattggaactgacaggtgctatacggtggtgggacggtcggcaggaaggaatacggtaatgctggagacgaacgaagtcggtaagtgagcaattcgcactggccgatggcatttgctgacaaaaatgccgaccgaagcgacctgcttggagttcgacattgtcatccacgaactgatgcacaccatcggcctttggcacgaaca

SEQ ID NO: 4961 - DNA, 990 bp, Heterodera glycines
cgggggatatgtgaaaaattcaacatatacgcatgccacacttgcatgtggaattcagttcactcccggacaaagccgaccgacggaaggccaaaaagtggtcactctcgggccaccgactatgccaaccccggggacaactcccgagacacttcccacccgaacgacaacaaccggtgagtgagaaaacgagaaaaagaaagaagacacgacaatttcagagccaagtacaacatcccctaagggcactcccgcaaaggacagaaaagagggcgatcagacacgaccgacgccggcacttccgatcattttaccattaatcaacaacaattggtggtggaagaacacgccggcaccacccctcaggagagaaaggagcgaaagggacggggagaaaaggagaggcaacaaggaacagaagggagggaaagaaagaggcaaaggaagagagagaggaaaaggaaaaacacagaaacgatcgtataaatcctaaatgaatcacaaatctctctgttggcaaataattcgttccgccttaataattttaaaaaaattcaaggttcggaattgatctgaatggatgttgtaaattttatcactgaagcaactaagaaaccccagtgtttaatttttgacttaaaaaaaattatatgatttcttatatttcgaatagtttagagaaaaggaagcaaagactaaatgtcaaagaaaacaaagtgaaacagaatgacagaatttgaacaaatttgtcagaaaatgatgtcaaaaacaaatcgaaagaggtaaatgaaagaaattagaaacagagagcaaaaaatgaagaaaagtgagtcattcgattagaggtgaacgaaggagaaggacatgctgaaattccaaaatcggaagccgttaaacagaaaataatccacgacgaaaaattggaggacgaaacgctcgcggaaggcaacggcgtctgaaaagggtaaactaattacgaggtcgttgcat

SEQ ID NO: 4962 - DNA, 1470 bp, Heterodera glycines
tttgatttccagcgtttatcaatcaattcgaaaaggtgcccgacacggacagcacaacgtacggagtgaagtacgactaccaaagcgtaatgcattacgcgaaggacgcattcgcaacggcagcgggcaaaatcacaatggaaacattggacaaacaattccaagtacaaacaaaggacacgcaattggccaacgaaatgaaaggacatttgcggagggcccttttaattgacagaaaggagcattatcacagcactaaaagagaaaaaagcaaatttaaatggcaagttccataaaacatggtactttcgccaccattatgaacatttagctgaatgaattaaacgagaaaatgccgaaaaaacatggaaaacgcacttagttttacttttcaaacagaaaatccaattaaatttaacttattacattagaaaggtttttagcaactgacttatgttggcaaattaagtgatcatttcttacgctttttactgttttctttttgcggataatagttttgtttttgtaactgttgtgagttacgcattgattcataaggcccgtcctccgtcagtttaaataggcgtccgcaaatgtctgatagccgagcagaaaaaaccattttgaggatgttatcggaagagtaaaggacgcctccccgggggactatgtgaaaatatgcaacatttacgcatgccaaacttgcatgggaattccgttcactcccggacaaagccgaccgacggaaggccaaaaggtggtcactctcgggccaccgactatgccaaccccggggacaactcccgagacacttcccacccgaacgacaacaaccggtgagtgagaaaacgagaaaaagaaagaagacacgacaatttcagagccaagtacaacatcccctaagggcactcccgcaaaggacagaaaagagggcgatcagacacgaccaacgccggcacttccgatcattttaccattaatcaacaacaattggtggtggaagaacacgccggcaccacccctcaggagagaaaggagcgaaagggacggggagaaaaggagaggcaacaaggaacagaagggagggaaagaaagaggcaaaggaagagagagaggaaaaggaaaaacacagaaacgatcgtataaatcctaaatgaatcacaaatctctctgttggcaaataattcgttccgccttaataattttaaaaaaattcaaggttcggaattgatctgaatggatgttgtaaattttatcactgatcagcaactaagaaaccccagtgtttaattttttgatttcttatatttcgaatagtttagagaaaaggaagcaaagactaaatgtcaaagaaaacaaagtgaaacagaatgacagaatttgaacaaatttgtcagaaaatgatgtcaaaaacaaatcgaaagaggtaaatgaaagaaattagaaacagagagcaaaaaatgaagaaaa

SEQ ID NO: 4963 - DNA, 1721 bp, Heterodera glycines
  misc_feature (1702)..(1702): n is a, c, g, or t
cgtttgtttgggaaaatttggaaaattggctatctctttttctgctcaacagtaataggaattccaactgcattctcagaataattacgccgatactgattgttgtcccacggggcgtggacggcctccttaagcttaactacccgtgctaagcgttccctccatgtttttgatgtccaaggtcctccctcttccatttccttgtcaaaaagctgtgcctttatttccgtaggcaattttgttgtcatctaagttattgcccagactttccaattgtcggcaaattcggtcaacattctcagaaaaggctcttaatgatgaggaatgccctgttggcttagctaagtggaagagctcactccttaggcggtccgcccttttatcatcgtcgccataccgcccttttaaaaggtcaacgacgatcagataattggggtcggttagtgcgaacccatccaccaaagtgcgggcgttaccccttaggcgacccactaaataggtgagtttttgcgcgcccgtcagagaggcattatcgtgaatggtatgggaaaaagcggcccagaatgagggccagttgccttcgtgcccatcaaagtcaggtagctgaagcgcgggaaggttaatttgggggcgaattgctggcgcaggagaggacccttgagtggggggcggtgggggagccaaagaacgaattcggtcaattttgatgtccaatttcgtctgaaccccatggcccttggcgatgatctccccgggggatttccctcccaccaaaaaattggaaaacaaagcattttcctcatcccgaatttccgggttcggggaggctaggacatacgtccactctttcaaaagctcctttgtcaccgccaaggtacgagcgagattttcgctcgttgagcctatggcgtccaatgagcaaggctcattgggcaaagcctcaagtggtggcccctgggcaacatccgccaaaatgtccaacaacaaaggttggagttgttggcgaattatggcggacataattggaaaaaaggcgggtacaataagcaaaaaataaaaaagagggtacggtaagcaaagggaaaaagtactgcaggcaaaaagagaaaggaagaaaaaggcacggtaagcaaaaggcagaaaaaggagataaataagcaaattaggagttcgggagtctcccaaaaaggtaaaactaaagttgcccggttagctcaattccgtgacgagagcaccagactcttaatcccctgtgttcaacagctgggaatcggagggggtacgcccaagagaaggggggggggccctcaaattcagcagaacactcaaaacaaataagcgccaaaaaaagcttccgtttcccgaggcagtgagtgctaaccaggggaaagggataggaaaagggcgacctaagggaaaagccaagcggtcggccgacgtaaaggtgagaaaaagcaggcaaatgccgagggcgaaagtgccaaagggttggacgaagcaaaggcgagaaggcaaagggatggccaaatggctgaacgccaaaattggtcaacgcaaggcgagaaaggagaaaagcaagtgggccaaatggcggagcgccaaaattggtcaaattgtaagcaagggaaaacaagggaaagggtgaacaaatgagagaaaagtttttttttgttccaggggggagattaaatgaattcggcanaaattgggagagaaaattc

SEQ ID NO: 4964 - DNA, 2346 bp, Heterodera glycines
catttgcggaaaatcgcactgaaaagcacagtgtcatcgcgaatcagaaaggcacagaacggatggtcggcgacaaagcgcagttctctggccgccgcttggtaacatatgccggtgactgccctggcagtcgtgccctcctcgtttacctaaatttcgttttataaattaagaggattccttttctgcccgaaaaaacaattataagcatttttgcataatttttgggagttttgcggtcgctgatcagtgctcaccattaccctgatttttacgtagctaaataaggggtgcactttatttccccccgccgtcccgacatcaaaaaataaaaaacaattttttaatggtcttacaaaaaatttttcaaggatttttgaaaaatttttaagtttgggaattttaaaaaaatttcgggggtaaaaacgatgcgcgggagagggggaaacgacctgcccactaaataagcactaaaaaatggctaaataagtgttaaaatcacaaaaaaatcccagcttaaattggttacaaacaccgcacctcaatgaacgccttctgcaccacttggccaatgtacaaaggtttcttgtcggaaatgccctcaaaattggcgttgttggtgaacgcggtggccatgcccatgttggtcaacggtttattcagttcgtgcgtgacctccaacgtgaacttgggcaaatccacctggaaaagaaggggttcggctgtgatacaactcatttatttctccatttatcgttctctcccggaaaggacaattgggcgatatggacacgggtgcattacgtcccccccccgagaattttttttttattttcaaaacagaatttttcaagaaaaaaaatttttttggtgaattactaagaagcgcaaaaaaaatctataaactcgcccagttgaccaccaccgttttcttcacacccccccccccaaaaaaaaactgtttttccccatattttttcaccgactaagaaaaaatatatatacttttaagttttcgtgggtatgcttgcctaaacgaataatcgtaatacaatgtcaacaatcaatgcccatgtgctatggtttagttcggtcaccccacaggtcgcaatctttcgatgtttggggtcaacgatctaagaaacgatggcacatgggcactgtgttaggacagttcgtttatttaggcatgcccacaaccaaactccaaaattagacaatgccatgaataaatgtttttttttgtgatttttcttaccgtcacagtgtgtttgtcccgcattttaatcagttccaccagctttttgccgtccaattgagccaacaatttggccagtccaaagcgttccgtaggcaacagcacaaacatgaactccttttcacctttgtagggcatgccgagcagttggagctgtacaagcaatcagaaaagtgaaaggaaaaatgcatgaaaatgtgggaacgacctgagtgtcctcgaaataaatgaagctggccatcaaatgcatcatttccagctaaaaaaagtcagcgttggtcgtttatggtcaaaatgagattttatgaagttttaacccccacaaattttccccatattttttattgaattataaatgccaatataaatgttttcatgggcttcaataaaaggtcattaaaacggcttttagactaaaaatgtgaaattcgaacattttagttttgactttttgttcgagttcggggttcgtaatcggtcgaaatggatgccggattcgtgatcagcgacgccgaaaagctatggaatcatgttttcatgacttttgaaaattgttttttttttgaaaaatgagtgagagagacaaagtccttttttgggacctgatctaagcgattgccgttttcatggccactgatcataaattcggcacccattttgactgatagtgaatgagtcccataatcagctgttatccttcttattcatcacaaatttcacgcttaatttgtaatttgaaaaatgaattttttaaagaattgacttttgttctattctgatacagtggttcgaaatggatgccagattcgtgagcaaatgctttgataactttttaattggcattttaattttaaaattgtcctagtaattgtccgccacctctttgaagtttttcgcatccatgtgaaattgcgcctttttggtcaatgttgcgttgaatttgtccgcccatgtgcccttgaagtaaagcgcgttgatcagcaccaaactgaaagaaaggcaatgcccaaacatttgtattatttgcatcaaatagctttttataaaaaaacattttttaaggggcaaaagagaggcgagttcgtaaa

SEQ ID NO: 4965 - DNA, 901 bp, Heterodera glycines
ttattcatcggccaattcgcctttttcttcttccgccgtcaaatcaatggccaacgtcactttgtcctcatttttgtcgtaaaatccgttgctcgggtccatcaatttcttaatttttacaatttattaagcgaataaaagtgttttaaagccactcactgtaaaagtaatgaaatgaggaaatccccagccggcccattccttgttaaaaacatggtcatatttgaaagtcaaatcctccgttccgttcttttgtgaaacaattcgtagggttgccgaacattcgcagctccaatttccatctttggcaatcaaaattaattaatgcaattaaaaattctcctatttatcaccatttttcggcgcggagcacaaaaggtaaaagcccaaacatttatctgtgcttttcgtccttatttctgccaatattttccatccaaatccatttattcgaattgcataatcactaaagcgtttactccccacttccttttgtgcaaattcagaaaatttctcaatttccatcgcgagtgtcactctgtttcccttggctatgttccaatcggaaattcgtccatgccatggaaattccaatgggttaagtacgggcacatcactaggattgggatgacaatggaactgataaacggagatagcttcataggttgtcaaaacgcgagaagtaactgcaaaaaaaaaacaatttttatcaattttacaaattgctaccgatgctgctggtaaaatcccttgttggtatgagaggaaaacgaattttgaatagtgccgggccaagcgcagcacgtcgattctcagcggaacattcgatggcattttgacggcacttttcgtcggcccaacggagtgccttaattagaaaacaaacaaatcaattaaaata

SEQ ID NO: 4966 - DNA, 1601 bp, Heterodera glycines
tcaattagcgaagatggcaaatgctcgaaagccaaccgggagaaatacgtcccgaacatcgcccccctctacaatccgtctctgtcgctgtccaaccgttcgaattcgctttcgtattggcctaactcctcaattttccactcgaccacattccggtcgaacagtgactgtcgctttgcttttgcctcgttttgcggtggagagacggccactcgactcgccgggcgaggggggcgagtggggggactgccgggagagccgaattggatgttcagggaagcgacgctggaggcgcgagagctccaagtgagcgctgatgaaacagagggaagtgattgatggcattacacggtactcacgcggaggatgagaatggtgcggagaggggtcgacggaacgcgtagacatgcgacggacaatgcccagtttggagggagggaccagcgccggggacagtcgatcggggaccggctcattttggagggactgaaaaacgagggggtgagaatttggcatgtgaaatggtttcggcaaagtgaacacaccctgtagacgaggtgcagcgcaacgatgaactcgggaaggtccaaaactgagacggaggataaattgccccgatgaacgaacattcggattccccatttgctaatgtccattcaccgctcactcacatccatccgagtccatatccgccaagtcccaaatctaaagccaatgaacagttttacccatcggtcgccccattttccttgacttttataggccaacctttgccagcgtcgtcttcggcaattgcgagttgagcagcaccggtttgcattggtcgccgccgagcttaccgccgattggccccaaactgtggaagatggcctcgtacttgcgctgttcctccatcccaatgggcaagttctgttcaccgcctcctccgctggccaaatcggcagagactgacggactttttgagtccgcggagggcggaggcggcacggggggcagaggaggcggcgtggggaaggacagacactcaaattggggcacggcggacaacggcacgtcgagaacggagggcgcgagagggaagccttcacggtgaaagaaagacagtaccgatcagagggggaaaaagcaattggacacccggggaatgaaagacaaatttggaacctctcttcccccacgcccctatcctaattaggcctaattaccatgctgaatgccggcgaccaactgaaaatggaacaaaaccatcattaaaaaagaaaagtggtccccaattcaaaacctttaaacatataaacacgccaattttgttcagtgcgcttcgatttttgtatccgctcaattcgctcgcaatttcccaaatctgagaatgataatgagtaaggtctgaatggcatgttttgattcttttgtcattgtttgcctgagagagttgtgcgacgctaacgccgtgtgccgttttcagaaaagcagcgatagacgcggcatcgacttcggcacttccggagggattcagctgaaagtgtaggcaattggtcaatggcaaaggctcggaattgttcaaaatgtatgccgtcgcgatgactgacgaccacaaaagt

SEQ ID NO: 4967 - DNA, 1978 bp, Heterodera glycines
gcaggccataaatcagcaaaaatggaaatccgaaaagtaaatgaccaattaaggatttaagggtcaaaatttaaaggaaaaacaattagtgaccaaagaggaaaacattaaaacaatttaatttttcatttgttttttaaattttcattcgagggagagaaaaggaaataggcctgaaaaggggcacataaaaaattaaaacagaaattgtgaatacctaaataagaaagtaacattcgagaacagcacatacttattccttcaccaccccggcttgcttggccatcttcgcaaacatcgattctccgtcggccaaaagcgcagtcggcgtgtcgaactcagcaacagcgccttcgtccatgacgatcacacggtcgtagtccaaaatggtgtcgagacgatgcgcaatggtcaacaccgtacaatggcttaaaagcaattagccgtgctaatgacaataaagcaataagagtgttccgacttgaaatgggttcgaatgcactgctgaatgcatgagtcggtgtatgtgtcaactgaagacaattcaaatgcatttcctttttaaggacccccgaaaaacccgctgcggtggcttcgtcgagaatgagaatgcgcgtcctttgacggagaagcgcacgggccaaacagaccaattggcgttgtccctcactggaaagcaaagaaattcaatgcacaaaatggtatttcaatgccaacctgagattcgatcccttttcagttaatttgtagagcaaagtgccttccaatccgctaattgtgtccttaagttgcgccttttccagcgcagcccaaagatcgctgtcagagtattggtcgaacgggtcgatattggagcggagagagccacagaagagaaccgggtcctgaaaatgaaatataatcaatttattatataaaaaaagtttgaattgtctgacctgtgggatgatggtcaacgccgagcgcaggtcatgcagtccgactgttgtgatgtccgttccgtcgataaaaatttggccagaagcgggctcaacaatgcgaaacagtgccatggtgatggatgatttgcctagtcatagagaaatacagcatttcccggaatgatcaccggttggtcacctgcacccgttctgcccacaatgccaaccctttcagatgaagcaatttcaaagttgagacggttcagcaccaaagcactgtcttcgcggtatcggaggcacaaatcgcggaattggatttgcccgcgggagggccattccgcgagacgttcactcgcgggcgcacgccaatcggcctcccatttgttgttgatgtactcgttcacacgttcaacgcacaccatttgcacctccgattcacgccaaaaacgtgcaacttcgccaaggtaaccggtgaactgaaaagggatggggaaggacattacttcattttcagacagagcacaatatgatttgtccccgtagcctgccgacttaaattccaaaaaaaagaccgtatatccgcagccgatgaccaacgcaagaacccccaacgaaatgacgccttgacttgccatccaaattgcaacagccacacaaataaaaacggaaacatcggcgacaatgtcaagccgaatttggagccatctgcagagaaatgtttaccaaggaaaggcaaaaaaaaaaagaaagaaattacctgttagagaatatttcaacgataaagcattcgttgcaaatgtcagaaattcggtagcctttggccctgaattgtttgatcgccttaaaaatgcgaatggaatcggagccggagtaagcatcctccacaaaagagagatgggaagaacgcgatttgctggtcaaacgacgaaattggaccgaagaaacgttgtaaaagtgctaaaagaatggaataaaagaacaaaaattacaggaattcccaactttaccgtaatacataggaagataaccatcaacggaacaacgacaaggacaataaa

SEQ ID NO: 4968 - DNA, 4436 bp, Heterodera glycines
ttcgtcaattcggtcgatgtcattgccaattcggttgagaatcgggccgaggggagtccggtcgaaaaaagccatcggagaacggaaaagcgagtggagaagtttgtcgtgaaaggccaagctggcgcggtacgcaccgactgaaaaagtggagaaaaacgcattaaaaacatttgcaccaagaaaaaaccgtacaggaaaggaccaagctggacagagcagcggaaaacactgaaaagaaaaagtttatcgcgatagaaaaacagcagagggaccacacaaccacataaacccataagaaacattctcttttttttaatttgagtcgtcaagtttcttacaattaaataaagttaagtaccgtagaaaaaaataagtcttcgggcttactacggtttctttttctgcgactgattgtgagtagagttttcatgaaacgaatcactcaccgtaaaccgagctgaatgctccataaatgcccaaattccgaattgattcctccgggcttgtcgaattgctggtcgaccatttggcaagccaaacgttggaaaggcccttaaaaaagcaaaacaatttgtactggtaaaagcaaggggcgtatgtcgtcacttggaaagtgctggacccaatgaataaacaaaggaggtaaatgacggtcaacgaaatgctaaaagccctggcgtagtccaagtaaacgcgtcgcttcacctaaattaaacagccaacaaataaatgcattgttaaagtgaacggaaaagcggacggaccattcccgtgcagagttcctcttcatccgtaattcgaccgacgaggtcagaagcagacatcgcattcaaattgtggggactgtcatttgtggtgttttgttgatgctcctccgatggttggggatgggcggatgaagcgattggatgctggcagaaaagtattggaaatgaacagaataaggccaaattggagtccatttagggacacatggcactaccagacacaaattgctgttataccacaaaacttgttgccgaaacttgccgggacatatcatccgcaaaaaataaaaatatttcaataattaaaatttttttaattatttaaggactaattgtaagtgataccaaatttatataggttttccgacttacagttgggaatgttcccttgtgaaaacaaaatttgctgaattttcaaaaaaaaaagatttattttttcatttccttgaactttcttgatatttttttattttctaaaacaaaaaaaaattgcgttaacttttgtcccggcgacagttcggctggcaactgtggcggcggcgacgttttgtcctgctccccaaaatgcggggacctcccccgcccccgccaaaaaattgaaattcgttttacctgctgttctgaggaattcgcgggcagagattgatggccattactctccgatgactccaaccgacgacgcatttcgagaagagagtgactgaggggtgaaccggcgaactgttccaacacctggtcaagttgacgatgagaggtcgtttcttccgtgtcgtcctctgaaatgtccattttcggtccaaacccattaattagggataattagggttgtacctctgctgctgtcaatgcgactcttccgtccctcaaagtgtttctccatgtgttccttcataagttctgcaaatggtccctccgtgtgctgtttcaattcgtccaatgttccgaccgagtcaatttgaccatctttttatgaaattattagaaggatattgtgagtcattgtcagccggcttaccattcatgaccacaatcaaatcacagaatttcaagaaggacaaagagttaagcgcgaaaagacgagttttgccagcaagaaggcctaaggaaattgaaattttgagcaaatatttgagcggatattttacctttttggttactgatcacccgctcaaaaatgtgagcccccacgtgagcatccaccgctgaaagggtgtcgtccaaaacgtacaaatcagcgtccatgtaaactgcacgtgccagtgccactcgggctttttgtcctccggaaagattaatgccctgaatcaaggtttaatttttcgactttatcggtccaattccagccaaaatatatatatatatatatatatgttctgtctttttaacatttggggtcaccttttctccaatttcggtcatgtctcccgctgccaacagtttcaagtccgctttcaacgcacacgcatccaatactcgccaatatttgtcctcgttaaacggaccatcaaagagcacatttcttctcagggttttgttttggatccacggcttttgaggcacatatccaattgaggaagccctcaccatgcatttgctgccctcttcctccacccgttccatttcgcctaaattcaaaggaatatttgacataaaattcccaatcagttggaaaggcaaagaaatgttggacaaactgaccgagaatggcggacaaaagcgatgatttgccactgccgactttgccaacaatgccaaccaatttgcctgcttcaatctcaagcgaaatgtcgcgaagatggagaatcggagtttcctttttggcactttcccaagtgaaggaacagtgacgcaaaatcactgaatggacgcaaaattcttacacaaaaaactagtttacaaaacaaattagtgaggagttaagctaaatgctaattgtcaaacatttaatttagccaacctgaatttgtcgaattttcggatgaataatccgtgccaatttggcgttcgtcagttgtaattttgccatttcgatgttttgccgttttgtttttctcaacgccattcgctgcttggataatgtgactttgctgctgctcatccgcattgagaaatttcaacacgcgccgaatactgacgaaagcttgggcagagtaagaaatggtctggggaatttggtagatggcgtaacgaagcatggcgaaaaacagaagcgaaacgaaagccacgtcgggacgcatcgtttggtggtaaatgatggtgaatgcggagaaagagacgagagtggcctaagcaaaaaggaaaggcaattcatgcattcgagaaaaaaaaattagaaaattttcaaattttatattttgttaccaccccggggcgcatgtatgggagaaaaaggattttaatttggttccaatcctcagcccctccccctcccaaatgatgccaaattatgcaaaggaccgcacaatgagcggagccagcatgaaggacaggttgatgaagacgtcgagcaggaaaatcatccacagatttttgacctccctgtggcgcagttcgaaaatgcgcttttgcatggactcctcccaggcgtacagtttgaccactttgattccaccaagcacatcggtgacaaatttgacacggtcatctttgattttcatttgcttattctgaaaaaaacgagaaaaaggaaggaataaacagaaattaaatggataaaagcgacctcaaagtgagtcatcagtttggtaagaacggcgttgatgggcaaagtcatggccaaaacggcgaaaccgaacacagaactcatccccaactccatccaaagtccgaaacttgcaaagccaatcttgggttaagagagagacaatttcaagtggacttcttcaaaaaattaccatgaaagggcaatagacaaagctgcgaattgtgagccaaaagtaagaaatgcgaaactaaaatggattctgacaatgagacgcaaatgaaatttggaaagaaaaaccaaatccgtggacaagaaattgacgacttcgccggtggaaaaagactgacgagcggaggaggacaatttgaacagcttaaaaagagtggaaatgtgaaaaaacggaaaattgaggagaaaaaccttgtcaagaattgcacaagaaatgatggaacgcaaactgagcaaagcaatgaaagaatcgaagtcgcgacgcgcgagcatcactttgccagtaaaatccacaaaaaagagcacacaaagagcggccatggacagccacaaagggaagccgaggtcaacgaatgtgacgatcactctgcaaagcattgaatggcagttttaattttttttttttttttttttaagaaaaatggatatttttttttaatttcctcaatttacatatttaatgaatttgaaaagggttaaaattcccgtttttcgtaaggcaccaaaaattcaggaaattatattagacacaaaattttttgggccggaagagcaacaaaaaaaaaaagctcttcgagtgccccacccaaaaaaatttctgcttatggacctgctcgcggaagttattatatttttattgtaatgtagaccgattgtaattgatttacctgagaaatacggcgtttgcgtaaagacaaaagacaacgagaacggacagcaaaatggagcaaatt

SEQ ID NO: 4969 - DNA, 1626 bp, Heterodera glycines
aaacgcagcaaatggtcaaagaaagcacaaaggaagggagggacctgtggaagcgtaagaggggggccgaagaggagaagggcatggcacgggagcagggagacgaggcggaggaaccaggcgatgtgcaaggggccggagctgacgaggccagcccggacgcattgagcataagcaaaagtcgaacagagctaaacggggagacggaatgatgaaaagaaacgaaaattggagagaaagggaagactaaagacatacggaaaagacgagatcgatggtcgaaccaacacgttgttcgggaagggagatgggcagcacgaagaggaggagggagaagcgaaggagcgaaacgaacaagtcgagcgtggagagggcctgaaggaaaatgtgccgggacattcattcaaagcaatgcgcacccctttgaggatgatcagccggttaattgggaggggaatggcattcggacgaaagagccgcgcgtaaagaaacagacaaagcatcgagaagacggagacaacggctgggacgaagggaaagacgacattggccagacagggcgagacaatttcggacaaagtcgaatttgggaagacgggagactgaacggaggaacggaatatttggagggagacggaattcaaacgcactatgacaggagaggaacagagaaagggcggcacggaaatggggctgaaggcgagcggatttaacggatgcaaaagagtaaccatcaccaaaggacctaaaaataaaggaaaacagaaaataataattggtgttggctcttcatgacaaatatatgtatatatacacaaattcccttcaaataaatgtacgtagccaaggaaacggaaaatgatgacaatttgcaacaaaatatttttttattaaaattagtttgaattaattaaaataataaaattgggggtctttggcgccacgacgcatacataaaaattgaaaagttgaaattttgaaggttacagtccaaaaatcgagcttacgttaaaacgtgggagtcaaaaagaccagttcccaacgagaacgaggaaaacacatttattaattgatttccatagtaattgaataggtacataagtagggcgtgtaattatatggaaatccatattttttcctggattattggaggactgaaacgcacgaaaaacatgtttttagcttggtttgaagcttctaggatggatttctatatccattttttccatatttcgcgatttatgtccatatttccatattttggcattttcgtccatattttatgtccatattttgggatttttccaaaaaacctctattagaacggccccagcagctaaatttgcctttttgagcccaaaaaccggaaacttttacaaaaaattattttttcgctaaattttctcgacaatattgaataaattcaaattttcttagaaattaataaatttatgtcaaatataagcaaaaaaacgaaaatttcgcttttcgggttgatttttcgctaaaaataagtaaattttagcttatcgtgttttttttcttctaaaatgatttttaataccatatttagccatttttgaaggtaaggtttatatttaacaaatttaaagaactttgggaaat

SEQ ID NO: 4970 - DNA, 1567 bp, Heterodera glycines
ggcaactcacaatcagttgattgctgattgggggggctttgcagttcgacgacgcgtttatgaacacgcactatgggtcaactccactgtgcagagaaaagcctagtactatttcgtcgttttctttttctttgtaatttctctctgtttggcgtactatctctttattttaattatgtaaaaaacaacatttacttctctccatataactttttttctaatgcatacagttgcaccaaattttgcataccgatagagaaacaaattctgcatttttcaatcgcttttttaaacaaaacaatcgcttagttcaatagttatagatagggatgccaaaaatatgcatataaaatcgtaaaatatgcgcataaaatatggaccaaaaatcgcaaaatatgcacataaaaagtgaaaaatatgcacataaatttttccaattgagggtataatttctcaaaatttcttcaaattttttaaacataaagtaaaatcttcaaaaatggctaaatgtggtattaaaaatcattttaggagaaaaaaacacgatacagcttaaaatttactcattttagcgaaaaatcaacctgaaaagcaaaattttgcttatttttgacataaattaaccatttttgagaaaatttatttattcaatatttttcgtgaaaattttgctaaaaaattattttttggaaaattttccggtttttgaggtcaaaaaggccaatttgtctgttgggggccgatctattagaggttttttggaaaaacgccaaaatatgcacataaaatatgcacgaaatgccaaaatatgcacaaatggtgtacggacatttcgcctactcgacatcatgacagtaggcgaaatgaccgattttgggttagtaggcgaaatgaatgtttttggcttagtaggcgaaatgtcgagtaggcgaaatgtcatgtagcctgcacaaatatgcacataaatcgcgaaatatgcacaaatatgcaaaatatgcacatggaaagtcatcctagaagcttcaaatcaagctaaaaacatgtttttcgtgcgttttcagggctcccgcagtccaggaaaaaaaatatgcatgtgcatatttttggcatccctagttatagaacaaaacataaaaacatatttctttttctctctttttggcgtactattttcatgtctctagcacatgtaaaaatcgaaattcgcaaattctactagttttggttagaagagtacaaaaccactttggacttttaaaatcaataaaaaagtgattagtttccgcattttggttgaaaacagcggcctcggacctgagttataacgtaatgaaaattttaaattcccacaacttttttcatatgagttaaattgcttagcatttgcttagaaaaagattctccttttcaaaatctttttttagataccaattttgttcagtttagttggagatgaagcgagttatggaagatcgaaataaaaaatacaaaaaaggcatttaccagtgtaacttttgaattagcgcgaaaaatttacgccaattacgctatttggcattatgagcaa

SEQ ID NO: 4971 - DNA, 6474 bp, Heterodera glycines
gtgccatgttacaaatgtttttcttgatttgctgtccatgccttcggtgttcccctcaaatccgtccaattccgtcaacatttggttcaccattcgatccgtcacgtgcgaattgtcactgcctcgttgcggcgcaatggcatcgatctgacaaatttaatgaaatctctaaaaacattaaatacctcatcaaaaatgatcaacgccggctttgatgcctttgctctttaaaagaaaagttaatggataaaaaagtcaaaattatcacttggcaaagagttggcgaatgttttgctcacttttgccaacatatttagacaacaattggggaccctttaatttaattggtgggcactcttaagaaaaagaaaattcaccctaacactgaacacagtggctcccattgacccggccaatgcccttattaacatcgatttgccacatccgcttggcccgtgaaggattgcgcggtgtcccacgcgaacgccagacaatccaaaaagggatggatactgtaagaaaacggtaattgcaacaaaaaagaaaacaattagtaccctggcaggccaaatgaaaatttcggtcaatttgcttttaacggactccaatccggcgatttggtcaaagcgaatggacaactctccttcgccgaattcgttccgtttgcaaatgtaagcgacggagagaatgtcttccgacgattctattgaccggctaaaatcgtaagactatgaaaatgccccaattcacccgcgggcgttcgatttgtgccaattcgcaattccaatctctccaccaaacggcacagttcaccgattgtgccgaaattcgctgattcaattcgcagatctgttcgcattatgtctccgtgcattgataatttgttcaatacttccttttgtgtgcatttgtcttgatatttgcgtattgtaaaacaaaataaacaatcctaattaacgcccaccgattggaccaattcggtgcgtctcccacttcaaaggcggtccttcccatgccgaaatctcttcggacattttaattccgccagaaatggcacaaacaattggcactttccttcgtcggaattctccaaataatctgccgaatatttctgaactatacacataattctcttgagttgttggtctttgccactttggtaaatcaaacgtttcgtctgttcttcgttttgcatcgacgaagggtcgcctccgttagaaaatttcccaatacaaatgtcaaaattatccagcaaaaggacggaaggccaccgattgactaattcagccatcgcagaatcaacggaatcgacaaaacgaagaagcgaattcccttttaaaggaggaaaaaatcaaccgaattcaaagaaggaccaaaaattcgcatttcgaattgaaaaaatggcaaaagaaaggccggactttggcattctttttttttgatcgctcaccagcatccgaacaatcgacaatatccgctgcgactggtacaaatgcattgtcttcgtcagttgttcgcagtttgctcataagttttgccaacaaagttgacttcccactgccgcacggtcccttcaacaaaagtgccaatggcaccaccgcttcttcgccggcactttgaccttttgcgccaacaacggaaggtaagcagcgacagcgcaaaaacgttcgaatggaatgcgaaagagaggaaagaacggacaattgagcactacgaaatgccaaaaagggaatgaaagacgacggatgaaagacccacgggaaatcgaccatttgcacacacttttgatggtattgcgtcattgcttcatctttttcattggcttcagaatgactttcatttggcaaatgccaattcatttcttcgtcattctgaacaaaatgaaatgacatttcgaaattaagcattgcttgaccctgaattttatggtcattttaggcgagagaggccaaaaaagacggtgagtcccaattcgatcgttggcatttaaacgcgttttctcctcatcatccattaatttcagaacaatttgtttaatcatttctgaatatgtatgtacatattattattgagtttttaattgatttgttagtttttactgttttggttcagcttatcttccgtttcaacttttggtaagtgtaaattccaatgggatttatcacgtgacaatagccacggagcgttcaattgtcgggcagaagcaatcaaatccatgaatgtttgtttgacttctgccaaatggacgcgacttgttgaaacgattaaattgtcaatgttcttgagctgatctgatgggattgggcgaagtttaatccatcgcaaatcagcagagcgagaaaaaagacggctgagagactgagacagccaacagtggatgaggccggaagaaaggcgaaatcgctgaaaatggcagggcatgggaatacaagatttaaatgaatttgctcgtttatttgctccgctgattgactgattcacccgctgatcacctcaatttgaagtgccagtcgttcacagaaatgcccaaatggcgtcgtcgtttgttgcccctcttggggaagtgtgacaaggacagcttcggccaattgactttctgttgtcccttctccatcgtcaaattgcacacaaacgcaacagaagcgaatttcgttcgattcgctcttttttatgagtgttccatgaggcagaaaaatgaacggaaaagtgttgagcaaaagacgaagtcggcggtgagaagagaagaaagggtttgaggaggaggagggggcgagggggagaaagcggacgatggaacagcaaagggcccgagcagagacatcgaaatgggcagcagggactgaaaggaggcaacgaattactgtaggacattcagcagcgtttactgtaagatcaattcgatgagcaaaaatggatcgaatttgtttctagtgatatatgcgattctgatcataacacatgaaacccacccatcgatgagtaaaaacagtcggacacttcggaaccaatccccggcacaaaagcccttccaagtgacgccgtcccttccgccgccctttcgctttcttttcgcattccttttacgtttccctccactaatttctcatcagatgcagcagcagaatgaggtgcattaacgagaagacgagtgccataagccatcagaaaagcgggcggatgagaaaggaaatttccatttgcgaagcaattggccatttgaacgcgggggagaatttctgagcaaatgctaataatgttagtcgccgaatgttgcttttctcgccccaatacctccaatggtaaaattggccatttgcccatttttaaaatggacacaaattcgcatattcgtctgaattacgcggagctgtccgaggaggagttcttctatttgttcggttgaagacacctttaaatagctgcaaatgaaggcatataattccccttttcatagaaacattttgaaatttccaaaaaacttacaattttttcccagtcgccgttatccaaaggattaatcacaactgattcacaccgatttaaagcattttcagagagcggatgtaaaaataccttaagctatgcttttacattttaacaaacaagaaatgggtaaaatgttggtcattggatggaagtcgaacccgcgtctccacgcttccgtgaccattgagctaccgagattcgagtccggaaccgggatttcgttattcagtcgggatttttgcactaattcaaaaaatattcaaggaaaaaaactgaaaataaacaaaaataggcaaattacgttccaagtctcaaaaccaccctttattggtctaatctaagcccgctagttttccacttgacatttggacagactaatcttctcattttttatttcgcccaccttttctccgtccttcaatttattggcactggcgaacgtcccattcaaagaaaaagtttgatgagattttgaagcgaaaagagacgatttgtcagcaaagaaaatttgcataacaatggcgaagtcgatttcatctgaccgaaatgtacgaaccaaaaagaaaccgtaatggccctaaacgaaacatgatgagaatgacagatgttctccattttcggacaaccgacaagaacgacggaagagccgaaaccttcacaagaattttgaagatcatcgaacaaactgccgaaacaatttctaattgaattatcgcaatggagacgagcagtgattggagacaatgaaatatcatgggaagtgccaacagttgggtgggtataatgcatctcggaagccctataagaatatatgtaagtggtaaaaatctaattattttaggacgataattgcaagaaccacattgacgaagcccactctcctgattgctttaaaaatattttttcaagctatttttttttctaaattatctgcaattgtccgtccgaaaatgtccaacttcgcctgttatactgcaagaatacccatttttttggccaaattatttacaaagcataatgctattgaattcttttattatttaaatttttagtaaaataattggccaaatgttttttgtcaccaaaagttagccaagataaataacttttatgtaggtagtacaataaacatttaaaattatgccacttttatacagttagttggggtcgaaaaccaaagggggatcattttgatttgcaacaaaagattattgcatatttaaaggtggttgattatgaattgtgcaatttatttttgtcatttgtgactttcaccaaaaaaacttatgtttttagtcaaaagggggtccgtcctttagtgtttaaaattttgacagtttcaaaagaattaaaaaatgaatgaatcaaaataaaatttagccttaagggagcatggctctagtgcacttagacatccaattggctttttggcatccaaccgatgacttccttcagtttctttggcataacttttttcttgggtcagtgcttggatcaaacgaagcttaaatcaataatttataaatacaagaaaagagagcaagaaccggtaataccaagaatgtaggtattgaccaagtaagaaagatgatttaaaaacaaggataattttgattgtacgtctaaagtgcactagagccgagagcgctttggactgatataatttattacaaaaacctaacgtttaagtgtttacccttcgtttgatatgtaatttctctaaataattaaaaacgcagtttttaagttttattttctaggtcacaatgagtaacagtaatgacagtgacgacctaattatttatgacgacaatgaagacattaaagacgtttcatccgattcgggtgacgaagtagcgatggaggaagtcaccaatgcaggcacttctacagctggggccttatctaacgaagaaatcagggactaccaagtagagtttcaagaaaagttcacaataatgacagaaattacaggtgctttctcagacggagttggtcgacgaactgaataagctttcatctgaaacttcagcagtgttgcgtttcaatggctcaatttgcaaggtacttcttcatcacttcaaatggaacaaagtcacactaattgagaggtagctaattttttttattgttgactcaattaatatccagattcttcgaatttcctgagacttcaaacaccgattcattcttccgcaatgcaaatcttctcgatcctacaaagcataccaaaatcgagggaaaggttgattactgcaagatttgctacgatttaagacagctgactggattgctgtgcaaccatttgttttgccgtcagtgctggtccaattacttgtcgtgcaaggtgcttaaacaaaaaattaaccactaattgtttattatagattctcggcgagggtcgaccttatgtcacttgtcctgaacttcgatgtactattgttgcggatgatgaatttgtgctcaaaaatgtcgacaataaacaagcgttgcgttcctatcacaaattggtcctcaactcttttgtggaggttgatatctttgggagcattcagctacaaattttgtttagtgtaacaccttgattaaatggtgccccgctcccgaatgtggtcgtgctgtcaaagtacctcattcagaaccgcgcaaaattctgtgcaaatgtgggtgccttttttgcttcagctgcagccaggtgggcgtaaaactttattctaattgtaattttatcattttttattctacagcaatggcacgagccaataaagtaattgggattcactcgaaataaagaaaggaataaattatgcttttagttgtgaccttctcaagaagtggcagaagaaatgcatcgacgacagtgaaacatcgaattggttgagtgccaacaccaaggactgcccgcattgccacgtgttttatttttataaaacaccgtcactcattagaagaggtgaccatcgaaaaagacggaggttgtaaccacat

SEQ ID NO: 4972 - DNA, 3488 bp, Heterodera glycines
atatttgcactactattcacgcttcactaaccaccagaactctctcaaactggagagaaaggtaaattcattgacacttatattcctattgttataatttagctctttgaaaaagtgagcgaaaaaatggaacaaatgcaggtcagacgttgaaaaaagcaattctaaattaaaaaaatgaatttctttaaaggtgctcggcttttcgtggattgaaacgcagtttttgcagaaggcggttgaaattcttgtcgaatgccggcgtactttgatgtacacgtaagtttcgtaaactaaataaaggtttaattcgtattttcagttacgtgttcgccttttaccttgtccaaaataacatcaccaaaatgtttgaagacaaccaaagtgacctcgagctggcgactgaacaagtgaattttaatgttagttaattgttgtgacaatgtttatgttttagttgagtgaatatttggagagagagcttccgaatgagaaagttgctgaggtcaaacaaaaggtgcgtttgttttctttactttttctacttcaattactgtttcaggtccaagacaaataccgttacgtggaacagcgtcgccaaattctgctcaaacattgtgttgagggacgcgagcgcaacgaatgggagttctgtcaggccacgattgagaacaaaacggactttagagggatgtaagaactgcggggggcgtgctatattcgatattctaattgcggagagttaaattgccgctatgtatcatttctatgaacaccttaatggatctgtcaatcaatgtttctcacaatgtcttcactgttcttttcaatgcatatgttatgatgcactaatgcttttcctatggcatgaatatattcaggagtcctctcacttttggcagtttaaactaaaaattattattccaatgtctacttttttaatgtgctttttgttttacaaaattcgtagatgggaaattactacagtcctcctaaacgagtggggcagaaccctttgtaagttgtttcttccctaaataaaatgaccgagaattatgcagcactcgttctggggcgccgccgcctaaattggtcattaggaaggacaaggatgtgccgatgcaccgagtcaatgacccggtaagagcaacaataactaacggattaggctttagtccaaatccactttcttgcccatatacgcgtgcgcccacccacctgattaaacaattggaatatgcaatatttctttagatgagtttgcagctgcatatggcgggtattaataccctatgctatatttgaatttgaattaccacagatgaacgcgttcggactgcgggactctcgaaggcggagagagagtggagagagtgagtgacaattagaacttcctccaacaaaaagttactcaaatatctattttagaaaatgggttcatgaccagagtatgcatccggatgagcctatccatgtcgacgcggtccaccggtagccatttgttctattttatatatttaaaaattattaacccaatcaaatgtatcttattagaaaaattcagccaactgaatccaatcagagtgctttatcgatggccaatggataagctttacaagcatttcttgcgaccaacttttgggaattactgggcaacgattatccgtgtctatgttcccaagttcttctggttctttatgacattcgaatttttctactacgtgtggaaatacgaatcgaaggtgcttgaaatttttattttctttaaataaatgccataaatatggtaaatgtttattataattagggttataagttatatgcactaaaaaatgccaaatatgcactaaaatatgccttaaaaactgccaaaaatggcttttagccctcaaaaaatgccaaaaattgtgtataaattaagaattgacttttaaaacaccaaaacaatggctaaggagcattttttagacaattgcaaaaatattgaaatttccaaatttataaattttattatatgctaaaacaacattacattttacatatacataaattttttttccaaaatttcttacaaaaatttaaaattttttcgatttttaagggcgtatttttaaaaaaattccaaaaagtcgatccttaggggtgtatttttcgcttttatcgcatttttcttatgaaaatttccaaaaaatgaccaaaatatgctctaaaaatgcaaaaatggtcaaatatgcacttattctcaaaaaccctcaaaatatgcttttatatgcactaaaaaccttcaccaaatcaaaaaattttaatgcagaaatgctatttttgagcccctttcttcatagcatatgcgcagaaaaaatatgcaaaagcatataatttacaaccctaattataatcattgcagagttggcaaaaacgaattggcttttccactatcaatcgaccggatcgttatgtgcttgtcaaagaccacgatgaggagacgcttaagcttggcctgacagactacagccgatctgactattttgacaaggaattctaccagcgcattaaaacggccaacatcgacttcggccccccgaagaggccgtggtgatcgctgcgatggtggcaatgcccattcagaagagagaggcggaatagaaaaatgaaattaggttatgatggcagcattgttggatttttgtttatttctgtaatgtatggttttcgataaaagtctggacagcgacttcctttgtctaaaaataaagggccagaattgttccttaaattgtttgagttttttatgttcctttttattcacttcaatcaggagcttacttatgctcactcatcggaaataccgtctcttgcaatttgcatccgtttctggtcgggcactaacaataagtccggaattcaggcagctcagttctgtttcgtccatcccatctaattcgcataaaacctcaaagtcagatggaaaggcgcccaaatcgagcactctttgggtcagtcatttgttgtcgtgctttccagcagatcttttgttgtaatttcagcttaatttgccctccaatgctgaagaggatgtgcgaacacgtgttcggagctctttcttcggcacttacgtcgctttggtacattttcgttcctacttttttcatataaaactagtgttggtatcctaccttttttcgatttaataattgtgtttcattcatcggcaactggcatttttcgtccattaatttgcataatttccccagttattcccagccgccacttttgctttgggttgttggcaatggaaaaggcacaaatggaagaccgaactcatcgaaaaactgaaaattgcaacaaaaactgcacctgtggaattccctgtggacaagtgagtcttccggagcaggacaaaacatcgccgggaaatatattccaaaatttatgaactaacaaaacatggtatttttcgcttctcacctttaaaggtatgattggccagt

SEQ ID NO: 4973 - DNA, 1851 bp, Heterodera glycines
  misc_feature (44)..(44): n is a, c, g, or t
aaaaggaatagattagtcgttattttaaaatactgcaaaactangatgtctatgacaatatccttatacttccgattcgcccatatttatggatatcattgttgctgctaacttttatctctgatgtcctcataaataaattagagatccatattgacaaaaaattatcttataaatgattgtcacggttggaagtaaacagttgagtcataataacaatggctgagttcctgtaaaaatacaaaatataattaaatttattataacccagctttggaataaataaaggaattttttgcttcgtgttgaacgcgcctttgggttcctataagcaggaagccttcagatttagccagaattgttcagcagcgaataattttgcatgttttttcgttttttattttgtagcctaagacaaaaggaatagattagtcgttaattttaaaataactgcaaactacgatgtctattgacaatattccttatactttccgattcggccatatttatggatatcattgttgctgctaacttttatctctgatgtcctcataaataaattagagatccatattgacaaaaaattatcttataaatgattgtcacggttggaagtaaacagttgagtcataataacaatggctgagttcctgtaaaaatacaaaatataattaaatttattataacacagctttggaataaataaaggaattttcttgcttcgtgttgaacgcgcctttgggttcctataagcaggaagccttcagattcagccagaattgttcagcagcgaataattttgcatgttttttcgttttttattttgtagcctaagacaaaaggaatagattagtcgttaattttaaaataactgcaaactacgatgtctattgacaatattccttatactttccgattcggccatatttatggatatcattgttgctgctaacttttatctctgatgtcctcataaataaattagagatccatattgacaaaaaattatcttataaatgattgtcacggttggaagtaaacagttgagtcataataacaatggctgagttcctgtaaaaatacaaaatataattaaatttattataacacagctttggaataaataaaggaattttttgcttcgtgttgaacgcgcctttgggttcctataagcaggaagccttcagatttagcccgaattgttcagcagcgaataattttgcatgttttttcgttttttattttgtagcctaagacaaaaggaatagattagtcgttaattttaaaataactgcaaactacgatgtctattgacaatattccttatactttccgattcggccatatttatggatatcattgttgctgctaacttttatctctgatgtcctcataaataaattagagatccatattgacaaaaaattatcttataaatgattgtcacggttggaagtaaacagttgagtcataataacaatggctgagttcctgtaaaaatacaaaatataattaaatttattataacacagctttggaataaataaaggaattttttgcttcgtgttgaacgcgcctttgggttcctataagcaggaagccttcagatttagcctaaattgttcagcagcaaataattttgcatgttttttcgttttttattttgtagcctaagacaaaaggaatagattagtcgttaattttaaaataactgcaaactacgatgtctttttcctcccccccccccccgaaacgaaggtcctggctacaaccttgatctcatttagctaaacccacctgacaacccgagtggagccatcgcccgacgccgcccaagtcaaagcgatgagc

SEQ ID NO: 4974 - DNA, 1855 bp, Heterodera glycines
  misc_feature (141)..(141): n is a, c, g, or t
tttttggctttttgtcactattttttcacttttcgacatttttgaaaatttgttaccaaaaatgcaataaaaacaaaaaatacaccccttaagaatcgacctaaaaattttcaaaaaataccagttagaatttgaaaattntcataaaaatttttcccccaaatttttcttacaaaatttttggtttaaaaatttcaatatttgctaaaaaaaaatgtaagaaaggaatgtcatttgtaactgcaatcagtgaataaagatttttttgctcaatttttggctgaaaattatgtcactattcgtcactattttggacttttttcactattttgtcactattttggcactttttcgtcactattttagttaactatttcgggatttttcgtcacaaagtcggttccctactaataactagtgatgctcgagagcaaaaatttcccgagaccgagacttgaccccgagactcgagaccgattccgaacttaatcccgagactagataccgagaccgagacccaaaaaacccgagacttttctcgagtcgagaccgagactttctccaaaaaattttcttacacactaaaaaatcgattaaaaatgaatcttttgaggttttttctcataattttttgcattttaccttatttaagctatcccatccattttttttttcatatgattgacgtctttacaccattttttgtggtgctcatttttcccggcggtgcagataggcgccgccggggaaaatattgaactttttaatgcactttgtgaaaaaaaatccaaaaatgacatattttaattgttaaaaaattgtgattgaattcccatcgaaaaaactactaggtcgttgcataaaaagttgccgcttatgtttagtgtactataactattttcgtttttattagaatagactaatttgatgtttattcgatacattaaagtgttctctacattttgataccaaattcattcattttcatgcatttctaatttatttatgcttattgtaatggccgctgacaaggaaaatatccataccctcttacacattcaattccaacttggccacaaagtggcccaagcagctcgacatatcaatgaggctgttggagctaatgtttgcaaagaacgaacggctcgacattggttccagcaatttcgcgagggccgcaccagctcaaaacgcaagggagggtcggggcggccgctgatggttgacaagaacgttttggcacagcggttgcgacgacagccggacagttcaagtgcagaattgtcggcgcgacattgccacaaaacaacagcatggcgatggcttcgaaagtccggtcgtcggccgaggaggaccaaatgggtggcacaccatctgacggatcaacagaagcagcgacggctggacctgtatctttcgaacatcgccagacaccgaaggggccatgtgctcaaccggattgtcacttgtgatgaaagctaactacatatgttatgacggcacaacgcagaaaattgtttggcggaagaagaatgaagacccgattttgacagatagtttcggttcctgtcctttgtccttgttaattacgatttgtctccaaattgtcaattcgcttttgccattgaaatgtttgtccaccaacgcattgaaacgtggcgaaagaagtgccattttgaggccgagttgaggacggtcaaaggatgggaaaatgtccatccaaacgtcgttgcaaatccaactgaaatgggaaaacagtttagtcaaataaacgacgaatttgtgacttttaaaaattcattaccgtcggttcatttttgtggcaattagcacaattggacgagttccgaatgat

SEQ ID NO: 4975 - DNA, 1162 bp, Heterodera glycines
  misc_feature (833)..(836): n is a, c, g, or t
  misc_feature (839)..(839): n is a, c, g, or t
  misc_feature (842)..(844): n is a, c, g, or t
  misc_feature (849)..(851): n is a, c, g, or t
  misc_feature (855)..(856): n is a, c, g, or t
  misc_feature (864)..(864): n is a, c, g, or t
  misc_feature (866)..(869): n is a, c, g, or t
  misc_feature (875)..(875): n is a, c, g, or t
  misc_feature (881)..(882): n is a, c, g, or t
  misc_feature (887)..(887): n is a, c, g, or t
  misc_feature (889)..(890): n is a, c, g, or t
  misc_feature (899)..(899): n is a, c, g, or t
  misc_feature (903)..(905): n is a, c, g, or t
  misc_feature (909)..(911): n is a, c, g, or t
  misc_feature (914)..(917): n is a, c, g, or t
  misc_feature (921)..(921): n is a, c, g, or t
  misc_feature (930)..(930): n is a, c, g, or t
  misc_feature (933)..(936): n is a, c, g, or t
  misc_feature (939)..(942): n is a, c, g, or t
  misc_feature (944)..(946): n is a, c, g, or t
  misc_feature (949)..(952): n is a, c, g, or t
  misc_feature (959)..(959): n is a, c, g, or t
  misc_feature (961)..(962): n is a, c, g, or t
  misc_feature (964)..(969): n is a, c, g, or t
  misc_feature (976)..(978): n is a, c, g, or t
  misc_feature (984)..(984): n is a, c, g, or t
  misc_feature (988)..(989): n is a, c, g, or t
  misc_feature (991)..(991): n is a, c, g, or t
  misc_feature (993)..(994): n is a, c, g, or t
  misc_feature (996)..(996): n is a, c, g, or t
  misc_feature (998)..(999): n is a, c, g, or t
  misc_feature (1001)..(1001): n is a, c, g, or t
  misc_feature (1015)..(1015): n is a, c, g, or t
  misc_feature (1018)..(1019): n is a, c, g, or t
  misc_feature (1022)..(1022): n is a, c, g, or t
  misc_feature (1026)..(1026): n is a, c, g, or t
  misc_feature (1028)..(1029): n is a, c, g, or t
  misc_feature (1031)..(1031): n is a, c, g, or t
  misc_feature (1033)..(1033): n is a, c, g, or t
  misc_feature (1039)..(1039): n is a, c, g, or t
  misc_feature (1041)..(1044): n is a, c, g, or t
  misc_feature (1052)..(1054): n is a, c, g, or t
  misc_feature (1056)..(1057): n is a, c, g, or t
  misc_feature (1063)..(1063): n is a, c, g, or t
  misc_feature (1070)..(1073): n is a, c, g, or t
atcagaataattttcaattttgttattaataaaaagtaaatggtagaagaatggtaattagaaacaaaaaagaatcatcgcccaactcaatgaataaaaacgatgaatgacaagaaagaaagaaatgcataattgttaaaagcttttaaaaaaataaattatttaacttttattgatgaataaattgatacaaaatgcttagaattgtcgttcatcaatgtaagaaatagaactaataatattgttaaatcaaataattaacaaaattgttaatatatcaacaaaaaataaaaaatataccgaaatactttaattgacattaattgctaaaaattaatattgaaaaaagattataaattttatttagctgtataatgcttgtatatattaatttgagtgggaacgaaaagctgaatctcacaaacgcgcccacctcaaactggcacaagaaatcattgaatgccaaaattactataaatgcattatgaaaagttaacgctttcaaaattgtagcaatataaaaaacaaataaattcataaaattaataatatttcataattgtttatattggcaaatgataatattatcattcgttaattcacttgatagatttcattatttatgttaaaatctcctcaaaaaaaacaaattcgaaaattatttgaaaaatttgaacattcatggaaaggtaactagacgtacggcatcttatcctgactagtttaaggccattgaaatataaaaataattcgttaatgtttttagagccgcaattttaaggagccaactcactcatctaacattgcttctcctccagtccgctcttttggcnnnnccnttnnntgcgnnntttnnttggtttntnnnngctttntttgcnntgccngnnctttttttntttnnnggtnnnttnnnntttnctgctttgnctnnnngtnnnntnnnttnnnnccttttntnntnnnnnnttgtggnnntccctntttnncntnntntnntntttggtgttttcgnctnnttnttgncnncncntttttntnnnnttgtttgnnntnntttctngcgttcnnnnctctgttcaggttgcagattacaaaaattgcaaacttgttgcacctcagtagaagagtgctgattattaaaaaaatatattaatgaaaa

SEQ ID NO: 4976 - DNA, 6354 bp, Heterodera glycines
taattgtccactatatgctgcaaagagtgtgacgtcaccaccgcgaggggtacggtagtccggtgaaaattcgcaataaattctgccgcaggcaagcggattcgaacttttgctctgccaccaaaaccaacacacaaccactctgccacgcgaccagttgccagaaaaaggataattgtccactatatgctgcaaagatgatgacgtcaccactgcgaggggtaccgtagtccagggaaaaaactttgaaaatacgcaaaacaagacaaaacgccacaatatatacataacgccataatttattgagacgaaaacctttcgcattagattcaaattcaaaatttggcgggaaaagtggcttggcgtcgttttttttgtttctatccttaatcctacccttttttcaaaatcattcttatcttctttcattatttattaacatgaatattttctgtttctgtcttttacaatgctgtttagccaaaccaactatgaatttcaacaatttgactacgccgattgatgaacaaacaatgattgaaagcctgtctttggatgaaccatcaaacgagctacgatctgttgaggttaacctttattaatattatcaaatagaaagaatattttagaaaatggacgaagaactgaacaaaaaggaggagccgttcactctcgccgaatgttgcacagcatttgatctggttgcggttatgttcgactgcaaaattccggtgccgtacgaggaggagcagaagcgttacgtatacgagcaccaggacaagccgcgtttcatctacatcaccgaagatggagactagattgagttcaagggaattgtcaaacagtttggatacgtcctaagcgttgagactatctacttcgacaaagaaaagggaattgatgaattctataacttcctccgtaacaatgtcatgtgtttcttcagtgttgattcataaagtgaattgaaatgttcaattatttagcgtgctgtttactgtacaaatatttcatattttaattttcctcaatcttattttacgatttttattgaaaaaaatgaccgtcacatccaactccgaattccgactcatcgaatgtgtgccaatccttgaggaagttgctcgtgaatttggctgtattacgccactaccaaaccttgggcatgtttctttcgttttacaacactaactccagcatacagtagccatcgtgactatcgtgtaagcggatgtatgatgattcgcacgctgacatcgttgaatcgactctacattttcgatgctgaagactgtattgaggttaatggaaaatatgtttcatattttattgctattttaggtgaagggtttcttaaggcaagaggacggcacgagccaaaaatggtcaacgaatattatgaaaaatatgatggactaaatggatttgctgaatttattcggaattgggcctttacctttttctgtttacatgcctttgatgatgacgacacatctgatgaagactaatttcgttaatatttattgtatgctcttggttacaaaccgataaacaaatccatcagggttatttgaacgatttaaaatttgcataacattttcgaaacccaatccgatagacataaaataaacgaaagtaattacatagtgaccacaaacattggacaacaccgattgaaaccgcgtcttattatagtaaatgtttttaaaattatcggataaatattttttgatcaatctgataggcatctctccatatgagtcaaagaagtaggcaacagcaggagactgtgcccatatcgcacaccaatgagttcccggcatacctgcagggtcctgaatggaaatacgatgagcaaatgaagcaaaaattaagcgtaccaggttaacaatcagactgcacggaaattttgaacaccttggcaacccatctgcgggatatgtgccgctgaagtaccttttcgtcgcaggattctcaaagagaagtctgtcgatgaatctgttgtccattacgaattcttctctctcgcaggaataaataggtgcctacggctgccgcccctgccgcaccgaacagatacacaagacagaagaaaaagtttattggcgacttctcaataacatcggggaagcacatcactatcccgtccctcggaggcgtgtccatcagaatgttttcagaggaataattctgactcatactgtgaggtcactagtgatcgaacggttacgatcaataagaatgagcccgtctgcctctccgtacgcaatcaatgtaactccctcgttgggtactgcttcagtgaatcggatgttcactgcagtacagccctctttgatcagctcaaagcctggcgagtcctcctgcgcgttggtcatttggaagacatagaggcaatgtgaaaaaacatatttattggacaattgaaaagatacctcttataattcgcaaggaaaataaattatttataattaaaaatttgtttaataaaaattataaaaaaatgattaaatataaagtttttaataaaaaaaaattgtacagccttcaattcgaaaaagaattttaaaaattataaaaataaacgcaatttatggctaagacaatccctaattaaagaaaaacgaatatacaaagtaacatttcgaaatgcaacaattaaaaaagagcaaaataatagaaaaatgttaagaattttaaagaaaaagatataatattatttgttaaacaataattattaaattatatataatctttagaacaataatattatttatttatgaaaaatagaaagaaagcatttcatttttacagtgtattaatacaatacacttattgcttaaattaatattcttatttttgctataatatggattcattttttaaatgggattgaaacttttgataaatatctaaaaatcaagttaaattgacaaagctttatattaacaaaaataacttatattatgtaaattaaacataattacagcaataaattgcaagatataaaattattattatttttttaatttttactaaaagatgaaaatttaaacataattcaaaataacaaaataatactattaatatattcatatttatacgaaaattattattaggatcaaatatttaatgaaaaaatataaattttaatatagtaagaatatttaaaattgtaaatgtatagctgcaaatttatttccataacactataaatgcaaaattcataatcaagtataaaagtaaagaataaaattgaagaacattttgaaaaacaaaagcaaaaaagatgcaaactaattaataataattgaaaaaatgcttgtataaaattattaatcattcattttttacttattccaatttttatttacgttataaaatattcgagatttcgaaaaaatcaattattttgaaatgaaaagaaataattttctgaaagtaactttttacataaaatttaaaattaaatttaattaaaaaatatttttaatttcggtgcataatccaataatttgcttcaaatttagacatttgataggatgaagtttgcatacaaacaatttttttttgcttttatggatttaaatttttaaattattcatattttatacaatgaatttttaagcatagcttaatttatttagtcaactgtattttgtttgaataatttattttagtttcaataatataataaatatataattttttaatattttatttaatttttaacttttatgcatttttagcggaaattcattagatatcatttaaactttattttcgtgaggcaagtttctaattgttccatttttgataatcgtttaaaataattttgtattgcaattctaggatttttctttcatattttagatatattttttaacacttattctatattttgattatattagcgaaaaaacgaaaagaactcgtatttagattaatgaaatggtttgaagcaattttttatttttgccttttttatgatctaaataatttattaattttttttttcatttaatttttggaatcataaaatggaataagatatatttcgcttttactcgtacttgtgatcgaatattttgcgctggttttgaacatcaatagaaaaaataatttatgatgtttcaaaattaacatattttttgaacaatgtttgataaatccataaagaaatcaattttaaaaagtttattatttttataatttaaatctattattttgaatgaaatttagattatcaattattttcattaaataacaaagactcgccattttttttattttttttcattttatctgcctattttttggttttcaaaaatgttaatcatttaacgactgatcaagtagatcttttttcatgtttttcgtgttgtacatgagaacttgatctcgattcgtaccgttttggctcaatggtttatataactaattttcaaaatatatatttccgcatgatataattaaaattttgctcgttggcgaagaaatctccaattatcttaaaaataaaaccaaataaagccaaatttataataaattaaaaatgaaaaaattcatattttctttataatggatagaatttatttaatttggtttttttttaaacacatacaaatattagttaactaaaaaactacaagttaaatagttaataaattccaaaaattgcataaaagaaaaagcaataaaattgtaatattaattcattttaaaaatttttatatagagagtatccgcatagaaaaaaccaatatcatggaaatattattgaaatattttaggatattaatgttacaaatttattttatagattttttcctttataaattgttataaattcattaggttattttaaataagctattttaattttctatatttataaagggtagaattagaatttctcttaataaaaaaactaataaaccctaagtttggtctttttatattattgatgatttatatatttaaatatatttatttaacagattttttggtatatataaaaacatgaatatagattatagataaattgaaaaaatatataatattgatttttggaatataaatttaaaaaaattaaaaacttaataaaaacctaattgcctcaataatgtcttgagcaaaaataattattaattacaaaaattattaaatttttcttattaaaaattaaaaattttatcattaattcgctttttttaacaaccagagtgaaggaggtcttggaacgattcaataaaaattatatgtaaaaattaggagtttatgaattaatttatttcataaaaataaaaggaaaatttctaaaataaatattttcaatttttgattaaatatgattaaaaaattttcgaaaataaagcaaaacttcaatctatatttaataaaattagaaaaaaagaatatttgtagaaataaattcataccgacaaaatatcaaaaattattaaatgcctacaaaaataaacaattttcaaattattaattaacatttttataaaataaattaaaattataaagaattaacatatagatcaacgcaattgttcacgttgaaaaagcttggtgaattaacctatatgaacacaaaataatatctataataaaagtatgcgaattcaagagaagtaaattaatgtcagcaatttttatacaaaatttttaaatacatataatgaaaaattttaattgaaaatagaataccttttcttctaattctagtcctaaacatgaattcgataaagtaaattgaagggttgttctgcgcctccacatttttctaatttttcatcttaaatttggcattgtcgtttgtttttataaaatataattcgaaataaaacccaacaaaattttttggaaattttgctctctttagcttttggttaaatttatttctcacatattattatattttgtaaaaataaataaatattataaatgttgtggaaaatgagaattaaatatatttattacagcattatgcacagaataattatttttaaattcaaatattttatgtaattatttttcttattcaaacggacattttattacttttaatttcaaaataatgaaatttttttgctggctttttttacttaagtaatattttaacatattcatatacatcttatgatagtttttgtgtatttatgtttacacgtttttgtctaacaatcaactatttaatattatgtatatataaaattgtttattacaggagctggtaatcttcagtttttcttcatcattagaatcactctagatacccagatcttcatatttcgctgctcaactaagttgatatatctatctctacatatatgtgggtatata

SEQ ID NO: 4977 - DNA, 3756 bp, Heterodera glycines
  misc_feature (1773)..(1773): n is a, c, g, or t
  misc_feature (1786)..(1786): n is a, c, g, or t
  misc_feature (1810)..(1810): n is a, c, g, or t
tattttatagcccaaagactccaaataaccactgggcatctgaatttagagaaatgcgaaggaatcttatttaaatttatacataaattgaaaatgattagggcttaccgaggtcaaaaactcgtccagctccaggttggcctccttggacagctcgttcacttccatttcgacgtgtgccttttgttggtgcgcctcctccgtgtcgatggtcctctcgtcgtcctctccgtccgttagcattccctcgccctctgacaagtcgcccgcccgactcttttccgagtgactccgtctgctgacagaggccgagtcggccatgtgctcgtgcaaaagtgaggtgattttgtccgctgctcccaccagaaaattcagttgttggcccaatgcttttcgtttcctcgactcaacaatttcctgaacatttccatcgttgaaagaagagatgaacactcagaattgctcacagttgcccgaaattcgacgactttgtccacatttgtccagaattcccttatctttttcgcgaccgtaccacaaatgcgtttggcctccttctcctcctgctccttcttcttaacttcgttggttgaactgagcaaccggtgccattcggccttcgctctgactgctaactgaaaattcccttccttttcgtccgatttttttggtataaaaacgacctttcgggcccactcctttttcgcctttcgctcattggtaaaatctgtcgctatccatcgcacttcttccaacaaataatcccagtgcaatttccgtctcggcgggtcttcgcactttggcagtcgcgtcgcgctccacagccccgcctccctaagttcgcgtatcctcgcgtaaaccttcgcatcctgcaaaagtcaggtggtcagcctatcattcccgtcgaattttgaatacttggacagtctcgggatgggaactgatcagagaagaacttgaagagggctgttgaacaatctcctgaaaggggagatggatttgtcaaaccaatgggactcggaaaagcataattaattcatttttagagaaaaagcaaataaaaacccacagcgtcatcaccaattacaatttcaatcggcttatactgttgatcattggcctctgctgatgttgatggacgactaaaaaagcaaaatttgaagaatcttttgccaaatgttgccttactcatcggcaaccaaacgaagcgtcccacccgacaattcaccgaacgctgctttaaattcatttgtttcaacctcagcaaatctgtaatttgtagagaacggaactcttatcgtcttttaaatttgaattagaagcaaatgaaaattacctttgctcaattgaaggaattgaggaaacagccttttcttgaattgaagacgactcggaacaaaaatttcgcagaagcacctcaaacaaatttggcgtatttcctcccgtaaaatccatgataaattaagctcattaatgttaacctgaattcgaaaaagaaaattgagacaagacatttccctaagaaaaatgtaaaatcgaactttgttaaatagtacataatttggttggtttcgcattgacaaagcgaaaaaaaacaaaggaaaaggaaaagtattcgcagagaaaagaaacgaacgaacgcttaaaagttagagaaatgatggggagagagaaaacaaatggaaaagtgaagaaagacagacacaagacaagacaccacacacagccaatacgacataaaacataacatttgcaagaggtgggagcgcaggnaatacgaaggcanaggcatagaaagcgaatgtttacncaatcagaaggacattatgttaccggacaattgagtacctcccctcggatagtgtttaactccaaacttcaacctgtagctgtatctatttgttgtccaaattatttgtattctccgcttcttcatattctctgctcttttttccattccttacgaattggtaactaaaaatggcaaagagaaaaaatgaccagtaaatgagctaataacaattcgactaaattttaaaataatacagcaccacagagtacacatttgaattttctacccttaaccaatttaatcaaattaaaaaagtaaaaacaaatagtgggttttctttctcttcatcatcgaatattttgagcattagcaattgtttggcttagaggaaatggactaatctccggctggacaagttaaaagggaggacaatcataatggaaatatcttgttagactttcaatattgcacttaagaaatgtattcgtattcgtcgttttggtctgttcgttgtaggtagtatttgtcaatcagcgattcgatgttctttttgatgaactaaaccatttccgaatgcaatttttagggaaacaaatttcaagaacctgaacatcgggaacaaatctcagctgcgactgctttatgacctcttccacgagtgcaccgtgcttcatcactttccctgattattgttgttttttttgttttgtttttttgcccttcccgacatttccgttcttactggatttcattattcgcacaatggcacattccgtgtaatattttctgtcctgttgcactgtgttacatgtcgcttccgcctccttttcctgcggtttgctcggaaggggcaacatcactttgaatttctgccgtttccatgtgaattccgtgttcagatgtagcattgttttgtccgtcaattcctcacccttaacgacagaatttaattcctagaatttgttgctgttagtaccttttcttctgttgtcagaatgctaatgtccaccaaacttctcgaggctctgatcaccgctgggacggataagctgcaaaggaaggcaatttgtgcaagttgttgggtgttttggtgggagaagagcaacagaatggacagctgataaacgctcattgtgacttaacgaacaaacaaaaaattattcattattatgtccccaccttggtataatttgtcaaggtaattgaggtgcacttcggctaaaaaatgatcttattaaggtcgttaattttccaaaaaccggtcgaatttccgtataaccaagtcagcttccttccgctgtgactggtcgtgtagaactgttcgaacagtttgagtgaattttgcagcaccggaggcggcacatagtcagccgttccaagtccatggagaaggacaaattcgctatctgaacaaaatgtattggtttagcaaatcatggcaatttaatttcgaataccaaacgatttgagagcatttttgagtagaatttctggaacaagtccttgtcgtcgatgaagcgaaagatgagaatagcctttgacaaaagtgcgtcaagttcctgctcactctttccccgtttgctgttggtacgcattaatgagataaatgccacagaacggagagtccaattgcggtaatttaaaaacttagagtcgttcaaaacaagttttaggggtcttcagcggctttttcggcaacatggacagttggtacaatttgcgaaccgctgattggctgattgctgcagtgtccaagtcgaaacaggtcacatccgacggaggctcctcgtagagatcaaaatagcttaaaatgttcagcaaacattgtgttaatgaaatgaatgttaaggcatccttcctttttttttaaattttactaaaaatgggtctaggaaataaaatttttaccgaataaaaaggagaagttaccaattttgaccgtgaatccgagccggccatgcatg

SEQ ID NO: 4978 - DNA, 2739 bp, Heterodera glycines
tggatccctgaatcgtgatcagcgaccccgaaaacccataaaaacttgttttgaacgcctttctaagtttttaaaatttccaccaaaaaataggggttaccatcttaactattaccgcggtttgaaaagggaacgacgaaagtccaacgaaggcaagggacgactcaaaaagttgagagggcgaaatggcaaatgcaattggaaatttttgcgatggcatcaaaacaggaaaagcaattttaaaaaattcattaattgcaaaagaaacacggattaattaccgaataaaattaggtaaatggacaatcagagataccgaaataatttatccgtctctaatacatcatctgagaagagacaattacataaaacattcaaaatatatcacgagtgatacattcaaaaaaacagtcagtgaaacggaagaacaacagcaatttctcaaaacatccaaattttccacctcaatcttcggcattaacttcttcgtcagatacagtctgaacataacatggaatagaaaattaaaagaaatcaggaacataaattcatttacatgtgtagggaaaacccaggcaagcaaattccaaatttcaagtttatcagtttttctttgttacctgcgacgtgtcaatcggtgacgttctgcccaagcggtacagacgagccaactgacgacgaatacaaagcagatctaaaaaagatataattgcaaaaattgataaacataaaatatttactttcaatatgggccttgcattctccttcatttgcccttataacgtcatcgctaatgttttgagcatagaccaaaaccgagttgatacaatgaaccaattcgattttctaaattatctttttttattgacaaaaatttgtttattttgtttctgccttggacttgtaaaaacttttatgccaaaaatggccatattttcctagtatttagcctacttttttccttcctgcgttcttgcggattagctcagctctaacccatgaattttgtttctgccacacaaaacaatcataggccttggaaacccgggtgaaggcccatcgaatgtcaaacggaagattggaaatgagttcgaaaagcaattcggatggaattctcccattcttactccccattttttgaatggaaatcatgggagaaaatggcgcattttgtacttttcaaatagaaaaatgaggcggaaagaaaaaaagagagaggccgtgggaaagggataaaaaaggattatagtaaatcatttaagtattttctaataaaaataatgtacaagcgtcatgttaaaattaaatcccttcttacttttgaaatggaagaagaaacgggcgacaggcgacgcttaaaaataatttaaatagtattacaataacttctcagatcgtttaatttcaattataaaaaagacgaaagctaaaattagcggagttatccaatcacttggcaagtaagggcaactgaatctcctctgtattattcatttcccacactatctactatatctctctcttcttttcagctagccttcctccccccttagttaatttagttggatactgtactaattagattttataagttagatgctttttttctaacttttttaatcggcggagtgctcgtgtcgatgcccatccgttggcgcttccattgcttatccccatgatccatccgacggactagcatcagcaaaatgcaatcgttgtgctgcgcccactcgggcaaaccgacaccgtctaacggcaacagatcgacatctgaaagaaataacaaatcacagacggcagtttacaattaaacaatttgttatgaaaaatggattctcagtcagtacaagttaaaacaaacaaaatttttctcacgtggcaacggttcgcccgctttcagcgtgaacacataaccgtctttgattgtcgggtggtcgacaaagtccagcacaccaatttggttttccttgtcgcagaaagcaaaacattcggtgtatttgtccaaaagttgccctcctataaaacaatttttgtaaaacgacatcaataaatggattgagagaaaagcgggaacgaaaacaagtgcttaattacataccttcgggtttgttgatgaccatcatacacaccttctcatcccagctgtccctcagctccaccacgtacttccaaacagcgcacgagtccgtcagtccgatcaaaaagatgcgtcctcctccgtcaccgcttccactctgttcgccttccgacacggttgtcatcatctcacgacccgcttttgacactgtaggaccaccactcacaggtgtgcacgtacagtcgaagaattcttgttccctccatatgaactgtcctctccacacgtcattgttctcaatgtatggaggcgttggaagctacaaaaattttttaaaagaattttaatagaacgttaggggtaatatcaaaggaagaacagtaatttactcccatctgtgctgccagacagacattttatttcgttgttaaattagttccattggcaatattttccctccctagcctcacccaacttttaaaatttaaattatccctggggacaaccagcctacaaagcacaagatgagaattttgtgataaaactgacttaccgacgcttggggactgccttgggctacaaaatgagtggcggcgtcagtggccacagcagcggactccagaagcaacggtgacgaacggtctgattcggccacagcagaa

SEQ ID NO: 4979 - DNA, 1724 bp, Heterodera glycines
atgtttttttcctggattctccatagcctcctaattacttttaaaacactgtcttttttgtgtttgcgaacaaaagttcgtactttttatttacatatttcgggatttttctacatattacatatgtacatatttttatacatattttggactttttcgcattttttcaaacatattttgaaatttttgaggatttttaaggaaattttcattaaatgtccccaaaaaaacacaaaatttcacaattttttgtacatatttttaggatttttgagaagtgatagaaatttcatatggaaaattttaaatttttttttgaaaatatatatttaggtcatttttagggcattttgtacttatttcacccctttacgaagatttttttccaaaaaacaccatttaaaaaattttatttacatattttaagtacatattttgttcttttgtacatatttcatacatattttagcattttttatacatattttatttacatattttgcgatttttcttacataaaaaaagaatccctgataatgaaaaatgcgatcattttttatgtgagaataaatgttaaaaaaaggggggaaaggggaggaaattccgcataaattttaatgatgagaaagtttattgaaataaaacaataaaaaggaggaacgtggaacggaagaggatgaatgaatgataaatgttgaaaacagtgattgaatggagccaaaaaggaagggccaaatttttaatgttattattattattccaaaccgagaaaatttcaattccagacagatgatcgacgcccaatcaaaaattaacgagtccatgatcagttcgagtttaaaaaatacttcaatttgagagtaatttatttttattgcctttcccatccggggaacgcaacaagtacaaattcagtggttgtaagaaaaaacatcagcaggacactggacaaggttgagaagccgaagaccctttgtttttgggggatattcgcgaaagcaattaacaaatttacccaaaaaaggaccaatttccttcaactaagtttttgtttttaggttttagggggcgtggcccccagcttggccatgcccttcttggtgtttcaagtgtttatccgttcgttcatgtcatgccatggcatttgttccattgccctccccccgcttcccattttctttccgatcagtccacaacattcattcaatcaatcagtcctcctcgctcttcagctgcttcagcttcactcgctccaacagtcgctcgcgcagagtctcctcctcgccctgctcctccatcgccaccgccgccttctccgtctttattggtgctgtcgtcgtcacttccatcggagttgccgtcgtctcatcctctgccaaaatgggtgaatttggacacgaaaaaggccccaaaaaaaagaaaaaaacaaacaaaaatttatacactttaaaggaaaaataaattaacaaagcaaaaaattgcaatttgtctctgtccaatgcaaatgaaatgcctttttcggcctttttctgtgctttcattcattcctttcatttaccgctggcgtttgtccgttccgacggcggcgtttgcggctctttctttgcctttttgggcgaatggcacaaatcactcgaggaactctttttgctcttttttgaagacttttcctgaacaaaatgttgtgataagcaaaagcaatgtaaaaaaaacaccaaatttca

SEQ ID NO: 4980 - DNA, 1008 bp, Heterodera glycines
  misc_feature (15)..(15): n is a, c, g, or t
atgaattgaatattnttttttcataattgaccccagaaaaagctctaattggacacattcggtcaaaatcatacaatgagctaaaaacatctttgactgggccaaattttgaaaaattacttaaaggccgagaaattgacaggatccctacaatactaaaattttattttccccccgttttgtgtctgtctcatgtctttctcccccctcccccacactacctcgtccttgtcgcgcttcttctcccgcgacctgcttcgctttcgctcctttttctccttcgccgtcgtctctctgtccctctcgcgctctctctcccgctctttgtcttttttgctgctcttctccttgtcgcgctctctgctgctcctgtctttgtcccgtttcgatgctttgctgccgctttctctggtggaatggtcgcgtgaacgagagctaaacctttttttggcaaaaaaatttttttttaaatgccgaaacgaaaatgtccgtagaaattagcacaccgtttgctggcctttttgcggtctttgtcgcgcgagcgagaacggcgacgcgaccgcgagcgtttgcgatcgcgcgaccgtgaacggcggcgacgcgaacgggacggcgaccgggtggagcgagaacgggaacgacgtcggcgagaacgagagcgggaacgacgactgtgactggaggacctgtggaaagggaaaaattggaggccgataggcggatggatttcggatccaactaattaacgtgtttaggggggaggggcagggccgaggagccatctcaaaatctcataataaaaattccatcgacgtctgtcattccgcttggatacccaccctttcaaccacccaccccataattcttcgcagacttacgttgaacgtgagcgggtggagcgtttgacggatggacgcggtgaggtcggcacaacgcgcggggcgctgaccccgggacggaacggcgaatagccacggcctgtcaaaagcatttgcttaacttttctcg

SEQ ID NO: 4981 - DNA, 4474 bp, Heterodera glycines
  misc_feature (11)..(11): n is a, c, g, or t
  misc_feature (19)..(20): n is a, c, g, or t
  misc_feature (36)..(36): n is a, c, g, or t
  misc_feature (4451)..(4451): n is a, c, g, or t
aagtaataaantggttctnnctttttgggaaatcanccggcctgcatcatgccatggaatgtgcccaactgctccatgaagccggggtttggcgtgatgcagtccctcttccgcttgacgtactccaacgcctcgtccagtccccagccgtacgctttcattgcgtaagcgatgacagtggacgcggaccgactgatgccctttttgcagtggaccaacactttggcacccttttctctgtggagtttttgaatttcaaattggcatatttttggcaatttgcccacttggcctccttgataaagtcgtaggtgcgttgccaatgcatcaaaagttcggtggtcgtctcgtcggacacccaaattttgaggtaagtgaactgagtggggaagaaattgtccacttccttcgtcacgttcagaatgtattggacactgaaaaacatacatatacaaggggtgtctcagaccaagggccatacgacggacgattgggacagggggggagggtgtctcgggaccgatttttcatacgaaggtccacaattttctccggcgatgacctttttttgttgctattcaaaccatcttttttttgcggcgcctttttccaaaaaaaacttttgggaaagggggtggcgggcggtccggcggtgccgataggcgccgccgggaaaatttttaaaattttgtattgatttcgctaaggaaattgtgcacattttaaatttttcctgcttcgttacgaccccctccctcttttacagccgccccccttacgacgaacgagggggggggggggtgtccgaggcctcatacgacgagggggggataagccaaacccctccccctccatctttacgcccctttttttggcccacccattcgccttcagctcctcccaattggacgcgttccattccgtgccaaggtaaaggtaatcgaagatttttgagggcagatccaattgacctggaaaataagtgtggataaattcaggatcagatatggtatatctgaccaaggatgacgagcatttggtggtcgatgaactctttgtagcgccgctgatccaccgaaatttgttcgctcaaccgccggcggatgtcctgactcgtcctgcaaatggcgccttacgtattttttcaactttttccgcttttacacgtcgtccaggtccacgctttgcatgatttgcttcagtgccgttttgatgcgctgctccgtctccaattgctccacgttggcgtattcccctaataacatactgttagtaccagtgtccgtcgttgtgcgcccgtcgctgccgcttttgatcgcttcctccacctcctcaagtgcctggtcagccgttttgcgttgcggttttatgatcgcaactttggaatgttggattctgaggggatcatatttaaaaagtggattaaaactaggcccggaaagttttgttcatttttggcaagccctaatgatattaagggagatattcttgagaaatttttgaagattttcattgagaattttttgagttcgagcgagaatcccaactcagtacccgaagctctaattaaactaattgaatatgccgtttaaattaggattttaatcctggcaagcatgtccgtgtccatctctaaactcatggatcctgcgcctgttccgtcaaaattccgagtgctctaataaatttagttttcttatttccagattccaatgaaaaatctaacaaatgaaaccctacttttataaattatcctgtttttacacaatgttgggagatcccattcgaccttaatggacgtccctgaaactccaatgagtcgctgttttgcagtgccaatggcaccgacgactgctgactgaactcgacgtaagcgtagtcacagggcaaatagtcgttgccggccgccattcgcaaatacatcacctgagaaattgagaaaactattaacaaaaagctaactgttttgaaaacaatagctgcagaacggtgtgcaaaaaaaaactatctctgatgtttttctgattagttgttttaaattccaatccccccccccctcccgcggggctttcgttggccctctcacctcgccaatgcacgcgttgaagaagttgagcacctcctcgccgtcgcatccctttggcaaattgcccacataaacagtgcgtcggatttcctccactttggccggctctgtcgttggcggcaacggtgggtaggcgggcagaccgagcgccgccaaattggggtcaatcgtcacaatctgtggagggtgggtttttttcataatttgacttatttgggtggatgggtatgtatgtaaggggaagtgccatttggagaaatttaaatgtaagggattggcgcgagttaaagtattgttggctttttttctaaacggtttcattaattccatctttaccctcaaattctcaaacctgaatgcaaagtttcgaaataattgaccctccccttctctaatcgctctccgctaattgaatacaacaaagctttcaaaatgtgacccctaacggctaacggggacgaaccatttgctgtccttcgcccatgtcctgcagttggttggtgatgtgcggcggcagttggcgttggccgggcaaagcggtgatgccgctttgcaacgctgtctcctcgtcgggaatgacatctttggggaaatggcaaattgttaggcaaaaaggacaagcagtagtgatggcaaaaaggtaagaaagctcaaagcagaccccggaatacaggccaggaaatttttcattctcgggtctgataccattatgttttttgtcaggaaaccggcaatatcggaccggcacagttaatatgtctcgaagcaactgaactatttatcggggtttttcaggaaatcgttttaacacggtctaattgtaaggcccctttgccacttaattgtgcgccctttccatcatcccctatcacttgtctgtgacggaatgcagaccaacgctcggtccaggaacaccgtgttggtcaaatgttggccaacctccacgccgcgctcgtcctcaaatttgatgtaggcaaaccgaagctgctgactgttctgcaccatggacaaatcggacggataaatctgaagggttaattcacgaaatttaaatcccattttatttaaaatgttttgtgtaaggaccaccaatttgtgttcagaaattggccgacaaaccttaaactcctcaatacggccgacgtaagaaaagagcatttgaatctgttctttggtggcaaagggcgaaatgttgctgatatgcaacacttgggtagaggtcatgtcgagcaaaattcacaacaatttgctgaaaattacctgtgataaatgaatacatatgtgcttatgttagccttaggcaaaggcaattcgattgcaatttctcattttctttcatttccttgtcaatggatggaatcaaattttaaatgagaatttgtcaagagaaggattagtcattaatacatacataatgtctcatttttaagacgtaaatttttccaggaaactgaaaagcacgagttcaattacatacatactttcggttttgtttttaattatttttttattttttagtacctaaagcatagagacagagaaagaagacaaagttagtagagaagcagagaaaaagaattaggaaaagagtgaaaggaaaaggaaaaaaataacaagagaaatagtgtgtaaccttttgctgttattctttttttatatcgctttattttagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattttgggaaagaaggggtccggcggtgccgataggcgccgccgggggaaattttaaaaatttgggtgcaatttgttaacagattttcaacaaaaaaaggttggtttttgcgattattaagctcaattggtaggattttcatttaaaaaatgataaaatatgtatcaatttaaaaaaaaactatgaggaatcatattttgtcgatagtaaagccatgagcctacaaaaagaaacttcaaaatattttactttccatagagggattgaacaaggggaaagaagaaaggaaagtcaaggagactagccattaggccatttgcacacttgggcagtgttacttttaaagaatatattaattattattttttatttttccctttgactccaattttcttaaataatttttcaccangaccccccattcttacctagtgc

SEQ ID NO: 4982 - DNA, 1671 bp, Heterodera glycines
  misc_feature (1643)..(1643): n is a, c, g, or t
aattttttaaatgaaaatatgctaaaaatatgctcaaaattcttaatttttctcgcggcggcaccgccgggaccgtaaaaatccttaatttacaagcaaaaatttgctcaaatcgcaaaatttggtcatttttcggacaaaatctgttaacaaatcgcattcttttaatacatttatttggcaataaaacatgaatttctgccttctcgttaacaatttaattgatgttaaatgacattttgaccattttttcattccgtcacttttcctgggcttcggagacttctcttgggaatgccttcgtgtgcaatgcggtggctatttttaggccgtcactcttccggaagatgtcggcccctgtgaaacccattgtttggcctctccggttcacaaatgcatcaatcagaatggtgtcacctaaaaagaacccagcaataaatcttgtgttttttttttcttttttacgtaaaataaaatttttcaaaaagaaaaaattagaaaattggatggcatttaatttcttttccaacttttttttatacaattacctaaccaatttttgctggtgccaaataatttacagtcaaatccacgctgacaccggccgacccgcgccgtgtcgcgcacaaagcagtcgttgtcacaatgtccacctgtttgatataccacaatttttgttttcatttttcctgaccaatgtcgcggtcagtccgccgtgcaaagtgccaaaagtgttcgtgtgctcttcctgcacttccatttcgactttcactcggccttcgtctacgtccacaactcggcacttcaaaaaaaaagaaagaaagaggctgtcaatgcttcaatcaaatttcagctttactttggcagcagttctctgaaaattttgcatcgctgcataacttttgtagaagccggagaccaactcgaaatatttggatttggaagcagctgccatttaaaattgttggattggatatgcaattaatgctgttcttaatggcctgggagtaaattaaattaaatcgtcagaaccggttcggaaaacaggcaaaaactcgtttccccccccgccctttttttctcacatttctcattttttgggtaacaaatttgtgctttaatgtactttatctgttagctgagtacgttctttcaaattctcaattcaccaagttgtttccgctctttttgagcattccttcccaaatttacctctgtcaaatgcattttactttaaaaggaaaggggaggaaaggacgcccaaagcattatgtacacaaaacataaattagaaaggacaaatcgccgcttattgattctttatttgctaaattcgcgcctcaatgcgttggaatgggaggcgagtgcattttttccaatgaaatttcaaattttcttcatttttttcttctttggcctactcattctcgacagctgtgacaatattttgactaatgcctttccaatcctaagattctcattaaaggcttttccaagcccacccatggaaatgggctgttgtttgggccttcgtccgctatttttccaattgtttttgtctatttttgtcgcattttccgctgccatttcagtgcgaaggttacccggtgaggaagtgaagcggtttgacatcgcaaattcanggtcttgcaaaaactatccaaaaaaata

SEQ ID NO: 4983 - DNA, 1561 bp, Heterodera glycines
  misc_feature (963)..(963): n is a, c, g, or t
  misc_feature (966)..(966): n is a, c, g, or t
gttgttgtccggccccgcgttttgctccgatcgcccatttgaagtggccaccaaacggcggcggccgatgctccgtccgtccgcttttgtcgggtccatccgggccgtctccatccctcgcgggccattccttccctccctcccaaaatcccccgtcgttcgtccatcccgataatccactttacacaaaacaattcatcatcaacatgcattactaggattggatgatggatgtgattggggctgtttgtcgtcgtcgtcgttctgcccggaggggaaggacttgtccattcattccatccgccgatgacgacgacgcgacgatcgaacgcattttcattcattcttccgccgcccaattgtcgcgccaagttcattttgtttttgttgttgtttttttgtaactttttttatttattggcactttttctgctgttgatcatcaccatcatcattcattatttgtaatcggatttagtccgatcagaatttgaaaaaattgtaccaaatggacggattattaattaatgggggacactgcgaaaagctgaaagctgacgacaaatcagtcatttgatcacagaaatgcgcaattttaaattcatacgatcctcgaagcaacgtgtgcttttcctccgcttgctttcattcgattattccgtcccttcccaaagtcacatttcatatcgaggccatcatccccccccatttcatcccccgtcttctcttccccttcccctttttccaaggtcgccgcgaatcgcgacgattcatcccaattttattgccccaattcgtcagtcagttcagtcccaattttctgtctcttccattaaactggttatccgtcgcggcacagaatgccaatcggcggctccaatttaaatgggtgcgacattcgctttttgtgccatttcctcgctcagccaattaaatgcaaaactttctcatccaaactcacgnggnctgagcattccattcgctgatcgatgatcagtcaatgctccgttcaaagaagggataattatggattcattaataattattttgcgatgacaggcgacgattcccataaaactgtttgtttcgtttcttcgtttaaaaagcatccgatccgatcagtccgatcactttatgcttttcctcaccccctcacctcgctactttcccctcctcctccgttccaccaaattatatcattacattacgatcattcgtctctctttttatgagaggcttaacatttcttatagcaaaaagagccaaaaatgagaaatttatgtgccttcggggaaatgctaacattgacttgtgctacgggaggaatggcatttcgcaaaagcattcggcttgctttgcctttacttacaaatattcaatcgatttttgctcttttaaattgtgcttcaaattcgcaatttccaaaagtttcttcgtctctatttgcgctgtgttttacccacacaaataaatccccggaaggcgtcgccaaaagccaacccaaacacaaattaaagggggggggggagggaatcgatgggtattcattgcaaatgccgct

SEQ ID NO: 4984 - DNA, 1598 bp, Heterodera glycines
ccacaatttccatttccatcccctcgggcgcataaattgggtcttaagggaaggcacagtttcattcattcaattgcttgtgaattgatgctttgcgctttgaggtgccccttcaaataaattcaaattttgcttaatttttccgattttccacaatttctctcttttttttgacatttcgtcggatttccgccactttttccaattatcctttcgatgctttgcggtgaacgaatcgatggatttgtgtgaatttcctgacaccgccctcaaatatttcctgttcttttcgcacattgtctctttttagtgcttacttttgttcctccatttcccctcatttttctttaccgaaattcccccgaggggtcaaataaagggggggggggataaagcacatccttaaagcataaataattagcaaatgcggaaacaatcgtttaaaaaaagtcattgaattaaaaatattaattaaatcggaacttccaatagaaaattaaaatttactttttctttccattaaaaaagcaattttattcctttctcatttaaaagttttcaaattgtattcattttttgaatattttttcgtttgtttggccttttgtctgtcatttgatcgtataaattccttccaaaatgctaattgcccaattcttttgaattcttctcacaaatgttgagagtcagtcgccagtcgctgctccctttggtcatttgagccccatttttgaagcacaaaacatttggctacgaatttgggggggggggcagacaaaagcatccgttggaggacagaagaaggaaaatttaaaaaggcaattagggaaattgactaattaagcacttaattgcttttctaaggggccaacaataacaacaataaatgactgttttaggcggaccgaaaacaaatcagacacagacactttaatctcaaatatctctaatcagattgaaattttttaatattttggctctgagcgatttgattaatattttcattctttctgcatcatttttattttaaaataatttaaaataaacatttaaaagtaaaatgcaatttaaaattttgaaaaatattctttaaatccgtcataaatttcaatttcataaggaaaatgatgaatgtttttttgggctctctctctctttgaccatccgtcgtcacttttgctcaatccgcacacatcgaaagccaatgaaagcattggattaatccaatttgttgtgctctctttgctccgtttgccgacggcgttatgccccgagggaaaagcgacaaaaattgcgcattattttattaatcactgcgtaatgccccgaggacattttctgtccataaaagggacggggctttgttttatatgcttgttaattcaaatttaacatggattttttatttgtcattgtttacttgttgagaatttgatttattttatttgaatgggccttttgaccatttaatgatgggcttaatttaataataaacactttcggctcttctaatgactattttgttttctacaaatcactgctgattactctgtgctaaacatatggttttaccgtcagcgtgctgttgcttctgtcag

SEQ ID NO: 4985 - DNA, 3765 bp, Heterodera glycines
  misc_feature (38)..(38): n is a, c, g, or t
tttaattagcaatttatgccttgaaatgatttgctacnctatgtaaatgcgtcgtatttgtgcttcacaccgtcgccaatgtctttcccccgccctccctctcttctctgctcccttctccgatcactctttcttttactctcctcctccttttgttcaccgccgcttcagtcccggctaattcgtcttcgtccaattccccacccgtcgccgtttcgaaatgcgtcgccgtcgtccggccaaagtgcggcgccgttgctgcgttttgagcctttccgcgcctcggagccctaccgttgcggaatgttcgcggaacagacaaacccaagcggacccggcgatgcgcgtgttgcaacgggcacagaacgcactgatccgcacactgtcgcgcccatttccgcaccaaagttcgaaattggcacattaaactgaactgatcagatcgcattgaagagcattgatcagagcagttcattgttttccatctctgaacattttgctttttccagaacttctttctgacgatgctttgcttggaaacaccgaagcatggaaacagtcatttgttgagaggagggatcaggtggatcagcagtaaccgatcaaacttttatttgttcattatcgaaaaaatcttctttgttagcagagggttttcgtgatgccacgggaaaccaattaacgctcttaattaccccatgccccccccctcttttaattgctaatcactccccctcactctttgatcagtgggtggaattcgatttttggtggctgatcggttcgcttctgctcgtctctgtgccgcccctcttcactctgctctatttgctctaccgttgcgtgtcctgctgctgttgcagttcaaagcgatcggagaaggcacaattcgccgaccgccgctttgacagcgtccgtcgattcgtgctgaacgcactgctcggactgctcgtcgtggccaacatgtgagcaggaacaattaaacacattgattggcgaatcgtttgaaaagcgaatttcgaatgaaaaagcgatatttttggcattgtgcccctttttgccatttcctcaattctattcaaattttagcttttgtgccgccgttttgctgatcaacactcaatacgcccagcacggactcgacgaattgcccacccgtctccattattgtgccagcgacgtgttcatctaccgggcagagactgttgaggcaattaaaaattctagcaaaaaaaggaattaaaaatgcctaaattaaagcgaatccgaaaattgctccgcgacgatttttttgtgcttaacggttcactgaacttggcattggacggggccggcgaggcggtggtggaacgactgaagaaggcgactggtgccggactgatcagcgaagtgattgacaaagcgaacagtacggacggagggggacggaagcaattaattaataattaattaattacttaattgaaaccaatggaatcgtcggtcaaaatcaaaacatttttgtcgggcaactaattacataattaattgacctatcgcagcggttttaatacacttaatttacggtaaatccatttcaaattcgcagatgttggcccaatgcgaaaacactttgatgagttaagccgagagcttccgcatattttggatgcaaggcattcgctgcaaatgcgactgctgcggttgcgacaggcgcgcgacaaactgcgcgagtgcgaacggaccgccaaagtgcgttaaataacacaacgccaaaaaaccatactattttttgatttttggcggataaatttctcatacattaaataaaaaaacaaaatttaattgctgaattaagtttttatttccaactataaattaaggacggcactcgcgtcgccctctgccaccaggcgaaacaggcgctggcgccggtgttgcaactggcgggcggcgcggaagcggaggacaaaacgggcgccgattgggaaagtgtggaaagggcacgcgaaatggtgggttttgttgtggcatgtgccggcccagccaaaattgggtggctgatcaaatcaatcatttgcatcggttgattgatcctgcttagtccgatttgttgcccgagggagtgccgccggcgttgcgcgccatcgaacaattggacttggaagcaaagtttgcgccggccaacgagggaatgctgctgctgcagcggggcgttcagcaggtggtcgactcgcgcagaagcggtgagcggacgggaacaattgaattttcatttacttttaagagattgattggttcattaattcagtttatttcatttattttttgtctaatttggcagttttttggtgaaaatctgttaacaaattgacacgaattttcaaaaaatttccctgacggcgcctacctaccggcaccgtcggcccccccccccggttccccaaaaatttttggaaaaaacgtgccgcgaaaaaaattgcgttttgaaaagcaataaaaaaaaaagtcgtcaaattgcatggccggaccccttcgcaaaaatttcggttgaccccccccccctttttcatgtatgatctagcgtcagttctctaactgtcagtcctcttctttttccgcgctcttcgtcttttccccttttctccgtgttggtctcctcgtaaaggttcgcgaatattgggagagttttagtctctaactgtctgttccactaccccctcccctctctctctctctttctctgttttctttctcctcttgccttgtctggaaggtgctatgacgttagtcaaaaaccagcataatgggcgttagtcaaaaaacatcaaattaaaatatttattgatataactttgctcaaaagcatctaaatttttaattcttgatatcattagatagccctaagtgttttctattaggctacaaaatttcaaaaagtttcgttaagtttcaagaaggttatgactaaaaatgttcaaaaaacttggttttttgagcttttcaggtcataactttttttaaacttaaagaattttttaaaaaatttgcaggataatagaaaacacttagggctatcgaaaaatatcaagattattaaatttgatctattttagacgaaattatgaataattttctctcaaaaattttccatttgatggttttttgattaacgcccattttgatggtttttgactaacgtcccagcaccgtctggaacaatctctcatttctctaactgtttgtgttcttaatttcccgcactctatcgcctcaacatcatacaaattttcattgaatgctttcccttaaattaggtcggtgtccaatttgtgcccgacgtgacgcattacgagataatgaagttgcgtctgctgaacggtggccatgccgcaattgcttacccggccgcactgctcgacatcaaattggcgcacaacgcaatgcaaaacaaactgatcagcgcattcttgcacaaattgcaggtggccaattcaattaattcactaattaccggctaattgaataatgacacaattaggcatgttactaaaaaattttccgtttcggttgccgattaccccccccccctcccaaatcatttgacgaagaaatattaattattttattatgtgttaattattaaacgtgtgattttctgttttaaagaccgatgaaattctgcccaccgtaccgccggtgcctggcattgatttgctcgactactgtaagcacgttcagcaaacggtttggcaacccgaaaattgaggacacaatccgacgtct

SEQ ID NO: 4986 - DNA, 3057 bp, Heterodera glycines
tggttggtttttagtttattatttcttttaaaattctaccattgttttgatttgccagggtccgggcttgtcgcctttttggcattggcactttttctcgacctttgctacggctgttgcggtcggcagcccaacgaatacgaagatgactgctgcgtccgatccaccggcgcttcctttttttcatggtccgttcactgatcagtaaattgatcaaaattctgagcgatcaattatttacatcgaaaagaacttaattagtccaacccaacaaaacgaatgatcaaaaaaaggaaggcactgatcgatgatcattgatcactctgtcaaaatgcattagaaacttgatgatcagataattatttgttctttctcagctccatttggctttcgttggctttcatcagtgtgtttggactgctcgctgcgcttgccatgcttttcggtgccaatgtctcccatttggtgtgccgtcctttggaggagccgctgcaacggccggactttctttcggtgtgcaatttgcgagttttaaattaattgtgttattcccgtataatcccagctgctcgaccggtttgtccatctgtacggtttggaccgtccttcgtccgtctctccccacaaatcctccccgtccgcttctgatcacttctcgcttgatcagcttttctcggctaaccgtcgcccggctgacctgatcagcgagtgtgcccagaagcacactttgtacacaatgctcgggttggacaagaagttcaagctgatcggacgtgaaggtcttcaggacgactaccaatacttggtcaatggggcaaacaaattgaaagcgtcgatcattcctttttcatggcattttttggggaggatgaatcgatggcatttccctaatttttgttttttccatcctctacaattgttgattctctgttcagcaacgttccatcatggacaacctttcctctcatcagctgatcgatgaggcactctctcgcggcattgtgccggacgacccgcggctgagcgctcgccaatggcactttttcagtggaccaatgcgcgacgcattgcaacgccttgggcaagtgcggatgccggaatggaacagcagcgacgtggagcaggtaactaccgatcagcagagatttgtttagtttgtatggtgatcattagcagggaattcttccattttgggaccgatcgattacttaaaggctggacgaaattaaattccgtaattatggagttttttcaattattgaaatcgtatggaaaattttgttctctatttcgccatttatctttctctctttgccctttcgttgttttaatcaattctctccactttgagccatttcattggccatttctgcttttaactcatcattcccatgcctctaaaaaacaatggcccagctaaaaaattggtcccaaagcgattagcactcgaacttttgtatgaaatcactcttttcatcagtccccgcaatgacttgtccagcttctgttcctcctctgctgtatttagagaatttatgtgtccacgtgtgattaagtggaatttattttggcactcagtatgtttagcgggaaatttgacaaaaaaaacataattaatttaaactatatcgttttctattccttttaggcgattgaaaaactcaagacgagctacaaagaggcgaaagaaagtccctcgtgggataacaccatcagcactgcttctctgttggcgaagctcggtgacgactcggtcttccgttttctttcagacgccgtgaacttggtaagtgttttttttaattccaatgatattaaaaaatatttggcggtcttttggagaattttatagaaaacttagtccatcatagaatttttcaaatttttttatgaaatttcctcagaatttttttggaaaaattcctttttatttttcgggagcaaacgaccttctctgaatgacgaaaagcaacttttttttgtgtgatagtcaacttgtccccctggcagttgccgtttcttaatacgaaaattcacagcttttaaatttaagtgtgaaggtgagccggtccgtttttccagtactcgccctgtcactggatcgctttgcatttctccgccgccaaaaaagctgaaggaatgaatggccaattgacaagtgtattaagggagaatcttttgttgttgtgtaagacatttttttgttttcgcgaaaaaacgtggctttaaatcatttcaaatccaattgattggtgcttcgtaaggttgacatccaaacacaattctgtgtaatgattcttcattaatcgagtgtgatgtttatggcattgcagacgcaattttttaatagtacatttttggaaaatcaattttaaaatatgtaaattgccaattcgtcgtgaaatattccgtcggctaattcagtgaattttttcctttcctcgtccgtcagttgctggtaaagttgttccatctcttcttgactcgtctcccctttcgctggttgctcctccccaagtccaattggcagtccggcattcagaattcgtctgtccaattcctgatcatccagcgaattgaattgctcgagcgtagaggcgaccattttggagagatattccggctcgtcgtcggaatcgaataaaatttcctcatccgcccttaaatttgactatgaatttttatttatgcgcataatccttttttaaatatcttcagggaaattaggaaaagcggcgctatttgaaaagggttcgaattttattaaaatacagggagaatcattttggtatgctttttgttgtacgatgattattaattgttaacttgttcccgttgatattgtgtcggtgatcggaatcagacaatccatttaaaccaattacgaagcgctaatctaaatttatctccccacccttttgggtaattaaaaaaattaagctctgcgctttactagcgcgaaaaatatatagaaccatgggtcctaactgaaaatttggtaatagtgcagtttgtcccccccaaagctttttcgaaaaattttttatgttttcaaaa

SEQ ID NO: 4987 - DNA, 1356 bp, Heterodera glycines
  misc_feature (1284)..(1284): n is a, c, g, or t
atttatcgcacattgtataatctcaaaacaattgcaatcattaaatccaaatgatagcaaccaatgaaccgacaacaattaatggtcccaacataaacttaatgagaaatgagaaggcgtaaatcgtcagtccgagcacaaagaaaccgccaatcaaaagtaccaacatcagaatgatcgtgtccatttggcgcttctttcttttatttggtgccaacaatttgggatgaccatcaacgctaattccttttgctagcttggccgtgatcagctcgaccattttgggccacaaagtttggacaattggtccaaaaatagcacttggctgcattaatttgcttaatttgtataatattattgtgtgttccaagtggtaggtcagaaacgtggaattttggttagaccggaccgggacttgccaaaagctgaaacggttctaattgaactggaaataaatccgttatttttaatcgagaaatattttttcaaattgatattcgttgacagttttatccttaaatgtttaatttttgaaggcattcaggccaggcccgtaaccagggtggagacagggcggggcagttgcccccccccctcgaaatgataaattaaattttcccgaaatacgaaatttcccgttttttcatacagcgccgaacaaatactgtgggaaaaatttttggcccgaaaagcaaaaaaaaaaaagctcttcggttgctcctcccgaatttttttctggttaccggcctgattcaggcagacccccattcaaagaccgggacatggaatgacagtaatttccgaccggtcccggcctacccgagtttgttgtgctcataaaatgtttccaaattaatttctgccggcattttcgctgaaatttgcttcaatgattcacgaattgcttgtgacactgatgctttatgctcttccgaagcactttcttcatcctttttcaatttggtcagaatgtttcgtccgttgtccgtcagcgtttgaatcagcaccgtttgtccgccaaatgctttgatcaaattcgccttggcatttttccaatctttgccaacaacaccagtacaaaataggccaacaaacttgtttaatggaccaattaagacacttttatttctgcacactattgtatgtgcccattcagcatatttcctaatagtacattgtttagtcaaaaccgaagagcttttagattaaaaaaaactgcgaaataggtaagaaaatcatgcgtgaaatttgtagatttaaaattttgggacacacatttgggtncccgatacttttggtttggggatccgcacattagagggtttcttattaaaaaagaatatcggcaaatctttt

SEQ ID NO: 4988 - DNA, 2500 bp, Heterodera glycines
aaaaagaatatcggcaaatctttttcaagaactgttgcaaaaaatcttattttaaaaatttacagacaaacagaaaaccataaaaaagcatcaaatgaaatatattttcaaattgctaaatttaatcttttcggtctacctcagttcggcccccaggattcagcacccacggttttcggccccagcatgtttttccactacaacttactataaattttttcttcgtcaaccaaatccaaattgttggaatcattcgaaatcttaatgtgtttagtgctttttctaagctattactttgcgattagataattatcaaaaaagttatacatgaaaattgcgaaaaagtcgaaattttcaacttttttctcaataaaattttttccaggcttgaaaaactttccgctttttggtaagactaatagagcatgttaagagctttcgaatgttacgaagattgatggatttggataacaaataaaaaagctatagtggaaaagcatgctggggccgaaccgtgggggccgaatcgtgagggccgaactgagcggttccgaatcttttcataaattcatgaaaataataaatttcgaaattaccatttacctggtatttgccatccactcattgcctccgaatagcactgaattagctaatttattaactaatttgtatgagcaaattaccaagttcatcgctttctaatacgttttttaggttgttaatgatgtctgatggaacaacattgagttcattgccgggctttgctccgtttgttggtgcaattacaaataaaagcaaaaaagaaatgattcctttcattgactgctttaaacatttttttattattcattactttttttttgaaataaaatattataatgtggcggatggatgaataaattgctggattgatgggaaattgattttaaaacattcgtttttcgcacgtcatttatgctatttggaaatctctcaaaattgccaaaaaccacgttcatccaactcactatttttctaattctggaaatttcataatcagtgtgctttctctaaaaataaatttacaaataaaataataataataaagaaaataattaaattaaacttagatttttgattcaaataaaaaaaagaagaagaaaggaatatgctgtgcttaaaaattagaaatcttattaagaagataaagcaaattggagctacttgaaaaaacaaacttagagaaatgcattttgttcgcttttttaaaatttaaattaatatttcatttttccaaattgcggaaatacatatttgcttaaatccgaaacagttttttgtgatcaaacctacaaaatcagctgttttatgatgtttatagtaacgcgctctaatttaactttggacggagaaaattaatttttcttgccgtatatatctctaaaatattatctgaaaaggaaaaaactagaaatccgggccctgaggatggtttcagattatgccataccttctatttatgcggtccatctggcattgttcgacattatttatgacgctgattatgccaaccattatgacaatgagaatttcatcctactgattcacataattaaattacaaattgcgaattttccagtaactattacgagtctctctctcctttcttgaataattttcctactgagtcctttcttttttatgtttattaattcttcaaataaaattttttcacattgcccatagccatatttgctttagtttattgaattttaattacctagatatataatatgtgtcaaaattaggagtgtcggtttttcattttaagccatcctgaaactatgaagaataaatattttgaattaattttatttgcttacaagaagaacatttcacctccaatctatgaacgggtccaaatgatgggccttaaaatgaacaacaaataacaaatgtataaaacattataaaaatttcgctttattaaattcgaaatataaaataaatcgccaaaaacgggattcaatatcaaaaaattgtttctgagtgaaaccattatggatcatagcaaaatttatagcttaaaaacctattgaaaccttataaaaaattctcagttttagttacttttttaaaattttaatactgtttgaaaatttcttaattaaatattttttaatatcaaatgttcattcccttagacaaaaatgataaaatttctggttatcgacttccgaaatccggcactttttgtaccgaaagacttttttattttagatttttttcactttttattgttgtacacagcggcccaattttaggctctcagtgcaaataggtttattatttatttagtaatcagaacgccaaaactttgcaaaactttaaattttcttgggattttcccttgtaaaaatggaagagccgatctcgagttaaaaacataacttcgaaaaaataaacagggattcgatagagggggtcaaaatatgggcctatacaaaatttcaaaaaaagt

SEQ ID NO: 4989 - DNA, 4483 bp, Heterodera glycines
  misc_feature (9)..(9): n is a, c, g, or t
ttattaaanttcgaaatataaaataaatcgccaaaaaacgggattcaatatcaaaaaattgtttctgagtgaaaccattatggatcatagcaaaatttatagcttaaaaacctattgaaaccttataaaaaattctcagttttagttacttttttaaaattttaatactgtttgaaaatttcttaattaaatattttttaatatcaaatgttcattcccttagacaaaaatgataaaatttctggttatcgacttccgaaatccggcactttttgtaccgaaagacttttttattttagatttttttcactttttattgttgtacacagcggcccaattttaggctctcagtgcaaataggtttattatttatttagtaatcagaacgccaaaactttgcaaaacttaaaattttttgggattttcccttgtaaaaatagaagagccgatctcgagttaaaaactagacagctaaaaaataaactgtgattcgatagagggggacaaaatatgggcctatacaaaatttcaaaaaaagttacccacaggaaaaaatgttttcccatggcaaacatttcaatactttaattcttttttagccaagtgcgcaatttaaggccaaatcaaataaaactaacaatattctctagaattttttttattaatgaaaaaataattctgccttcttctttaaaagaagaaattgaaattaacacacaacatagggaggacttgaacctgggaccccccttttggtgactaactcacagaccactaagacgaaaaatccagcataattgtacttggagcccaaaattgggccgctgtgtgtaccaaatacaaaactaagatatcatatgtattttaaattgaaattttttatttaaaactcttggaatttgaccttttttcaaatgcactaaaatatgagcattacttaatatttaggagttagttacatatttcttaacaatttcggggaaaaaggcacgaaaaaggtattaaaggctgttccaaaattacgtgcccggcattatgcaccaaaatcgcagcaccaaaattagctgactgcgtgttcactgaggtattgtcatatgagattgtccactgactgatagttcgctaaccatccattagcaattctcaactcgattctacgcaaaataatccgagttttttacctgataaaaaccgtcaaaattttccttctacgcttatttagtgatttgaagccggattttgttcaacaatgggtgaaacaatgaatgctgtgatgctgagaaatttttgatctcatcgacatctgattgttttttggaatagccgattttaaacaagtccatcagatcacgaagttgattcattgggacttgaactttctgcaataaatacataatcatctattgcatatttttcaaggcaaaattatattttttgtgaagcccattaaaaatttcctggaaccataacggaaaacgaaaaaagcgcgacaggtttcccgcttttttccgttgccgccaaattcccgtcaatttttgcgcaaatcccgacgcaaacataaaaaatttgaatttttcataaatttatttaaatattatcaggttgaaaatatttaatattaatacatttctttgaacatagtcttattttttaaatcttacatttttataatcaagcaatcgagcctccattgaaatcactttcctcgcgactccaatcgttgttctaatgttttcgaaattttcatccatttttttgtggagctgctggagtgccttgtattcctcggactccggctaaaccaaaaacaacatttataaaaagaaacatcagaattaataaaataccacaaaacatgctaagaacaaggaaactcctttaattaagagaccaaataaataatcggaatttcaagtggatcaacactttatttgaaacccgaattttcatatatggatattgactcacttttgttgcaactttttaggggataaatttttctacatcttctgcgggataggtatggaccgggatccccgctcccgaggatgagaaaacgacggacatcggtaaaatccgcgaatcccctactctgtttgacctgctgaagatatttcgtccaaatcatcagtatccaattcatcggtatcataattctgatcatcgctttccactcaagaagctctcacaaatgcaccaagcagtgcaacaaatattgtagaattattttccacatagctaaaaattgacatgatttttttgcattaaatttgatttttgatataattttttaaaactgttcatgcattttatttaatatcgaacaaattaatataagtgaatttatttatttaaatgctatttttctaggttttctttttttctatttctctgctgaggttccacctctcatgatatcatttacaaaaaaaaattttttttgatacaatacttttgacctgagtgtatttttcaattatcgaggcggaaaagtccaatttaattgacaaatttcaaaaatttttaccgacgcatattgaaaaaagcttctcaaggatatttggaagacgaattttatttaaatcgaatttaccgctttcaaaatttcaaattcatcactgaacaacaaacgatcattatcgagaagattgcacaacattttctgatcagtttgcaaaaataaatgccatcaccgagtaaatgaatctcaactttgaacgctgctggttcaacgtcggggatctccaccataaggcaattagcagaggctaattgaaaattaactaaggtaattaggatagactaattggagaatgaaagctgattaaatttttcttttaaaacaaattttttaccgttttcgctttgttttttcttggcgtcaaacaggaacattgcctcaaaaacatagaaagcattcttcaaaatgagttgatgtgaaggctaattaattcaaattgaaaaataaaaattttaaattagactcgccttttttgcgtctccgttcaccaccaaaaagtgcaaatccgaatgtttacccgtgctcaacaaatgattcatccgtcccattaattaaggaaaaacatggctaatttttgtaattaatcgcaagaataaggagaatggaaactcagccatcgcctctcatcagctgacaccaaaaaataactgctttcttccacttggcctgagtgatcaaagaatacttcaattgtgatggttttccgtcccaattctcgactttatttatcgccttctcactctttttgaagcaaagtttttgggaaggcttattttgaggactaatgtcgtcatagaaacccagcatttcagctttagtttagcttaagcaaattaaatgctcaatgcagcaaacgaacatgaagcagaaaattaatatatatttggctcctaatggacgtaataattaaagcataaaaaaacttttgtttatgaaaaaatgaaaaatctaacagattatggtatataatcaatattaaatttgttcagttgtatctgaggcgaaattttgacagtttgacttttttctttttccaaatttaaggtatatttttttaagcacgtatagtgcaaataattaaatttaataaaaaaataatttaaatgtcccatccctattaatcaatgtttcattacaatacatagaattttttttaaatattatttaaatttaggtaataaatatttttcttttcatcatacattaaaatatatttgcgcgttaataaataaattcatttaataaaatatcttaaaataaaaataatttatcgcgaatgaatgatatccgctgcataattttacaattgatgggctcaagaatcacttcaaaatgattgatggaattataaaataaaaaatagtcgaattatgcacagaagaatagccagataaacaaagatttacattttataaaacaatctaaaattaaaaaatatcggaataaattggcttttaaaaaattatttattaactgaatttctttgccaatgcgcaacaatgttttaatacgaaattaagaaaagtgtattatttaagtgaaagaaggtgcatatttcttcaatgaatccttgagaattatatgattgataattaaaataattattttagtcatccaaatttaaatttaaatgaaaaattaatacttcataaatattatttttatttaaaataattctttatttgccctattcatcacgttaaaaattgtcagctaaataaatggaaaaaatttatatttaataaaactcattatgtatacattaaaatgcggaaaccagatttgtcgcgctttttaaatttcaaaaaagctggaaatttaaaataacgaaaacccagccacttaaatggatacatggcatttgtgcccggacatttaataggaggcatggcccatgcacaagccattatccaggatccggattttctagttttttttcccaaatttttaatagcattttat

SEQ ID NO: 4990 - DNA, 1114 bp, Heterodera glycines
  misc_feature (1085)..(1085): n is a, c, g, or t
acacagcggcccaattttgggctcccagtgcaaataagtttattatttatttaggaatcagaacgccaaaactttgcaaaacttaaaatttttttgggattttcccttgtaaaattagaagagccgatctcgagttaaaaactagacagctaaaaaataaactgtgattcgattgagggggacaaaatatgggcctatacaaaatttcaaaaaaagttaccaatagggaaaaattttttccaagggcaaagttttttctttttctctcattttgacgtactatttcccagtctctaacatataaaatagcacgtcattcattttttttgctaataaactatttttttaatttttatttaactttgaaatattcttcagaattttcccttcaaaatgagcacaaaatggttttgtttggtctattattggccaagttataagctaaaaaaatttcataaaatcaagggtaaaatatagtgtgtaccttttactgtttgtatttgttcttttggcgttctgtatttattattattttatttatttgctttaaaaaattgaaatttatacacaaacacaaggaggaattgaacttaagagccccttttttggtgactaactcacagaccactaagacgaaaaatccagcataattgtacttggagcccaaaattgggccgctgtgtatatacacgatcaaaaataaaacaattacttcaaatatatgagttttgttaaaactaacaactacatatttatttaattgaataaataccaaacaagggattgcatgaaaatgatagagtaacatattttttttaatggattgaaataaaaataaaaattattaacctaaaatttaattgcaaataaaattttgtatttttgtgtgcttttgttaacagattatgcaccaagaatttgcatacactaaagatcaaaaaaaggtcgtcgcaggcaaaaaaaattataaaagtagtcgatcgcaaaaatttgcagctgaccctgaccccccgccctttggccattttgacccaaaccattccaacaactttgttttctcggtacttttgtaaattggccaaaantataatgtcaattgtaaaggataaatgtg

SEQ ID NO: 4991 - DNA, 1107 bp, Heterodera glycines
ttttgggcattttcctttacatgtcatcttcttttactacggtccccaggctggcctgacttaatttttacctcctaagaatggcatttttaaaagagaaaaaaaaggcacccacacaatgccattgatgcactttctgttctcataaaaaacacccgggcatcatttttacattttcatataaacgtcaatctttgtttctttttctcaattgtttggggtcaacaatttgccgcattcctttttttcaaatcatcattttattaatgatagaattattcttttttttctttcattagaaattctttacattttttgttacctgcaaatttccatttattttcaaatttctcttgatttttttttatctagaaaccaaaagctgagaatttatatcaaaaccacagacttttgcgaatttcaaaattccttttagcgaccagattattttatagtgaaatttttcagtgaatattcaaatcaattttttttttcaaaaatagcttaaaaatcattttattatatattttaatcttctttttttttaaatttccttcactatttaataacataataagtttattatgtcattttctaccaacgctgctacaattaatgaaattagccatcatcagacaactggtcagcagcaaagttagaaaatagttatataattcaaatgaaccggggcagaacttcggccctctgattcggcttcgctctttcggatttaagttttttttgtagttaaatcttgttttttgaaaattatttttcggagaatagtaaattcgtagttcactttctgtaccaaaacaccgccgaagccaaaaggacccaggcgccgagacggcggagccgaaatgtccagtcatttgagtgtgacggcatttgacgccttataacttttcttagaaatgaccaaattcaacattctggtatcattcactagctctcagtgctcagtatcctcttagcattcataatttcaaaaaattccgttcaatttcaaaaaagttgtggccaaaaatgctcgaacaagaaggttttttgaattcttctagccataactttttggaaacttaacgaaatttttcaggataatag

SEQ ID NO: 4992 - DNA, 2259 bp, Heterodera glycines
  misc_feature (5)..(5): n is a, c, g, or t
tttantttgaccaattggcgaaacttatcaaagttggaaacgccgatcactgatcagacagtggacgtaattgtcaaaacactcaaggtcaatgcaaagtgtaatattcgtattaaaattagtgaagaattgcattttcagcttgttggccgttttctcgagaatgatcgtgggcctcaagcaatggctgagtttcttgctttgtttgaccggtccattcaggaaacgacgactgaccaattgagcgagtaggccaagggtcgattattgggataaactaatttagaaacttttaggccggcgagggaaaaagtgcgatgtttgttcaatttgcgcgagaacaaatggggcgttgtcgcggaagtctgttttgaaacacttggtttttatttccgattctttttatagccaaatgtcggcgatggtccgctgaccactgcttcgacttcggtgggtatcattggcccggacgatgttccgttaacggaggacgaatgcgcctttatggaagaaaacttggacaattttgtcgacaattctcccggcgaatctcgtaggatttggactgatggttttaaatccaaacgttataactaatatcaaaccacacaaaaaaaacaatgtctccattaattgaatgttttcagaatgcttgaatgcatttgacgaggacaacgttgaggacgacttcgagaagttcctacaggtgctttattcattagaaagggtttctcttctttaaccattggctctccaacaggcaacggccattcgtgctgctgagaaggcgttggaaaaggtgtccattgacgaggatgacgacgcctcttccattgtgtcatcggtagggcgggccaactttgtaattataatttgaatcatcgaatcagcacaaattctcgacaagcaaatgacgaaaagtggagaaagacatcggaacacaaagagaaggaagaaagaaaaggaaaaaagagctgataatgagccagtcaaaaaagtaaactccgaaaattcgtttccgcacctccgcttcatgttttaaattaaaatggtatgctaacaccgtattccaatttttggcagttgtataatggtagcgcataggcagcgggacttatacataccttcttaatatctgtctaattattttgatatttttactcaatgttgaaagcgagtgatttaaaaacgataaataaaacgcattgtttctgagtctaataaaaaaaagccgtttgttttctaatatccgtgtgagttcttcacttcaggttaggggtgtcgttttttcatttgacaataaaccgagaaattgccaatcctaaacaggtcacaggacgggtgagtggccatgaaaaaatgatttttgtaacaattagtaatacaccactgcaaaacattcgtttatttacttgtccattattcggtactcattcgctttgggtcctatattttggtcaaatttttttttgttttttattatcagaattgcttttttaatgaaacgcttaaaactttttacacttgttatcatcatcgatttcgaccacctcgggatcccggacccgaattcaaacaaaaagtcgaaaattcaaatttttcaaaatttgcttctatgttagaatccaaacaaaattatcattttttcatgtttcaatgatttatgactacttttagctttatttatttatttattcgtaaaaataaaaaagtcatcagaagggtgagaaccacttactctgacgactattcaggtaaatgtgtagtagagtaagttacaaaatacagtcatggtcatatgtttaggaacacctcttttttgaataaattctttgaaaatattgcttctctggattgaaagaaaaataatcaataatctttttaatgcattttgtagcattttttcaaattcaggtaagaatggatgctgatcaaaaaaggtagcaacaccaagttgatcagatcactccttcatggtgatctgatcagcccattttggctgggaacgagggtaaatttcaaaaaaaatttctagggggttgggaaactttttctggaaattttgagtaggcccattttatagagcacaaaatttgctaccgaattgcctttggaatagtgggtctacgatttaggcccgctgagatacgtcgacttttatttcggtgcctataaaaagtactgtatttcttaagaaaataatgcattttacactacttcaaaattgaagtgcccatacctcagccggtataaagtcat

SEQ ID NO: 4993 - DNA, 3031 bp, Heterodera glycines
  misc_feature (1261)..(1262): n is a, c, g, or t
  misc_feature (1275)..(1275): n is a, c, g, or t
acaatttgatcattcgctggtaaaactaagtctaaccacgagttttccctggtgggtccattcgtggcattgaaaaggaaagcttactaaaaaagtggcaaaaaatttcaccaaatttactcatagaaattggctgcccttccttccataccaggtctttattcggaaaattaaaatcacccaacacaacacaattattgttatagaatgtttctaaaaatttaaaaagttctttggtttgtctatgtgttgtcttaggtggtcggtaaacaagcacaaatctgattgattttagtttttgtaattgaaaaaccaaaatttcgcaattatattttgtttcagaaaatttaataaaaaactcgcaaccgcccccacgcgttaatttttgtgatttcctatgacaaaaataaagttatagttttcgcttatccatggactaaagaggattgagttttcatcctttgtccatgtttcagttaacagaaaaatttctatgtttttatttaccaagtttaaagctatttcatcaattttgttgtggattgatcttatattaactaagcaggctttaacttcccctattttcatcattggtttattgggcttaacatgcttaagaccggaaaagatattcttattttgtgaaaaatatgtatttgtcaaaagtgatttggggagaagtcaattgattttccggaaattgggaatgttcgaccgttcaatgaccgtcccagcgtagatcacccagtctccgccgtcttttcgcttctctgcacattctttctgcagttgtcaacgtacgtccgctgggctcagcgacggacgaatgttcatgttcttccatttgtcctgctgcatcattgccccacgccgtttgttccattcagccaatgccaggcgctggaatttacttgcggggaagataatcttcatcaaatgaagtagacatattcttgaactttgccggaaatttttggttttggggcaatggtaaagaattgtggttcctaattattaaaaaaactttattttgggctcgaaaccaactttataagggattttcgagggtgctgattacgaatcttaactcggatttatccaattccaaacacccgaattcgaacaaaaacgaaatttttttgcgttgatccatttttctggggtaaaaagcttctaattcattcaacaattattaattctgatgtaaaacaatgcttcaattgttattatttatatggtccctaaactgcatatgaaccannataaaatgtctcnaaaagtatttatttttcaaaaaaatcaacgcggcaaaatttcaccgccaatttttaaacttcaaatttaattcataaagcgaaaaagtatatgaaaatcatgagttgtcattaattttaaaggtacttatgcagtttacggggcagatttaacatacattttttaatgcctataaaggtattcattttacatgcataaaaacataaaatacggaatttgaatatttattcacgaaatttgataaacagaagcaacttgagtccaaaatttgtcctttttgtcgttgaaatatagttgcatgtcttttccgcattcacaaattttttttgagtgaagtaatttgcattctcggagccattactcagcgtctggtttttgcagaagagtaaataaatcatgaatattgaaagtcttttaaagtttccatgctcaaaataaaaatgtaaaatgaataaggcattaaaaaatttcttcgacgtatttcgactcgtgagtttaatgaatgcaaagagacgcgaattgcatagtttttattccatctaacatttgtccttcatctatttttaaatatttaattttgatcaatataaaagtatttccgatcaaattcctaaaatggatctcggcaaaactgtggatgctttagctgaagatgagtcggtggaactcttaaacgaatcagcagaatttcgggtaagacaacacatttaacagacagtgaaaataactcaaatttaattttgctttcagggcgacatggactccagtttcggttccgaccttcactcggtatctttccaggagatttcctccattttgcgtgccaaaccggacatcaacgtgttctacagaactccatgttcgggtgccagtcgattttcgcgtcgttcttcttcagcccgtacacaaattggtgttatttttcagaatgaatgaatggctttctatccattgaatgtttccagaagaccacttcagtcgtactcttcccgattcgcttttgctgcgcatttttttctatcttaacaagcgcgacttggttagtgttatgctcgtctgccgccgcttcggccaaattgcgtaagacaaattcaatgcgtgtcgggggggggggggattctgttgaattttaggattacagcttattaaagaactatttggtctgtatgatcaagggtcttgccgtacccttggcttcggggtggggcgttaaagaattaagtcccctcacaaatcaggcctcccccctctggctatacccttaatatggaacagtgtcttcatcatttttatttttctttaaaatttagaaatgacaaaactctctgggaatttatgaacttggccggccggcttctcgatgaagagtccatccatgctctgttcgaccgtcagctgaaagtgctgcggttggcatcgaccgaagtcaatgccattaaacaaattagctgaaatgaatgcatctgacaaattcagataaaacccctttctctgttctcgtggtacaactcgcagcagatgaccactgcgcagttaacgcatttggacctgagccaggccaaatttggctcaagcgacacactgctgcgtctgctcattcggtgcgagtcgcttcaggtcagtgagtcatcggcgagtggacgcaataaaagtgccatttaaaagaggcattataatagcatatttgttgtaagcaggggcgtatctagaaacatttttcgggggggggggacccgacctgaagactttttttttt

SEQ ID NO: 4994 - DNA, 1681 bp, Heterodera glycines
aagggagggggcgggggggtcgacccccccccttttccatgtatgttttattcccctctgaactttataatttttcagactcgtggaactgaatttgtcctgggctgaggtggatgtcgatgccatgctcgccgtctgccgacttatgccctccggcgttcgtcggctaaatctatccggcttccgacagctttcgtcactaaatgaccgcagtgagtctctctctgttgggtgcattacgttcccccccccccccccagaaaattttttgtttcttaatctacaaacatgtttaaaaaaattcgggggaaacggcgggggtggaggagaacactgctcccctctctttctgttcgtctcaattttgccctttatttccccaaggcgttgcccagctgtgcgaagtttgtccccatctcgtagaattggacctgagtgataacgcgttgctaactgaaaattgcttggattccatttgcaaccgcctcaaatacctccgccgtctcacactgtcgcgctgttacggcattgaacctatggcatttctgcagttgaacacccttgacgaactgaacattttcgggtgcattaccaatgacggggtgcgaatagattttgtttgtgttacatcaacgcccttttatcgccattttttgccaggtgtctttgctgcgaagtcggcttgccccgactttagtcaacgcgtcgccttattcaacagtggctaagccgacggtactgtttcaattgaatagaaatttttaccggtacttaggaggagactgataaaacacaactttcaaacggaaacatggtcattttaaaaagagaaattctaaattttaacaagactaatctagcaacaaaaatctctaacaaaatttgttttttctggattgcaaattagaccccattttgacccgataatgcgcaattatactggtaatgtgataattattggcggtattactttgctacttaatcccgacaatacaaaatcattaaaaggttggagacagtgtgtccagcatttggcggcatcgtacccgtgacctttactgaattggaatgacttggttcgttctttccgctttgatctcctttccctcttctcgccaattttgccaccattttcgtcagcatttttaccttcagtagttttgtcatattgataatattggatctctcaaaagcactttcaaaatcttttgtttctgtttgtgttttcagttaatttagtttttcaccaattttttctttttgtctttcattttttgtaattttaccttctttttggtggatattctcctgttttcttctggacttaccaaaaataaaattttgagatttgactggcagttatcatttttttattaaagtggaacatttgtttggcattgtacatacaatattgatctcttgttaaattcaataattttattaaatttcattttaaatattatatgaggctgattgtgagggcatccgacactcgtgttgttttctcgtatttggatttgatttgtctcccgtcgctgctttcacaaattgcgcctttgggctatttgctgctgggagtgcgttctgttcggtgttgttttggccacctgtcaaccgttggttggcattgctttggccaaagggccgtgccgacctttctccgttctctgtcatttgttgt

SEQ ID NO: 4995 - DNA, 7832 bp, Heterodera glycines
  misc_feature (2627)..(2627): n is a, c, g, or t
tccgcgaggcgctttctttgcgcccccggagtgatgtatttcgtgcaccaactcggtgtatgaccctttgttcacaaaggaagcatatgcgatttgagcccctatttggaatgggggttcgttgttggattatggccgaaaaggaatgattcggctgaggagcgtttcatttccttccactggcctccaccgttcctctctgaacggccgggagaagcggaacggtgttcctctcccttggttggctctcccctcatttgaatgagggggaaaattccggggtttttcctctccccggaaaatttgagtacatctctgtacttcttctttcacttcaacgatggaagagatagctcttcggagctctgtgcagttaaaggctcctcctgccctcatttccttctcaaccacttgggtgagaaggtggtagggcagtttggacttaattgtggaggccatgaacttattttgttcattctctccatagtccaacaactgatggcaaatccgctcaatggactctgagaattgtctcagagactgaacggatttagctggtttggcaaggtggagcaactccgcttggatggactccaccattgtcttttcatccccaaaccgctttttcagaatctcaactacccttgggtagttttcatctgacggtgggtataagtcaattgctctcctagcaactgacttctctgggaggcatcccagcaaataaatgtgcttcttgaagtcttcaatttgaagactttcaacggaagtctcaaagagcttccaaaacaaaggccattctcggggttcccccgagaatttgggcaatgttatcggcggaagcgtcacatcatgacgctaatgcaccactggtgcctgctgcacaacttgtgctggctgatttggctggggaattgcatcccccagctccgagaggcctaaagccccttcaatggtgtcgacaagccctcgggcttggtcgacccaatgcatgaaggccttgccttctggtttgaagtctctgtaattttgctcttcatcttgaagagcttgtcccttcactctcaggaaaatggcttcccattttccattgtatttctccaaaagagaaattgttttgcagagattttgtctctctgcgatcagatctgcacggacactttggtccgccagctctttgcccaagttttcttgggctgtctcaatatacatcttgagacgcaccaccattggtgcaatggagatgcgcaagagctcactcattgctcttacgcttgatgaaaacacaataaacccctttgggttgtgtgtttgatccaagcgctcaggccgcgctttggattggtttggttggagggtaggcttacgactggaagccgacccctacggggctccaattttgtgggcaaaaagccacaaaaatttgcacttcccggcagaaggggaagcagactctcccggcagaaggggggagtcttttaagcaaagcgaatttctgtccaaaagacagaaattcactgaatgtccaaagggacgaattaaaggaggaaattcctctcctttactgaagggacaatttggaaggagaaatccttctcctttcctttgataagccttttgtgacccaacgggggtcaacggcttaatggtctgtattaaagggctcctgggtgtccctttaacagaaaatgataagactaagactctttcttaatctttattcaattcaattgcacaattacaatttaatgcaaatgcttggacagaaaactgtcccgacttaatgctgatcaagcagaagtgcttgtagaaatctcacaagatgaagtgaatcaagaagtgagaagtaagaagcaagaagcaagaagtgaggaaaatggagaatgggccgggcttttataccctcacaaatcaatgggggcggggccaggcacgtgaaaaatgtgcacaaacaaatggaaaaaaatccataaaaatatgaggaagagagaagatgactcataattaacgagcgagcgaatgcaaaattgatcgatgaaaaggattaaaaaataaatgaaaatttccaagaaatttgtgtcgcttttggcgacattctccgggcctcgagggtggcggcaactgttgctgtcctccgccaaaattcttttcatcgtcggttcatctgaagtcgacgagccacccttggaggacgattctccaaacgtccatctggtagctgtgcttggtcaggtggaggaagatgcggttcctccaccactgcaggcgctctccaggcaactccgactcggtttcggatgttgaccaattcgaccgggtagaggtcgacgagcatccctccttcgtgagggctgaagcctacatattcttgtaggcaaggcatgaatgggtctatttcgtgacccatgtcaagtgctgtctcgtaccatctgggttcatggtatcgctcaatccacgaactcagaggctcaatccggccatgaactcgacgttcacgccggagatgagcgtcattcgctctctcttcttcctcctcttccaatcttggatcgcgtagccggcgatcaacatgatcgggaaccaatggtaagactggctcccagtcttcctcaaaccatgggtcccgngtggggattctcatcgccaaaaaggcgatcattgagaatctcggcattttcgggtatgacaacccggctagcggagaagtacggcccttctcttatgggaataggcattccgtggaaggatgatttgaagagtgtgtttgggtggcaaatcagccacccttttataccaccattcgatggaagcgatgaatcattccccacaacaagggatgactcacaaaattttttgactgccgagaggataggacgtgattcaacaccatatccgaaggatcctcccccggccaagtacagtattgccaatactgtaggcacattaccgtacccctttctcgttatagaccaggaaataaatttccaaagtctatagaaaggagaaagtttaatgaaaattgttaggcaaacaatgcctacacaaataatcattatgaagatgagtgatgattggaggccaatcaaagaccaaagggtcgccttccaatcaaaattccagttaggccaactggattggctgtttatcactctttcagagtgatttggactgtaatcttctatttgttcgggttggacatagtgtaatgtccccctgagaacaaaagaagtgtttccagccaaacattttgtttggcaatttgtgtcaattctggctttatcaaaagccaaaattgtttggtaaattgatgcgttggaatcacattttgtcgaaaaatgtgttccatcatcgcatttaatttcggcaagagaattgccaaaatttgtcgagcacacataacggaattgtgctcccgttgaacatctgtaacacccagatatgttcaacggcaaaattgtgcaaaggctttggtgaagttccaaagccatttggagaccttcgatttgaaggtttaattggacaggactaaatcctgtcaaggcaattacctttctcccagtatttctgagttggtaatttttgatgtttaatggaagtctcctctctggactttccattaatttttcaaggttatgtgaacggcaattgcagttcactaaacctgatgaatggtcaggtatgcaatcagtgcatgcctgaacaccaagactgcaattgaaatcaattgcttcttgccgacttttacagttaaagtcaattgttaatggctctctggttagagccatgttgctcccgtcataaacaaaatctgattttaagacgggggcgggcggaaaagttactccgatcggagtagactgatgtgttcccatttcagtgttcttcctggatagaggaacacctgagttgacttggtttttcgcccaaggtttccaggcgaattattgcaaaaacaataaattcccaagaattgcagcccatgatttcatagactgtcttggacttttcctgagcataccaacgataaaaaaggcatgcactgccgcctaagaggcatttattgccccaaaaggctgtgctgtccaggcaaaatgaattgcctggaaaatcgttggcatcttttagctcaggaatggaagtattgtggcgaacttcgctacaatactttccttcacaggatcccatcttagggcaccttttagcggccaacacattaattgcgtatgaacgttgccactctttagtgaagctttggcattccaaagctaaagccttcagcaaaacgttaattgagccaaggagaacaccttcctctgttttcagaagaagagtgtttgtttggccaactggcagcaacgtaagcgttgctgagttttcgacaatgcatctcatgcttgtcgcatttttaaagcatttttccgatttggccatgactgcgatggtctctgctccagtcaaatcctggagagagttagccataaggacaacaaacgccattgttctgtaaacacggcgtgatgtccaattttgagaagctgttgcccttggcctcctatctttcggaggccgatttgggccagctaaataattattggcctgataaattgaattatcagccaaatgaccatataaagtcctgaaaacaggacttttaatatggaaaaagccataaagcttatgctcatgaatgataagcaaagtccccctgctaacattgatgaaatcaatggataacaggttggattcgctaactgttcaatgcaaaaatagcattcgatgagttcacactcatcaactgctggacataaaatgtccttcttgaacatgtgtttcgaatccatccaaaaatgaccttcgcattggaagtcatttaggaggatttcctttggtagctcataagtgagcttctttacattctcatgaatgtaacagttctctgcacagaagagctcaactttattaatttcctttggaatctttgctttaacgcctttgttaaagcaaagaagtttgcactcattgcattgattggttggataagcatttgtttctgttccccccttaacgggaagagggaacaaacatgctaaaattacagtaaacgccattatttgcaaaatatggcgcgctgtacaaaattgagggattgcccctctttgccttccttcttgaaagcaaggcgtgctctgatcctcaaaacaaagtaataatactttgagttggatcattagccaagcaatggttttacgcccaatagaaagggcttttaaaattgagagaaccatcaggcttatgctgatgtaaaaacaaagcgtcaatgctatgattgattgctctgttcgattaggaagagtttcttcccatttattgtccattcgattaatacgaatggaaaaaactgaatggctcacaacaccattcttttttatgcaacagccacagattttcttatctgtgggagttactttcggtgtcttctgctcaccgaaatgagagtcagattggtatgaaatctgactcggttgatcgaaaagaactgacttttcgatcattttttggtggtcgtgctttggcatgaccatggcacgacaaaaaaatgaatgtgatttatttgtcacatttttcaacccactggttgagctgcagtggaaagcaatactttcagacggtttatcctctactctagaggatacgcctgagtaaagggtttttgaacgaggaaactctcctctttgtttggaggactgtttcttctgaacagtccttccttcccttatctgttgaggagtgctcccaattggagcatctccatgataacagatcatatagtggtgctttccaccacacttcaagcatctctttggagattggcattgttgtgccttatgatctttcataaggcaattaaaacattttcgctgttttgcgagccgccttctgcgtgctcctggtgtggaatattggggacatcgacttggaggatgtcccacaacacaacaaagggaacaagtttgtcttgtccgtgtccctatttttctttgagaaaattggggacttgtcaatgtcagaaatgatctgtttacttgaggagacatcatccccacagaatcatttctgttgtcgggtctctcgtgaccctggataaactgattgggaggggactctgtccccatcccatggaaatcattcctctgcacttgcggaggaatattccattgtttttctcctccataacacaccataaagtggtgtctttcaccacattgactgcacctgcggggtgaggtgcagttcagggaattatgccccataatgaggcaattaatacacctgtcttggtccgcgaggcgctttcttcgcgcccccggagtgatgtatttcgtgcaccaactcggtgtatgcccctttgtttcacaaaggaagcatatgcgatttgagcccctatttggaataggggttcgttgttggattatggccgaaaaggaatgattcgtctgaggagacatcctcattgccgtttcatttccttccactggcctccaccgttcctctctgaacgggcgggagaagcggaacggtgttcctctcccttggttggctctcccctcatttgaatgagggggaaaattccggggtttttcctctccccggaaaatttgagtacatctctgtacttcttctttgacttcaacgattgaagagatagctcttcggagctctgtgcagttaaaggctcctcctgccctcatttccttctccaccacttgggtgagaaggtgatagggcagtttggacttaattgtggaggccatgaacttgttttgttcattttctccatagtccaataactgatggcaaatccgttcaatggactctgagaattgtctcagagactgaacggattcagctggtttggcaaggtggagcaactccgcttggagggactccaccattgtcttttcatccccaaaccgctttttcagaatctcaactacccttgggtagttttcatctgacggtgggtataagtcaattgctctcctagcaactgacttctctgggaggcatcccagcaaataaatgtgcttcttgaagtcttcaatttgaagactttcaacggaagtctcaaagagcttccaaaacaaaggccattctcggggttcccccgagaatttgggcaatgttatcggcggaagcgtcacatcatgacgctgatgcaccattggtgcctgctgcacaacttgtgctggctgatttggctggggaattgcatcccccagctccgagaggcctaaagccccttcaatggtgtcgacaagccctcgggcttggtcgacccaatgcatgaaggccttgccttctggtttgaagtctctgtaattttgctcttcatcttgaagagcttgtcccttcactctcaggaaaatggcttcccattttccattgtatttctcaagaagagaaatggttttgcagagattttgtctctctgcaattaagtctgcacggacactttggtccgtcagctctttgcccaagttttcttgggctgtctcaatatacatcttgagacgcaccaccattggtgcaatggagatgcgcaagagctcactcattgctcttacgcttgatgaaaacgcaataaacccctttgggttgtgcgtttgatccaagcgctaaggccgcgctttggattggtttggttggagggtaggcttacgactggaagccgacccctacggggctccaattttgtgggcaaaaagccacaaaaaatgcacttccctgcagaaggggaaggttgactctcccggcagaaggggggagtcttt

SEQ ID NO: 4996 - DNA, 7067 bp, Heterodera glycines
  misc_feature (7)..(7): n is a, c, g, or t
  misc_feature (23)..(23): n is a, c, g, or t
cttaatnttgagaaaaattattnttgagagcaagttgcctccccctcgaggcccattcatgaaaaaaaaataatttcaaaacttttcttgggcaacaatgaggcaaaaaacagaattctccgattccgcctcctccgaattttcttttgttttcacgggtttatttagaggcctgccaacccaaaaaagtgcattcattttgatttgtccgaatattcattcattcatccgctctcacaaatgctgtctctccaagtgttcctgacggcgttggcgctgcagcgcggccactcggccctcatttttgtagttgcggccaaaatgcgggtgctgtgccgcctcccactgctgctgctgctgggcgccaatgccatcctcagcacccccaccaccaacggtggtggcactggtgacaccgaattcgttgtccgctgtgaccgttgatttggaaaaggaatctagcaaatcgtccacgtccattaattggttttagagaataataggtttttgtttgatgaaaatgctaaaatttgaaagtggatacaaaatgtaaaagcaagcaatttcttaatcaaatcgtctgttttaaatttaaaacctcaaaatatttgcgataatttcttggaaattgataccatcattaggaatgaagaaagtacttgaaaatcgcaatttgaccatgtcaaaaattttgacttttatttatttttttggccttatgcaattttacgaatttgaaaaacgtcaaaaagagctaaaattcccaaccaaacgatttaaattcatttaatgctttggaaatcttccaaaatgtgaatgtaaatgtgtacaaaactaattagataattaagggaataaaaaatgcaaagattggataaacaaaacgaaaggaaacgaatatcataaaacgatgtgaacgcatattatataaaaataaaataaataaataatcgtttgtttttcttttctgggggtgtacaaaaagtgaaaatacttgggaagagatggagccatttaaatgaatcttttgccatcggtggagattcaaaattccgaaattttttttgacatttggactagccttattagtggatttctatcggttgaaatccgacatggagatttttttgatcaaattttggtcaaaaaatccaggaattaaaaaaaggatttttcgggcctttgattccatccctagtcgacacagcaaagattcaatcgcgaaaaacattgtgcaaataataaatgaccatgacaagtgctgtctgctcgagacttttgacagtcccgagaaacggtcatttaaaaaactcgaagcgctaaacatcgcaagcacccatctcagaacctatgagcactgaccatgaccattaattaattaattggcggactatacaaaaaacaaacaacaacattaaaaaaacgggtggcttgtcgttttgctctgttcaaaaaaatgtatataatatagtatatttatgtgtgtacgtgttgccccaattttcattcttttttcatttcatcatcatcatcatctcatcaatcatcatcttcaagcagttcattcattgttatgggaattggtgctgctgcggaaaatcttcttgctgctgttgtccggcatagccttccataagagaggccttaattttgctgatttcctctggaggcgtctgaaaaaataaagcaatgggcatgtgtgattgtaattttgaacaaatttcttaataaaatcctaaaatctcaacaaaaaaaacattcaccaacggttcctctctatcgcaccgcctaaccataaaaaccctaattttcccttaaaaaattggcctaaaatctctataaacttacaattagtatttttggtgaaaatgttatgaaatatacaaattttcagaacaaatttccctgtggcgcctaacggcaccgttggatctccgccctccctgaaagtttttttgaaaaagtgccgcaaaaaaagggtcgtgtcgatttacacggccggacgggcccctcccttttagttgaccaccgccctttttttaatgtgtgcacctgttgctgttgtggaccaccgtcagcgccacctccgttcccggcgcccgccagcgaagcgccgccccctggcgcgccgctttgcgagtgaactggagagaattgaaaatcaatttcgaaaaagtaaaaattcggttccagggttgagctttaatagcagatttctggctagaagccctcagaaattgtgctggaatgtgaagtccccggcaccaaaaatgccggaatgttgagccaaaataaacgcaaacccatctccctgagattttaggactcaattttagacttttcaacggcaaaaatgccaaaatgctctcctctcccacctgagctgggcccggccgtttgacttcctccgcctcccacattgcttccgggcgtgcctccgttgaccccaccaccgccgccgccactgaatgccggcgactgtttcatttccatgccgccgcccccgtcgccggccgtgccattgagcagcgaatggagcggaccattcggcgccggtccgccgccgttgggcgctgcgcgactatcgcctaaattggcaaaaacaaattttttggaaatttgccgattttttgggacccaggcggtgccatttattttttagttttaaaattacgaaagggtgcacctgacgagtcgcccattcctccgccgccaccgttgctgttcatcggattttgtgccgaaacgctggacggcccggtgccggcaccgccgggcgtgccaacgccacccgccgagtcatggtggccggcgaactgaaaaaacgtacattttagtcaagacaggattttttttgaagggggaaaaggtcgagactctgggcttttttaatgctagcttttttttgtaataattttatcgatattttttaaaatcaaattaaatttttcttttttttgttaaaaatgaaaataaattttctaatttttcaaaacaaattcgtaaaactttattttgaattttcctgttgttgaaattttttaactggtttaaaaatctaatttgaaattgttttatgaatttcgtccgagattttttttgaaaaatgaaatttatttttttgctaaaaacgtaaattttttttgaaaatttttaatttttcatggctttttaaataaaactttttaaatttcgacctgggactgcatgctgcccggcatttggttgcccatcatgaaatgctgctgttgaccgcccccgtcctgctgctgaggcgggcccacgccggcggcgcctaaacatcggacaaatttttttttaatagtctactttagcaattaaaattgaaaaattccgtccgacagtgtcagcggtgccaaaaaacgccaccgatacaaattaaaaattgtggggacctgccggtgacatcagcgaagcagttgtcgggcacatcatgccgccgccgccaccgactccgttgtgcgccagagggttcttggaaattattcatttcaggaaacttgaaaaaaaatccccaaatcttcgccccatcattttttaacagcgatttattcccttccatattttcctggcaaattgtaagggggtcaagaaaaaagagtgcctgcttgtgagagttgaaacattccgagatagagcagttcgttccccctgccccaggccgtaaaaatttcaggaggggcaccaaaaacattttttttttttgctgttcttcgggccaaaaaaagctttttgcccgtgtaattttcataaatttttggagtcgtgaaaaacggtaaatattgtccattttgcaaaaattttggccattttgagccctaattttggcaaaatagttaagaatgcggcccaatttatacatggaatggcggcgtgccggacggggagtccatgtacgggtgggcgttgttgaattgggcggcaccgccgccgcgcactgctcgcccaccgttgttgtgctgctgctgttgttgttgctgcagcacatgaaaatggttgcacaaaatattacattttattagacagatttttgcaggcaattttatagaaagaattttggtttttggaaaaaaaccgtgtgccaatggtttataataaatccgaatcagataaagcataaattgtaactatattttatcattccttctcccgagggatttccaatttcatgttgatttaacggcattttccaaaaaaagaaagtagggatttcacgagatttctcggccccatgggtttttctacatttccctgaatttttcaaaatctactaacacaagtgggggatggaatttttccgcactatttgattttcggcatttttgccaattttttatgattttcccttttttcgcccaccatttgcatgcgaactgcttggttggcctgctgttgccgtgccgccatcatcatgcgcagttgctgctgctcgttgagtgccatcatttggggcggtgccaaacccatggggaaattgggcggcggaccgccgccgccgaccaccgacgacggagtgggggcaccactccttgaaaaaagggagggccaaaattattcatttttaggtaggcccagtaaaatttaaaaaatggaatatgtgtggccccaaaacaaggacagtgtgcaaaattcatgaaaatttcgcccgaatttctccggcggtgcccatagacatggcatcgctaaatggaccatccaatttaaaaaatttgacatttttggccaacattgagatttttcttttttggaggggcgggggacgggaatcaattcgtgtccattgcacaaacctggtcccctgctgtccgtagcgtggtgggccgccaccgcctgaaaattggaaaattcaaaaaaatttaaaatttcctgaccactcatcactgaccggggatgggtgacgcctggttggaggaggggcccggctgggggcctccccggggcccgtagtacgcgttcggcatcattccgtccgggaaattctgcggcggccctccgccgggacccatcgccgccgggttcgggaactgcaaattggtgaaagcttcaattttaaaatcccaaatttacgtaaataatacagacacactaatgaatttttttaaatttaaaaattttcgagttacgaaaagatttggcatcgaaatttcaaaatttggagtgaactctgttaatagacctttcagcaaaaataatcaaatttgaagccagagaaattttttttagaaaaattcgcatgaaatttaattaaaaaattttcacaatttttcaacggaaaagaatacaagaaaaatgcatttatatatttcgtcaatttttcattttcccatccactgtaaaaaaatgcccgaaaatgattttttaattcgtcatttttcgattcctcattcgccgtttaaaatttgcaacacacgccccagtaataaaaaaattcaatatttacccgccacagccgggtggcccgtacatgccgcccccgttgaccatggccgcctcgtggggcggtggcggcgccggtgcgggcactccgttgtaatttgttggcgggaacatctgcagatgagcgagtgcccgtgggaaaaaaaggggggcaaaagtgtaaattgggggcaaaaaacgggaaatgagaaaccattttgtgataggtttttgcctccgaggtggcgtctaccttgtctttcttgtccggatgggcggaatacaggtcccaaaacacactgaaaaaggggggggggggaattaatttaaacgaatttttaaaatttcggattcggcaaatgagtcgtctcataattaattatttgggcactatttcgattagaattggcatcctaggattgattctcaagcagcacttttttgacataattgatgggactttcttctaaagctactgtttcagcagctaattttgattacgcatttttttgaaaatccattttcataaaaatttctatcaaattttagaatttccgaatctgccgtccaatttttcatttttgccaataatttattaaatttaattatttaagttaaaattaggcttcatttgattcaactcggtatattctgtatcgaagataccacaaaactgttttttttgttttgttttttattttaaaaaatttagcttacttttttggtagaaaataattatgagacgcataatagttttgtttgtaccctttccattttttggacatttatttaaaaagcagcatctaaaacacaatttttcatgggttttaaagtcgatggccatgaaaataattccgttcccggggaccaaattcaaaaataatcgaattttatgggttgataaatcagcacctccaccaattataaaggaagccgggcccggacgagctggacaagtcaatttgcaggttcggcatgttgtgggcgagaaactcattcttgaacatttctgccgtttttgtggcgcctaattggtacaaatattcgtagacaaattgtgacagtctgaaaatttgattttttaaaattatttaaaaattttttacttttcccgggcctgcgaatctgaggacagaaaattttccttccgctgctgctgcatttgtgagtgaggtggcggttgttgttgaaacattctctccttttttattctgctctcgtggccaaatttaaaatggaaaaatttatctaaaaatggaaatttacgataaaattgagggacaatttagagagttagctcagtaaaaaggcattgaaattcatgcaaaattatcaaccagctcaaagacatgaaaagggtaagttttaaaaatttttgggactgggtcgttttggcgccgacgttttggcgccagcctcagtttttttattataactttttttcttgttgaccaaatctaacaatcttggtatcattcgaaagcccttcacaagctctattagccttacaaaaaacaaacaaaaattttagcttctaaaaaagttattaagaaaaaaactcaaaaatttcgacttttttggaatttcatgttataacttttttggtaattggctactcgcgacccaatagc

SEQ ID NO: 4997 - DNA, 2800 bp, Heterodera glycines
aaacggcctggaaaatttttcaggccaaatgaaaaagctcatgatctaaaaggcaaaataatttactgccaacataaatggagctctttaagcagagctacaaccctggttaatagaaaaattaattagtttaaaattttatttaaatgtttaattaatgtcaagaaggtcaagggagaaagaggagatgaaagaaaaaacgaaagtgcaagaggcgcggcaaaaaaaaaacgaaaaaaaacaaaattaaaatgatttgaccgaattggtcgagtgtttgaatcggttgccttttctggtccggggtggctagccatgccagagttcctgtgtgccagaacaattacgttttgtcaatttgacattctctctaaaattgaccaaatctatcaatcttggtatcattcgaaagcccttcactagctctattagccttacaaaaaaaacaaaaatttttgcttctaaaaaagttattaagaaaaaaaactcaaaaatttcgacttttttggaatttcatgttataacttttttggtaattgtctaatcgcgaagcaatagcttagaaatatcttctaaacatgttaagctttcgattgataccaagattgctggatttggttaacaacaaaaaaagttataacccaaaaacttgggctggcgccaaaacgtcggagccaaaacgatacggaccaaaatttttatcttacaattaaattttacagattattcataatgccaagattacatttaaaattttaccgtatatttttttttactacacatttttaggaagcctcagtcactgaaatttttttccttaattccaaataccgaatttctcagggcccagcatggtttctcttaaatgccttatcgttttaaaattaatatatttaacatatagtttggctcaattaaagttgaatttgtcaagcgcccggcggtgcggacggaccggacaatcgatcaatccgtggcgtggtgttgggtggggtggctcctcctctccatgccctattttcaacagagcataaaaagaagagagagaaaagggaggggacgggagagaaagcaaatggggaaaagaaaaaggaggaataaaaagaagggttggttaaaatatttttatagacgaagaaaaagcaaaagcagcacccttttggtgtggtatgcttctgccctttgatgagggggaggaagaagcatagagaaggggaggagaaagagggaggcaaagaaagaatgggagaaaatgagggggggggggaagggactcggagaaggggtcagtcaatccctacgcttcctcgtcccccaaacactgccaacaacaaatatcggcgtggatttgcggcgagcggagggcgggggcctagaggagaggtgggatttatatcgccgagtggtagacaaggcgcggatgcacggcggagcgccgccgcgcccaataatgtgcaccaccaccaagccgcagcagtccaactccccactcacacccatcatcattagcagtgtgtggcgggccattttactaatgaatcggtggtggtggcacacccattgtcgtcgcttcccaagccctctcccccgccatctacccccattcattgttgtgtgtgtgaggtggtggtgagcgacggcgaggaggaggagaaggaggcgcatggcaggcccacccctcttcctcctcatcctcacaagaaatatttcttgactgggtgataaatgggttggggatggttcacaatgccttgccggccgcccatcttccacttcatcaattgttgctatgctatgatggtcacgaggataaggggggcgggagcgaaggacgcgcgtaatggtcgcatcgtccaaaccctgctggtgatgatgatgatgaagaggagatgagatggtgatggtgaactgcttgctgctgttactgatcaagaaaatgaagacggacggacgaatttattccgctgctgctgctgcttgttcaccaccagcatcacggcagaacagacggtctcttcaattggcgcgaaaactgcccaatttgtacacccaccaccagacagctcatacattttttgtacaatagcagttttggggggtgtacacatgacgacaatacacatacatacagtaattagtgctgcacgcgtgacgcgtaaatacattttgtatgtgtagtcgttgtcctacatttttgttgttgtactgctccgtccgtccccgctcatccgtccgctgcggcggcgcgcgtccgccccacaaatattatatatgatatggcggtcgttcgtcttctccgtgctcttccccttccccacccattcattccgcactgttgtccatcgtttgtccttcctcgcgccggcgctcgccgccctccccctttctcgtccatggcggtcggtcgatcggttgatgatgtgatgatgagacgggcgagaggcggggctgggcaaggaggacaccaattggtggtggttgtgctaatgatcattgcggttggttttccgtccacgcctcgcgtataatgagacatatacattttggagaaggccagcgagagagagagaggggggagagagaggagagagtacgccctcctcggcccccgaggcgacgactcctcgcccacaaacaccgccagcagcagaagtaacgattgcttccccgcccacccctcttctgacttaatgtgtatacgtgcctaaatgaatgcccctcatcacacaattatacctctcccccactctcggcgccctctctctccgtgttctcgacactctttttgttctggtgccgc

SEQ ID NO: 4998 - DNA, 3597 bp, Heterodera glycines
cagaagttatcatattcgcgatcagcgaccttggaaacctcaaattacgaattttcgaatttttctgagggggggggcagcataacccggaagtaccatacgtagaaaaagcccgaaatatgtaaaaaaatatgtagataatcacaattgtcatctatcacattctacgcatttgacctcatttcatcatctccaaatgtcaatcgtcttgtattacttttaccaattttttaaaatctaacgtgtaagtggtcaccccttcgttagatattttatttcttttttctttttctgaataaagatttttctgacatccctattaattattaattggtaaaataatttttaccttttcattctttgttgtttaaaaaataataattctttgttcacagaatgggaaagttccttaatccccttctgctatttggaatgagtgaattgattaattaattatcatgcgaaaatcaaatttaattacatttattctttttgacgggcgaaatttaaatattaatttattcattaattgtaataattttggatattttcagttcgtatattttttaaattctgtttgattaccaattcaaacaaaaaaaaatgtcggacaatccgaagaaagcaaataaagaaatggagaaagcgatgtaaatacctctctaaatttgaattttccatgctaataattttgcttttccattttcagcttcatctctgccgactgttggttggaggtgttcaatttgcttccgccatctcaacttggccttggcattgctatgattagccgccgttttgactattacgtcgacgaacattttaaaacgcgcaaatggaaattgggcaaaatgaaaattcgacgcaaaattggacagaatggcgcaaatgaaatgaaaattgtcaatgccaatggaaaagagctgccaatccctcaaaatccgttaccgaacaaagtcatcggattcagaagcatttggatctagtaagaatcatttgtgatcatcacacatactctttttttcagcttcatcgaccaaaatgtgatcacttttcttggccgttttgaccgctttttcgcttcatgtacaacaatgttgtccattaccactggaaatgttcgcattttggagtttattgtgctcaacatttggccgatgttcaaggacaccatttatctgcttagcttggacatcgtcgcttttcgtcgaatgcgtcaattggcgccgtcaatgctcaacgattgtccatcccttcgttttgtcaatttctttgacggcatttccctcgaatttccgcccgatgatagtgccaatgcgtcggatggccaaacggtgaccaaatggctgttcacgcctcgtcccgacaatttgatgaatgatctcattgtcagcattcaggattcagcgatggaacagcaatggttggcaaccgtggaacacatcaaagcggtgattagattatttgattattaccaatttaattagtctttttctattttgtcttcgttttagtcattttcctctgcttcttctcctgtttctttcgacatttatatagacttttcgctgtcctcttcaatttcttccattgtgccatttgaattgaccaacgaattcaccggagaaaaattggcactgtccaaagaagatgaagaagcagattttgaagatgaagaaaaatattacagtcttttttcccttagtcgttgtccaattgggtccgatgataagaaacagcagaagttcgagaaatttgacgaattgtacgaccgttggaacctaattgacatttggatcggagacgacggattcggcgatgggtaattaatacgattaacaattttaaaaatccaaatgcttatttttgtttttcttttcagtcttctcgacggttcgcccgggccgagtgatgatcactgatcagaacagcggaaatgaattgattgattggttattgatgcgattattatatgacccaaatgttgggcaaagatatttaaatattgttgtatttgattgttgctcataaattcataaaaacgagtttggtatttttgcgaattttcttcggattttgaaccggtacaaaaggcaatttttatttttagcaaaggatcttttaagtcattttgggtgcaaatgagtttgctgggaacaggatttagctgattttaacaatactttctcccagaacaataaagatttttaaatttacaataattttaaaaaaatatttttgtacaggcttttcttacataaaatggtaaaagtgaagaaaacggacacctcggatttttatattaaatatatcaattggttcctcttaacgagagaagacgaatggtaccattgttagggcgtggcaattattccgaacagagttacgggtctgtatcgtttcggcgctagcccttgtttttgaactataacttttttcatcgtcgatcaaatctaacaatcttgatatcattcgaaagctgaaaatgtttaaaagctatttataagcaattgcttagcgattagtcgcttactaaaaaagttctaactgaaaattgcaaaaaagtcaaaatttttgtgatttttttaaataacttctttacaggtcattttttttttttggtttttgtagggctaatagggcttctgaagggctttaaatgataccaagattatggttgtcaaataaaaaagttatggtccaaaaacaagacgcggcgccgaaacgacctagtccccagttacagacccggtactgaaatgtccaactacccccgggactaaatcgtctaatggcttttttaggaagcataaaaaaggcgcaatttatttattaatttgtcaaaaagaaaaataatcgatgaaagggaagcaaagctccaagactttttgaattactatttcttcggatgtccaatatcccattccgcccggttcttcaagtgtatccgaatatataaagcggaccaaatccccttccagtcatatccttcatcacttttattccatttgtttgataaattttgttttttcagttaatttctttttaattttctgtgcttaccaattcaaaaatgtcggacaatccgaaagaagcggagaaagaaatggaaaaagcaatgtaaataattacctaatctaaatttgattttctaaggtcattttgcttttcccttttcagcttcatcgctgccgactgttggttggaggtgttcgatttgcttccgcctgctcagcttggtcttggaattgcgatgattagccaccgatttgactattttgttgacgaacactttaaaacgcgcaaatggaaattgagaccaattgtaattcaacgcaaaattggagagaatggcgcaaaggaaatggaaattgtcaacaatttcggtggaaaagcattgccaatccctcaaattccgttgccgaacaaagtcatcggattcagagccattcagatcttgtaaaaactgaatttggaaattgttgtgcccatcacactttcggaaaactgtagtgatcaccccgctgagaaaagggttaaatgatttaccaatcgcgaggagttaattgtaaggaaagctcttgagttcccgcaagt

SEQ ID NO: 4999 - DNA, 4019 bp, Heterodera glycines
  misc_feature (1889)..(1889): n is a, c, g, or t
  misc_feature (1937)..(1937): n is a, c, g, or t
  misc_feature (1954)..(1954): n is a, c, g, or t
cgacctagtccccagttacagacccggtactgaaatgtccaactacccccgggactaaatcgtctaatggcttttttaggaagcataaaaaaggcgcaatttatttattaatttgtcaaaaagaaaaataatcgatgaaagggaagcaaagctccaagactttttgaattactatttcttcggatgtccaatatcccattccgcccggttcttcaagtgtatccgaatatataaagcggaccaaatccccttccagtcatatccttcatcacttttattccatttgtttgataaattttgttttttcagttaatttctttttaattttctgtgcttaccaattcaaaaagaaatgtcggacaatccgaaagaagcaaataaagaaatggaaaaagcaatgtaaataattttatttcaatttaatttaatgacaatcattttgcttttcctctttcagcttcatcgctgccgactgttggcttgaggtgttcgttttgcttccacgctctcagcttggtcttgaaattgctatgattagccgccgttttgactatttcatcgacgaacatttcaaaacgcgcaaatggaaattgagaccaattgtaattcaacacaaaatcggagagaatgacgcaaaggaaatgcaaattgtcaacaatttcggtggaaaagcattgccaattccgcaaattccgttgccgaacaaagtcatcggattcagagccattcagatcttgtaaaaactgaatttggaaattgttgtgcccatcacactttcggaaaactgtagtgatcaccccgctgagaaaagggttaaatgatttaccaatcgcgaggagttaattgtaaggaaagctcttgagtttccgcaagtcgagacttattttttcgtcttaactcctcgagatgaagcaattgattgggatataatttaacctttttctaagcgggccgttcactacagttcccgttacaatttcttatgattttcagcttcgtcgaccaaaatgtgatcacttttcttggccattttcaccgctttttcgccaaatgtgcaacaaatttggccattaccactggaaatgttcgcatttctgagttcgctgtgttcacaatttggccaatgttcaaggacaccatttatctgttgattttgaacatcgtcgcttttcgtcaaattcgccaattggtcccgtcattgctcaacgactgtcaatcacttcgctctttcaatttatgtgacggcatttcccttgaatttccacctgatgacagtgccaatgcgacggatggccaagcattggccaaatggctgttctcgtctcatcccgacaatttgccgaagaagctcagatgctatatgaattcaatcatggaagaacaattgtcggcaacagtggaacagatcaaagcggtgatttgtacaaattaattcattttttcctatttttaaaatttttttaggcattttcctctgcttcttctcctgtttctttcatcattttaattgacttttcgtcttcctcttcactttcttccattgtgccatttgaactgaccaacgaatttactggggagaaattggcactgtccaaagaagaagaatatgaagatttaattggcttcacccttattcgttgtccaattgtgtccgatgataagaaacagcagaagttcaaggaattggacttgcgatggaaccgaattggcattgatatcgcagatgccgaagcagcgatgggtaattaacaattttaaaatcgaaaatgcttattttggttttcgtttttctaggcttctctgcggttccccggggccgagtggtgatcactgatcagaaacagcagaagtaaattgattgattgatgcaattatgtgacccattttanatattttgtatttgagtgttgttgctcataaattcgtaaaaaatgagnttgtttgaccaatattnttgtaattaaaaaaaccacacagatattttcatgccttatttctggagacagatttctaggtttctacctatttttttacggacttaatacctgacgagcagggctgaccgtgattgaatttccaatcacggatatccgtgagccgcgatcacggggcttcaaaaaaatccgtgaactgtgatcacggcaccccaaaaaccccgtgattataaaaaatggtctaatgatttttttgtttaaatttatttaaaaaaacggaatttaatcgctgggaaaattcccaaaagatattttaaagaaaccaaaacataatcgcatttttgcggcctaccttttccaagaaatgactaattagagctttttgtagaaatctccaaggaaaaattattttttaactaagtttattgagaaaaattactccttcatggcgatctgaacgggtctgtatcgtttcggcgccagcccaagttttcggactataaatttttttgttgtaaaccaaatccaacaagttggtaccatacgaaagcttaacatgtttagaagttttttttaagctattgctttacgggttagccgacttttgcgccgcgccatttgcgccgcgacacttgcgccgctcagcaaaaaagactcttgcgccgcggacatttgcgccgtgccatttgcgccgcgacacttgcgccgcctaacaaaaacgacatttgcgccgtgccatttgcgccgcgacatttgcgccgtacagcgaaaaaagacatttgcgctctgattaaaataaatttatgtgctttatagaataagaattgatagatattcattattaattcctttttcgaagcctttcatgtcaattccatattgaagtgcacgtaatgattgatcaaatcttgatcattttggttttcattgggaccatatgcgataacaagccttcatattgcctgatcattaagcggcggattttaattaattacaaaggaattgaatttcattcttttttcgaagcaaaaaaataattggggtttctacagaaaattctttttttttcagttttttgttagtttgtattcttaatcattttttcatatctttgatgaacctattcaatgttaagattttaatggttaaaaaattgaatgtcaatctttgtgactagtaattttttcgaattttcaattagttatttttgtcgatggcttattgttttagtaaaacttattgataatagtggaatttttatgaatataatatttttgacagcgcggcgcaaaagtccatttttgctgggcggcgcaaatggagcggcgcaaatggagcggcgcaaatatccgcggcgcaactgtctgcggcgcaaatggcgcggcgcaagtgtcgactttgctgagcggcgcaagtgtccacttttgctgtgcggcgcaaatggcgcggcgcaaatgtctcatcacgtgctttacgattagccaattaccaaaaaagttatacatgagaatttcaaaaagtcgaaatttttgaggttttttcttaataatttttttaaaggctagaaatcttttcgtttttttgtaaagctggttagagcatgtgatgggctttcgaatgataacaatattgttggatttggcttataaagaaaaaagttatacccaaaaaacatgggctggcgacgaaacggcggcgccgaaacgacctattcccatctgaacaccccaaaagatactgaaagtagggaaaattttagaaaaaattcaatgggggttgggaaaatttttcttgacatgttgattaagtctttcattataaatttaagcgactgagagaaaaatagggatttttagccgtttttgcgccaaaaagggctattttttgccattttggggtcaaaatttcaaaaatacggtaaaatgggggtccgtccgccggtggtgccgataggcgccgtcgggaaaaattttgagtgaatttgtttaacaaaatatgtcaattcattggttaatttattagtctacggacgttttaacaataaagaaaaataaaatgttaggaaatttcttattaattaaattt

SEQ ID NO: 5000 - DNA, 1886 bp, Heterodera glycines
ctcaaatcccaacatcgttccgtgtgcactgtgcgccatcggtgataaatgctaaatattttcgtacaacgttttaaatgaattataaaaccgatagcgatcatgataagaaaaatggcacagaatttgccacaactcctcgcagtaggcaaagttcgattccaggagagatgcggctggcaccagcacagcgtcgcaaagattcaaaattgtgttgttaactgcttatgatgcccaatttaatccaaatttcggatgttccactgaccactgtccacttcggtgaccgaactttgtgcttcctcatcgctataatatgtgtttaaaagtctgatcattttgatggcgacttcgtgacgggccccaatgtatgggccgagttgaaaggcgatcggacaagcatcagcgaaaaaagatagccaatcggaaacctgtaaaaatcaaatgcttaaaaacaaatggtcgactttgcctgttttggatgacatgtgaaccgttcccaactttctttcattcgaacgcccgttgcagaagaattgggtaagcattcgtagttcgaagcagcctttctgaaataattgttaaagtaatataataataatttaaaaagtgggacatacagacggtagaacggttcaatgcaaaatccgataatattagcaaatgccattgaaattctttgactgaaaaatagaaaaattattgaaatatgcaaataaaaaaagcaaagcaaaacgaaccaaacaccaaagggatatccgtcggggaaaaattccaaaagtttctgagccttttccaagtcgccaaattccaacagagcacacagcaaaccgagcttttggtttttgttcaaaacagtctaaaaaaactccatttaattattataatttttcttttcacatcgtcaaaacgtgagcccgccaattttcggtcttcgttcaattggcactgagtcgcggcggaaaaagaaatggccgaagctggcgaaggttggtccaacgaagaatcatttgccgcgttcagaatcgacgcgatcggaaagctttcagtgacactcgccaacagaccgacctaaattttgaggattaattaaaacgagaaaatggtaattaagaaagcctatatcaatcggtcctgtagtgtagtggtgatcacattggactttgaatccaataaccccggttcgaatccgggcaggacctaccttttttaaaaatttttatttgaatttagcaaaataaaaagtggatcgattaatttatattgtttcatataaccaatttttcttacatactctaaaaatcgacccttaacgaatatttctcaaatatcgttaccacattcgaagagattgtttccgcacggtttgaccgcaatttgacgaggtccgttagcgatttgtgctcctccaacaattccttccgagttggagcaatctaaactcaataaaaaattggaaaaacaaagtaggaaatcaaaaatgaataccaaagtgaacagcgtaaaaatgtcaacgaagccttcttgcgccagctgcgaaacgacccgataaagtgacatcggagtgtgctcattacgctagaaaacaattttttgtttttggtttcaataatttcacggggttgacaatgagagaggaatttttattttacttgacaaaacagaaatttgagtagcaaaatgttgcgcaggtcgcctcggtccattttgaattctctgatgaggcggagaaattgtgacgcattgtttggcggagagtgctcaaaacactccaaaatgatgtccacgacacggttcgggtccaaattgaattggccttatagtagtgcgcaattaattacctcactctattaagtgtagcagtcagaaacagtccccttgggggg

SEQ ID NO: 5001 - DNA, 4369 bp, Heterodera glycines
ctctagagtccgtcaaactccgattggagtgcgaccagcacatcgaagcgttgagaagcatttgtgggtttggcctgttaaaaacatggaaatgaacaaaaaacggagaaatgagcgaatcgcaccaaaacagcctttagattccgcacactttcttcaaccgatgcttttttggacagaaaggcgcggcaatgggacaacagttgctgcaccaccactctctcctcatcatccgaaggtgccaatgaggaggaagggctgtgcatttgaagctaaaagtgaatcaaaaaaggatcaaaaaaagtggacggacattcatggataatgcaatttggcatatttacaacacatttgcttatttgtacaaattaaaacatttattatcaacaaacatcaaaatcaacaataaatgtggaaccatataaacaaaggtttaggccaaatgccccttaatgagtcattttctggccgcaatatcaaaaatcaacagatatattcaagcagatcggagcacaccgaagtattctaaaaaccaaaataatttgtgttcgcatgaaataattttaaccgacgttcaaattgaagtttctcctcaatgtttcggcttttaacgtgttcttcgtggttgtgaatgaagtaaaccacgctgccatccgattcctcaatctttttccatttgtttgatggcaaatttgtataggcagtcaattgggcatctgaaattaggggaagaaattattaaaatatcaaaacgttttctcccgatttacgcgacactaattgccattaccatcaataccacccaacagattgaccaactgttgcttgtgaatgcgttggaatgtcacattgatcacttgacatgcatctgggaaatggaagagcaaagtttctcgatttgacaaacgcgaaaaacaattcacaattccgtgtcgcctctttgaaacttgtgacggactcgaccaattggcgaatttcgtcaggtctatcaataagaatgttttgcatatttatattctcttcccgctaatttgaactttttgaatggttcgtcgagactgtcgcggggtttgtaccgtccgtcgacgagacgccaaaagagcgcgaaattgcaagactcgagaagagagccaatctgacagacgcgtcgcaactccttaagacaaaacaaaataactaaacagcattttcccaaaaagtcataccggagcgttcactttggcagcgtccaccaaatattttgccaaagcaaaatcgttgcgtggaaaattggtcatcgttttcaatagcacaaggcacacgtacttttcgttgtaaagaaatgggttcaacttaactggtggacaaataaatgcattttgaaggccaacccaacaaaatgatcacctggtacagcttcaacagtgtcatcagaatgtccttgtcgtatttcgtctctattttcataaattagtacttcaaaaaacccaattacccaacctttgatcatcaaatccaccgcccgttccaaaaccggcgcattgtttgggttgtaccgattcacacctgaagagggaaaacagacagaatttgttgttgtgaacatggcgaattgcaattttaccacggatatctatgatttttcttagttcctcaaatgtaccaatggctttggcgcgtttcttcagttcatccatagacattgcaaactcaattcgtcaaaaagagaattaattataggcaaaatttagaaaaaaattgatttaggaatgaaaatgaatggaatagcataatcaaagacaccaaagaattaagttttttagtgaattcgtaataaaattggcagaagcaaagcataattcatttgcattagacagcagtctcttgtaaagtatctaaatttgtataaagataagggtcagaaattaaattttaattgttggatggtaaaccctcaatggcactttcgtccgtaaactcttccaactctctttcggtttccgtcgttttttgtgcaatcgaaggagttgaaaagtgtacaatatgcacatgcctctccaaatttctttttgttgtgcactaaaattatacaaatataaaataaaatgagggaaactgacggcgtattggcaaaacgagcaaatgtacggtttttcgcctgtgtgcgagcgatggtgaacaatgcgagcggaggatgtgctgtcaaaaaggtaagtccaatttgtgatttacccatagcaagtttttgaaggcactatcaagaaaaaaattaatatttttaaatgaaatttattgagtaaacttattcaaatttataaattcccgaaatgttatttggtatcattatttcattaatttggaagtcttgttaaattatttaaaacccaatacaatgttcccccccccatttaatgtatgcatttaccgaaatctttttgaacaaaaagcgcatgggaagggcaattcaccggtgtgaattcgatgatggacaagaagattgtgccgaaacaaacgtttaccacacaccggacattcaaccttttcgaaaattgctttctctgaaaaaacaaaatgaataagccaggtcagttattagatggtggatagttttttgatgcaaaaacaaaaaaaggctcaaggattccgcaattcgggatatatatttttttgccgagacaaatatctcgcagatcgaccattttttgttccagtgacgccttttctacttctgtaatttacttaaaattttggctaattggtcaccgtaatttggtgaattgtctccttttgccgcagtcttcttcttacaattagcccttccatttacggagtccgctttttcttttaattgactttccaatgaaacgaacaacgaaagaaagcctaaaaggaaatgcatgaaagttttgtattcttcaattagcaccggatttgctgctcaacaatgtcggttcaccgtcaaaatgaagctcctctaagcttgaaaaactgtctgttttagtgagttgaatgaaaatattaccaccatcaattcccatacgataggcttggctaacggaaattgaattatccaccaatggcgatgtttggaagctaaacttacaaaagaccgttacaatacatgcggccaggaaatttgcaaacccaaaatggattttcaaaatgaaataatttcagataaacaaaactgcttaaaaaaggctctattatagttcacataacattacttagtgtcatttgaaagctcaagctctaagagttctttattagactgcaaaatttttgttgtttttcgaaaaattatcgccagaaaacttaaaaaaactttataaacatttttggagacacaaagttttttgttacagagactaatagaggactcttgtggtcatagaattaccaaaaataatttatttagatgctctaggaaatggtatggtgcattaaagttgccaaattattttatggaatgtcttttttatggtcgtataaactgtttcaatttgaaacatttggacataggtatgtacaggaaaatgggtaaataaacagattaaataaagccaaaatgcccacctttccttacgctgtctacggagttctctttccaccgcatttatccaacaaggctcaaagtgtgcttgaaattggtccgagttgtcaaagcgccttcggcattcggggcaagtaaaaatgggacggcgaatattccttgccaatggcacttttacaggtcgaaaatttgtgaaatgagcagaatgaggcaacaaattgcaggacgaagaaggaaaatgcaaacactcggcagaaaaagaaggctaaaaggtggaataagtgaaaatgaaaatagtgaagaaacaacaaaacaattaacttgtcgatcagtgaaaaaggaaacaactccaccgccgatttgaacaattgaattgagttgtggatgatcaagcactgaatacgactgatagagaaatggagaaaacaaagcgattctattgcactttgcctggcaatttaagtttcgggctttgtgtctatcttttactagtacaaactcaccaattggttgcttgtatctgggaagttggccaagttgaccgtcctcagccgatgtgtctccaacaatgcaaccagtatctgttaaaaagcgttgttcaactgcagaaatgtaatgataaacatttgaagaagcagaatttgcggcaaaggtaaagaacattggtcccgaaaaatttttttttaatttttaaaaatgatttagggtaaaaattcctaggccatgaccctgaatatgacctcatttttgctcgaattctaaccccggaccgggagttgttgaaaacaattaagcgtggttacagtctgacacaacagctatgaatcgggcgaaacc

SEQ ID NO: 5002 - DNA, 2131 bp, Heterodera glycines
  misc_feature (2117)..(2117): n is a, c, g, or t
aaaaacaaatattcaaagttgttctcactggaggtccgtgttctggcaagacaacggggcaggtactgttttaccatatgtcataccttcagtaattttttataattttaggctcgccttttaagtttctttgaaagcattgggtggaaggtgtacaccgttcctgagaccgcgtcatttttcctcggtcctggacgcattcgttttcccgacctgagtagtgagcaggctgctcaattccagacagatttgctcaaagcattgatacaaaatgaggatgtactgcgttttctaatgcgcaactcatttctttacatttttaggtctttttcaaccaggccgaactcagtgaagcggaaaaaattatgatcattttagaccggggtaggtaacataaattagaaattagagtaatactaccgattgtatcacaccttttttgaaaaaaaatttgttttcaaaaatcatgaaaatgtgtttccacaggattttgatgttgctgaacacgaatcttgccttcctagtactgatgctttcagtttatttccaagtgtttaaactaattatgacccaaaaattagaagatcttaactctatcttttgtgcgaatttgggtccgggttaagcaattagttgaaatggcccaatcgtgatcagcgaccctgaagacttcttgaaacaagctttgattaattttgaaaacaaaaaattgttttcaaaagtgtgtgataccaccggtagagtattacctaaattagcatcagtaatgagcattttcgctaaacaaatattgagtttaggtgcgatggatggaagtgcttatatcgacatggaatcttggtcaaatgtattgtcagcatgtggcgtggacaaccatgaaatgcgtgaaagataccaccaagtgagacattttcgctcattatttacaaataatatccatttctaacaataagatttgtcatctcgtcaccgcagcggatggtgcacaatcattttatcaacttgcgaataaccaagcccgaaccgaagcaatggaggaagccattgagattgacaaaaagaccagagaagtatttttattattttattagcatccaatgccgaaattaaggcatggattgggcatcaatgtctatcaatagttgataattcaaactgttgttcgtttgacgaaaagatctccaaacttattgctgttgtttgtgaacgtcttggcattccgatttcggatcgtttggctccaaatagcaagtaaatttttataaatttggtttccataaatctaaaattccaaggaaacggaaatggttggtcagcaagatcgttgacaacgatgccttcttgcaaattaagcaggaaaagttttcgttacaacatgattatctcaatacggcgggttcgagtcaggtaaattttacttattacagcgtgaaatttatgtcaaccattttcttttacaattttcatttctggaatcgttttgcgtttctcattatcgtttaaatttttcgcgcatttttaccagaaaacatcggaaactgtaggtccccatccctttgtgctacacctgggctacaagtttatctttgcaggttcgacttcgctcgcgtagccaaaatggaaagtacacgtacacacttacgacccgaacctttgaagacgctgatggcaagaagtaattttcgcctttaaaaaaaattctcttttgcaaatatagacttccccaaccggttgaaacacggaagcagttggacaggcgcgagtatcagagctacttgaaacttcttgacagaagccgtcaatcaattcacaagaaacgtgtgtgttttgtcttcggaaatgtggtaaatcggataccttcaaaagtcactagattgctaaaagaatatgcttttcctttcccagtattttaacctggacatttacattgcacctcttcctccagcgttgatgtacaatgaaaaccagctgatgatcctcgaggcaattaaatatttgccatattttatagacaaaaaacattgttaaaaatgtctttttatagctcgattaactttccagacatacaccacgcgccctattggtgatcctgagccgcgtttgcccgattttctcgnaaattgagcgtgag

SEQ ID NO: 5003 - DNA, 4242 bp, Heterodera glycines
tttttgagtgggaccatcaaagagtaagcttcacctcccaccaggtaccttcacactttcgatggcacccgctgtgcctccactgtccaattttttgccaatttcgggcaattccacgtaaacaacgtcgcccagagattcctacaattggcatttaaacaatccaaatagtcaacaaatcaatcccaacttgagcatggtttgtgatgccgacggtgccgacacttctcgcctcgtccaacgaaagccactcgtgtttatccgtgtagagaatatctgctaaaaccaaacattattggttaacccattgctaaaatcatggtactttggttttaaattataaaaaaacgcaaaaaatggcaaattggcacacttaacgaaaggggaagcgggggtaaagccgaactgtgaaaactcggatcagaaaagcgtcgatatagccagggacaacattgaagtcaagttttaacaagactcctaagtttttgggtgattatcatgctatttaaggtcaatgctggaattgaattcgaacaaaacgaagaaagtacaattagaagaatttataatgtgtagtaagttaatttgttcataccaaacatcggccgactcgttgacaaagtcctgcaactaacaaatgtctttgctggaagtcgcttgaacaatgagcaaaagcgaattgttgttgaagccatttcgatttaaatttaatttaaatttacaccctaaaagtttgaaaatgggctttaagagaaataaaataattaaaaatttagttggttttatttttgtttgcagtttgtatctccgctgtggacgaaccgttcaaaagaaaagttgattgattgtttacttatcgactggctaatgaaatggtgtgcgtaaacataaaataaaccgactccatctcttaagagagtaatgttcatagtacacaaacaattctcgatgtattgagagatcgaaacaaacagaaatatcaaacccgtttataagcacgagacttcggagtatgataattttgtttttgttagggttagggttaggggagtgggagatggggagatggatgggcccacgtgttttttttaatttaaggctgatttacagaaaattttaaattttgaaaatttttgaattaattggcgtggtgttattaataaaaaatttaaaaattttgatttgtttctcgttagaccgcaatttttcttagttgttttaccggtttcgttatttttagtttttaggacaatgcaaaagctagatagaatttaaaaaacctttttttaagctcttaatctcgattttgctttaattcagcaaatttttgttctaagaaactatttcatcttacatctgatcaatatgctttccaacaaattggttcgtattttcaaatttataatataatgaacttttcaaattaaaattgcaatgatagcccgtttttttaggcaaaatttgccgctatgaccatggcccgttgtcaaccgctgaacgcgttagcaatgttgggcggggcccgactgtgccaccacacgccaccaaactgcatggacgccattcgtccgcttggtccgaaaagcagtgtgccgagttttaaggttttcttccctaaactgataaaaaaaataatatttgaatcacatttaagggccaggcaattgtgaacgcggaaatgaagaccatttcgtacgacgactacaagggcaaatggttgatcttcttcttctacccactcgactttacggtactttgcaaaatattttctcgggaatttcttgtcgtaatttatctgaacttgacaaaatttcagaaatttgactgatttatagagaaaactcaggaaatttgagagatagagaatgtttaggctcttgtttctggtttcctaaatttggtgccatacaatttttacgtgctataatcaattaaagggtcccctttttggttttagtaaaatttccactgtaagtagcgccatcaattgagccgtttttgtgcaaccccgaagttgaactttacttttagttttgctttttaagttccattcttttcaccgtcccttcagtttgtgtgccccaccgaaatcattgcgttcagtgaccgcgtcgccgagttcaagcagctcggctgtgaggtgatcgcctgctcatgtgactcgcagttctcgcatttggtccttatttgttccattttctgttgatttaatacgatccgccgtatgtttttaggcttgggtgaacacaccgcgcaatgatggcgggcttggcaagatggaaattcccgtgctcagtgacttcagcaagaaaattgcggctgactttggcgtgctggacaaggagaccggactgtcctatcggttcgtttttctcggccaaattctaatcggtaattgaaaaaagtctaaacttttcccctcatttcagcggtctttttctgattgaccccaatggcactgttcgccattgtttggtcaacgatttgccggtgggccgaagtgttgacgaggcattgcgcattctgaaggccttccaattctttgagaaacatggcgaaggtccgtcatttattttttttttaaattttggcataataaatcgaaaactgactcaaattttgcgaaacgcacttatttacaaaagttttgctttagaaatttaaatttttctgctcccctcggattacacgggcttgggtccggtgcaccccaaaacgtcgtcggccgaaacgtcgtcggaagactttttgaaccataactttgttcgctgtcaatcaaattaagaattgttggtgttgttcgatagctctatgtgtttattattaatttgcaaaatctcaaaaattttcgttaagttttaaaaaagttatggccagaaggaactcaaaacccagtaattcgaactttttttgctcagatttttttgtgcataaataaaaatttttgaaaatttgcaggctaatagcatttttcgaatgctttcgaataataccaagaatgtttaatttggttgagaaagaaaaaagttatggtcgaaaaattcgttcgacgacgtttcggctgacgacgttttgtcctactccggcttgggtccacggatttcagacggattcgctggctgtcctaagaaatcactgcttattaaagtagtacatttttcgcaaattatcaagtgcaaacaataaattggattttgattaataaagactcctctaatcactctaattaccctccttcataatcgcatcaatgcccctctaattaccccctcccctccatttttcagtttgtcccgccgattgggaggagggcggtgaaacaattgacgtcaaatcgcccaaggagtacttcaaaaagcaaaaatgaacaaaaaaaggggccgcataaagcgattagatgacatatttttatttattttcgattgaatttttttgtttttatttaaaaaccgcaccattttttgtgtgtgacatccgtcatttattgttggcgctgataatatagtgataatatttatccgaaaatgttaattaggtattgtgggcattttctttgttgacaccgtacacattgtccaccgcgataccgtattgctcctcaaccattcaaaatttgttaaaaaagtcgcttaacataattctctgtcttacataagttcgtcatgaaagtaaaaagttgcattaattaattattgacgggcgggtggcccatgccacacatccaatccctcagaaatgccctcctcctccggcgcgtggtgtgttattttgccgcgcataaacaatgaccacacttaaagagagcaaacggcacgcactgatggagcagcagaaaatattgggccaattatttatggatttgttggccataacacacaaaaaaaaacagctcctcggcatttcacacttttgaagcgagtgcatttggcgagactctcgagccgcaagaaattgtcttggtctttgtccgagaaatctcggcgatatttggtctcggtttaagcatacggcattcattttggagatttatttttagctaaaaagcgttagcttgggaatttcaagagtgctttctctgatcacgaatctaaactcgggttttgtcagaccgaaaaccatagattcgaaaaatcacggattggatgatgtcaaatttgagttcagattcgtgatcagcgcccttgaaaactcccagccgatcgggagtgcgaaaggaaaatggtagatcagggacatactttc

SEQ ID NO: 5004 - DNA, 3376 bp, Heterodera glycines
atgagcctttgaattaaggaatttcactgccctcgggggcgtctattttttgcatgtgatggcatatgaaaagtgatcttttgaccaagccatccattccaccctcacccattggcaatattttttcattttaaaaccttcctccccattttttgaaaatttagctaccgatttagcaaatatttctcaaactatcgagttctcaatttgcacaaagtaattatttaatggattaattttaaattgcttcttgtcatacatagcttatttttaacccgaaaatggcaccaaattttaaatatttcttactttcagaaaaattcggggtttgacattctttttccattaaatttttaaattagattttttttacccaaaaattcattttaaacattcgtttctcacgagtgagtcaatgcaattatgcaaaaatttgtttgaaggtccaatttggacacgcttctttgggcccaaaatgtgaatcaataagcggcacattttggcgatgaaaagggggaaaaatcacaaaaaatttaaatgaaaaattgggtttttgaatgaacccttcgggctaaaattttctttttatttcattatgttaaagtgggagagggggaattggccgactcatttttagaatattttattctattttttaaaataaatctttattctcaaaataaataattggaaataaatttgcttttttaactttttttttcttttttactttaatatttatatcaagaaactaattacatcttttcaatattattttattcattttaaaattgcccaaaatttttaataaaatgccatttaaaattttgttcttttttttttgctttttaactcaattatgttacccccttttttgtgttgaatttcaacaaaatcacagcttgccatcctcgcacttttgttggcacggttttgaacagaaaatattttaattgctttctgaacaaacccaataatatttttaaaatatttaattttaacaaaaaaataatttatttttcattttttattcacaaaaaatgcattccatttgaaaatttaaatattaattccattttaataatttttaacttttaaacaaattaaatattttaatcatttttcatttccttttccaagagaatatatttaaattatttttgaaaaaattatttcaataaagttcagttcaattattaattcatatttttgtatttacttaattcaattattttacttagattttcgaatttttttttaactttaaatacttaacattaatttattattttgcaattatttcatttcacattttttgcttgtgccaaatcaatctctgcactaccattcattaccccaataaaatttccgctttaattttacgaatttttttttgtttttttgtgtcccccggggcaaaggattattattatttctttcctttgccaatgcttttggcaataatgaataatgagtgaatgaatgaatgaatgacaataaataataatccacggccccggaggatggtcagcagaagcagcggctaattcatgtgcaaccaaaccgatgcacttctttcactttttctcaaagtgccgtgccgcaaagaaaagtgtttccattttgggagaaaattccgccaaaaatgcgccgaaatttttggcaaaaaaacaaaattatcacattaagagcgagagagattctcaagaatttttgatgcttttaataaagtttcaatttaaattaattaaacctttaagtggaaaacagtttgttttaaaaatagtttataatttttaatttgcaaaaaatgcatgccgcggcatctgacgaaattttattttttttcaaaatttttccgttttatttcgccctggtgccattggacattttttgaggcggcccacaattggcctgcgaatagtaaaattaaattggtcatcacaaaagttcagcttcactaattaggctaattaaagccacgcgccgtcccaaagtgaaaaaatgcactgctttgagacgggaaaataataatttatttcctctcccttctcccggaggggatacggcgatgaggcgggggggggaccccccgggctacgacggattggatgatgggatccgatttcgccacccgccgccgcccccgggggtgttttgccccgcggcgaacttccaaagccgacgacagtgcccgcccaagtgatcccacccaaaatgtgaacttagccctcttggccagtctccgcccgtggttttgatcgatttttgttggaccatcgcattaatacacaataataatgtgggggggggggggaagctggggcggtaattccatttagttacccttcggcagggcaaaccgaaaaaaaaattggaaaattaattttcctgccataatttgtttgtttgtttttttggcatgcctactttaaaaatttattcaattttttgcccaattttttaatttaattcaatttcttgccattattattttcttaccattatattttgttatttagttttctcatttccaacataaacaaataatgtgtgtgccgtgccgcctttgtttttgccccaccaccaaaagaggcgcttacaaagttttgcgtggcccacaaaattggccaatatcccttccctcccccctcacggggcatgccgcccaatgatggcacatcattggcacattgtcattgtctttatgccgtccccgtctgtctgtctgtgtgtttaattttgttcgcctgaaggggtgccgacaatcggcggacggtgtcctcccccctcccccacacggacggttaataagacgctcgggctggggcctagttgccccgtccaaaaaatatgatggcatggcatcgccggccgaaacttttgcacccgggcggagggacggtgccattggcgaaatcggaaaaatgatttttatttcgtcgaatttaaaatgccgtctctttttgaaacataaacctaatttggttcaatgattttcgataattttttattcttttgtttatgccccaaatttttggcatatttgccgaggaaaatttgagaatgaattgctggccaattcagtaccaatggggttaagccgagtgattttaaatttttcctaatattttgtattatttttaattaaattttctttttttttaatttaaaaattaaattataaatttaccattttttaaaattaaatttcacaattttatttgaatttttcttcctttcttttaacatttgtgaaactcagtttcaattttcccgcttaaatcctaaaaaaaattcccaaaatttcctgccctatggcaaacactcaaatttaccaatttttccagcccacaaaacaatttctcaccctggg

SEQ ID NO: 5005 - DNA, 757 bp, Heterodera glycines
  misc_feature (682)..(682): n is a, c, g, or t
  misc_feature (690)..(690): n is a, c, g, or t
  misc_feature (692)..(692): n is a, c, g, or t
  misc_feature (696)..(696): n is a, c, g, or t
  misc_feature (702)..(702): n is a, c, g, or t
tttttatcttaaaattattaaatatttttcgggcaaattaatttgttcggattttgtttcaacaatttaattgtatttaaaaattaatttaaaattctttaataatttctttacttttcctagcacacattgaaataattaagcttaatatttacatttaaagcttaaaactttgtttttttaactaaaattttcccctcccattaattttttgttggacagacagtaaataaaaagaatatttattatttgtttggcatactgtcgcactctctcccacaaataaaaaacaattccccgggggccttttgcgttaagcggccaaaagagtgaattatttggcggcctatcaatttttgtgtttggccatttgtccgttaaatgatttcccaggcgaatttcatgccgaccaattggaaaaaaacagaaaaaaggtagaaaattaaaaaaagagagaatccgtccgatatggcaagttttgcaacgctgcggttcaatcccccgcgcgggacgcaaattttaaaaaattaaaattttattttccattttattaaaggaattatttattttaattaatgcaaatttgtccatatggcgaccagcaatgttcccaaactgctgaaacttcttctgctgtttccgctttagctgcagtttccgttgttgcgtctaaagggcgtcnccaatcgncntccnatctgncaagttactttatgcagggttcgggccctgtcaacggcatacatgtttttttagg

SEQ ID NO: 5006 - DNA, 2478 bp, Heterodera glycines
ccccccgctgaaaaattccggcccaaatttggtcccaagatcctcccaccctccctttcatctgacccctctaccgcgattcgctccccgcatattttgatcagataagattgttcaattgcgtttttttaattttcgtttgttgcgaaatttttgtgcggggcgcaccaaaactggtgccatccgcgctccaaggtcaaaatagtttttatgttcacaatctatcaatcaaagttcttgggcgagaaaatttaaagcgctgcggagatgcaaaaatatttgcggccactttaccgcagtttttatacacgggaactgtcaatcatataaagaagggaacgccgaagcgacttcatttcaattccatttcggttgaggcggggggtcggggccattctttgcctctcgggtcgcttgcccacaaatattcaaatttttccatcaatcatctttatctgccaccgcggcacggcagcacggcatggcagtgggtggagtcagcagccgcaccatccgcaagtttactttatttgccactttcgtccgctttcaattttgtcagcagcagaaccatcctcaatttcaattctcattgtttgtcagtttcgaccactttccattcccaacatgtcttttattgcccccggcactttcgcgttcctttcaaaagactatggggaattttcgactgggcattttgacccaaacagagcatacgacccaaattcacttgcagaactttcgtaatggcatttattttgcttccattatctttcattttttctttgtagtcaatggagaaaagagtttctggacggccgatacggatccaaacaaccatcccctccttccaccccgcgcgccccatcgcccagcttcccaatcccagtcatcgttggtaatttaaatttcagttttttggattttgcaaatattccgtttacaggaaatcgtccacaggatgaaaattgtttgggtttccacaaatatcttgtctgatttttttcattttagggcggcagatgttcccaaatgacgatggctacgaatcggaagatgatgaaattctcttgccacctccgccgattcccccgcaacttggccaccctccgccaaatgtgccggtaatttcggtctcgcttttcgttgctttttctcaatttccgagtgcttttttcaggcagttcgtgttcagccaatacatgttgggcagcagcggctgccgctgagagacttgccacaattcgaggaccatccacaaaatgtgccggtaattttggctcgcttttgttctttttttcaagatcccgaatgcaggtaattcgtgtccaaccgatgcaacaaccattgccgctgagagacctgccgcaaattttccaccctccaccaaatgtgccggtaattttgggtctttctttcgattgctttttctcaattcccgagtgcatttttcaggcaattcgtgttcaaccaatgcagcaaccggtaccaatgagagccgtgccacaattcccccaccctccgccaaatgcaccggtaatcttgagtctcgttttcggttgctttttcaaaatcccgagtgcattgtttttcaggaaatttgtgtgggaccaattcatgatgggcaacaaccactaccactaagagcgttgccacaattcgcccaacctccaccaaatgtgccggtaattttggctcgtttttttgttactttttttaattcccgaatgctttttttcaggccgttcgggtccaaccagttcaacaaccgataccactgagagacgtgccgctatttgtcaacccaccaccaaatgtgccggtaattttggctcgcttttgttactttttttttcaagatcccgaatgcattttttcaggtaattcgtgtccagatgcctcaaccgttgctgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgtcaccaaacttgccgtatcatccaccagaaaacgttccggtagttgggtcttgtttttcaagcgtttctcatattttcggatgtttattcaggcaatccaaccacggcaacaaccgcgccagctgagagacgtgccactattcgaccacccgctgccaaacggacaggtaatttcagaccctgtcttctacctaacaccgaaacatcttttctaagcaaatgcatcccaaccctccgagagtgctggaagtgatccgacggctgggcgagtggagaggaagaacaagggacccaagacgtccgcctcaatgaatgaatggaatttggattttgataaaatttgttgttttaattttttgaattgataagggttaaatcccgttacctaaattgtttgaaaattataaaattt

SEQ ID NO: 5007 - DNA, 4836 bp, Heterodera glycines
ttttgacccaaacagagcatacgacccaaattcacttgtatttatttcgtaatacatttattttgcttccattatctttgctttttttctttgtagtcaatggagaaaagagtttctggacggccgataccgatccaaacaaccaacccctccttcccccccgcgtgccccatcgcccagctttccaatcccggtcatcgttggtaatttaaatttcagtttttttttggattttgcaaatattccgtttacaggaaatcgtccacaggatgaaaattgtttggttttccacaaatatcttgtctgattttttccattttagggcggcagatgttccccgatgacgatgggtacgaatcggaagatgatgaaattctcttgccacctccgccgatccccccgcaacttggccaccctccgccaaatgtgccggtaatttcggtctcgcttttcgttgctttttctcaaatttaagagtgcttttttcaggctgttcgtgttcagctaatgcatgttgggcagcagcggctgccgctgagagacttgccacaattcgaggaccatccgcaaaatgtgccggtaattttgggtcgattttcgctgtgttttctcaaatttctgcgtgctttttttcaggctgttcgggtccaaccagtgcaacaaccattgccgctgagagacctgccgcaaattttccaccctccaccaaatgtgccggtaattttgggtctttctttcgattgctttttctcaattcccgagtgtatttttcaggcaattcgtagttcaaccaatgcagcaaccagtaccaatgagagccgtgccacaattcctccaccctccgccaaatgcgccggtaatcttgagtctcgttttcggttgctttttcaaaatcccgagtgcattgtttttcaggaaattggcgtgggaccaattcatgatgggcaacaaccactaccactaagagcgttgccacaattcgcccaacctccaccaaatgtaccggtaattttggctcgtttttttgttgcttttttttaattcccgaatgcttttttcaggccgttcgtgtccaaccagttcaacaaccgataccactgagagacgtgccgctatttgtcaacccaccaccaaatgtgccggtaattttggctcgcttttgttactttttttcaagatcccgaatgcattttttcaggtaattcgtgtccaaccgatgcctcaaccgttgccgctgagagacatgccgcaaattcaccatccaccgcgaaatgtgacttcaatttggatcaaattgtggttgctttttctcagtctctgggtgtttcttcaaggcattcatgttcgacaaattcaacgggaatacgccgtaccgcaatttgcccatccgccgccaaacttgccgtatcatccaccagaaaacgttccgggtagttgggtcttgtttatcgtgcgtttctcatattttcggatgtttattcaggcaatccaaccacggcaacgaccgcgccagctgagagacgtgccactattcgaccacccgtggccaaacggacaggtaatttcagaccctggcttctacctaacaccgaaacatcttttcttaagcaaatgcatgccaaccccccgagagtgctggaagtgatccgacggctgggcgagtggagaggaagaccaagggacccaagacgtccgcctcaatgaatgaatggaatttggattttgataaaatttgttgttttaattttttgaattgataagggttaaatcccgtcacctaaattgtttcaaaattattaaaattttaagaaattagatgctaaacctaacctttgacatagattatgaaaaaatgaaaagaaatgacgaaatttttggaatgttccttctttttattatctatggattttttttcatgtgcattattttggtgctagtaagatattgccgaatgaattaattggttttttctcttcattttaaaacatttcacgtccccatgccctgcccacttcccgcggaattgatcaaggaaataattgacgctctcccccctccaaaaacacatcggcttttgcgcgtaaattttgttttggcatactttgttaaatgtcggttttattccatgatgagaagattgtttcgcccagagcatatatcaataccaatggcccgaagaactggaatttatttctttttcgatgttcatactccccctatttattttccactctaccaataataacatttaaataaaattataattttttatttcttatctgattaatttcgatcaatattttttgataattaaaaaaaattgtatttttcccaaaagaattttctcgcagtagcaactcatcggcttttttttactcccttcataaaatgtctcgcttttgccctatcgcccaaatcaaggaatcgggtcggcttaacacaccaaaggggaaatttagtgagttccaaacctaccaaattaaataaagaattttgataatcgttttaggtcttttttacgctctggaaaatgctcgaaactaccaacttatggggaaaagcataacggaagataaatttcgttatttgatgaaaacggagaagaaacaaaggcaattggccatgtaattgatggaaaaggcagggataagcacggatgacaaaacttttggtacccaacaccttgaggctgtacaaaaatactgggacagggaattcccggatatgtttcgcattgtggcttttgaaatggtaaccaaattagcttgaaattaacccattttttacattttttttagaaatttggacttaggccaattttcaaaggggaaggtgttcgaagaaatgaagtgggtgtgataagagaaggaggccattgggatgggatcaaatcggcttcttggttttttggtgttcgatacttctgtgtcagctgtgaagtaacatttgatggtccagtccgccatagtctcatatgtaaggaacgctgcaaaaaatgttgtcggatggggttcgggtttccatgtacggatgtctgcgatgagattcactgcggcgaatgcaatctcaagttttacaacccggaatgttttgaagcgcacaagaaggcggcctgtattgagtacaagaaatgtgaaaaatgcggagagacacacaatactcggaacaaacacacgtgcggcgaaaagttttgcaaactttgcaaagtttgtcacccagggcggcaatgtttcatcaaaaaaatacatgtgcgaccacagaaaatgtatagaatagtggcatacgacctggagacgactgtagaggggggagaacatcggcctaatcttgttagtgcggcactttcttgcagcatttgtgcgggagaggagcgggaatgtgatatttgtgaaggccccaggaaaatcacatggtcggtagcggatggttttgacccaatgagcgagtttgttgtttgggtaatggggtttcaacgatttgaaacggttgcttttgcacattatgctgggaggttcgattcccactttgtcttgtccgagctaacgaagaaggaaatcgcaacggagttgatgatggcggacctgaagatctatcaaatcaaagcaggaagggtgtgctttcgggacttttggatgctcagtcagaataaattggtggaccttccaaaaacgttgggattgaacattacggaaaaattgtattttccacacaaatacaataagaatgagaattttgggaagagactatcacacctgccacctttggaagactattgccccgacagcatgaaagaggaggaatgtcaaaaattggaaaaatggtataacgagaatttccaaacggaatttgaactaggtagacaaaaaatatgggttattaaaacttatattggttttaggggagcagcttagggtgtattgtgaaaacgacgtggaaattctgatggcggcaattttgaagtttcggcagttatttttggggataacaggagatttggatgtgatgaaggacagcgtgacaatcgctggtgttgtgatgaagatattcagggcaaaatttttgaaggaaaggcacattccgatcatgcctgagggagggtatgagaaagctgagaatcagagcaaaatcgcagtgaggtattttgaatggttggcgcaacgcaaaggggtgaaagttcgacatgcctgcaacggcggggaggttgaatttggtgggctgaaggtggactgtgtgattggggcagagaaaaaaataattgagtttcaggtaaaagaaaaaatattttctttttaaacaatacttaaggggtgtgcatttcacgggtgtccgagatgttttttaccttggactatagcgccaaacggacggacaatggaagagaatcaaagtagaaccgaaattcgcatggaaattttgagggaaaagtgcaaaaatttttcaatcggagaagtttgggtagaataaaacatttagaaatatttattaattgttagttttaggagtgtgatgtcagagaggaattgaagaaaaataaggagatgaaaaagttctttgaaagtgtgccggacaagggaccgatcaatccgagggatgcttatgccgggggaagaacgatgccattttgtttgtacgcaaaggctaccgaagaaattgagatatcaatgtttgacatcattagtttgtacccctttgttaattatggtaaaaatgtgcttgcttttttttgctaatttccttcgcttaagacaccccataccccgttggagtcccgaaaattgtagtgagcaggaattttagatgtgaattggacaacacccaacgacataccctatgatg

SEQ ID NO: 5008 - DNA, 2624 bp, Heterodera glycines
cactaaactcaaataacaaacactaatagtttatcaaaaacatgacacacataattgtgtcacactaaactcaaataacaaacactaatgtttatcaaaaacatgacacacataattgtgtcacactaaactcaaataacaaacactaatgttttatcaaagacatgacacacataattgtgtcacactaaactcaaataacgaacactaatgtttatcaaaaacatgacacacataattgtgtcacactaaactcaaataacaaacactaatgtttatcaaaaacatgacacacataattgtgtcacactaaactcaaataacaaacactaatgtttatcaaaaacatgacacacataattgtgtcacactaaactcaaataacaaacactaatgttttatcaaagacatgacacacataattgtgtcacactaaactcaaataacgaacactaatgtttatcaaaaacatgacacacataattgtgtcacactaaactcaaataacgaacactaatgttttatcaaagacatgacacacataattgtgtcacactaaactcaaataacgaacactaatgtttatcaaaaacatgacacacataattgtgtcacactaaactcaaataacaaacactaatgtttatcaaaaacatgacacacataattgtgtcacactaaactcaaataacaaacactaatgtttatcaaaaacatgacacacataattgtgtcacactaaactcaaacaacaaacactaatgttttatcaaagacatgacacacataattgtgtcacactaaactcaaataacaaacactaatgttttatcaaagacatgacacacataattgtgtcacactaaactcaaacaacaaacactaatgttttatcaaagacatgacacactaaagtcacagaacagacactaattcgctaaaatattaaacaaattctgatcataacgcttcccaacccacttacaaatgatcgaccatccaaagctgaaatagtgcattcctcgagagtaagaaaaaagtcaatggcttccaaaactacgcaatgaaatcacatccaattgtaatccaacacgttcatacaataagtcctttcttcatctattggatttcttttctaaattaaatattcttaatagaaacagcaaagccaaaaaaaaaatcccaaacaaagtcatcccagcaaactttcatgaagcatttagactcagtctgagcatgctgttgaatgatggctgacctgcagtcatcacaaaaaaaaaatattgccgaagcggcagaatagctaaattacaaaaattatacaacaacagaaaacaatgcatgtaaatagacaaataacaacatcaacttcttctttcatgcaaagaatacaaaactaaaaaaccaaacaaacgaagactaaaaataacaaccatacaatcatatccgaaaatttgaaaaactaaaacaaaaagctacgctgttcttttccttaatcttttacataaacagaaacaaaaacttttcatatgctaataacaaaacaatagaaactatgaatataagaaacaaaaaaaaaagaaatttttaactgtgcttttgcaaaaatcaaaaactgacaaaacaaatatgtaaaaacgaaaaccaaacatttctttttttcaaattcatttataacgcaaaacaattacaaaacgccagacacatacatagcctcattcatctttatatatatagattttgatttttttaaccattttgacaaattttttatgaattaaagttaattttattattggtcattgatgtgtagtgtggtgtagtggttagtgaatcaaccttgacattactttctgtcgtgagttcgattcaggttgacggtttcttttttaatttattttttttaattttaaaattcgcctggcgctgcttatcggcatcgcatggcccaaaaattcgtaaatcttattaaaaaaattctctaaaaattgcaaaaacctatcattttttggacaaaatctattaacagatccatcagttttcaaaaaaatttcccggcggcgcctatcggcaccgccggatctctacgcttgcacattcaccaagtttttttttttttggaaaaatgtgccacaagaaaatatgttaaaaatctgagttccaattttgcttgaataaatcatgataatttaatatattaaaaaacaaaaatctatcgtaaaaatcttattttttttgtaaacatctgttagaaatcgagcttaaatttcaaaattcgccaggcggcctatcggcacctccggccccccaaaaacctattttttcttaaaaaattagacaaaaatctctaaaatttggtaattctttagacaaaatctgtgtaatttatgccaaaaggaattgaattgaggcgatacattgactaaaggaatgtggagccatcacatcattcgataaaaaattaattttttgtaaaattttttggagttaattcaaatcaaacctccgcccccgtccccgcgggggcgaaattttcgtgcccccgtccccgcccccgcgattatgacccccgccatcccccgcccccgcgaaaagccacccccgcccacggggtccgaacccta

SEQ ID NO: 5009 - DNA, 1655 bp, Heterodera glycines
  misc_feature (36)..(36): n is a, c, g, or t
  misc_feature (290)..(290): n is a, c, g, or t
gtaaaatgtcatgggacgcgtaaaaccgactagacncaattttaattattttttccgtttgacgcacgtccgaccaaactgacaaattattgtagaagatactagccgcaagaaataaaaaagttaagaaatttgtccgaattcgggttcgggattcgaaacatggatgttttgcacaaatccgaccaatttcagtcctaaacaggtactcacgcgaaaacgtccccacgcgaaaacggccacgcgaaaatggccacgcgaaaacgtcccccacgcgaaaacggccacgnccgaaaattgccacgcgaaaacgaccccgaccgcaattttatcacattgccaattctttctcatataatacaaaatgccaaggtttgcctcgtatttctgctttgaatattcactaatttgcgtttcttcataacctttcataaatgcaattagcttttatcgtccacctaattaaattgggttattaaatacaattgcccaattaattgttcaccgttggaattgcagttaatatattaaagagaaaatgctggaaaataacaataccaaagaatatattgtagcagaagcagaataaagcattgggtacttctttatctaaattttttgcaaatatagggaataaataaaaagaaagtatattcaatcaatttgtaaattataaaagaatttcggggtcggggttattaattatcattagggctataaattatatgcttttgcatattttttttacgcatatgctatggagaaaggggctcaaaaatagcatttctacgtttaaattttttgatttggtgaaagtttttagtgcatgtaaatgcctattttgggtgttttcgagaacaaatgcatattttgccatttttgcattttagagcatatttcgtccatttttttgttaattttcatcagaaaaatgaaaaaaatacacccctaagtaacagctttttgggaattaaaaaatacacccttaaaaatcaaaaaatttgagccttgaatgtgaagtttttgaaaaaaaattttgtttatgtaaaaaatataattttgtcttatttgcatttaataaaaaaaaaaattcgaaattgcatataaaattttgaaaaatcaacattttttgaaattgtctaaaaatttgttttggatatcaattttgtatttttacacaatttttagcattttttgaatgttaaaaaccatttttggcagtttttaaggcatattatagtgtgcatatttgggtatttttcttgttttttagggcgtatttgaaggatttttactgcatattttatgcgcatatttggcattttttcttgcatataatttctagccctaattatcattcaatgaaaaccttacccacatccatttaccatctaatttcgtattgattattttatgtttgtcttcatttatttcattggctttccatggattttctttttttgccctctcttccgcttttttaaacatttccttcaaattttcttcaaaattttatcggattattccgtttacgctttcatttgtttgccattcatttgctgtatcaatcgccaattgcaaaatcatttcattaattggtaattttggttcctttatcgaatcaaacgaataatttattctctccacattcaaca

SEQ ID NO: 5010 - DNA, 4038 bp, Heterodera glycines
tttttatgaaatataaattatttcgacaaaacatgccataactttgcttaaacacaatcaaattttacactttctttgtaccattcgatagccaagttttttctctattagcttgcagaatttcaaacaaaatttattaaaatgaaatataaaaaatctcaccgccttataaacggagaaaatttgattttaaataatgatcataagtaagattatccaaatctacttaatatatttgtttattatattaaacaaagatgaaataattaaaaaattgggattgatagaattatccaaatctacttaatttgttttccattcattcgctgtgtcaattgtcgattgcaatagcttttaccttttccaaatttacctgttcttctttggctttttattttgcattttcatacaaattttcattttttacaaattcttccagaaaaatgcactgacaaagaaaggtccccaagtgtccgcggagtttcggaacccaaatttggtaggttttggtaggtggctagagcacccctgggtccttaataaaagtgcttttaatttttgtggaatgagcttgagtgaagagttatgatgtgccaaagtttttaaattaattaacaaaagaaataattattagtactcctttgcattggtttctagcttagaggcagtgcgcagggcgtacctttttaggtctcaggttcgaatcctctgcatgcaaattcattttacaataaatttctccaggctaattaagaaaaaattcaaataaaaatggatggatttttatgttaaattacgcctcaaacttcgcgttttttaaaaaccattatttgcgtcaatttaaataaataatgttatttgttaacttgtgtttctatggggtgataatatttgaattggtataaaattatatttaaaaaactaaaaatccttttaataattgttttggtgtgactttttgaaatttgattgcaccaggagcaaaatccaaaacaaaccacagacacagaaccaacaacttgggattatatttctcttattatcatcaaagtgaaaaaagcgacactccacgcggcgcttggacggagtaagaaaataaatcggaccgaattgagcgggatcggttttctgacatcagcaccgcaaaagattttcagccacttcttcgacgaggcaccggaaggtgttcaacacggccaaaatcggttatgcgcacgtgaagaaagtcgagtgctaggcgaaggcgaggaactaggaaattgaacgggtttcgagttaggatgattaaccaagaaacccacctgaatacgacgaggagaagtgctaactgattaagaaatggtgagggtgcgtacatttggatgaacaatttttgggctgaccaattgttacgacgaattctgggtcggtaaattttgaagatgggagagagttacctggagatgatgagtaagcagtgccagtcttctctggtgcatcattgccgcttttgatgtcagatgattttggtggaagtgatggtttcagcgtaggggatttagacaggggaatagacggagaagggacaatggagtcaacgagcattggagaaggcattaagttaggtgaaggattgggtccaaaaattggtgagaaatttaagtgattatgtacggtttgtagcatttattttggttcagttgcgtgagagaaatagaatttttggatggtttacacaaatttaagcaaaaggagaagtaggatgctacttaaaacataaatagttcaaattataaaggataatgggggagattcaatttcggatgtgagggactctagaccgaaacatggatgaattggatttattgttagatgaattaggattaggtcatctaccccacgtcgaagtgcataggtttttgtgaaattccatgaaaaaaccaaaaaaaatatataattttaaaaaccgaagcagacactcctaagaataagaaattcccataattcaatgccagatagggttgagcggtaccggtaccggtaccggtactggccggtaattaccggtttttttggtaccggtaccggtaccggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcacatatggtgtagtggttaaactttctacctttcatacatatgcttctgaacaattctaattctaaaaaacaggtactcgcgcgataactgaataaaaattttgtatttggaaaattttgtccaaaaatttttatgttctaaaattaccggtttttaccggtaccggtaccggtaccgttttttgcagtaccggtcagtaccggtaccggtttttttgcaattaccgattaccgctcaactctaatgccagataatgttttttattaatttttaaaacaaaatttcgctttaaaattgctttatttaaaaatttatttcaaaactttctaactttttaaattattacgtttataattgaaataaaacttctttcatgctatttgcgatttttttgtgccaatattgcgcatattttacgattgtaaaaatttaattaattttatgtaaaaaaaattttcatgaatatgagtggggggtatgtatgcctcatttgttgtcattatgagttggcatttttgcgtgtgcatcgattttcaataaagacctttattagttttttaatgctaatacgcataaaaatattaaatgaattttttattatatatgtaataattgtaaaatattataaaaattgcaaacaaataatattaaatattttggctgtattcttaataatattttttactttttaaaaaacgaggtttttttttcaaaattttaaatgattttcagaagaaaattttaatgaattttttctgaaattttcgatttttttaacacttattttgaaatttaattacaaataataggatttttaattattataaatatttgtcatgatcatcgtagcatttcaacgctgcttaacatttctcagaaaaaaaactaaattaaacattctgtagactattcaatagggctccctctatctacttttatgctattagtcacaaaatttcatgaattttcgttaaattaaaataagttatagccaaaagattgtttgttatccactctaaaaaaatgcaattttacgaaatacttaaaggaacaactttttatttttaacaaactttttatgaattttcgagctagagaaccatttgaacctgaaaaataatatatgaaaaatgttgcatctaattgctaatcacaaattcattcgagaattctttttatattttcaattaaggattttaggaaatattatttattattgttccatgcttattattccattttggattattctgttcttaaatgtggccagatggggcattctttcaatgcccgaaaaaatggttggaaatggactaaacatgggccaattgattcaaaatgatcaaaatcctaatcaaatagaaaaccaaaatgggccaaatctggaccaaatagcaaatcaaaatgactcaaatctggatcaaatagatctgaatgcgccaaatccggacgaattaatagaaactggcaaacttggagaagttccgattttattgccaaggaaatatcaagaccgaacaatacaagttgaattcattgctcacaagatcatttcggatgcagaaactcgtcaaaaattctttaaaccagttgagctatgaaataattatttatttttttgaaatttatttagatgtaaaaagttaatgaaaataaataattttattttttaatcaaaaatcaaatttcctgtagaagcaacaaccctgcagtgcaaataataaaacatgtgcgtgcaaacgcttgtcagaatttcgaatacaggttgaatgatattttaatatgt

SEQ ID NO: 5011 - DNA, 1824 bp, Heterodera glycines
  misc_feature (1299)..(1299): n is a, c, g, or t
gagtggtgggagaaatgggagagaacctctaaatgtagcatccgtagctcagttggttagagcaatccatacggtatggaaaggcctgagtttcgagtcccaccgggtgagtaaccaattaattatgttctacataattgacctccttttttggcataaaacagttaataaattatgcaaacgataaaaattgttagcaatttttcacgtgatgcccctgctggacggatattcacatttcaaaaattgcaatttccaaattacggtgccttttttggacggaatactgtattccgtaaattttagaggcctttatgccgagtatgggttacaaatttgttgtggatctgaatcccgttgattattgaaatttaaaggcttgaactccgaagttggatattacgggaatatttttgggcttccgaacccagaaacaaaatattttaatatttataaaaactaaaaaggcgaaatgattggcgaataccttggcgaagtgtcacttgaggatgaaagcgaaaatttcgactacacattcagtgtgcccattgacaaatacaattcgggctccgatgaaagggattttgcatgtaaaaacatacatatgtataatagaaaattcatttaaaaaattttaatttttagtaatttaaataattatttttttagtggttgatgcctcgcgccgcggtaaccatacggccatagcgaaccacagctgttccccatcagcggaacctgtgtattattatgtgcaggacgctgatgccgaactgatgcatccggccataggaatttttgcaaagtttcttttgattgagaggggttggtatcccgggccaaaaacttggcctctcggccaactgagtcccactgatttaccacattttgcttcgaaaaggattggcctcggccaatttggtcccgctgattcaccaaattttatttcgaaaatccttggccacagccaactgagtcccgctgatttacgaaattttatttcgaaaatgattggcctcggccaactgagtcccgctgatttacgaaattttatttcgaaaatgattggcctcggccaactgagtcccgaggatttacgtacttttatttccaaaatgtttggcctcggccaactgggtcccgttgatttaccaaattttatttcgaaaatgtattttgaaaatgatttgcctcggccaactgagtcccactgattcaccaaattttatttcgaaaatgattggcctcggccaactgagtccagctgatttacgaaattttatttcgaaaattctcccnccccccccataaattcggtccgaattccctccgatagaataaagcgaattttcacacataaaaaaattcaaatttatcaaatacataattaattaattaattttttttaatttgaaaggcgaaaaattaagccgggtgaagaaataacaatacattatggtttggattattggaagaagaggtacaaaaacggcctccattgcgaatgtggcagcaatttgtgcttcgaaaaagtgggttataaatttttttattattttttttggcaaaaatttttttaattccgaatctgggaacccgaatttaaacaaaagttaagaattcaggttttcaagtttcacatatgcttgaatccgtatgggaatgaagatcttttgattttgcaatggttttgaaattttttttttgcttgttttaatcaattttagacaaaaaaagcaattcgaaaaatttgagtttttgtctacatttggttcgagtttgaacgggtccgggaccagcaatttgccaatgactaaggaaccg

SEQ ID NO: 5012 - DNA, 2759 bp, Heterodera glycines
tgtcgctccgttccaaacctgcagacagtcctttatcacagttctgaagctcttcccgtatcttaaaattggaatttccatttcccacccaaaaagggaacgtacgctttgtactgctcctttcggtcggcgttcgtctcaagcgaaggcgggtcattctgaagggtcagcatcagcactttcattggggggtagcgatggtaaggggcggtgcctgtggcgagctcaatgcacagaatgccaaagctccaaatgtccgctttgaaatctaagagacgaattggaaacaaccagcacaccaccgactgaacaaccgaccgtaaccggacacctgctccatcacttcgggggccatccaacagggagtgccgacgaaagtgtgccgaactttcttaagggcatacatcggaagtccggaaacggcggcatgcccacctgtcgggaaaggtctcccccactggccgccagccaaccggacactccgaagtcagcgatttgcacggtcccatcgttggccaacaaaatgttgcctaacaagcaactggaaaagtaggcctaaacagctaatgactgacccgctttgatgtccctgtgtatttggccagaattatggaagtactcgaggccccggaggacttccttaagaactgtcgcaattatcacttcgtcgagcactccgtaggccgcctggtctttgccaattgcctaattagaatttggttaattctctcggaaaataatgacggaccatgcctttatttttctcttcaatatgtccaacattgaaccacagttcaacaaacgcatcaccacccaaagttcctccccgacgacctaaaaaggttcaattttaaggcattagaagaaaattacgaataagaaaaggggactatccatggtagacagggataacaaaacggacaattggtccaagaattatgggcactttgtctgacaattggcaaaagggcgttcattcccaaaacacacaaaggaagtgtagtaattgacgacatttggatgcgaacacagcgacatcgcctgtatttcatgcgacaattcgtccaccgaagtctgacacttttccaaatttatgctttttatggcgcacatttcgttcttcgacttgcagaatgccttaaccagttttgtccaatcctttccaatagcaatggcctcctcaccttaaacacagtcgcagtggcaccaactccaattgcgtcctgaagttcgtactcatctttcgaccccggccattggcacccaacggacaaatcccctccagccattctcataagggcatttcatcactgcacgaaattaattaaagaaagaaagaaaaaaacgtgccaagcaacttttaaatgagcaacaaaaggaacaaagcttttgtttttatcgaaataacataactttcagaaaaaataagttaaacaaagacataattcattagtctctggggatggaaaagcagaaaaaatatataaaatattcatatttatatttgtgggaatttgtaatttgattgatgtctgtctgtgggtgtgtccattagccaaatcgcttctcttctccgccccttcccgtcaattgttttgtgctccaatcatttcgtttaatgctgcgattgcagactgaaggattacgatctttgccttaatttctccgattttgaccattttttcagtctcgaaggtaaattaccttcgactgtttaacctccaaatcggccaactcggacaaattcttcttgaatgacgcgatgcgttccttcttcagctctgtcaattctgttttggccaatttgctgatcatttcgaacttcttgcatgcctcggcctgttcattttccgccttcagaatgtctctgtttcgtgctcgacagcgctccaagtttttgtttgccgtttcgtaatttgccaagcatcgcgtccttcggtagagcaggttctgaccacggatttaacagttagaccgcatttgggggatgatgagttaagccaactcactttggccgcttgcgtttcgcccaaaaaataacgcaacgtgtccacctccttcaattcctcgtcggtgccaaccctcgcctcagctttcttcagcttttcaaaggaagttgtgacctttcccagaaattgcccaaattccttctctccactcgcagcctccaattggccaaatttctccaatccatgcgaaatgcgagcataagtgtcggcaacagctgtgaaaacagtattttttactcggttaacaattcttaatttacttaaactgaaaaaggagaaataaacagggaaaatggaaagcgtatccaaaaaagggaattagattaatgtcaagtcaaaagtacagaaattggggggggggggggaatggggtgggccaaacgaaatcggcccaacagcaggagggaattccttaagaaacgtaaggtactgctcaagtcacaactacattagactctaaaaaacgaatggttatatgaagtaccagatagttaaaaagaaatttcgtaaaaatgatatgggatatttttcagtctaaagattcaggctaaaaatcactttataattattattattttccaaaacatgtttagaatctttgtgactataatatttttactccagtaacccttgtagaaatcgagatttttttgaatgacattcattttaggagttaaagcctttggcttcgatctttcacgcactcactttgtctgatccgacaaactttgtcggccctgccagtcgctt

SEQ ID NO: 5013 - DNA, 4011 bp, Heterodera glycines
aaaggttttctgcatttaaggcgaatgacaaaaaaaacaaaaacgaaaaaagagacagcacttggccagagaggaaaacttcgtcggccgtttgagtgaaccttttgaaaatggaaccaacaatttctttcttgtttcgacttcgaactgagagctgaaaattaaacgaaagttgcaaataattagtaaattgaaaacaaagatttcttacatcattttcatattccaaaaacacgcgaaagttttggtccttttgaaaaacggggtgagcagcaagccgagtcaaaaacttttcatgaagcgcgacagtctttttgaacgttgccaaatattccctggtgaaatgcacagacaaattaagtaaattaaaaagtaacacaaaaaaggactcactgctccaattcctgtttcattttcacaaattcctcctttgtcatcgtcgcttcgccttcgccaagtttttgaagtttctcgcgagatgcatcaaaatcgggtcgaggcggtgcggggggaatctgaaaaaaagaaaccgtattatgagacgggaggaaaggagacaatgtcaacatgatacaatgaatccggcgtattcctcattgtcttcgagacaattgtgtagccaaataaattcgtcatgctctctcacaacggacatttccaccctagcaaattcgggcgcatttgtctttgtttgaacagtgtatttgacctaaaagcattttatcgtattacaattcgaatttcaatataacaaaatatgcaacaaaagttttaaatgtacgaaatatttgtcttgctttcagaagcgtattttccgtcttatttcgtgtactttattgcacaatttttaattttgtagaaaattgaatttttattcgagtccggttcggggttcgaatttggtcgaatttttctcggctccgtaaatttataaaaaatttatttgaacgaggggagcgggggtggctccgtactattacctgacaataagtctaaaaaagcatatttgatagccatggttcgaattgggcaatgattccgaaccccggacccgaacaaaaagttgaaattttttttccaaggattacatttttcttggggtaaatgcttctaatcatttaacaacttttttttgatgtaaagcaatgcttctattgttattgtgtaaaaatgcgcaattttcgccaaaattataacttatattttggttttcaacttcttgttcgtattcgggtccggaattgggcaaatccgagttcagattcataatcagcacccttgaaaacccccagaaactgaattttagtccaaaataaaaagttaaaatagggaccacaattctttaccattacccgaattgttgcatgttttttcaataccttctcacgttccgaaagagcatcggatatgttcacaacaattgggtgctgagtttccacggttttgccttcctcagtgtcctggtcaattttattacacaaattatttctgaaaatcccacatttccatttgctttctctctatcgcgcaaaggtgttaagtcattgggagttgcggcattcgacgcgacaattatttccgaaaattcgccattggttaacccttcgcccacgttcaatggatgcggtagtttcacgtcagttgaagaaatcatgtgacttactacacatcatttaagcagtcattaaaatgagaggtaagccgagcaaaaaacagtgtattaaaaaaacgaaatcattggaaaatatttatcaaatgaacatttcctaatgagtgagcaatacacctaatggtgtccgtcgttctttttgtatttgatcttgcaacggtattcttcgggcacgactttttcgtaagtgtagggaatcataaaaacagcaaagcaggccagagaaatgtgcaaaagcattttgagaaaaactccaccaggacgcctatcgaaccaaccggcatcttccggaagcttaagtgggtaatagtgtagtttgtcccccccccattttggaaaaaaaaaaaattcaaattttttttcttcattgaaacatgtttttgggggttttcgaggtcgctgatcacgaatctgacctccattgcaaccaatttcgaaccccggacccaaattcgaacaaaagtcgaaaattcatttttttttaaattctcatttattgtccaaaatcagtgacatgagaccaaaaattataaaaaacatcaacggtatcgccaaaatggttgcgccacataaactcggggaagtaactttcaaatgtgtttgcagtgtttccgctacgtggtcggaattgcttataatgaatagccattagggggtgaggaataggtctaatgccaggaatttggccaaatggaatgggctgtgaagtcccccctccccgcccctaacacccattcaaaaaagacgttagttcgcactgacaaacacaaaggatgttcaaaatgcagctgcaattaacaaagaggttgtcgaccagccgatttgaatttggagaaaatttaatcccgttcgagcatcgtaatcgattttggacaataaatgagaatttttgaaaaaaatgaattttcgacttttgttcgaatttgggtccggggttcgaaattggttgcaatggaggtcagattcgtgatcagcgacctcgaaaaccccaaaaatatgttttcattgtaatttatgaatttcgaatttttgttcgaattcaggttcgggattcggaattttgaaaaataaatgtcatattcgtgatcagcgccccaaattaccctagaaatgactttttatttgaaaatttcagggggggtcacaaaaccgaaaagaaccagtatttattttttaaatgaaatcacaggaataaaatcgaagtaattaataaaactgttcataaaatggtgacattataatcaaataattatcttaaatttgcataagttcgcgggtcactaaaaaaattcataaattataataaaaagacaaaaatttagtttggaaatggacaaaataattataattgttaaaaattgcgcggatgtgggaaaagagggaaattgcggtccaatacacagacagagagatcaaagagtgacagagggcgagcaatggcattgccgcgaaggcccacggcactcacaatcgacgggtgctcctcgtccgtctctgcttgcggcgtcgccctctgtcgacgcttctcgtcccgttgaccatcatcgactcttccatgctgagctggtcgaccaccgtataattctgaaacaatgcattgggcaaaaacaagaaataaaaaatgacagaaagtgcactcatataacaaactgacccaattttgcacttgccatgaacgataatcgcggagatggtaaaagaaagtgacgcccaaccaaacgaaataagcgaacagaagcaaagttgagagacaaagaagtgctaaaagggacagtttgagcaaaatcaaaacgcaagaaaaaggtgtacgtagtcggtttagccaaattaatccgaaatatttctcctcaactcaagtaaatttgacttgactccattcgttgctcaccgacgccaatttccgtgtgcggtccgtcggttgccataattccggcggtgtttccctgcagcaaatgccacccggagagaaagcacacggtggcactcataaggacgagcggcgttagcaggaggaagcacaataaatcggtgagaagagtgccgcgaattgtcaacggaagaccgaacacaggacgaggatggccggaacggacataggcaaagaaagagggcgcagtgctgagggggagggggggggggaatgcatttatgccggggcaaacggacgaacgcaccgttttaattggaatttgaattggcaaatttcgcaatgagtccttaaggggagaaaaaattaagagacaaaaaggttggtgaattgattgatattggaatttgaaaaccaaaaacttttaaggtcggaaatgttacctctgagagacaaccagccatttttcagacaa

SEQ ID NO: 5014 - DNA, 2464 bp, Heterodera glycines
  misc_feature (2438)..(2438): n is a, c, g, or t
aaatggtggaaaaaggaagagatgacagacatataattagagatcccataaccattgacttttaaataaacatttttgcataaatctgaaatatcctgtatcattttccgggtcaatgtcaactcttaaaaatcaactcgaataagggcctattttttttattcccgagagtttaagcttttgtttgataccaaaaatgtaggcaatgaccaattaagaaaaattatcattgattggatgcgcaaattttttaaatttgagtatccattaattagcatttgtgacagtattaatccggtaatttattcctgttgatgtccgctcaaaaaaagcgcaattccggtcaatgtccagtgattctttgatgccggcaaacacggcactttcacttccaccaccggcgccccttttcgctccgagtcggcgaacaatggcaaacttagctgtttctcagattcgactgattcgctaggatttgccttgatatcaaattaaaaaacggataatgattggtagcaaaaccatttttgtccatgaaatgtccaattgagggacgggggaaaagggcgcggcgctcggaggcaccgggcgcaattcggcgccgtcgaacagcgccccctgaattcggagggagctcagcgtcagtttgggcgcagctgtgccattggccgccgtctggccaaagccatgccaacacgtgttcagcaccaactcatccaaactaaggcccaattccctgaaacattcggccgattaaaagggcgaaagcggaagagaaaggcgatcaccgggcggagaattggcgaaaagcattcagcagagaaacggggcgaaaaagctggcccaaattgaccggggaaagcagcaattgctgggactgggccagggagagcagcgtttgggtgctgtgcactttgaacaccaattcctccaaatatttcgatggcaccgacggaccaccggcccaaagggaatcccaaaaagacggaatctgacaaaaaaaaggattgatcaacaaagtctatttgcattgcttttgcctggaaattgatcagcgattgggccacttcgatggtttgcttttcaggcaaattggtgcctttgattgcgcggcttatggccgaaagggacgagtgaatgttttgcaacaatttcaaggcgtacgcaaattccaattgaagcatttcgaccaaagggtcgtccgcgttggcttctcctccaaatgttttctttcacttttcccactttttattctctcttttttaccctttgcgtttgctttttctttttccaattttggcatttctttttgcctttcctgcgcattttgcagcatttgcggcttttgctggttcagccttttccaaagtgacaagagcggcgccaaagcttcgccccacaaatgtttcgagaatgcctttgcgatgtctcggcgagggaaagtgccgacgccggaggcgttttgctgggacaaagaaagggcggcgaacagtcgccgaagtttggcgatggcggcgtcactttgggccaaatcccacgaaagcataatattccgaggcaaattcagcaattccggccgatcagtttcgggcaatgtcgaggagacccaatccatgaaatcctgaagcaaatgatgacacacttgccaaaatggacaaacattctggcactttttgctccccaaacattggcattttcagtccgggcgccaattcgtcgccggccccatcgatcattttggaattgaacagttccagcagaaaggcgagcagcacgcggttgtccagctccacatcaattcggcccccgtagatggcgtttagcatcaatccgcggaacatttcccagtcgacgcctttcaaattgttttttcccgcaatgccaaacagcgaattcaacgcgattttggcacttctaaggtcagcttcggaaaattcgtaggccctgaatgaaattcaaatgcttgtttttttggcctatttgagtaatttctgacttaagccacgcctgcgggatgaaattgcgtcgttcctgcaccaccgcgtgcagccaatgcaacacaaatgccgccttggctttcgccgcttcgtccgtcccccgcttcgtccccttttgctctgtccttccgccgatgaaatttctctccaaattctttttaagccccggcggcgtttcgtatgccgccttcaggcacaactgcagaaaaaccaccggcaattggtcgtccggttcggtggtaagccaaagtcgaaagtcggcgtggagttggccggagagggagccaagttcggtcatcagacggttgacgacggcgggggtcaaatgcacgttgtacagacacagccaatggccctcaagggcactgtgccgcaacagctccacaacgtcccattcggcgtgactttcgcccatggccaattgaaagaattgctgccccngaggcattctttgcaaattctctctg

SEQ ID NO: 5015 - DNA, 2161 bp, Heterodera glycines
  misc_feature (65)..(65): n is a, c, g, or t
  misc_feature (68)..(68): n is a, c, g, or t
tttcaatgccattttgattttcccaaatgccaacccctaaaggctttctcgcccttctgcagcgngangccattcctttgaatccccaaagcattttctgaacagagcgacacagtcattgacgctgaactgataacagtgatttatcgtgtggagagggcgaatggcaaagtaaagttgggcacaacgctgcgcaaatggcagaaaagtgtcgcgttgcaaatcaatttgtgtccgaaggtgttgcgaatcggacagaccctggggcaaaaaaaaggcatttgaatccgcaaatggaaataagccaaagtgtgcgcactcgtgccactttgtccgctttctctttgctttcattcaacgactcgagcagtgccgtgttgtccagcaaagagccgtcagaaacggcgagctgttcgagcagtacttgctcgagattgtccatttccaacttgagcgcctccatttggctgcttaattgtgtcgaactttgttccaattcgggcttttccaattcaatggccaatgacagaaattgggaggccaagccggatcgagtgatggagaaattgatctcggagaccacggcactgacgtgagaagccaaatggcaatgctcatttcgagagcagaggaaaagccgaaattggtcgttgaaatcgacctgagaaaatcgacgattaaacccaaaaaagccgaacaaatgaacagctaaaaatgccaaaagcaaatgccaaactccgtcagctgtccctgttctttgctctgtgctcgcctgtttttcgcccaattgtacggccaatcgcgcgccaattgtgtgaaagtccctccttaggagagggaccaatgccggctcaattcgttcgtcgatttcgtcaattatcaaagtcttcccaaagcgcacgcccaattcgatcttcaacaattaaattacaattgcaaaaagcgtcattttccgtccgaactttggtcattaaatccggttgattcgctcgtaaaatttctgtcgaattgcctttgaagtgattggccagaaaagtgcacactgtgccgctggggtcgacaacgaacggagtgtttttgacggcaaataaaatggcgccattttccattgccaatttgttggccaacaatccctcggatttccatctgagctgagcagtttcggaggcgagaaaattgaggaggtcaaaagcggcgggtaattggcaaatttcgcgccaattggccatcgtttgggcacgcatttcctcagtggcagcgcccagaaaagttacgaatgccgcacctgaagaagcaaattgggacgattggatcaacgaatgatcagactaaagtgatcactactgatcagaccaatcgatcatcggaaaatgtcaaaccgatcagccaacataaatttagagtgatgatctaatgagtgagtgatcagccgaataatggtaaaaccgatcaaccaatcaaaatcgaatccaacagcaaaaaatctgaccgatcagacagcagtgctccaccgttctgagctcgtcctccaactccttctgctgctgctgccaccgcgcgtactctccgcccaatctctccaccattttccccgcaaccacaatggtcgcctgttccctgtccaagtcgattttgatttcggtcgcctctttcatgcaattttcgaagttcgttttcagctccgccacttttttgtccagcgatttcagtcccttggacaatcgctccatttgctgctccgccgcgttcagatttttcaccagcgactcctttttctgctcgagcggcgcaattttctccaaaatcaaagcgtactgcaaatttgcggttacccaagcagccagcggagcaatcgcttaaatgttagccaaaatttgaatgtttcggctttcgagtggaaattccatagaaaaagccgtagaattacctgtcgatgcgtttttagcgttcaccgggtcgaacgaagcggccttcgatttgaccaaagcgcccacttttttggcggtcgacggagtgatgcggcggacgtcaaaattgatgatttcttccttgacgccacctttggccaagaagcgccgcatggactcccaggaagtgtccaaaatgcccatgaaaagaagcaccgcttccaaatgtcgcggatggaagtggcgggcgagcg

SEQ ID NO: 5016 - DNA, 1421 bp, Heterodera glycines
gctttttgccatttgtccgtttaattcctcttttgtcagtttaatttcttttttgaccatttgtccgtctctttgggccatttgtccttttaattcctcttttgtcagtttaattctttttgaccatttgtccgtctctttgggccatttgtccttataattcctcttttgtcagtataattttctttttgaccatttgtccgtctctttgggccatttgtccttttaattcctcttttggccatttgtccgtttaattcctcttttggccatttgtccgtttaattccgctttttgccatttgtccgtttaattcctcttttgtcagtttaattctttttgaccatttgtccgtctctttgggccatttgtccttttaattcctcttttggccatttgtccttcccccgccttacgtcggccaattgctgctcgatcagcttcttctgctgctcgatgttcgcgttctccgcctcggtggtgctcttcagcttctccatgtcctccttctgttccgttgctccgctcatactccgcgttatctccgccaatgcgccgttcgcttccgcttgcttctccgccagcagcttcgacttcttcgccgcctttttctgcatttttgccaccgcatttcgcgtctccgtcaatcggtcgacgcccgcccttagccgcgccagccgaccctccacggccgtccgtttggaactgatcaaagcgtggaaagtgtcgacaaaatgagcaaatttggctgggcattgactctccgctggtgccaagtgaaaaagttggacaaaggcggacaaaagccacgaggacgactgatcggaccgatcagcagcaccattttgttgtagagagagagcggcaatttgggaaagcgtctcgtgggaccaatgatcttgccaaatctgaaaaagtgccgaattagagggttaaatgcacttgatcgattggattggacacatgccattgtgcagcatttgctcagtgccggattggacaaaatgcgcgactcgaactgcggatgagcaacgtccatcagcagcaccaagtgcagatttgtgcggatgcgattcgcaaagtgaacatgcaaagtgccaacgctgccgaagccgtcgtccaatgcgaattccctggggacggacaatggcataaatcgttgttctgatcagcaacagtaatacaatcgcgttaccgtagcctgctcaacagttggtccagttcctgctgggtactgtaaagtccgggaacgtatccgtcagagagaagggaattgatcatttggaggaaagaatcgtccaacagttggtagtcctccacgaggagaagcacctgctcggcatcgatgcacgcacaataaatggcatctttcaagtcttgaccgaaattacgaagtgagtaagaggaagaaacgcgcagag

SEQ ID NO: 5017 - DNA, 2801 bp, Heterodera glycines
agagagagagagaggagagagatagggagaggggaggggggaggggggaggaagagagagagaaagagagagacaaaagagagtgagagagaaagtgaaaagggagagagaagagagggagataagtttgttctgttgttgccctaccaattgttccaaatgccgtgccgttgtgttcgcactgcagtgcatgttcagcaacagtctttgcgcttgaatgccgcctccctcaaagcattccttcagcagcgtctcttttccgcacccctcgggccccaccaccaaaatcggctccattttttgcgcttccgtcgccgctctttcgcggcctttgggacggagccattccatcaaaatatcacgcgcaatttgcatacggacggaccaaataatgggcggacgaagacgaaaatgggctaattgaattggcaaacctatgccaaaaatgggggggggggaggggaattgaggtgagacaatttgtgccatttgctgacagaccaaagtcatcggaataaccgagcaaagagtcggttcggccatcgcagtaaacattcaatggcaccttcgtgtcgggaatggcacaagtgttttgcgaaaagaccctttggcacaattcgctgcgtttgtccgacgaaacgaaaggggcaaaagcacgcaaaagggcgacgagaaattggtttttggacttggcattttgcaccagtgacaaagcgttgttcaaaatgcctttaattaattttctaaatattcattgtcttttgctttaccaatttgactgaatgccaatgctccgtttcgctgctttaccgtccattccaacgacggcaccaaatttttgtttagccaatcgccgaattgggcgggcaattccttttcattttggtgaatgaatcttcaaaagattaaattactgagaagctgctcccaatgcctttccgatcagtagtgatcaatcagtctgtgtctgatcatttttaatgcaaattgccgtgactttccgatcagtaatcagtctttctgtttctgattacccatccactactaattgcccattccttcacctgtcaattagcgtttgcatttccaaatcctcgtggctgaccaaaatcattcccatgcgcgaaatcgttgccggcgacgcgtggctcaaatcgacgcattcgaacaaaaaattaacattcgacccgaattgaatgcgttcccccgagggaagggtcaacaatttgttgtcgtccaacaccgaattcaatgcttcgatccatctgaggcaaaaattggttactcatcagagagaaaaatcattgaaacgacgtcctctttttacatgtgccactcaattcgtctacactatattaatatatgcgtatagatgagtggggtggattaattaaagataatccccccccctctcttctctccgccgccccactcactccgggtccacgtccccgtcgcagacaatccatgccggtttgttgcgcctttggcggccatgcgagccgcctgggtcagcgtgccgtccgtccactcgcgcgtgtccaagtccatttggcccacaagtcggctgcgcggcatcccttttgggttcatgctgaaatacatccaaatttcaccttctttcaaaaaatgttgttgacctgtacacgtcccccggttgttctccgctcagagaaagtgccttttggaggagtcgccaaagcgtcgatttgccggagcccggaggaccgacgatgatcacgccgatgcgctggcgcaactgctcgtacagttggaacagcttctgaagttgggcatttgtcgtgcgcatttgaaaatgttccgacgcttttctgatgggttcgataagatcggcaaattgggccttaattttctttttgcttttcaattttgaaaatgaactcaccgcctctcttttcgttcccgggaaaatgccgtccaaaagcacgcgaaagcgccgtgcgtccgcaaatgtcagtttggacagcgtgttcagctgcagttgttgcaccaccatttccgtctcgtcatccgccgttccgccacggttctgtcgtcgtttggccattgcatctgcgcatcccttcagcactgtctttagtgccctcagtccccaatcgtaatgttgctgttcgctgagcatttccttggccaactcaaaaatagtcaccaactttttggccaacactttcgcttggccaaatccttcggagaatagcaaagtttcggagatttgctggttgtccggcacggacattgccacgggtcggaacagctgcttcaaattgtccggcaatcgctgtcggccgccgtagcctttgcccgcggggttcagcgtgacaaaaatggccgagttgaagtcgacggggacggaaaggtcgccgatgcgacaaagggacgccttggcacggacggcctcctgaatcaactgcacttgggaggagacggcggacagaacaccgcgcccgaggcgattgaactcgtcgaaacagccccaggcgccgcattggatcagtcccacgaaaatgcgaccgatcgccctcacatcgatgccttcgtcgcagttgaacaccagcacctcaagtgggcagcgttgcttatgccattccgttttctgcctcctcccacctgtctgcccaacagtccggccaatgccttcaccgattcggtctttcccgtccccgccggtccgtacggattgccgcccatgccaatggccaatgcctgcgtcagcgtcaagtagcatttgtccgtcagcggcgtgtgcaccaatttggccgtgtttccctttttgggaagca

SEQ ID NO: 5018 - DNA, 4951 bp, Heterodera glycines
  misc_feature (4930)..(4930): n is a, c, g, or t
agatggtcaaccgaagcgattgcgttgctgttattatctgtcagagcatgcatttgtcaacgttttcaaggaggtgtgtccatagtttaggttgtcagaattggaatgtttgggagctctaaactggaaaaaagccataatttctagagcgcgggatttcgaaattgccagtaccggggtcgggacttgaaaaatggaccggggcgcgatttcgggaccgagactcccggtcccggtggtctgtcaaaaaaaacgggatcggggccgggagtcccggcaaaatcccggcgggccacggtcccgtccgggctctaataatttcttaagcgactgatttaattactttttaatttccgttttcccatcaattagaaatttatccgtgccaccacttccgccagctacgaaattcatttttttgtttataagtcaactccaatcgagccatttgaattggtgaacaaacggacaaacgaaaagctgatattgataaaagcaaaaagaaatgcaaggcttaacaaagggataatgaagcggtatccgattgggaattcggtggcggttccgtggggaaaaaacggaaatttgaacaatttgaacaatgtcagctttatgctttgcgatgccaaacgatgcaacgggtaagcaacaggaatagcaccgaattcgactcccgaaaaaactttggacgtcggaaattccgatttcggaaaaaattatgatttaaaaaatgggaaaaagtattcttcaaattgctccgaatttttaggcctttgtctctatcagcagcgaagcaacgaaaagggtgtctaattatgtgaaagtggctactcaacttttgaggaccagacatttgaggatatccccgatttttgaggacataaaccatttcaaaaaaataaatgaaaattttattttaaatctttattttaaaaatagtttcccaagggccaacgagagcgaatataaagccattgattatctggatcatgccagtttccaaaagaattgagaataagacggttttgaaacgataaggaatgtgtgagaatttcatccccatttgggttctcatttgcatcaaagtcttcaaccaaattccgtatagccaatttgattgtgtgtattttctatattttaaatgctataaaataaaattccatttatttttttgaaattatgtatgtcctcaaatgttgtaccatggtgaaagtgaattaattgaattggagaaatggccgatgaagcagttcggattttgagtgaaaattgtcgctttgataaatgtgtagccccgtggtggtcgaaggacaaaaagtgcaaaatttgctaaatttttgactaaatccactcataacttttctcagacgcaaccaaattgcacaatcttggtatcatacgatagcccttgaattgcgctattagcctgccaaatttcaaaaaattatattaagtttttcaaaagttatgacaattttttcattttttggctagaacttttgaaaaacttaataaataagcctaagcctaaaccaagcctagcctaacctaacgataaaaaactgttcatacaacaaattttatttcctctttttttgcaaaaattgacaaaaaaatgggcaaaaaacgaaatttaataataatattattttaatataatatcaatcaaaaatattattccaacttttagacaaaggctaaaatatgggaagagcaaaagaatggaaaattgacatttttgacagaaacggaggacgagaggagcacctgctggacaaaaatgggtggcggaattaaaattaaatatcataaaataggtagtagaatattctggcatatatttttcaggatttgcttattcttaatcttttttcgtattaattttttgattttaaaattgggaaatttaaaataaaattctcctccctttaaatttaaattatgcgcacatttctgagaagtcaattttgataaaaattggtattctttaaaaaaacaccacatacaatacgaaaaaatatatctgctgaagagtggagaaaagataggacaaaaaggtgagtttttaacgtgaacttttgtttttaaattttttaaatttagatttttaaattgtcgataattaaaagttaatggcacggcaggccgtccagcaaagttgcattaatattggtgctaaatcgttctttcaaaaaaaaaaaaattataatgggcaatcattaaaaaacatcaaaataaaaaaatttgctgatggccaaaaatgttcgaaaagcaaggtttttgagctcttttggtcataactttttggaatcttaaccaaatttttttgaaaattttcagactgatagagaacacttagggatatgattgataaaaatgttttatataaattatggccaaaaacagcgaaaaattacgttttctagcttttttttggcgccgtgtgccatataaacgctaacaaaaattatcaattaaaaaaaagttcacgccgcattctcaaaaaggtaaacaaaaattaattaatattctctgtggaaagaacccgattcattaggtaaataaaacatataggataattaggaggaggaagcgaggggggggggctattagcaccgagaaatttaattggcgctcgagagtgtcagtccacctctcggggagacactcaattaaaggatgtatcgaaagtctcgaaagatatgtctattcaaatatatctccgagaatgggttcgaaattcaagacatgagactctcgacagatacattgtgccatatgatttgggtgccgaagccgtgcactgctcgtcaaaatgtgacggcacaactcgactgttggcatgatgattgattgatgtgttctgttcgggtggtaccggccgagactggtcaccgatgattgatttttttttgttctcgatccgctggtccgatcacaccattttcggcgtgccgggtgcgctcggcttgtcgctgctccgctgcggtgtgctctgtccgctgctgatcagaagtgaggcgcttttcgggaacggcttctccagcagttgttgctgctgctgctgctgttgttgtcgttgcttgtcatcggtgtcgtctaaaaataattaaatttaaatggtaattttttaacattttggtcaagcccacaaaaatgaaaattttgaaaaaaaaatcggtataaatagaatgaaaacaattcaaaagagaaaaaatctattcgatgccaacaaatcgcatatgccaatgcccttattgtaaccagaaaaaaaatcgggaggggcaaccgacgatattttttttttgttcttcgggtcaaaaaatttttgtccagtgaattgatttaaattttttggcgccgtagaaaaaacgggaaattttggccattttgagaccaaattttgaaaaaaaaaaatatataggaaaattgggatccggcgctagcgttagacgccgccggggaaaatttaaaaaattttagatccaatttattaattgagtaaaatttaaaaaattgtacatttttcggtaaaatttttttttttttttctttcaagggcgccgtgggtggggggggggaattttaattttccattgactcaccactttcgctgcactcctcctcgtcctccatctcctccagccgggtcatgtaccattggcggttgtcctccagctggtccaggatggcgttggcgtccggattcaccagctcggcccatgtctcgtacagcggatgcacaatgaagtcgatgaagccgatctaagatttaaaaaaaaatatttggtgcgagttaaatctgtgtcaatttttttttttatctaacctataggatatttttaaccccgcccccgctccggtaaaacagctctcccatttgatgaatttgaaaaatttaaaaatttcagacagaaattttttcgtaaaattttctaattctctaccaaagtattaagtatattttttattaagattaattaaaattccaagaaaaattatcaattttttctcgatttaataaattacaaattattttccggggattttaaagtaaatgatgcagccaatgggagtcgaatcagtttgaaaatttcccaatcaaaaatatattaaaaatcccaaaaattgcctgcgatttctcgaccgtgacattgcctcggtcgcacattgggctgatctccaggcctagctaaaaattttaaaaagtttttgaaaattctaaaaggccctggccaaaaaacccacctgtttttcccgatcaccctgtcgcaagtactcctccaaaatgcgctcattccactgccggtacagctcaattggcttcgtcgggttggacaaatcggccaaatgaatggccgagcgaagaacctaaatttaattaatgtaaataaaaaatattattttcaagtattttaatttattatataatattgttttattaaagtaaattaattaatttttgcttgaattttaaattaaaacccaaatattaaggatatattttatttattttttaatattctttatttgattctttatgtttttaattattttatttactcaaaaaattttatttttaatatttacttttttggcttccattttttatcaattatttttcaaattatttatataattttattgaaaatgcaattagtttttattacattagccgtagttaattcttttattaaattctttaatataaattttggaattttatgaattgaataccattattaaaaaaaaaaaaattaaattttactccatatttttaaaagatagtccatcaacatttcttttgttttatttttatatttttttaaaataattttatttaataattacattaattttgaaatataaatttggttttcttcaattttaacttcttttaataagccaaaatgaattttttgtattcaantattttttattaaaaatttat

SEQ ID NO: 5019 - DNA, 1952 bp, Heterodera glycines
  misc_feature (42)..(42): n is a, c, g, or t
  misc_feature (138)..(138): n is a, c, g, or t
aaaattaaattttttgtattcaatattttttattaaaaaatntattaatgcttttttcaatttatgttatcccatttcatttctcttataaaatttgaataattaattattattttttaattaattgaaaaattcgtntaattaattaattaattttatttttttaccaatattctgtcctggtatttgtccagcagtgtgtccgtgccggacaccttcttcgcctccaccatcgttttgaggtcggccaacaaagtcatgtgcttgctcatgtcggtggccagcaccatttcgatgacctgaaaatttttgaaaaaataaaaataaaaaatacaataaaaatcaaaaaaatttaataaaaaaatacattaaaaaaccaaaattattaaaaaaattatgtaaaaaaaaacttaattcaactaacaaaagccaaatgaatagcatttttaattcaagagcgcaagtttataaatttttaggtttatttaataaaaaagagacattttgaatatttttttatcgaaaattctatttattttaacttaaaataaataaaaaattataaaatatttaagttaaatattcaatttcaatttttaccattttccgaaatgtttgccgctgttttttgctgaccccggccataaaatcgcaatccctttcctgcaacagcttgaacgccaccgcaagatgatgctgttccagcacagattctgtaaaattaataatataaaaaagaaaaggtcataaaaaacgttataaaatgaaataatatggaaaaagtgccaaaatgcaaaaagaaaataagtgtaaaaataatttttttttacaattaaagtgcctaaattcatttaaaacaaaaataatgataacaaaaagataaaaagaccaaattggcgataaaattaaatttgaattataatgaaatttttaaatgttttcgttttcagccatttaaattttgaattaattaaattttatttttgaaaataatcaatcaccgtcgttgtacatgatggccaattcattgttggtgttgatcaaatactgaaaatatttaaatttaaaataaattttttatttttaaaatttttattgtacctgatttgtgaagccaggatgatcgacctaataagaaaaaaagaattttattccataaacggattttaattaggttttgaacccgctgaaaaagaaaatgaccaaatcatggatgataataaactttacgatccctatgataaagtcattttgtcctacaagcatggcactcacatcatgaatggcagcagcgatgatcgccgccagcacttccaaatcggagaacacgccctgaggcgaagggaggtaagaggtgatcagcacggtgctgagtcgttatataaaaaccatcaaatggaaattttcaacctaaaactgtccataacttttgtcaaagtcaacagaacagaattaaacattcttggtatcatgcgatagccctaacatttctctattagttcatctaaatttcaaaaaatttggtcaagcttaagcaaagtatggccaaaagtacacaagcaaccaggttttcacagatttttggccataactttttttaaacctaacgaaatttttttaaattttgcagactaatagagggcacatagggttatcgattaatagcaaaaaaataaaaaacaaaaataatttctaacagaaattttttaattaaaaataaaattattttgatcatcaaaaattctgatcaaaacattcttagaacgaacaaaataaagtgattttgctatcattcgctagccctatgtgccctctattaaaaatttcgaaaaatttcgttaggtttcaaaaaagttatagctaaaaatgttagaaaaacccgccgccttgggtacttttggccataactttgttcagctttgaccaaatttttgaaatttaggtgagctaat

SEQ ID NO: 5020 - DNA, 1060 bp, Heterodera glycines
agaaatagagaggatgagagagtgaaaaagattgagagccagtggatgacagagtgaaaaataagtagggggacagagagcgagagaaagaaaggataatagggagcgagaaagaggggatgagagaatgaaaaataagtgagagggatagagagcgagagatagagagaaaatagagagcgagagaaaaaagaaagtcatagtgaatcatctgatcaaaaaaggggaccgtacttcgagtgccggtgtggagatgagcacgcccatggactgggccacatcagcgccatggatttggttgtgatatggattattcctaaaagagggggcaaattggaaataccaaaattacttaaatatatttaaactaaaatttaaaaaaaatttattggcgttccgtcacaaaattccgaccgataattatgctccaaatgcagcaaaaagttgaccaaagtgcccggattgatgtcaaatttgaacattagcttccgcttcctgagcaatgtgtacgtgacggtggtcaaactgtgctgtttggacagctaaaaattgaaatatttaatgaaaaattttttttttttaatttattttattttttgtaaaattgaaagaaatttaggcactgttaagcacagagattaggcctttcgagactgaaaattcctcgagactcaaaaaatcaaatgggaatccccactaaaaatggcaaacgaaatttaataatttaaaaatataaaataaaattaaaacaatttaaaaatgaaaaaaatatttaaaattaaaatgacctcatgaattttaaagatgttcaaaccccattcatttattcgttgcatgtaaacttcgatctgtaaaataaataatatacaaattttctatataaaaaaagattcgtttgacatttaattcaaggcttggcttacctcttttttacagggcacctaaaatataaaaataatttttttttaaatatattttttaaatttgtaactgaccccaaattcggatggcacagattgggtattacgtagcctttgcacactgtaaaataaaaaaataa

SEQ ID NO: 5021 - DNA, 1585 bp, Heterodera glycines
agcagttagttaatttttttcggacaggtgagtcttctgctatttattttgtccacttttggacaaatggtcattgccaatttgagcaaaaaaaactcgccccgaaatgcgcgacatgcccatcaccgcggccgtcttggccttgttaaacaatgacggggacggcaaccgttgttgttgcaggatcggggacggggaggaggtgctcggccgttgtgggtcctcttcaagcattgaatgtttctggagaaaagaaaattgaattttaaaaattttgaaaatttagggggacagagggaattaaattgtaaatttatatgggggaattaattttcgaaaattaagggaaatataaaaaagacaaatataaattttaaaatgaaaatagaaggttgggataataaatataagtttgcgcttagaaaaaattcaattagggaggaaaaaaaagtaaaatttttaattttgaaaatttagtcaaaaaattatttcaatattatgtaaaggaaaattaaaatttagaattataaaaatgtttaatttataataaaattcatttatttttgatggtaaatgaaaaaaagaaatatttgcttaaagcaatttgataaatggtataaatttaatgtttatatttgtgaaaagcaaaaagtaaagaaaatatattttttagaaaatatattcaacaaataaatttaggttagaaagcgatttttaagaatgttttgtaagcagaaaataggctcaaaagcaacagaaattaaatggaaaatatgtacaaaattaaatttaaaaatttgcaaaaatttacaaaaaaataatctgcggcggctgggaatctcacccacacaaattttaaaaattaattttattgcattaaaaaagatatacatttttttaaaacccgtgcgggtttcactgacttatatataaagtcaaaactttcgaaattttagtgagggaggaaaatgtcacaaaattcagtcccctcccccccgccccgccccgcccccgtgcgtcccccgcggcgacaacttccggcgacagcgccgccggcggaatcgccccgccgggggcggcgcagtcggtctccgattatcaccgccggcgacggggcgagcggtccccgtccccgccgcaaagtccatccgtttgtctgtctgtctagccataacagtgtctcgtcgttgctgattagcggtgggtcgcccccgccccgcccccgctggcggcggggggtaacggaatttctccaatttccgtcatcatttttatttctttttgagccgcccggaatttatacggtttccgtccgacggagcgacccggaatttttgggggttctcaaaaagtgaatttatgtattcagcgagaaaatttctgtttctacgaattccatatttttggagggaaatttttaggccaaacaatgattttttttttgcaaaatttttaagcaaatttcgaagtgccataattttttcctcaatttttaaagcataaaattcccacacgtatttcctccgcctaaataaaataattaccaaagaccccacacctcactaattatcaaaaaaaaacatag

SEQ ID NO: 5022 - DNA, 3947 bp, Heterodera glycines
aagaaattaaattttcctatgtaaacactccatttaaaattttagcataatgtggcactttctccgaaccattgagctgcacgaaatgcctgaattcttcatggatagccatctgaaccctgattactaccaccgaaaaaaacggacgctctaccatcgctgtattttcgcaggatgtcgtgcgaaaatgtgagttgttttttgcccaattgataagcttgttatttcaacaaatgggtttagaaaaatcgctcagtcggcaggaatccgccgggtgtactacaacgtggcgcacatgcacgggggacaaattcatcattaaaaaatgtgcgaacaggggaaaaaagtgggaaagatttctagagcccagatttttttttaaaaaaggatattttctagatgcctttaaaatatttggttaagaataaaaaattaataggaaacattttcaaagctggaaaatttccaaggaattgacattttttttttataatttcagggagaatatattttggaaaaattttttttaattcttcggcgatattttggaaaaaattttgcaagagtttagtaattcaccataaaattttgaatgttttaataggcatttagaaatatctttttaaaggttcttagtttacgataaatgtttaaaaacatctgggccttagttatgccattcattttgatgttgtatttacttttgctgccaataaaacattttgattgaaatgccctttttgttgttaattgcccttaaatatgcgtacatttgcagttttactcactttttttttgctcatctccttgatgtatttgttccggatgctttcccattgcttttgcagtcatatgaaaattgcactccttttggagaccctcttttgaccgtttttcaataattaccatcgatcctttcaattttgtcattttcctcggtctcataaaattcgcttcgatttgcgtagtccaaatcccgttgccaaattgtgcggatacttaatatccatcattatgtgtaaaaaaacaaaaaaaaattttgaccaaaaaaaagttgaaaaaattttcaaaattgtactcttttaaactagcgccaaaaattccatttaaaaaattaacaaggaaaaaaatgggacattgagtaaaacagcacaagaaaattcacatttaatactttatttatgattttgcagagaatgacagtcaattattatgttctctgtcttttatacgaatttcaaaggaaaaaacgggctaattaaataaataaataggtaaataaattcccgactttaattaaattcgaattgttcctaaaatgaaatttgtgaaataggtaggttgaaacaaaaagcgatcattttgacccttaattttcgtttttcttgtcactgatcaacaaacggtgtttgatataaatttgagtggatttgtgttgaaaatggacttaaaaagaattttgagcctttaatcaaaatttgtaatttaaaattgattcctttatgttttaaattattttatacaaaaactgcaattttaataaatttcacccttatatttgaaactttttcgcccctaaaaatccgttccctaattatgatatactaaaaaagcgtaaccaagaaatgttgacactgatgaagaaaaatttgtggcctaagaatttcattcctaccatcggtagtattacccaaatacacaacattgaccaagtaagaaaaaataaggtatgccctaagaaattgacgatggtcattgattaatcgcctaaaagtcgattgacgcatttatacagcctatacaatataatacagcaatatatacatatacacaacaccatgacatacatatgtgtacaattgagttaatccatcggaatttaatcacccatatcaattgcgcgattcatctccattcacagcagcggcgttctattcagctccacctttgcgctggttccactccgccagattgtcgtgcagcttctcaatgattgcgagtgcctccatcagcgtttcgttgccgctcgagtccgtcaatataaccgcatttgcatcgtcgtaagcctgcgcaaaaatgaaatgaacagcagcctctctaaaacaatgaaatccttccaaccaccttttgtgcgattcggcgagcctcctccgtcgatttcagtaattcctcgtagaaaacggaaaagttcagcgccacaccaagacggatgggatgcgatggtcgaagtttttcctgagcaatgctgtacgcctcctggtacgccttctgtgccttgcgaagatctgaaaattggggaggggggaatttgttgaattttagcattttcgaagcccttttaccatccgcttccgacggtttgatctcggccaagtagcggtggaagtcgcccttcatccgcatgtagaacactttggcctccgggtcggcagcctttgggatgagctggttgtccaacagagtctgaaaaatttcaaaaaattttttggagttaaattctttccggggaaaacgccgcacggacggacgcactgaccaaaatttcacggcccttctcctccgcctcgctctccaccttcttctgcagcaccttgacaccttgcttctgtttgtccatgatggtcgactttttcacatgggattcgatgacacgccacgcggaacgacgagtgctgatcgcccttcggtacgcagcggacagcaaagtgcgctcttcttcggtgagttcgacgctcatttcggccacctgaaatggggggagggaaattataacagggaaatccggaaaagcatccattcgatccatcgccgctcacaacacctgcttcatctcctttgccatttcgtcgtagcgttcgcattgttccgccagcttggcccgttggatgtggtcctcgcgctgttctgccatttagatggatgggttatgatgaatattaaggaaggactgggcttaattttttctgaacaaatatggcatacttgtgatgaaaaaacaataaaaattatttaaatttgtatgtcgtgtcttatcgaaaaaactgaaatcaagaaattctttttaaaatgtagggaaagaaatccagaaatgtgagtgctcaatttcagcacagtcaatgaaaatcaatcagaatccgaattcggattcagaagttcacagttttagagtaacaaaggacaaacagaaaaggtgacaatttttggtttagaaattatagcaaattaataagacgatgaaggcagaaaaaaaggcaaaagaataataaagtggaatgggcgggccaatttgactccttaaataaggatttttaaaggaaatacctatgcaaatttgtcatgcaatttcaaatttattttggcgttttgttttatagaattgaaaattacgaaaggcggagggttattcttcaatttgatgcttttgcaaaagttttgttagttttccggtttcacataggcatttgtttaactcgttttccttcacaaaaccccttaagttttaaaattttacttatctaattttgtccaaataaatgtcataaaatgtgacactttcatatgcctacataattcttttttaagaaatacttgaaaaatttcactatcttttccacgaaaaaagtaccgaattttctggtgcttttactcaatgtccccatctattttctctttgctaaaatttattttttcttatgaatctttgaaggaaaaaaacccactgaactgaaaagtaccaaaaactgtcttactaatttgcctcgacagaaaatgtcagacaaccgaaaagaagcagagcaaaagatggcaacagcaatgtaacttcaaaacgccagttttcaatttcaattttagactcacttctttcagcttcatctccggagacgcttgactggcggtgtgcgatttgctcccaccttctcaacttggcctgggaactgcaatgatca

SEQ ID NO: 5023 - DNA, 2074 bp, Heterodera glycines
ctcaatttcagctctggctcaataactcgtcaggagttgattttatcaaaagatcatctaagagcttttaggtagagaattttcagcccaatgtaatgtgctttatctcatgtttatagcatgagtttaaaaaaagttataaaattaattgtgattgtgaaactcaaaaccataggggggaccccatggttttgcatttcatgaaaatattttgtgctcatatgtatgtcaaaatgcatgtttatggcataatataagaagatgaacatggatatagggtattttttcagtttcatgcttttgcgaaggttttgttagttttccgatttcacataggcatttgtttaactcgttttccttcacaaaaccccttaagttttaaaattttacttatctaattttgtccaaataaatgtcataaaatgtgccactttcatatgcctacataattcttttttaagaaatacttgaaaaatttcacttttttccacgaaaaaagtaccgaattttctggtgcttttactcaatgtccccatcttttttctctttgttaaaatttatttttttttatgaatttttgaaggaaaaaaacccactgaactgaaaagtaccaaaaactgtcttaataatttgcctcaacaaaaaatgtcagacaaccgaaaagaagcagagcaaaagatggcaaaagcaatgtaaatttaaaatgccagttttcaatttcaattttgttttcgcttttttcagcttcatctccggcgacggttggctggcggtgttcgatttgctcccaccttctcaacttggcctgggaattgcaatgatcagcccccgttttgacttctatgtggacgaacatttcaaaacgcgcaaatgggcactgaaatttatgcgaattcgaagcaaaattggagcaaatggcacgaaggaaatggaagttgtcaattacgatggaaaaccgttaccaatgccacaaattgaattgccgcgcaaagtctccggattcaaacgcattctcatcaagtaaaattgtggctatatgtaaaaattttcggcaaaacttttccccattcattttcagtttcatcgaccgcaatgccatcgcttttctccaccatttgcgtccacttttcgcttcatgtccaattaatttgatcatcaatgcggccagtgatcacattttggagatcactttgcatttggccactgatcgtgaaaaatatttgtggaatgtttttttcctatccaattttcaaacatttgcgacaatttgcgccataacttctcaggacgggggcgtgaagactgaaggtgggggtagaaaaatttacaattttttttcttcaattttttttaacaataaaccttttttcttgaaaaattgataagtttgaaatttaaaaaaaataaacggtgaaattttgcccggcgaaattttggggtgcacctcgaataagcttgcactaacaataaatttcaccctaactgaatttttttttaaatttcaaaacagaaatttttccagaaaaaaataaaattttctagcgtttattccttgaattaccatttttttcaaatgtttccaaaaaatttttcggaggatgggacgaagcgatacattgagggagtggaaacgagctgcccccgttaacgacctgctccgaaataaaactttttcgatacaaattcagttttttttttgtcaaatacacattttttagcctggcacattccgttacgtgttcttgttttgtttggcacattttatgcacggagttggcgcaactccactgtacaccattggcttgtcctacattgacgaaaatgtgtctattattaaaattttcaaatatctctccaaactcaaacgatggtaattattgaaaaacggtcaaaagagggtctccaaaaggagtgcaattttcatatgactgcaaaagcaatgggaaagcatccggaacaaatacatcaaggagatgagcaaaaaaaaagtgagtaaaactgcaaatgtacgcatatttaagggcaattaacaacaaaaagggcatttaaatcaaaatgttttattggcagcaaa

SEQ ID NO: 5024 - DNA, 3015 bp, Heterodera glycines
  misc_feature (2947)..(2947): n is a, c, g, or t
tgggtcggggtcacttcgccgcggggccaactcgccgcgcgctttctcgccgcgggcccaactcgccgcggccaactcgccgcgcgctttctcgccgcgggcccaactcgccgcggccaactcgccgcgccttgttttttggcaatctcgccgccagaatttttttttaaaaactaagttcagaagaaagttagaaatttaaatttcctaaatttggcttttaaactattaaaaatcattgaaatgaaatgtatccctgaattgaaatatgtcaaaaaatcattgaaatttcaccaattcgacatcgattttcgaatttttaccccaaaaaagaatcggcgtaataaaaacgaattggccaaaaacgaatcgtccttttaccaatttaccggtgcaattgatccccagcaccggtgttaaaaagttgaccaatggattggcacggagctgggaagacagtcccatgcaccccacgcacgtctttttttttatatcccgttacgatttttttactttcacattggcactgttcgcttcttctgtgaccattttgacaaaattgttgttcaaatacgtgtgtattattcgtcatcgaattcgtctctttgttagcatcactataatttcatattgatatccacattaaatttcgaaaatatagaggaatcattcgttctgcaatttttgcttcctttgttgactttcaatttgaagcatattaaattggagagaaactttgatgaaatataacttattaaacacggcgattcaattttgggctcccagtgcaaataagtttattatttatttagtaatcagaacgccaaaactttgcaaaacttgaatttttttggggattttcccttgtaaaattagaagagccgatctcgagttaaaaactagacagctaaaaaataaactgtgattcgatagagggggtcaaactatgggcctatgcaaaatttgaagaaaattggtcaataggaaaaaatttttttcaaggacaaacatttcaataattttaatccttttttagccaagtccacaatttaaggccaaaccaaataaaatttacaatattctccagaattttcccttcaaaatgagcataaaatggttctatttgctctagtattcaccaagttataagctaagaaaatttcataaaattgtcgatgttgtacgtaaccaacactttttgaatataattttttattgacacgaaaactttattaataaaaaaataattctgccttcttctgtaaaagaagaaattgaaattaacatacaacataaggaggactcgaacctgagacccccttttggtgactaacgcacagaccactaagacgaaaaaaccaacttaattgtacaaggagcccaaaattgaatcgccgtgtgtaacgatgtggtgggacacaaaccgacgcgaatgccgtaaatgaaccttacaataattacttaattccagttccctcgggagtactgtcgttgccttcttccactcctttaaactcgtttatcaagaacggtaaaaaaaagtttgaaactaatatgttcacttttattgccagagcggacgttgttatcagcaatggacctgcaattgggcttgggatttgcctttctgcctgtttattcgattttctccggttgtatcgttgccgtgttgtctttgtagagtcaatttgtcgtgttcaaaagctttcactaaccgggtgttagtttataattctccttacgaaccattttatttcttttatttagggctaatttactatttccgaatttctcacgcgttcatcgtccaatggaagaatttgcaaaagaaatacccaagaagcgaatatatgggcaggctcgtttaattttcatgcttgctgtaatttttcagctaataaattggtactcatgcactttgggtcccattttgaaaatttgctttatgttagaaactgaacaaaatgatcatttttttatgttttcaatgattttgacttcttttaacttgttttaatcatttttagagcaaaagtgagaattttgaaaaattttttttatataatttccgactttattcgggtccgtgatccagaatttcatctagcgcatttttacagccgatgattttgaattcatagccgtcaaaatttatttttttcgcaaaaaacgaaacctatacataacgttatattccttggaggcgaatatggatcttctcatttcactattctttcccgcgaagaaatttagaaaggaagtcctaaagaccaaaattagcgttaacctcgtaaactgttgtaccttcggtttcggttcgatgttttcagcaaaaagcatgtttcgaacgtgatagtcattgtagtaataatgcctaaaaatggaaagtgagtcccatttccatgcaattactgtcgctacttcatcgactgcatatgatgccggcactcctcaacttttctgtcaatgattcgaagatcagagatatgggcattttttgtgaactcttaacagatttagggatgtataattaaaaaaaacattgaagagcactgattcaattgattttacggtaagttttttgaacattccagaagtggatctgcaacttctctacaggaggaattggatcggatattcattaaaaatcagttgttcagtaccttcaattaacagaaaaaagaacatacgtttcttcaacacttcacggaaaacaggaatcggtatgtcccaaaattcttagattgaaatttaatatataacggaaggaaatcactcaccgaaatcccaccaatatactttcacacttctttgcaactttttgtacatgataaggacgtttctcttggcttcagactgattatgcgatatgacgggtttgacagtacgggagattattgttggcacattagacaaagtcattgccgaaaccaggaatttatattanaacaaatataaatggaaaaggaaaactaaaaaatatttaaatgtactcgtaaacacagaattttacat

SEQ ID NO: 5025 - DNA, 3348 bp, Heterodera glycines
  misc_feature (105)..(105): n is a, c, g, or t
tcagtcccgttaataattagttgcatattttgaatttttcggaaatgaattttcgaacttttgttcgaatccgggtcaggggtgtgggccgaaatagatccaganaactatttctttatttctaaaattttttttgaaaattttctttttcaaagggggggggggtaccaagtacactattacccttgttttatcccaatcttaaatagaagactacaaaaaaatttttaaatttttaatcaacttttcacaaattttgaaaaagtcccggtcccggcgggaccccggcccaaaaatcggggccgggagtcccgaaaaacccgcagtcacggacccgggatcccgtcccggtccattttgcaactcccggtcccggccatttcaaaattccggtctctagtaacaaatctgactctcaatgcccacctgtcgattcagaagctcacaatgccattgttcgatcaatttcccccatcggttattgaaaataatttcatcgggtggaatttgaatattcaattgtctgagactctaaatattcaaataaatgattttaatattacccaagttgttacctcgagaaactcctcatggtccaggtgtacatttgaaatccataatttgcgccaaaagcttcttgaaagttcaatgaggctttcgtgccccctttccgacgcaaccatattcataaaacattggggcagcactgtgtttgataattttgcgagtaaatcatcaattacgcccttaaatttctttccttaatcttttcactgacaattattatatacatgtctggtcccaattgtaatgccatggactcgggccaattctctctgctgttcaaagaaattttttctcaatgccgccgtggagaaagggaccaaacttcctgggttttaaaatgatttttgggatgtaattaacaaataccagcagaagttaataagctcgaataatgcacaggtcggaagttatactcaatggaaggacagagtcttcgcgtgacatttaaacgctaaaaaagcaacattttgtagtgaccacaataaatccgtatgtaataaactttcaaaagaaacctcgaacattatccaagaagatattgtcgtaacatcataataaaaatcaattctcttgacaaaattcattgtgtccttaacacttccaaaataaaattatttcactttagtatttgggttattttatacatttacatataatgccaagaaattataaaaatgacgtagctaacaataaacctataactagctagctacaatttgcatgtgcataaatcaacaatatttgtggatttgattacagaattaaatagttaaattgatcaaatgagcattatccttactctgattgctcgagtgcgtgatgggctgattttggctacttcaattgagggggctgatgacgtaaattttaattcattataatttttcttcagaaatgaaatttagcctgagcacaacactgtcaagtacatgacacaagcgaaaatgctgttcaaaaagttgaacagtccggggacgcctcaggcgcaatcagtcgccagtggacaatatttctttcagtgagtgcatttgttgtaatgaattccatttgaaaatatctgtcatcatttgagctacattgtcaaagacactgtgtgtacgctttgtttatgcgatcagacgctcccgagaaaggctgccttttcctatttggaggaagtcgggagtgaattcctcaaccaacacggcactcaaatcgacgctacggccaggccgtaccattttctcgaatttggtattcctttccttttaatttattgggatccatttgtttcttcagactcatatatccagaatatcaaacgaaaacatttggacaggggccgtaacggtgatcctttctttctcactttttgttagttaaaattcaaaggaatttaacagcgatggcagcggttaacagtgagcttcaggatgtgacacggattatggtctcaaacatcgaagacgtcattcatcgaggggaggcgttgaacagtgagagacttgttaataagtgaagtgtgggagcggcggttagataaaaacgaatattcctattttacactctttaactttcttggatcagaatcgcttttgccctctcccaccctcttaattcaatttgtttcactatttagtcattctaattaacaaaatttagttttggagtccagggcttccgacctttcggatctgagtaaaaagtatcgagaggacgcgagacagttgaaccgacgaacggccatcttcaaactgttcgtcggacttgcagttgctttcgccttcttcatgatcttccgctttgtctatatgtaagcaaatggtcattcgttgtcagtggtgtctcacatatcttcgcttttattttattttttttgttattgtgcggtgtcaaaatccccttctttttcacttgtctaaaaatgaaaatgtaatcattttatttattgttgtttttcattaataaatatatatctcttttatggatgaaaaaagaaaagaaattgcgtttttctttccaaaatttttgctatgattgaattattatttgtccttttgctaatttttaaatgttactttgaatctgagtcaccgatgagcacactttgcattgaactcaataaaaatgagtttttggacagcaaaattgtacgggtcgaaaaaggatggaatttgcagtttgtccgtgggattggcctctttggaaagtctgtgcggatccgaattaacgaggctgaagttgagcacgtattcgctggtgctgttacggtcgatgacttggattcccggaccaattgggtgtaccgttgtgatcagttcggagcatttcggtcctatttttttgactacgtctgtaactttgctgcttcagctatgaattcttcgatgttgagacgaatgccctctctgcggttgggaggggttttttctgcgttgtgcccgagtggcaaattgctggcgtagggaaacgactcacattgaacggactaagtgtggtcacgcacttggccaagttgatgggaccgctcagagagtggcgggatcgtctgagggtggccaaggagtccggttacaatgtcagagcgatgctttttcactaaacatctccgccccattttgaggtcattcatttgactcccgtgcagacattgggaatttcgaacagcaggtggccatcacttcccatgccataataaattaattgcccacgacatttgcggccccaactaaaataggactcatttatcgaactcctttacactgaactttatttaatctatgtattagtcattcatttaaa

SEQ ID NO: 5026 - DNA, 908 bp, Heterodera glycines
  misc_feature (802)..(802): n is a, c, g, or t
atttgtttcctatttagtcattctaattaacaaacttttgatttggagtccagggcttccgacctttcggatctgactaaaaagtatcgagaggacgcgagacagttgaaccgacgaacggccatcttcaaactgttcgtcggacttgcagttgcttttgccttcttcatgatcttccgctttgtctatatgtaagcaaatggtcattcgttgtcagtggtgtctcacatatcttcgcttttattttattttatttgttattgtgcggtgtcaaaatccccttctttttcacttgtctaaaaatgaaaatgtaatcattttatttattgttgtttttcattaataaatatatatctcttttatggatgaaaaaagaaaagaaattgcgtttttctttccaaaatttttgctacgattgaattattatttgtccttttgctaatttttaaatgttactttgaatctaagtcaccgatgagcacactttgcattgaactcaataaaaatgagtttttggacagcaaaattgtacgggtcgaaaaaggatggaatttgcagtttgtccgtgggattggcctctttggaaagtctgtgcggatccgaattaacgaggctgaagttgagcacgtattcgctggtgctgttacggtcgatgacttggattcccggaccaattgggtgtaccgttgtgatcagttcggagcatttcggtcctatttttttgactacgtctgtaactttgctgcttcagctatgaattcttcgatgttgagacgaatgccctatctgcggttgggagggngtttttctgcgttgtgcccgagtggcaaattgctggcgtagggaaacgactcacattgaacggactaagtgtggtcacgcacttggccaaagtgatgggaccgctc

SEQ ID NO: 5027 - DNA, 2352 bp, Heterodera glycines
tagtcattcatttaaaacagagcttgaaaattgctagtcagcctaccaatccttaatcggccaattgatactgtagaattatgctaattgtaagatgtcctaataatgttttatatttccatttttcatctttaccgtaatttaaaaaccaggttttggtcgctctgtcattttccacattttttccttcttccgaggcgcaaatgtcgtgccacaaatgtcggggttccattgcccattatacattttaataccctttcttaattacgcttcccccaatttccaattttagctactctatcgccgaattcgatcagctgaatccgccgattgaggctaacttttccgatttaaagcatttggtggatggaattgagcatgagtggcacatgttgactatccaggacgtggtgtggaaccacgctgcaaagaatgccaattggttgcaggtgtttgtcacttggctcataaaatgccattgttcccaaaatttgcgtccaaggaccaccctgaatgtgcctataactgtgccaattcggcccacctaagaccggcgtatgtgctggaccgggcgttgaatcagttcagcagggaaattggggaggggaaatggacgagcgaaggaattccgacggacattcgacacgacactcacctttcggtgggggggggggcattcccgtggattaatcggaaagtgccaatgggaaggctcttcggaatgctctcgcttcaaaagtgtttccctccattcgattgcacgagttttttcaagccgacgtgaaaacaatggaaaagcaattcaaagctaaaattggattaagttggtttgataattgaacaattcaaaacttacagttgagacaaataaacggccaattaattaactttcctcagcagaaacccctgagaatggcaacacaggcggcgattccatcgaattaatcgctgacccaaactttcgtcgtttcggatgctccgttaatttgacccaggccgtgcaacttttcgcaacaaaagagtgggacttctttctttctgtttttcgctgattccgtttttccattggtcagtgctgacattggcgaaagcattggccaattcgttgctcatttgaatcggctgaatgaggacgcccgacggaccgttgagggacacattttgaaggcaatcgaagcgatcattggccacgtgcactacgaagtgggggacagacagcagcaggagtttgctccgttcacaacaaatttcagagagtggcagcaaatgggccgcgaaaagaagcagtgacactcagtgaaccgctggtcacaaagtgatcggatgcctttcccggggaacgaatggcctttcccccaaatgtttcagctatttttaccatccttccgaattcggtctcaacgcgtgggaggaggacgaaaagttcgccttcgatccttcgacttccgcccggctgatggcctgcaacggttgggtgatgaacgcggacccaatgtccaacttcgcggagtggccaagccaagtttaccttcgtcgcgagttggtctgctggggcgacagtgtgaagctgaactacggccaacagcccgccgactgtccattcctttgggaatatatgcgccgctacacggagaaatgtgcgcggattttccatgggtttcgcattgacaattgccacagtacgcccattcacgtggcggagtatttgctgcacgcggcgcgcaaagtgcgcaaggacctttatgtagtggccgaactgttcaccggcagcgaacagttggacaatttgttcgtaaatcgactcggaattacctcactgatcagaggtggtcaaaaaagcacccaaaacggatcaaaatgaaagtttagaggctcagaatgcgcatgacagtcatgaacaggtgcgttcggcgtgggttaatgggaaatggcaaagcgtgcttcttcaagggtcgctttgtttaccgctacgggggcgacccggtcggtgcctttcgctgtaaggcaacgcgccccgccccgtgggcggtggcccatgcgcttctttacgaccaaacgcacgacaacccatccccggcgcaggtgccgtctcttcgcccctaatctctctcttttccggccttttgtagaaacggacgccctatgactttgtgccgactgcggcgatgtgttcgatcagcggaagtgcgtgtgggacggtgcgtgggtacgacgaatttgtggcgcacaatatcgacgtggtcaaagagcagcgaatgtaccgcaagtggtcggagttcggggaaaaggcaaaggaatggtgacggcacgacgccttctcaacgtcactcgtttaccctttggcactttggc

SEQ ID NO: 5028 - DNA, 4832 bp, Heterodera glycines
ctttcataaatttaatgaatggtttatattcgttcatagtaatttttgtaggtagagaaataaattcttcgctctgtggacttcgctttaggataaagtatttatcaaccaaaatttctaattccgtggtagcatgagttgggtttatttttattccaccttttgtacattcagcggatatttgttcgttttcgaacggatcgaattctctttttttacgtttgagttcatccattaatgtgtcattagccaaataaaaaattctttcgatgcttccccatgcttttattgggataatttctcggtctgatttcacaagataagttttttcgtgtggctcgtaaaagcaaaattttgttccatgtgtgtcagtgcattcgtgttcttgacagaatttttgtgtaccaatcgtcagattgccctccccaaggcaacgataatcaattcgagaattggcttgtgtatgaagtaaattaagacttttgactgaatgaatgctattatcataaagcattattgaactaaatatatttttatccattagggagcatttttccgttttattgaatgaacaaacgtttggtttaaagaatgaaataattttttgaatgttttcctgatcagttatttctctttttattctgtgatatgaggcaaaactacaagaattagtccaatcaggacatttgcattgtggtccacaatagggtgggtgattttttatgacgtgttgtttgtgacaaaatattttacaataacaaaattccattgttaatttattttgtttgatagtaaatccattttcaacacaaaatgttgtatacttcgttctccatttttcattggtttttggacattcatataaatgggataagcatggtaagagttgcataaataatagaagaaacgtgagtgtgtttaaaaatactttgcttaattttggggatgataggacactttgttttctctttcgatttgtaccaatttgtttgtgttcagtggtttttattaagtttgtgatagtctcattctcttcacagtcaattttgttaatctctaacggatatagtaattttaatggacggttaatgacatgtttgcttggtagttcaatattagcacctcttatgataccgtcttttccttttatgacatttttaataattcctgttttccacattgctcttggtgtctcatcgtgaattatgacaacttcatttggttctggaaaagattttacacaattctttgggtttttattttctgttttgtatctttctctcagactcggcaaatattcttctgtccaaattttccaatagtcatccaagatttttgttgtctttttccataactctattgtttggtcataataagttggttttggtaagtaggttggatcattagtttcgtcttccaaaattggaggaatacataaatttttgtgtgggagtataaaatcgattggtctaagaatttggtacgaattaatttcgtcataaatgaatgtaattggtcgtgaatttactaaggcttcgatttcacaaataagagtttgaaatgaatcaaattctatcaatttccttccgattgcttttttcattgctgattttacattttgatttaaccgttctattgctccgttttgccaaggggctaattcaattgaaaaaatccattttatgttttccttttcgaaatagtttttaattgagtcgtctttaagtatgtcctttaattttaggacttcaggtaatacttttgatgcaagttttaattgtgatgcattgtcactccaaatattcttcggtgtcccttttcttgaaataaatctgcgaaatgcattgagaaagtgttgaactgataatgatgtcactaattcgaggtgtatcccacgtgtggagaaacatgtgaaaagtattatccaacatttttcagtgaaacttttaatttgaagtggacccatgtaatcaaggccaacgttttgaaaaggctcagttatttgaactcttgattttggcaattgcggcatttttggttgctgatatggttttgcgttatatcttttgcaatagaaacattgttttctgatttggtcaacaattcttcttcctttgggaatccaataagttttacgaatttctgctaatgttgtcattgtaccagcgtgtaaatttcttcgatgatggtccataataattaaatgagtaccaaaatgtgttcttggtaagaatattggatttgtcgcttttatctgtgcattttttaatcttcctccgcatttcaaaatttcatcattgtctctgtaaattcccaattgtctctcttcctcattatttggttccatttctttctgaattatgcgtattagcattttttgtgccatgaattttaagctcaattcgttttgaaatttctgtattttgaatttagttttgaattcgggagagtcttttaatgtaaaaaatacaaattttaataagatttgacaaattcttgtcactttatcccatgaattgtattttttccattcaataaatccttggtagtccattttgactaaatttgtctgagtgttttcgatttccattatgttatcatcataaagtgaatcattttgctcaggagtatagaaactgtgggctggccagttttcttttcctaatttaagccattttggtcccttccaccataattcgttgtatttcatttcattcattgttgtacctcttgatgccaaatcagctgggttgtctgttgattttacgtaatagaaagtgatgtgaaattctgagacaatttgttttatttcttccactctgttttttacaaatattggtaaattctttttacactttaaccagctgagtacacattttgaatcgcaccagatacatatcgtttcaaatttcaattttgattctttaatgataaatttgacggctcttgctgctattaatagtcccaatagttcaagctttgggattgttaggcctttgagtggggtaagcctcgttttcgcgaataataagtcagttttattatttgcgtgtaaatatgcggcagtggcgtaggctaattcagaagcgtcagaaaaaaggtgtaaagaagcacattttaaattttgacttgtaaatggtgagcgtggtatggaaacttcgtctatatttgaaatattgttccactctcttatttcttcatcatttaatttatcgtcccagtctttgtttgatctccatagtttttggaaaaatagtttgtatttgagtattactggtgatatccaacccattgggtcgaaattttttgcgatcattgtcaaaatttgtctttttgtcgtgtctctactcattagcggtatttttatttgaagttcgagttcatctgtgtcgacattccattttatacccaacatttttgtcattttgggtatttcagatccttctaatttttgaatctctttgttactttgttcatgattagacacgaattctctcaaattcattgatgctaatttgaatatttctttgctccagtaatgtttgaattttatttccttttcgtcgtcacacatcattacaaaattgtcgacgtatgcattttctttaagttctgtgcatagctctttgaattgtttctcttttccactaatacataattcctcatctatttgtaatgttttaaacttttcaaacatttcatctgtttttgataaatgaagattcacaacagcagttaataaaaacggagaagcattgactccgaagggtattcgtgtgaaacgtcttaattctacgtctctcatttcgatttctcgatatttttggtttatttcgtccaaatatgactgatttacccatagaaagcgtgttgtgtctctgtctatttcatttaatccaactcttagaaaagctttttctaagtcgcctattaagacgaaatttttgagtctgaatcggagaatcattccacacaaatcaggtaataattttggtccttggtgaatttcgtcattgagggaattgcttcctcttaattttgccgaagcatcaaaaactggtcgaatttttgtggtatttgaactctcttttataacggggtgatgtgggagatagtgaattaaatttttggatttgaaatcagcaatttcattaacgttagtgtccatttgctcttgcagtattttattataattttccaactgtttgtttttaatcaattgtttgactacatttcttaatcttcccaaacataatccaaaatttgtaggtaaattcggtgtttctcttttgtatggccatcggatgtagtatctattttcttcaaaaatgacatttttgtcaaagtgtatgagagctgtatcttcgtccgtcaaatgtggagagtcggtaattccaatattttctaattcccagaatttttgaaggatttcgtttgtctcatccttttttcgcttttctttcacaagattaatattttgtcttcaatagtaccttttccggataatatttttcctaattttgtatcgattgaaaaaaattcggagggaagtatttgaatttgtgagtttggcaacgtaaagtgccaatagtggtcgataccaattaaaatttgtggacaagcatggttaatcggtattttgctcttgcgtatatcaacagtctctctgttgaccattttagtaacatcagtaattttttccacagtctgtaatgttacgtattcgatttcaccgtttagtgtgttgatgccaattttgactagtctcgatgaaatgattttgggtttattttggcttgcaggcggacatagcgaatcatttttcttcgatt

SEQ ID NO: 5029 - DNA, 1468 bp, Heterodera glycines
gtttactttcaaatggagtccgttggtaaacgtttgatcgtccggtatttttcagaaaagtggcgacgtgctttcgaacgatcggttgttgtggtccggtagaggcggacgtgcaaatgttacgcgatcgtggcaccacttgtactcttttgatgtcgcacaaatgggaggggtagggaatttgacgagatgtgggggtgctgatgagttcagtggttggtagaggtccggcgctgcttggtggtgctgggctttgatttgtggacgagtagtgcgagtcggcgggatgggggcggctggcgcaatggtgaccaggagagggactggttgtggcgaaattttggggtggacgcttggcggtcaatcgggaatggtggaattgctgggggtcaagtgaggcgggaaagtgtaacaaattgcactttattgaatcctcaaacttgggtaattaaaccgaagggggaaatgggggaacggcacaaaatgggggaacggcacaaaatgggggacggcacagaaatggggacggcacagaaatggggacggcacaatggggggaaaatgggggacagcacaaatgggggacggcacagaaatggggacggcacaatggggaaaatgggggacggcacaatgaggaaatgtggggacggcacaaaaatgtggacggcacaaaatgagatacggcacaaaaatggggacggcacaaaatgggggaaaatgggggacggcacaagtcggggaaagatggggcatccggcacaacacgtcggcgacacggcacggcatcggtggtgcggggcggcggcacggaatgggcatggcacagaacggtcggcgcacgggtcggcttggcactgaacgggcggcgcacggttcggcatggcactgaacgggcggcgcacggttcggcacagcagtcggcggcacgaacgggcaggcggagcagttgtcggcacggggggaaagggaaggaagggaaaggaggacgaggcattggcctctcaggaaacagttggtgtactgattggtggggggttagtgccctccttttataccggcaacttctgcttgaaaatgtgtttgccaacctggcatgtccaattttctgtccctaacatttgccaattctactaaccttttctcattttccagtttgtgccactttagcctttcccaattctctaacattttacaatttcttaaatatcattcacaatttgtcccattttaacatttggtttaaaatctgttatttcttttaacgttccgattattcataattaaattttaacatttgacaatttttctgaaagaaaaaattgtgactaatatgactaatgttttttccttctctcattccttcatttcgttcacatttaattaattaatatttatctgtctaatttaaaattaatttaaatattttttgggtttaatgttttttattttttaaattaattttccg

SEQ ID NO: 5030 - DNA, 5327 bp, Heterodera glycines
  misc_feature (5316)..(5316): n is a, c, g, or t
tgtgcagatgttcgcagtgaactcatttagaggccgttccccatagtacgcgaaccatccagcgtttggaatttgcttcgcgagaagctcggccaaattgtctcccacgacaacggtttccttcaggacataataggcatttggccaaaatgccttggcacgaattgctgtcaacgcctgtccaaagcgttttgtgagttccgtgagccagctttcccatccgagggatggctcttctccgattgctcttcgattgaccagaatttctttcaattcaactggttcataagtccgttccttccactcttcagcgaagacgctgcatgatttcatccaaatatgcaagacttcttccaagtggcgattttgcattggcttgttttgatgctgaaagtagataatattcccaatcaaattatcgattgatttttgatcgattatttgattgggttccacttttttttctgacatcctcttccacaaacccaaacctattggatggtctcttagggagagagtacattctatgttttctctggcaaatgaaatggattttaattttaatttaattttgatttatcaatcgatatttttattaaaggttctcccagtaagggtatgaatgtacccaaataatcgctatacccatgcattttgcaagtatcgtatccaaaactttaaataaattagcaaaaaacctttgcacccggctggactcgaacccatatcaaattgctgcactaaccaattggccattttatgcctttggcaaagcaagattcaattcattaaattgtaaaaaaaatgacgtcatcatggaaagtaaaaagactccgccccttttcttgttggtcacgcccattgatttttgtttgctttgctaagaagttgactccgccttttttccttttagtttcttttgtcccgccccatttttttttgctatttaatcacagtttttctacataaaaatcattcgtccatttaaaaaaaattccatccacattcgttttttctgttcttcctgcaatgaattctcttaaacgctttcaactcccggagcaagggacacgacagcaaaaggagttggattccgttgaaccgaaacacatcagcgatgtggtcaacttcaattcggccggcgttttttatgttttgggaaaagtgacaaatatgcagtaccgtgtttacaaagtccaaattaaattaattaattattaattttttctagtctaggcatgcccattccgttccaaggggctcatttgccgccgaaaattgtccgatgataacatgtgtgaggcttgcggccaaaaagcgattgctcccatccacacggtgtttgtccgccttctgctgcaggatgttgaacaagcagacattgctcaacgtgtcaccatgttttcgagtgttgccgaagagttttttggaatgaaagctgctgaattgctcgccaaggagaaggagccggagagccttgcgaaacatttggacgatttgattgctgtgaagctgatcgcaaaagttaacattaaggttttttttgctatttattatgtatttgacaaaccacgacctaggcgaacaatcagacgtacactggatttgattggattgtcaaccttttcaagaagtgcccagggaatgatgacagtgatgtgccaaaagaaaaaaatgatgttgatgagattgcaaccaagaagtccaagaaaaattgatagagagagagagagaaagagaaaaatgattcatttgttgtgagcttttaaaaaaaaggattgagcatgttctttacttttttttaaaaatccattaaaaatgcattttattgttgaagatgatgagacacaaactccaaaatggtcttgatgtgattgcaattttgttttttcttcgtgaattcaccatgagacaggattgcacgttgacaatttttcgtaatgagcacagagagatttgcagttggctctatccgagtggtggatcgtcaactctcctcataacaatccaattaacgttgttggaaaagcttggcccatacgcgtttgtcacgtaaccctaatttttcaaaagaaggaaaagcactcctaaatttagttttgatcttcattaaggctgaaaggggatcatgtgaaaaaaagaatatttgtgcgttaatcatttctttattgataaacttggaaaaataattgatgaattttttggtaattggtaatttcgcaaatcatccatcatctcattggcatcacactgagaaatatgtcctcttctcttgagaaaatttatcaaagaataccagcataaaatgaaaacgggaaaagcaatgagatagtgggcaagcaatagaagttgtatgaggaagttaggatggtagcttttgttttcaaatgttagtacttgtatctctggctttaaactggcgttgactgtagtgtttattaattcattctccaattaattcattctccaattaattcataaattatcacgtgacaaattcctttacaattttcgtaatgcactgaaaaaatttcctaattttccacagttcatcaaagttcgcagggatatgacccaaagcgaactcaaaattttgtactccctgcggcaacaagcctatcaggccaatactgccgcaggtgagtacaaatattttgtggtcgatttggagatcaaatctctgaaaaccccccgcccgctcagaactcgctagggatacgcgagcaaaccaaacaaaaaaattaggaataagggagaaaaaagtccctgggtttcctgcctattaataaatgcccgatcaatttcaaataaaatatctgatttagaacatatagcacaaaagtatgatccatcaatattcatcatcaatgagacctggttaaaccccagaaatacaattgaaaatgaactatctataaatggtagatatagagtaatgcttgcgaaccgaaatgagaaaaagggcggtggatcagcaattctaactaaaacaaatattccttatcagacactattctctgggacaaaattccaaagcgaaattttacacattaaattactttttaaaaaaccaatccaaatcataaatatatatcgtccaccgaattgtacagttcagaatactaaaaagctactcaaatttatttcggaccagagtaattctgaaaatatcatatattgtggggattttaacaccccaaatatttatgggatgaaaataaggtaattcaaagaaatgaccctgtgtcaaatttattgattgagtttattgaccaaaaacaattgaaacagcatgtcaaacaaccaacaagaaaaaaagctattttagatttagtaattactagtgaatcagaaataattaatgatttaacagtatttgaaaatttttcaacttccgatcacaaaatggtcggattcaaaataaagggaaaatttagtcgtaataatcacagagtttatagaagagattttaaaaatattaattttgcaaaattaaatctagcgatacttgaaaatcgaattgatttagcaataaactcagtatacaccgttgaacaaaaatataaagaattcttaaataaagtaatgaaattatatgatacgtttatacccaacagatctctaaaatcgataataaagcaatcatatcctcaaaaaaataaaagatttattttcagagaaattacggttacataagcttgtaaaaaagtttcccgataaaagtgagattattttaaattacaaaataatttcaagggaaatgaaaaaacaattgaaccaatttagaaatgaaaaagagtcaaaaattatttcccaagggcaaaactcagttaacaaatttattcgaaataaattatcaaaaaattatgaaattcctactttaatcgatagtgctggaaatatgtattccagtaatgagcaaaaatgcaaagtattagcagaaacatttcaaaaatcatttttagaaaattcaattgttaatggtccattaactcaatcagcacagaataaaattaaactttttgacattgaattgaatgcggaataatttggaatatattaagaaagctccccaggcgaaattccacttcaccggataatgttccttacattttattaaaaaattgtgcagagccaattaccaaaatattagctgatatatttagattgattttggtaaaaacgatggacgatatatataattcgatacaaatgaatcagcaaattgacatcatctatattgattttgtcaaggcgtttgattctgttccaattgatttattacttcaaaaaatcaaaaagattggaattgaaggaaaaattcaaaattttttaactaactttttaaaaaatcggagttttaaagttaaattggcgaagaattgtcagaaagtttcaaaatattttcaggagtgccccagggaagtgtcttagggccattactctttttaatttttataaatgatcggccgtcctttattacaaatgaagctgcatcagttggcataaaaatgtatgccgatgatgttaacttatattatgcccatgaaaatgatgaccattcgaatcagttggataaagaaattgaggctttggaaaaatggtcaaaaataaatgggttagaaatttcaactgaaaaatgttttgttttatatttagggaaaaataatatgaaaaaagaatattttattaactcacaaagaatttcagaatcggataatgttcgtgacttgggaattataattgactcgaaactgaatttttcagaacatattaaaaaaatgtacgaaatgcatatcttagaattttccaaatttcgagagtgttgaaaagcagggaaataaaaactctatatgctacagaagtttggaaccctaacttaaaaaaagacatagataaaattgaacgtgttcaaaaattttttacaagaaaagcacttagaaaatgtggttttgtgtacaaaaaatatggggaaagactaaaaatcacgggtttacacaaattggaagaaagaagaaaaatcaatgatttaacaacagcttttaaaataatcaaagggttcaccagcctcgatgctgggaaaagtttctttttctcagaaaggctcaggaggcctttacttttacgggtaaagcgccacacggccaaaactcaaaataattttttcaatagaatagtaaaaaactggaataatcttccagtggtagcggtacaaattaataaggcaaaggaattcagggatttactaaaagcaatgagttctgagtagggttttccatgttgccatatttacactatatttttatcacctgtganatttttaacat

SEQ ID NO: 5031 - DNA, 919 bp, Heterodera glycines
cagcggatgcagggacgtggcgcattccccacggcatgtgtgccgccacggtcaatgcaccgctgccgcttccatcgcttccgcttgagaaagcaaccggcaactgtaaattttaaaaaattgaatttgtgaaaaacacaaaaatgaatgaggccaaaaaacttagcacaaattaccggaccaaccggcagcccaaacactcacattgttgttgttgttgtccaaaaacggcattggcatgacagcaacggcagcagaagtcgagttgcttcccagcggcatttgttggagaactgtgccggcactcgttgagccgagctgaaattgaaaaattaaattttttgtacaaatccgcttgagcaaagcgcagaggagggggggaggttaattaaaccctcaattgtttgataagcgactccgaaaacccgaccccaaatccacaaaaaaacttgccgaattgtcgctgctgaccatctgcggcatcagcagcatgtccaagtccagcgctgaagtgccgttgcggcggctgttgttgcttttgttgccaccgaaagccgaccagtcatcaccaccgccgctgccactttgactgctcgtcgcgcctcgattggcgccactggtgttgctcgtgctgctctgccgtgcccttttccgcccaatgtcgctctccttcaaaaaaaggaggaagggaaaaattaaaaataaatgaaaaatttcaatttttaaacttgccggcacgtcgccgttagcattgcgagagcggcgtggcggcggtttgcgcacaactcgcccgttgtcattcccgtcgttctgttgctgttgctcgccgttgaacattttgtgaatttcgtgctgaaattttaaaaaattaaaaccaaattccaatagaaatgcagtgaaataatggaggcgggggggg

SEQ ID NO: 5032 - DNA, 2237 bp, Heterodera glycines
tgccgaaaaacttcagaatggcccgaccaaaacacaatacgaacatgtatgcatatgcattttaatttgtcaatggctgacgcgccatatgaagaatcgaaatgatttttggcatcatgcatgaaatggtgcaggaaatggcgtaattattaaattttttaaatattcctcatgaaatgtatttcgactaaataagtaacagcccacttgaatcactttattgtagaaagaagctcaataaaatccatttgcagatgccagggggagaaatgtaaaaaagaaaggcttttaagcgtcgtgctggaaaattggaaagtacaaaaaaactaattttaattttatcacttatttttgcctaaagaagctaacgtgccaattttatcgacaggaattttaagggatgccgaaaaacttcagaatggcccgaccaaaactctatacgaacatgtatgcatatgcattttaatttgtcaatggctgacgcgccatatgaagaatcgaaatgatttttggcatcatgcatgaaatggtgaaggaaatggcgtaattattaaattttttaaatattcctcatgaaatgtatttcgactaaataagtaacagcccacttgaatcactttattgtagaaagaagctcaataaaagccatttgcagatgccagggggagaaatgtaaaaaagaaaggcttttaagcgtcgtgctggaaaattggaaagtacaaaaaaactaattttaattttatcacttatttttgcctaaagaagctaacgtgccaattttactcgacaggaattttaagggatgccgaaaaacttcagaatggcccgaccaaaacacaatacgaacatgtatgcatatgcattttaatttgtcaagggctgacgcgccatatgaagaatcgaaatgatttttggcatcatgcatgaaatggtgcaggaaatggcgtaattattaaattttttaaatattcctcatgaaatgtatttcgactaaataagtaacagcccacttgaatcactttattgtagaaagaagctcaataaaagccatttgcagatgccagggggagaaatgtaaaaaagaaaggcttttaagcgtcgtgctggaaaattggaaagtacaaaaaaactaattttaattttatcacttatttttgcctaaagaagctaacgtgccaattttactcgacaggaattttaagggatgccgaaaaacttcagaatggcccgaccaaaacacaatacgaacatgtatgcatatgcattttaatttgtcaatggctgacgcgccatatgaagaatcgaaatgatttttggcatcatgcatgaaatggtgcaggaaatggcgtaattattaaattttttaaatattcctcatgaaatgtatttcgactaaataagtaacagcccacttgaatcactttattgtagaaagaagctcaataaaagccatttgcagatgccagggggagaaatgtaaaaaagaaaggcttttaagcgtcgtgctggaaaattggaaagtacaaaaaaactaattttaattttatcacttatttttgcctaaagaagctaacgtgccaattttactcgacaggaattttaagggatgccgaaaaacttcagaatggcccgaccaaaacacaatacgaacatgtatgcatatgcattttaatttgtcaatggctgacgcgccatatgaagaatcgaaatgatttttggcatcatgcatgaaatggtgcaggaaatggcgtaattattaaattttttaaatattcctcatgaaatgtatttcgactaaataagtaacagcccacttgaatcactttattgtagaaagaagctcaataaaagccatttgcagatgccagggggagaaatgtaaaaaagaaaggcttttaagcgtcgtgctggaaaattggaaagtacaaaaaaactaattttaattttatcacttatttttgcctaaagaagctaacgtgccaattttactcgacaggaattttaagggatgccgaaaaaattcagaatggcccgaccaaaacactatacgaacatgtatgcatatgcattttaatttgtcaagggctgacgcgccatatgaagaatcgaaatgatttttggcatcatgcatgaaatggtgcaggaaatggcgcaaaagtaaaaattttttaaatattcctcatgaaatgtattttagtaggaataagtaacagcccacttgaatcactttattgtag

SEQ ID NO: 5033 - DNA, 1207 bp, Heterodera glycines
aatattcatcatgaaatggtatttcgactaaataagtaaccgctcacttgaatcactttattgtagaaagaagctcaataaaagccatttgcagatgccagggggagaaatgtaaaaaagaaaggcttttaagcgtcgtgctggaaaattggaaagtacaaaaaaactaattttaattttatcacttatttttgcctaaagaagctaacgtgccaattttactcgacaggaattttaagggatgccgaaaaacttcagaatggcccgatcaaaacactatacgaacatgtatgcatatgcattttaatttgtcaatggctgacgcgccatatgaagaatcgaaatgatttttggcatcatgcatgaaatggtgcaggaaatggcgcaattattaaattttttaaatattcctcatgaaatgtatttcgactaaataagtaacagcccacttgaatcactttattgtagaaagaagctcaataaaagccatttgcagatgccagggggagaaatgtaaaaaagaaaggcttttaagcgtcgtgctggaaaattggaaagtacaaaaaaactaattttaattttatcacttatttttgcctaaagaagctaacgtgccaattttactcgacaggaattttaagggatgccgaaaaacttcagaatggcccgatcaaaacactatacgaacatgtatgcatatgcattttaatttgtcaatggctgacgcgccatatgaagaatcgaaatgatttttggcatcatgcatgaaatggtgcaggaaatggcgcaattattaaattttttaaatattcctcatgaaatgtatttcgactaaataagtaacagcccacttgaatcactttattgtagaaagaagctcaataaaagccatttgcagatgccagggggagaaatgtaaaaaagaaaggcttttaagcgtcgtgctggaaaattggaaagtacaaaaaaactaattttaattttatcacttatttttgcctaaagaagctaacgtgccaattttactcgacaggaattttaagggatgccgaaaaacttcagaatggcccgaccaaaacactatacgaacatgtatgcatatgcattttaatttgtcaagggctgacgcgccatatgaagaatcgaaatgatttttggcatcatgcatgatacggtgcaggaaatggcggattataaaaatttttta

SEQ ID NO: 5034 - DNA, 3430 bp, Heterodera glycines
ttacctatcattttgtcactgatcgtttcgtcactgttcagttcgtcactgatcatttcgtcactgagaaataatttttaaaaaatgttggcaaatgtcattatgtaaattattttcattaaataaaatattttttatttcagaaaaggttattaaataattatgttgaaactaaaatctgcatttaatgatttttttacatatattttttaaaattgtttgttacatgcgatggaaaatatgcacaaaaagagttcgaattgaccgatacattttgatttgggataatggatcgttatcttaaatctacacatttgttgtttacttttaccaaccttccaacgaattggacgggttcttggttgagtttgtcgtcgattaactttctgatgagcgcaattgtccctgttcagttgaaattgaacccacgatccattttaagactttttttgggactaaccataggataccatccatacaatttttcgaattttatgcatcctgtagatcagcgacctcaaaaaccccataaaacttagtttcattaatttcaaaaacgtgcctttgaatcgttgagcagctcggctgccataatgcacgtcaaatcggcccacgggcgaggccgtaatgacgcggaggcggaaattgttgatcagcgtgacgtgtgcttgaaggagctcaatgaacgctatcggaccttttttagctgattttggttttgaaaatttgtttgaaatcatttacatttgggagtaatttaaataaaaatttaaatggagcattttcattcatgtaataatagttaaatttttgtttaattaattaattaattgtaatcggaaaggttttaattatcaataaattttaaaagttaaaaaagcactaaacactaattaattacattgtttaataaattgattaattagttgatttttttcatatttggccatacaaaagagcacatgcaaagaaaatctttattttacaatgataaaacgattacggaataattagattcaaatttgaatttattaaataatgtatacaattggattagtaaataattagagataagcgcatacaatttgaattaataagtaattagagataattgcttacaatttgtatgtctgtctaaatgattaaatagcaatttaaattactaagtaattagagaattaacagtaccagcacacgttttgtaatctgcacagtcatattgcacgaaagggttcactggctgttctgtgtttggtagagatgcgccgtgactgaaaaaacccgtgaaccgtgaatcgtgaccgtgaccgtgaattgaccccgtgaaccgtgaccgtgatcgtgaattggtaccgtgaaccgtgaccgtgatcgtgaattggtaccgtgaatcgtgaccgtgatccaaaaaacccgtaaaattcacggttttcgtgaccgtgaccgtgaattttttgagttaaattttttcctgtcggcgaattttttgtttttacactgtttttttttgtggtaaaattttccaaaaatttggaaatagggtgtccagcaggggcgtcgaatttttaaaaatttgagtgcaatatgtgcacagattttgtataaaaatggcaaattttgcgaatttgccaaattttaatgaaaaggataaatttttggagtcaggcggtgcctgtaaccgccgccggaggaaaaatctaaaatttgattgcaatttgttaacagatttgtccacaaaaatgaccaaattttgtgattttgagcaaatttttaagaacataaaagatttttatggtcaggcggtgccgacaggcgccgctgggggaaaaattgagaattttgaccatatttttagcatattttcattaaaaaattctttattttgcgggttttctcaaaaaccacaaaaagcctcaaaatttctcaaaaaaccacaaaaagcctcaaagcctcatttggaaaatctagcctcattgacctatgaaaaaaccaccaaatgaggctaaagcctcagatctgcctgccctggttatagtggaaaatttttgtaaatttgttgggatttgggatttgttaactgattttgcccaaaatagatttatttcgagcgagttttttaaagaaatgttgattttgttcaaaaagtttcaggaatagagattgggccggcggtgccgataggcgccgccggggaaatttttgaaaattttgctctgtttcttagcaaaaatttcccaaaaaaggaccaaatttctttatgaaacaatatgtaattcgtaaatttcaattttatccagtgtaaatttttcacggaataaacgtgaattggtaccgtgaatcgtgaccgtgaccgtgagtgaaaaaacccgtgaaattcacggtaaccgtgaccgtgattcacggcgcatctctagtgtttggcataaaaaaattattgtttcttatcatcaattcctctgcatcccacattatgagcaatcttatcagcttcacccattacaaatgtcggatccccacgttacaaatcctcccaaatttcatttggcccccaaatgccgagttcctaaatctcgttttgcccccaaatgccgagtttccaaatctcgttttgcccccaaatgccgagtttccaaatctcgttttgcccccaaatgccgagatgttggagtccctatgtcggatcggagtctccaagtttcgggatgtccaattgttgggtcccaagtcataaatccctaaatgtcgttttgcccccaaatgcctacaaaaactttatcccaccaaaactaattgatgtattatctgactaattaatgtacccaattgaaagggggatttgatcaattgtagatatcaatcaaatcacaccttgtattcggcccttgaaatatttttcataaaaattcgcatttgacttttcttcgccttcttttccaaaacggcactcacagtacacagcgggcaattgtgttgcatttttcagtttaacttctatatcattacaaatgttgaccttgtcaattgcgtgcatacagtccaattggattacattttgtctacctaaaatgtctcggaaaatgatcaaaatacgtacaatttcttggggttttcttaggctcccggacaatccgtcagtggacaataatccgtcagtaagtagacaatccgtcaatggacaatccctcataatgatttgtgttattttataaaaattatgatccaccatccgcgaccgagggtttttctgtccgcgccccacccctggtgccaacttgacaataacttgaaaaagcatttattttccataatatttatggggaaaatatttgataaaaatttcaaccccatttgatcataaggcttataaaaaattatacgttaaaaactattttttattcgacaaaatgataatcagggcacggatttaaaa

SEQ ID NO: 5035 - DNA, 1488 bp, Heterodera glycines
  misc_feature (8)..(8): n is a, c, g, or t
  misc_feature (33)..(33): n is a, c, g, or t
gtaccatncggtgagctgcatcctatgcataancacatggtcatgtctggagcaccgcaataatttccaagattcacactagggtgacggatgttgtcagggtccaacgtctgtttgaacttcatcgaatttgtttccaaaaactctccgcaactgaaagcgccactaaaattttacaaaaaattgaaaatgttttttttttcatacggtaaaagtatgtacagaattttttattaattttattttaatttttgatttttcacttagtcttacgttgaaagcacagagttggcgaggaaaagaaggacggtgaagaaattcattgttttaaatttaatgaaaattttttttaatagtgaatatcgcctggccaaaaagttgagaagttatttttgtggtataggcaaaagccaaatgaatgcacgaatagaagcagcactttgctgatcagaggtgattcagagaaattttatccattttcattaatatttattctcccattaacaatctgtccatcaattgccctataaattaattcactttttaatgctaaaagtgatgattaattgttcatttatttatccaaagtatttttcctggcaaaaatataattcggaaataggaaaaaaaaatcattaacaattcaagcagcaatttgggtgttaaaaagagaatgaaaatgatggttatgctaaaaaaagaataaataaatgttttattgataaaaaattattttgtttcaaaaataatttttcgtatatttttttactgaaagatcggcttgaatccgattcatttaaaaataaataaataaataaaatcgtctcttttaattgttaaacttaaaaaaaaaattctttttttttcaaatacaagatcctgtttttgtcattcaatttccgtgtgcaaaaagattattcctctatgttgtgaatctgtgtatggcggaaataactcgcgagcagaaagtataatccggtccatacggtataaggaacggtacagtaacaagccacttcatcaatattgtagaaagctaaggctgtagctacagctgtgcagctgatgtaggtgtagaccaaaatctaaaagttttttcgtactgatgaaaaaaaataaattaccgtattttttctaattatatgcccgggtatattatttttaaacctcctcagaaagggggagatgattgcagacgagtagattaagacggagtgattatcttttcaacctccgtagaaagggggagataattggagacgaggagattaatggagacgggcatataattagagaaaatacggtacctaactatgctgtaaaggaattcgacctcaaacgttccaatctttttcgagttgaacgtggtcgcgagacaggtgaacatgttcagtccgaaatagccaagagcccaggcagtgtctgtatttgcgaagcctaaagcagcacgggagaatggtgttatgatgtcaattcttggtttaagaa

SEQ ID NO: 5036 - DNA, 4184 bp, Heterodera glycines
gacatttgcggcgccgacatttgcggcgccgacagattcggcgcccagtcaaaaggacatttgcggcgccgacacttgcggcgccgacagatgcggcgcccagtcaaaaggacattttcggcgccgacacttgcggcgccgacagatgcggcgcccagtcaaaaggacatttgcggcgccgacacttgcggcgcccaatcaaaaatgacatttgcggcgcagaattaaatgaccccaaaaatatttcaacaatttatttaagttaacagaattgttattttaattttattttttaataatgactaatttaacaattgcatcctacccacaaagataaaggttgagtcgtttgccgttgtaacatattcagaaaacgattcacttcgccccacccagcattttcagagtataaattggatactgtaataaaaatatttttataaggttcattatcgccttaaaaagaggaagagcaccaacaaaactgcctgaggccttatgggattgactcaactcgtgggattactgaagggcctcgcttaaaaaatatctgcgaaatgatgaagcgatccgtagattagttatcgattttgacaataagtaaaacaaaaagattatgatataattaatagagcccggtaaaaaaattgtcgggagcgggttcgggagttcaaaattttccgggacgggagtcccgaacggtaatcccgtaaaatcccgctggagtcccggtcccgccgggctctaataattaatcaaattgcagtaccgcctagggatgaaaagctttgaagaataggactaaaagagtgattaaacaaatgtttttaaatcaaaaaaattgttcaaataatttttggggtcatttaattctgcgccgcaaatgtcattgtgactgggcgccgcaagtgtcggcgccgcaaaagtccttttgactgggcgccgcatctgtcggctccgcaagtgtcgtcgccgcaagtgtcggcgccgcaagtgtcacgccgcaaatgtcggggccgcaagtgtcgctttgactgggcgccgcaaatgtctgcgccgcatgtgtcagcgccgcaaatgtcggccaatcgtttctacggcgcaaaagtcggcacatcttatgatgttagacaaaaactatcaaaaagggcgttaattgctttaacctcctccgtttttatagacaagatgggcggcataaccgaatggaacagcaagaattagatcaatggctgtgaagatgcgcgggtccatccacttaagagatgcacttccccaataattagggatttttgtacatatttaataaaaatttgtatatttttttatactaaatatctatttcgtggtttttcttatctaaaatttagatctctattgatcacagttaagacattttgtttttgttttggaatgcattggcattttgttaattaagtcaatgattttttggcgattttttttactgtccatgaaagggcgggcctccgcgacaaaaagtccgtaccaaaacgggcgtttcgtatacagtaatctcaccttactgctaaaggcctcaagatcgcgtcgatggctggatgacatgacaaaagccggtaagactggcaaaagtgaggaaacaattgcgttggttgtattccagaagaaagacattttagtagacacactttttgggaagttttaattttatttaataaactaaaaataatataactatatgaaaattccgacttttcgaattttttgttcaaaatcgagtcagggatttggaattttagaaatggatgagagatattctttatctgtgaccccgaaacttcccacaacacagtatctatttgagtttgtttgcaaccctttttttgttgtggttttaattggctaatgaggctaaattttcaaatttaaattttttgataaaatcttaaaattgcactacaataatcaaaattttctaggcgggcctattggcatgcattttatttctttaaataattaatgtttaatatttttaagatcttttttaattattgggcctcaaaaatcgaaatttacgcctaagggcacttttacagttttgttcactttttattaattccaaactttacatttattattattttttgcttatttttactaaagaaaactatcataaaatttttaagtctaaaaaatgattttttaagttgttttgttatataatacattaattaaaatatatatttttttatgtttgatttgaacccgagcttcaaaaacacgaatttaaccaactgagccaccaattttaagtggaaacacagccaaaattttgatttttgaggccccataacttttttatttcttgctatggacccgtaatattaaaaattcacaatagaagtcgacattgctctatccaatggtatataacacatatgcattttccgacttacagttcgggtggttccccttgttagtcaaaaaccatcaaaaagggcgttaatcaaaaaacatcaaatgaaattttttttttttttgctataactttgctcaaaagcaattaaattttaaattctttatatccttcggtagcgctaaatattttatgttagcctgtaaaagttatgaaaaattttttgtcatatattttccatttgataattttttgactaacgcaaattttattgctttttaagtgctcaattagccggaaaaattaaaaaaattccaacaaatttatataacaaatttggccgaacatttaatatatttttttaaatgtgtttttggccacagcttttaaatattaatgaactttttttttaaatttgttatagtacgcgaccaagatcacaaccagataaataatatagatatcgcaatattataaaataattgaatgacgagagcaaataattagggtaggaatagcaaatggggcggctactaatggacgctgtgtgtgacagctgtcccaattttatatccctctcggcaacacaaaactgaccaatgcgaagcgcaaatagatgcaccgccaggcacgacgtttgggaataaaaggctttgaaagtgcaaacattttaggaccatcatttgattgtccttggtaatttcgaaggtgctaggtcatttcacaaaaaagtgccaatttgggcattttaaaaaatgtgcaaattggggcaattcacaaaaaagtgcgaatttgggcactccacaaaaaagtgccactttggtcatttcacaaaaaagtgcgaatttgggcactccacaaaaaagtgccaatttgggcattttaaaaaaagtgcaaattggggcaattcacaaaaaagtgcgaatttgggcactccacaaaaaagtgcaaatttgggcatttcacaaaaaagttcaaaatcaaaaatatgatttttcctaggatttttttaatcaatttttaacttataaatatgttatttttaaaattttgaagttcaattataaatggaataaggcactctgactcttatattatcaaaaagggagatgaataaatattttaaaaatttttaattcctttttaaacaggccaaaaagtttaggcttaactttttactgaaatttcaatcactcatagttttacgagtagtgatcagaaaaatcccagatttagcagggtaacagctgagaacaatacctaatttatacttttttccccgtttactaggccttgttaaaaaatttttagattttctgattttctgtactttttcaattttttgcaaaattaattctttacaaaaccttttggtcagaaaaaaaaactaattttacccccgaacgcctcgaaagttggcttctttttaataatagaatttgtaagcatttgccctctcattttacaatttcattaccactttcgaaaacgaaaaaattcttaccacaaaaatctttgttcaatttaaattagcaaatttaaagtgaatttttaattctttttagataatgaataagttattctttcaactagtaaatctttacaaggataattgtctccaactgatgcagaaaagctgaaaaaccaacaattggacacttgggaacaactgcaaaatgccattttgaaagaaaaggaagcgaggtaaaaatggggaaatgaattacatattataaaaaataaaaaaattaatttaaagagagcaaaaaatgaatgaattaatgagcaa

SEQ ID NO: 5037 - DNA, 3084 bp, Heterodera glycines
cgaattgttgtttcaacacacgatcagctgcagttttggcttctatttccgactctgtgattccattgggcaacgatgtcgtcgagaatgagtgttgaaaattcccaagaatctccttgagaattgatcaacccaatttcgcccatctttcatttccccaatacgttcccttcccactcccggcaaattcgcctttattcacctcggcccattctgcggattgttcggctgctgctccgcccgtgtccccttttccctcgccgtcctctctctccctctctccatccgtctctgtctctctctctgtctccgtcccaggcgtgatgttttccgtcccttcctccccgtcgccctctcgctcgccctgctctttcacctcctcttcctcttcctgtgcctctccccctccctcttcatcctccacctcttccatctctatcgtcgttgtctttgtcatcgttgtggttggcattgggtttgtgctcgtcatgtccaattcctcctggtcctctgccattggcgttgtgtggtgctgcagctggcgcagttccatcggttttgccataattagtcgccccgctgggcaaatgggcgaagactttctccgccgtgggcaattgtacaaatggttaatgtactcaatgtcacctgaaccaatgtgttggcattgtgtagaaacagtgacattcaaacatattaaaaatcaactcacaatcgctgaatacgcgccgtggccggtggggacggcgcatcggctcaaggcaggaagtaccggcattgaccagaattcgccctttcggcgggaacggttcgaacatattccagcatctgaagcagcacaaattggcttttataataaatcgaaacgataaataataatgagttgatcaagaccaattaatgatttcaaatttaaaatgcctaaagctcactcaatgtgcgggccgaggtcgctgaagaacacataatccgcctcggcacgacgcggcactaagcggacgcaggtgcgtacctgcaggtccatgcgggcgttgttcagtgcaaccgcttggtccgggtcgaccagcagccgcgggtcgtcctcaaagggaatgcgcgccctgggccaacctgagaaagtgcgaaagcatcgaaaaatgaaaagggaaacggacggaaaaagaagcaaaagcaattgacggaatgaaaagcatcgaagtaaaaaaaggaaacaaatttcgattttaaatgtttctgacatatttttactgaattttactgaatgttgttcgtgccaagtgccgctgattggccagcaataaaagaagcgccgatcggtaggccaagtcgatgatcagccgagtgcgccgtttcaaattgctgtcgccgttatttttggcacccattaatttaataaggcaacttctgttggtcgatgggtttggacaaaaggaaaagcgaataaattgcaaagcgatcgaatgaaaaagctcaattcgaacggaggacgacaaattgatcgaagtttgatgagcgactgaggaggaaaaagtgagcatttgcgaagggtcggccatcatccgccccatgaccaacccaacccaatggagtagtgaccggattttggggacattcactcattaaacggggactgaccgaccgaagtggggggggggggactctgcctgaaaactgagcacacgaaaagcgaccgatcatcggactgatcggagtagaagcacaggcggaaagtgagaaagagaaaaacagcggctgatcgtagggtcaaaaaatcggagcggacggacggaaggaagaagcaaatccgaattttgaattttgaagtgcgcatttccagcgggagaaatctgcagaatttctaattgtttttttttaattttttcccaatttaaaatctaaccaacacttttccccaagttcccctcgcccattaagtgctgctattgatccaaattgcgcttgtctcccccattttgtgaaggtcgccctcttctctcgccatttttctcctttctttccaagcatttccttcgtattttttcaattattttttgaatttattttaaatggaagaaaatgaaaggccggcatttgcggcagagagtgcccaatcggtgcttttcctccattccggcgattggtcggtcgtcgaccttcgcttggccattccttccgctgtccttttagggtttccgcccgcgagttggccatgcgtcgcttcttctgctccgctttccgtctcgcgctcgccgtctttgtgagtgttcagcttcggcattttctgttcagccccgtttggatgcatggctatctttggtccctcaaccaattctccgtgtctgaacaggcaaaggcaaagtctgtgccctcaacggaattaaacttttgaggggtccatgggagcggacaaatcggcgctgtcccttttggagcaacagatggcccaagtcagtttttgggagcacgcgacgcacggcattttctgcactttggccgtgaggcttttgcttcagtatgaataattgcgatgcatttattcctttttctgagaaaagctcctttttgaagttgtgccggattttctcaccagcaaaagtccgtctgggctttgcttcggttggcctttttttcggggatggccagcggattggcaagggctgttcaggtcccttctcatcccttctcacttttgggttactaaatgcccgttttgagatgcggcaacgccttttgccatgtgttcacgaatgtttctgcggagtggcggcggtgtttctgttgggactttgcataacgctgagaaacccatgggaaggccaacgggagaaaaacggcacgaaaaagacgcaatgaaagaagagaagagattggagagtcacatcaaagggagagaaaaagaggggaagtgagggaaagggagaaagagaagggaaggggggaaaagagaggaagggagaaaaggaggcctcatctctctctctctctcccctctctttgtttctctctctctctctctctcttcccccctctctctttctctcctcatcctatcatgatgtttttccgtttcctgagaacccttcc

SEQ ID NO: 5038 - DNA, 4409 bp, Heterodera glycines
gagaaaaggagggaagagagggaaagggagaaagagaagggaaggggggaaaagagaggaagagagaggaagggagaaaaagaatgaagtgagggaaagggagaaagagaagggaaggggggaaaagagaggaagggagaaaaggagggaagagagggaaagggagaaagagaagggaaggggggaaaagagaggaagagagaggaagggagaaaaagaatgaagtgagggaaagggagaaagagaagggaaggggggaaaagagaggaagggagaaaaggagggaagagagggaaagggagaaagagaagggaaggggggaaaagagggtaaaggtaatgtagaaaaaagagaggagcatgttaaaaaagggatgttcaagtttaaaagctttttttaagcaaacattttttataattctctaatatttctgtaaataaataaacagttaaattttctcttttccgcttttcctctcatccaccgtattcgtttgccggttgcatgttgtaagatgggtactgtatttggctggactcggccagccgcggctgtgaagggtccgggccggccacaatgatggaatcgatgttctgtgggaaatgaactgttgccagggcaaatgctgacctctgctgacctggcacacgcaaaccccgggctgtccgggagggccttggagcccagtagggcctaaattgtttcggtcccttgcattgtctcttaattttaccttcggggccggggtatccggactcgccaggctctccagggttgccggggtaaccccgatctgacaaacaaaaaggtctcggcggaatgataaacagctttacctccttgcggccctgtctgtccgtttcggccagggagtcccggcactccgctggctccgattggccctggggggcctgggtcgcccggggggccttcgcggacttcgcctgttccgataatacattaaagctgcccatttgactttgaattgtttagaatcgccccattccctctccaattaatttccccacctttcggagtttcgcctttgtctccgggtgccccgggggctcctcggaatcccggcgggccttggggtcctgattcacctgaagaagagcaaaataaattttttcattagttgaaatgcccacccggtgctccgtcgtctccgtctcggcccttttcgcccggcgcaccgactgggccaacgtcacccggaaaaccgggccaccctttgatgccgggcggtcccttgggacacggccggcacgggggcgggtcccgcttcacttgcatgggacacgtttggtttggagataggccaggggatcccggcttcccggctgttcccggtcttccaggcattcctaaagggaacagaagcgtgagtattttcctaatttcaattctaagtctttttgaactctcgtttaacgatagttttcaatttccgcttgcccggctgtccggcgggtccccgtggccccggggggccagggatgcagcagcccgggcattccgtctcgattggctgtccgcttccgagtgatgccattcccccgctgctctcctcgtactccgcttgccgttccgtgcggttagcgcgtgtcgcgtgccgcgggcggtacgtgcgcgactgaagcgacagttgcgcatccacaatggactgctcacaaaagtgcatttgctcctgaacataagcgagagtggtgtgcacttggctgtacattaatggcacactcagtgccacgaccagcagagagagacaactgaaaagggagagagagcgaggggaggaaacaaaaagcataacttacagcataattaggcatcaaatttggagttttattttttgtcacttaattaaatcccatattacctgaaggcaatttgtagtccggtgacgcattgaaacacccaatggcgcaccgattgggcatcatcggaggaggagcagagggaatcggacctggccaaaccaacaaacgttgtgccctcttcttctgtcactttgcctttgcttttacctttctccgtgcctctttttgcttgctgatgatagcattcctttctctctgaaagtgccgttgctaaatgatctctttgagtgaattcgctgctctttcaccgcttcgtttttcctccgtccgtttcgcttttcgtctgtcgtcagtttcgcttctttcttccgtctcagcctttgttcggtttgtcggtcggcagatcggcgatttgggaaatgatgaaaagtgcgcgacccaaccgatcaacggatgatcagaaactaagggtggatgagcaactgttcaaaggcagagggcgccgacgaagggcgacggacggcgacagtccatcccttcccccgggggacagacggaggacggggggggggcgaagcgcacgaccaatcagccgaagaaaacgaaacgaaacggacggaaggaacagagagagacacggacaaatcaaagaaaggggagacacttttgacaattaaggaacaaacaaaggatgggagaatggacgaccacatttgattgaatgtgttaaaaagtaacccccaaaaaaagcaattgggcgggggggggggagggaatgggcgttggttcggtcggtcggaaaaaacattggcccgggaaacaaaaacacccaaactttgccggcccccaacttttcgcttaaagctttcctaactcatgtattcatctcatccatttatgttggattcagacaaactttgatgtgccaaaaagtcacatcaattaattatatcatttgtaaatttgacaaaaatatttaccaattatttagcaaaaattacaaaattgatctacttcttttaaccaaatgtttcgagtactgtaggtaaatacagtaaatgaaaagtgtttgaaattaatatgtgcattaatttggagtgaattaattgcctatttctttattaaaatttgaattgcataattaaagggtgagcaatggaaaggcacaaaagtgaacgaataatcaaatcaaatgatagcaaacaaaaaaagatcgatttggcacaagatttggaaaaagaggcaacaaagggacggcagcgtttgttggcattgccggggaatgccttcgggcagtcaatcgcttcttttggctctaatcattcgccaatttccgttccgtcctctgatcagtgaccaatcaatcagatgcgcttcttcatcttcctcttcttcttcttccgcttgtacagctcatccgtcactgtatttgcgctctccaaggccgggggtgtcaatgcgcccattttccccacgccgtaagcgtcgcccgtcggctccgccggcggaagcgacggcgacaacggccttttctcggtcaacaccacttcagtgtcttggcatacgcatgtgccgggagtgccttcgaaaggtgttttcttttgtttgtctccttactctcttaccgatagggcccgcctctcccattggccccggcagtcccggtgttcccatcggaccgggcggccccggcggcccgggccatcccttttcgcccgatcctccggggtatccgtcttcgccaggaggtccaggatggccgggcggaccccttaaagtatctcttttattgaaaagaaaataatgttttcaccatggtcccgtctcgcccgggtctcccggtgggccaggaattatgtgcgcctcaggggtgggccctttgtcgccgtatggccctggttgtcctggcgctccgtccggcccaggcggcccgtcttcgcccggcttgccaggcagtccatcttggccaggtcggcccggtatgccacgatcgccaggctgagtaaaaactcgaacacttacttggaacacttcttacctctccagggaatccggggtgaccttaaattgaaatatcggaagtcccaaaatgccaaatagcacctggaggccctcgaggaccctgagggcatggcaaacacggcgggggctcaaacacgcgctcgggaatgcacgacgcattcggcgtcgtgccgggacgaccttgcgcaccgtcagggcccggggcaccaggtaaaccgggcaagccggggtcgccggtggggcctctttcgcccggaatgcaacacgctttaaggatatttgggtgtgccaacagtcagttacaagagtatcgcttacccggacactcctgaaagagtggcccattcgttggcaaaatgctggggctatatcccgcgtagtccgcttcacgtcgcgtgcggtttttgagcacaaacgccgcatttggcgctgcactttcgatgtcattgacagaccgctgaaagggaaggattaattggcaaagggattaatggataagcaattaagagaagtgacttcacagaaggcgaagtcgttgtgtgcaaagcgtgccatgctgtgcacttg

SEQ ID NO: 5039 - DNA, 8065 bp, Heterodera glycines
  misc_feature (55)..(55): n is a, c, g, or t
tccactgcgaccttcagacattaggcaaatccaacagagaaacgttgaacccttntggcgaccaaccgacgaacagtcgcacagccaagccccgaagcaccgccagtcacaatcgcaacaagtcgctgagcatttgcaagtccaacggaaaccattttggaaagtcaaaaataaactgaaaaaagaacacaaacttaacggacaaaaaagttctgtaaatgttctgtaaatatttgggtttatgaattaaacattgccaataatttcagaccatgtcaaattttaccacatttattatcaaacaatcaaaatggaatttatttgatcacataaagtacgacacagttatttgtttagcatttttccttgcataaaatgattccttttttggtcaacaatcgctgcgattgcagtgcttctggacgatgaaaaacggtgaggtcaatcagtggggcatcgttctgaagagaagaaaaaatgacaatggtaaaggtgcgaactttttacacatttatttataaatcactgataaaaataataacactgaaattttcgcatggaaaataaatcccattattagtaaaatttataatttgccaaatggacgcgacttcgtctcggagtgtgtccagcagttccttcaatccgctgtcccctcctcccactaattttgcgcatcgactcgcgtcatccctcgcccttcctttcagtcccattctgttcaatgccaaggctcgcctgaacaatgctttgctgttgttcgcttctcgcttcaacgctccacaggcgtccatgtacgctttttcaggtcttaataattaatctaaaagttaaactagcgtttatattccatttaaaaaagatacggtacacataggtttgtttagactatgtgggagaatttctatagcgaaagcgtttttaagtttaatcatttttggttacaaatggcagaaaataatgttattgtttaatttttgttattttaaggacatttaaagtcaggcatgtgaagagtacccccaaaaaagtttaatcaacaattgtcaatccttcccccccccccctaaaacctcccacctgtgcaaattgaggtaagcttgagcccgatttgaccatagaacagaactgctggggtcaatctcaatggcacgcgtataaagtaaaacggctttattgaaaagttttcgtcgaaaacattcgtttgcctcctctttaagacggcaagcgtcaatttgtcgctgattatcagtggacattaatctttatgcagggaaattaatggaggctattgtttcgctttatgtaatattggatagtcaaatccatttacatgacaaaaaaaaccaactcgaaaatatttattgaattaaaccattgtcagaaatcaaaaataatgtgaaagatcagacccgaataaaaaaaaaaagaatgagcaaaaaaacaacaacaaagaaatagtgaaacggaaacacgtcacttaaatcttctgataaattggccaaccagagattcatcgaggaaaaaggagcgaagcaaaaacacctgaaaacggaaagctataaaaacagagaaacggaaagctctaaaaacaatgaaatgttgggggtatacctgaacagcggcagcaaaaagcagacaaaacaaatggacaacactccaaagattaacacgttcaaatgccgtcttaaattaaatccaaatttaaatataaggcaagaaaagacacctccatgatcgacctatccctagtctcaatcgcccggaattgtgcctgaattcgttcgatttcgttgagattgttcttcacctttgtggtaactctcttaaaatcataacattacatgaatacctacatttattataaattgttcacattgaacacttccaaatgttcctccaacaaaccgtccttgcgttgtatggctttgcgatcaaaatcgttcaagtaatttccatcattatcaagcagaaaaatctcgaagaatatctaaataaacaggcatttttgggaaagccaccatttttaaagctcgttcaaaatgccaacccgtttgctgcttgtatagctaaatgtattgtcaaagcacagtgcgtagtctcctcgtccgtgttgaggttcatccaaagtgatccgatacgttccgtcagatttgcgctgatcatttgcgaccataaaccctttaggagacttcattgaaaaagtgatatcgaggtcaccaccttcgactaccttaaacgcttgtttctagccatttattttcttttgtgcattcacttggtaaacaatttcaaatgactggtattttggagagacaatagtttggaaaacacagtccactcttcttgcttccactacaactgtcatagcaatttcttcctgttgtcgctcagaagcaggactaaactgacttgtagacggaaaaacaaaatcattctgtttgccaattgttaacccaaagggaacagtaaaataggccaaaaaacactgtaggataaaaagacggcgaaattttgataaatacatagcacataaatttatttagcttaaaaagttttttttaaattacataacttgaaatataaaaattatcaaattaaacaatctaattttttaaaagaaaagataagcacaaagagttaaccagcagaggaacaagaactcatggtaaataaaaataaaggaatcaaaaaattatatagctatctaactataaataggaaaatttaaatggaatacaaattaattaatttttgacagtaatccggtggcctttccgccgctaacgtctctaccgtttgccataataatcgtagttcccttcaaggaatttcctacttcaactttcccaatgtatcattaccaatatcgcatcatagtaattggtgattcgactgtcggaaaaagcagcttacttcgttatttcactgaaggcaaaaatgctgaaataagtgatccgacagtacggattcaaagatttttttttgcattgaattacttttttaggttggagttgatttttacgctcgaatgattgagatcaaaccaaattatcgcatcaaattgcaactatggtgatatctttttcttttctttatttttggtattttacagggacacagccgggcaggaaaagtttcgttcgataacaaggtaatataaagttaaacgaaaacggtactaaaactggaaacaccaataaggtcgtattatcgaaattccgtcggagttattgtcgtctacgatatcacgaacagacgcacttttgagcatgttgttgattggatgactgaagcagaggcaaatttaggagggcctgaccctgcgcaattggcaagtgtaacatccttagtggccagtgaaatctgctattattcttaggtttttttactggtcggacacaaagcagacttagaggagcagcgcgaggttctctacgaggagggcgaatactttgcaaagcacagacgaattaaattcattgaaacatcggctctgacgggagaaaatgttaatgtaatagacaaatcaaaaacaacaaacaaaacgccagtatttaggaggcatttttgattgtatcgcgggagatcaacgccagattcgaaactggtgcactgcgcatatgcgacggttgggatggaatcaaaagtggactgttgcggacgcaatccatcactctatcagacattcaagagacaacgaaagaaaattctcagtgttattgctgataaaaaagttgccttcatttttacacttaaaccgctggcaatgtacaaacagcataaaacttattccttttttagtttgatatgtaccaggtgtgaggaaaaataaatcatatttaaagcaatttttgaaattaggctattacgaatttaataattgttataaaccaattaaacttgaataaattatgtattggcatatgggtcagaaattttgagtctgcggggcctattaccacaaaagcatggattttcaagtaaggatagatcacaagcatatcattggatgggcgtatgatgaaaataagtcagccttggcacaagcgtcgagagttcatcgcagcgtcattttaagaggtcctgcacgtcccacatcatgatagtgcgatcgtatcccaccgtaaccatcctcccgggtttgtctcccctgtcattcagcaccatctccaagacgccaattcgcagttcatttgttacggcaagaggggtcaagctttttgtaagaggttgaatttttaaagcgaataatatgttgagaaactcactcgaattgttctgggtaattttgcattttctcgtggcatgttttgcatatgcgtgccggtttttcaaagcccatagcggggaaaattgacgactgtccgcaacaatcttaagaatttattcataataaaaacacaaagaagaaacactcactcgaacagacagactttccacaagtgcgacagtggtgacgccgaacaccgacgatctggtcaaatgcaaataagcttttctatattgatcgtctcaccttccggtcccacattacacgcaaattccagaaaaatggcgtatcacaaatttcgcatttgtcagagtccacccatgccggggcggcaatacgtcgggcgctcatgtcccaacaaaccaatttgcccgactcatcggcggagaataagcgacgcgagtcggcacccaacgcaagacgagtcaacttggcattgtgaccacttaaccataaaaatggagagcgaagacaaaagacacaacttgagctcataacagttgccgcgtttgcctccgatgtcccaaacaatgaccagcgaatcagtgcttgccgaaaaaagaagctgatggctcaaatcccagcaaagatcagtgattgcccctgaaataacaataagataaaagccaagtcaattcacttttaacaaatgggaaaatgaaataagttggcaattttcacaataaatttaaaagcaaacaaattagcaccggtatgagcagataatttgctgattaattgcggttgctgttgcgtcccaaccaccagccgaagcactgaaatatttccggaataatcgcccacaaaaacgaaggaagcatcgccatcgaattgaagtgtggtacaaggcgaacccgtacagtaacttgctgaaaaactccagtaaaaaattataaataattaattgacaccgattttgcgagtggtcgacgtgcaatgccaaaccaccgttttgtcctttgagcaactgaccatttgttctaatcgttctgaaaagccgagtccactgatggaactgaacaaataattattccatttaacaattaagcgtcccacttggtgtgcgaattccattgccgtttgaatgaaatgctatgggacaataatttattttttgtaagcgctaaatatacctgttgaaatcgttttcaattgaatattcgtggatctgtccatttgcaaaaccgacaaaaatcctttaatgagtttgttaaaaataaattataaaaaatttcttcacgtgtttttctgttcactgcagctgagttttgtggggatgtgcggcaagtcatggataattgaaggccaaaacattcccgactcgcgtctgagcagcactcttagcgttctgtcctcatttacaacgagcagtccgtcctcccgctccaacaaatgaatgccggcgatgcgtcccgtgagctgaccttcgattttctgggccaattctgtgggtaaaaagtaacaacaatctgatcagtgatcaacagaaaaggaatggtacaaaatggttacccattcttgcattttcacccaaactgctggtcatagtaacagaagggttttggttgatcactgctgccataaagtaaccaaaagaaaataaaataataaaattgaacaactttattaaaaattttaagttagttaattgaaacttttttaattatctttcaatccaacttaaacatatgtaattggcaaacttttcggctgtatatagatttgtgtggtaattttgtaagtgtatttataaattaacagattttcatcggaaaaataacaatggaatatgtgcagtcatcagcagcagaaacagatgagagtaaactgtttttaaatttaaatgaatcagagaattgcgagctcaacgaaatttatgaaacggaaagtgaaacggaaagaaaggaaatcgaagcggcggagcaagtgataaacgcacttttatattacaaaaaatacgcattgagcaaactgaggaagcaggcgaatgccattctgtgagcaattaattggacattagcgaaaatggaggaaattttgcaggaaattatcggaggaagaccggaaaatgctaatcgtgccgagtttggaccactttcgaagggttcgcgaatgtgttgcagaaaaccaaaggcgagtcacaaaaataaaatcttatttttttattagagtaaaattagttaaacgaaaagaaactattttagacgctttttaggctttttaatatgatggccgaatgtggcgcccatatgctcggcgggacaatccaacaggcttttgaaattacccaactccgaccggcctcagagcattacatgacgaaggtgaaaagcgtactcaagcaaattttgcgcgattggagtgccgaaggtgagtgattttgatttggctaattttgttttattccacaaaatattcgttggaaaggcgccgatgaaagggcgtcatgttaccagaaggtcaaggaggagatggtgaagcagttcccggacccaaattcgcgacatgccgtcaaaattctagtcaccggtgcggggttggcccgattggcctgggaattgctcggcttgggcttttccgtgacgggcaatgagttctccatcttcatgttgcttgcttccaacttcatcctcaacacttgccgcaaggtgtcctcgtcgtgtcgtccttctctttttgaccttttccttcagtgccatgagtttaccatttacccgtgggcgcttgacttctccaacgcgtggagttggcaagaccaactgaggcccgtctcttttccggatgtcaatccctcaactgtctccaattctcaggtcccatcggctggtgttgttgtttaatctttcgccctttgatattgtttcagcgtctcaataccttttcaatgtgtgccggcgattttctccaggcttattccgatgagcaaaatcactttgattcggtcatttccgttttctttctcgacactgccgcaaatcccctccaatacatccgacttatccataaaattctcaagtgatttatattttttattttgttcctttcttcacctttttcttgcttaggcccggcggagtttggcagaatttcggtccgctgacttatcaccacgaagactctgacgacatttgttccattgaacttccgtttgaccaaattgtgcgtttggttgagaattgtggctttcgaattgaccaacttctcgcgaaggaccaacttccgttgtcaaggcaagggaaggcatttctccaaaaaattattttatttgacttgtttttaggtatacttggaacccgaactcaatgcttcagtacagctatcactgtggttattttcgctgtacgaaaatggttgaagattaaattctgtgatagcaattttattttatttgtctaactttttgtaaattgtgtttgtgtgagttgtgcattatttttctaaaatccaatgtaattaattagacccttggtatttcacttttctctctgtttgttagcttttttcattcatttttcggtttgaaaatggttattcgtcgtaacgacagtcctctttctttggatgttcaagtgagtccgtattttggtcggcattccctccctccccctccctttcagggcactgcgtttgatgttttgcccgagaccgactttcttgccgttgctggtcgaaatactctctccgtcgtcaaaattggcatttctgcgcactcctccgcttcctctttggtccaacttaggcataatcggaacctcgtccgtctcctcaatttcatcccatcggcaccggccg

SEQ ID NO: 5040 - DNA, 1554 bp, Heterodera glycines
  misc_feature (20)..(21): n is a, c, g, or t
  misc_feature (23)..(24): n is a, c, g, or t
  misc_feature (31)..(31): n is a, c, g, or t
  misc_feature (33)..(33): n is a, c, g, or t
  misc_feature (35)..(35): n is a, c, g, or t
  misc_feature (47)..(47): n is a, c, g, or t
  misc_feature (54)..(54): n is a, c, g, or t
  misc_feature (67)..(68): n is a, c, g, or t
  misc_feature (80)..(80): n is a, c, g, or t
  misc_feature (90)..(90): n is a, c, g, or t
  misc_feature (97)..(98): n is a, c, g, or t
  misc_feature (1266)..(1266): n is a, c, g, or t
  misc_feature (1464)..(1464): n is a, c, g, or t
  misc_feature (1501)..(1501): n is a, c, g, or t
  misc_feature (1532)..(1532): n is a, c, g, or t
  misc_feature (1540)..(1540): n is a, c, g, or t
tttgaaataaaaaaaatgcnntnngatgcantnanttaataaattanaaatttntaatgggcgtttnntaatttttttanttaaaaaaanctatcannaaagcaatcggtaaattaaaaaatataaaaattaattaaaaaataaatcagtttttgaaaatcaaatttcattttttacaacccgcccaaaacttacatttgccgcgatccgacgagaccttcttggtgcatccgatgttgaaggcagcatgatcatgtctgacgggtcacttgattgtcctggaccggccttgtttttggccacaatcgctttgtccgcctcgccctccgcgttcacctgtaaagattttaaaaaacctcaaaaatcgtcatttttatgtaaaatttctaccaaaatccaagcaaaaatttttcaaaattcgctgattttttgaaaatcctcaaaaattgccatataccgtatttgctctaattatcccccaatctccattaatcccccaatctccaattatcccccagtctaggaggggtttgaagaataatccctctatcttaatcccccagtctacgaggaggttgaaaaataatcccccatgtgggataattagagcaaatacggtatgtatagtctctatcggcacctccccctccaaattccacaaaaaaaaatatattttttagaagtgcgccgcaaaaaaaacatttttgttgatttttgtaataaaattttgaaatgctgatttttaagccaaaatgctgatcttgaaaattttcagtcaagacccctgtttaaaaccctgatttactcaccgaattttttttgccacgtgccgacgtcgatttccggacaacgtcaatttgagcttgggaattgcggggaatgcctccgggtaatgttggggtaccttaaaagaatgaaagattagagaaataacaataaaatttttaacaaatttcgttttaacaaaaattaacaaattggtcgtttctgttggataaaaaaatatttaataattgccattttcgtccacacttcccctataatattgcctcggaaaatcccatccctactttgagcgtgcgctttgtcggcactttgaccagcggaagcggcattgttgacaggtgcgagccgacgcgacttccccggagcagtgccgcttcgcgtccgttgcccctttggcgtgtctgaaatcatccaaaaataaacaaacaatttttttatttaaaattttattaaaatataataaatttgataaaaacttanaataataattatacccgtccttggaaagtccttaaccctaagttgaggcaaggttaatgaattaacaatttctaatgaaaatctgttaaaaaaactttttgttggttaataaaaaatttttcaaaattttactggcaaataaacaatattgaacacgtaaggctaaactaatcaaatccaccaaaaatatttaatttntggttggttgttactgggaaatagtgattcattattntcaactgatttggcgctattgtcctccgccncgtccaanacataccctccaca

SEQ ID NO: 5041 - DNA, 4048 bp, Heterodera glycines
ttaagaaatttttaaactttatttttttaaaaattactattttttttattatcctaaaaatagatttgaagatatccttaattttatcatttatttttttcgtgttttattgaaattgaaaaaagtaaatgattttatcagtcgtttaaataatgaaaaatgatcaatttttcaaatttaattttaataatcacctttggcattggcgcgcgagtatttgcatttgagctcggcaaatttgttctcctgctgctgaaattgcaacttttctggcaatgggtccacccatcgttcttgaggcacttcggtgggcggctcggctgctttgggctgaaaaagtgtaaaatatttttttgtttttttactaaaaattgcattttttttttgttgtaaagcataaaaaagactctaattcttaaattttgactccaagataagaccgcaactatcccaaggagggaggggggggggggcatatcgctaaatgattgagcctttttaaaaattgataaaattaaaattttattttttggacttatttgcaaaacttttttgagcaaacatttaatcaatttatttctaacaaggaaacatttctgacagtaaatattcaaatcacttttaaaccacttttattttgtggaggtattctatcataaattctcgacctttttttggccctcaccaacaaactgatcagaaaaaagtgatcaaactttcaaaaacctaaaaaaaaataattaaaaaatcaaaaaaatttcaattttttcggattaatttgagtcaagacaatatatttttatacggcatcatgacccacctcttctggttcaggtgatgccgccgtaaagtcaatggtggtgcgaatcgatggacgacggacgggggaatgtgttgcaccactattcgaaattaattattattttttatgtaaaattaaaaatttataatcaattaaaagtgattactgctaatctacttgtgtattcgcatgtgcgtagaaagtccacgaggcgtataaaaaggctcgtgactacattttgtgcatctccattcctggaattaatttggttaagtcacgatttttacattgatcgaaaaatcgttgggcaaaatgcatgacttgatcatcaaattattcttaaaatgttttggaacgtttttgaaaaaagcttatatctaaaactttctaacaaataagtacaaaaaagaccgcttgtcttcatgacatttctttactaacatatggtccaaaagttactgtatttcatcgagaaagtggacccaaatcgatcagctcaatttttgtgacgcaaaaataatcacaaaaaatgaacaaacgccataaacccaattttagggagagaaaaatcatgaaggtttctggaaatctaatatggtgctgatagttttttaattgctcaaaataactttttttaaataatgaaattatgcagtgaaattagaaaataattagggatagcaagatcacttaatttgttggttcaaagaaagttttaaaatcagaatttttgatgatcaaacttgttttatttgtaattaaaatttcaaaaaggtatgaaatgttgttacatatttcgcacattaaaaaccaaaaattataattgacccaccagaggttttggtggggcctccggccttttgtcacgtcgggcggacaacgagcgggacctttgcgcgtctatttcattgtgccattctaccaacgtgttgtcctcggacttaaattcgggaaaattaatttaatatttatttcaaaagttttgccttttttggcattttgccgttttggtgccttttttttggcgttttttccaaaaaattccattaaaaaatcatttaaatgactcaaaattaatcggaccgggtcagtttagtacgggccgttttagtacgagcgcacatttttccactataacttttttatttattatccaaatccaactttcttgatatcattcgagagcccttcggatgctctattagcctgcaaaatttcgaaaaattttgttaagtttaaaaaaagttcgagccaaaaaagttggataatctggtttttttaattcttctggccataacttatttgaaccttaacgagatttttcgaaattttgcaggctaatagagcacacttagagctatcgaacgatactaaaaatgttggatttgattggcaaagaaaaaagttatagccaaaaagttgcgctcgtactaaaacggcccgtactaaaccgaccccgacccaaaattaagttatttggttacgttttcggtgttttgctccctaaaaaaattcatcaagtaatttgttaaatcctcataaaatttattaattctttaaaaaaagttacctcccagaaaaggtggcccgtacttctgtgtgcatattcttttctccactttgcccgttgttggtcaggctagcatgaagaaaaaaattttaaaaaaatttaaataaattaaaaaaagcaattaaattaaaatttaattattatacccacagtaagtgttttgttgtccattgaaggaagcaaatattgcagaacaaataaaagctaaaaaataaattttaatataaattttattcctaatcgattcactaatagggaaggaaaggaaaggaaaagaaaggaaaggaaaggagaataaaatttagttgtgcattaatttagggatgcgatttttagttaaatacctaaaattttgcgcatttaatacgcacagataagcacgaaaaaagcattttccacttggttttgggtgtctacgatgacttttataatacctatttttacctattttggagtttttctacctattatacctatttaaggattttcagaaaattccttaacaaaaatgcaataaaatcaaaaaatacacccctaagaattggaaaatttttcccaaaaatttatttgtttttttatgtaacaaaatttttaatttaaaatgtcaatattttctaagaacatattaaaaatatttaaattattcgtttacaaagaaatagaaccaaaattttccccttttgtttgcttttttccactaaaaatcgttaataaaaaattttatttacctattttggtacctattttggaatttttgtacctatttaatacctattttgagatttttttttacctatttaagtacctattctgggatttttcttacctaaaaatcgcatccctaataacaacaatcaaagatttaaagtcgaaaaattttgtaaatacaaaaaaaagcaaatgccttacggtttaaaaagttaactaaatgagcacaagtgatcaaagggaaaatcgagtaacttttacacaaacttattcatggtgacaggaacatgcgggtttaaatctatgaaaataataaccctagtggattacgaaaatttgtacaataattagtaagcctacagaaagagcataaaattcgctaccgaattgccactgaatgagtgatctggttggtggttaaaaaagcttgtttgaacagcataaagagttaaaggaaatttctgttttctcaacttaaaaatgaattttggccaattaaaatttaagtaaaacttgtatcgaggtggccctggtgaagtggccagtatccgtgttttggactagagactgcacgggacgggatgggatcccgcgcgggattaatcccatccagtaaaaaaaatttgagttcaaatcccgcagcacctgcaaatttgaaattcccgtctctattttggactgtggcccccagcagcccaatttctacgagttggttttcgtccgtcccatcacctgcccaacgttgtcgtttttcttcgtttttattttgccccctacggcgagcgtggcgtcgctttgccctttttttctctgccgtctcgtcgtgtgcttatgcactctctcgtccactccaaatgaccgcccattcatttggtcaccacattgaaacacaagcaaaaccccagaaggtctttccttttcatcttcagtcactctttcccccctctttttttggagcataaaataaa

SEQ ID NO: 5042 - DNA, 240 bp, Heterodera glycines
  misc_feature (5)..(5): n is a, c, g, or t
tatantttttttaattatatgcatcccctctttcacttttttcccttccttcattgcccccaccctttctcctccttcatttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 5043 - DNA, 269 bp, Heterodera glycines
tataataacgctgcggacatctacatttttgaattgaaaaaaaattggtaattactctttcaacttttttcccttccttcattgcccccaccctttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 5044 - DNA, 5467 bp, Heterodera glycines
  misc_feature (34)..(34): n is a, c, g, or t
  misc_feature (3775)..(3775): n is a, c, g, or t
  misc_feature (5416)..(5416): n is a, c, g, or t
  misc_feature (5441)..(5441): n is a, c, g, or t
taacaatttttaattttacattaataaaattaantggcctttgttaaagattttaaaaatatttgtaatttatggtttgaacaaggatttaattgaattttttaataataataaacaattaggtccattccaaatcatagaaaaataattttttcatagaaaatcaactgagattattagtaactattttttgggaaatactcttagacaattttgaaaaatttgagtaaaaattacaaggtttaattaaataattatcaaaaataatactaatacaaataatgcgtatttagaataagttgaaataagaaataaattatttttcaatgattggcggaaatgaaaaataaaataatgttgacacattatcgtatgttgattttaatattgtttataactagggttgagcggtaccggtaccggtaccggtaccggccggtaattaccggtttttttggtaccggtaccggtaccggttttttcaaaaatgaaagtaccggtaccggtttgtctagtaccggtaccgccggtaaaaatttgcactgttaaaaataggagtttagcacaaaattgatgatgcaaaatttagggaaacgagaaattttatattagaaaatgatggatgaaatttaatggatttttgattaattaactgtttatgagtagggaacggatttttatgtttttacttattttttctacggctctaactcgatgataaatgcacgtaaaaacatttgttatccgaaaaattttcgttttactattcgaccctaaaaatccctatataaagtgatcgtccctaaaataagtttttatccctatttggtgtttcgccactatttcgcccttatttcgcgatttttaaattttttcatatacaattcacaaaattgtcccctttttgttgaaaatgataatttgtcaacttacgaaaaatattttgaatttaatctgtgtttatcgaaacatttaagcttttatctccctttgtttattaaatattaattaaataaaaatatctttaattttgaatctgcctgttttattttttcattaatatttttgctactaacatttaatgtataaaatttcgaaacataaatatatacttattttgctgaagataaatagattgaacttttcacttcataccattcatattcgatattaaataaatatttaaaattttaaaatttctaataaattattctaaaattataatctatgaacatcggtaaatggttgctcaaatgttgtcttttaatttttttttatgttgtttattgatatgcaaatgaaaaaaaaatatagtttataaataattgttttggaatttgtttttatttgcaaaatatttaattttttcatcttttattaatttctaatgtgaaagtttttatattgattagatttacattttccaatactgtttctttgtatataaaattaaaaaaaattaaaaaatgaaaaatactattttttagaaaattataaatttatattttatttattggttcgttatttaatattcaataattcaacaaaacattttttaagaggatcagacgatctcgtaaataactgagtatacaataaggattataattaattatttttattataccaagtaatatttagattgattttttaaaaatctattagtttagttttcttcaataagtaagcaatttattataacacatttttcctgataaggatatttattatgtttttaacgagtaaatagtcaactaaatggttgtttgatccttattacggctcaaatcgctgaacattttccaagtgtttagccgattcattgtgttgtttcaaattctttcatcaaaatgccaaaaacagtaaaaaacattaaaaattgagaccttatcttttgttcatttaaatttattatttttaattattagtttcaaaatgtttcatttattattctgtgatttgcatatgtccaaacatcctgtaaacgagtcgcgcaataattgacagccaatttcttcgtcaccatcccgccacccttcttgaaatcgataatcgccgttaattgttccgtctttttcttcagttcgcttttgcttacatatgatattttcttttttatatttaatttaaaagtattctttttaatagaaacttttttaaatttttatacttatctctttatatgtttaggttgaaattgttttgttttttcattttttgtaactcatttattaccaaaattttcatgaaaatatggctaaattaaatttgttctacgttattggcatttctggcaaaaattcagctgaatcccatttaattatttctggcacaatcatttatttaaaaatatttttcttattacattcacgacattggttaagaatgtaaaaattttttaatattccatttaaaaattataaatctaacaatcattatacaagcaagaccaggtttcgcctttttcaaatttcttaatcatttagaaaatttctttataaatacctaaagcagccaaatcaagcgctgtgttaaatcgtcactggatttctaagttcccggaaggaacttattcaactgatggaaaaattatcttttgtcaacggtgccttcaccaagtattagttttgactagagttgagcggtaatcggtaattgtaaaaaaaccggtaccggtactgaccggtaatgcaaaaaccggtaccggtaccggtaccaactttttccacaggtaccggtaccgctcaaccctagttttgacaacggaacagggcgggaaacaacaattaaggtgaccgaaatgtttctgatttgcaattgttctcacgaaattgataaagactgatattaaatatgattttttttttgcgtaaataaacttggattttcctattttttagcacatatttttgcattttttaacacatatttaggccttttttggggtttttagcacatattttgggtttttttagcacatattttattacgtatttcaggatttaaaatctgattatgcataccttgttatttgtttgtcattcttttacataagtatagggattaataaaatttttgaaaaatttagcattaaattacatgaacaccgaaccacaaatactacagctttacacatgatttttttaaatttgaatttttattagaattgtaattttttaactatgtgcattaatttttatatttgggaaataaataattgcaaaactttttataatatttttaatttttaaattaatacctctgcgttggtatttatttttagatattaaagatgaatttaatttaatttaaattttggttataaattgtaatcataattatatatattatatgtttattttccataattcagaaaactaaaaataatcattcaattttatttaattttactttttttaagtaatttatattttcatacgttcacttatcgaaagaaaaatatttttattggttcaattttcgataattaaaaaatctagcatttactttactgaattttaactttttccaaaaaaagccatatgtagataattttaataaaattatttttatttttattataatttctttgtttatcaataagtattctaaatcaatttacaaattaattcttgtatgattttaatgataaataattttttatgcttttggctaaataaaaaaaaaattattgcgtatttacaaatatttcagtttttattatttattttcactgttctcgtcgaccatgtatcaaggccgcatcttatgtganatgattttgattgcagtatattcatttttctagtatgtctttgtttcattaatgcttctattaaaattctctattttatattccaatcttctttcatatattatattcgtacatagaaaaccattatttttaattcctttttttcttaagcctttgtaatttattactttattatattattataagtttagtcatcgctctttaaatttacacgaattagtgtgatttattgcttattacactattaattaatgttaaaaacatttttcaattatctctgattaataaatctattttttttgatctgcgaatataaatagtagtcaaaaaaatttaatattcccctggtaattttaattatttcttttcattataaattaattcctttaaattgaatttttcttttccaaacataatttttgtattttctttaattttacgcatataaatttcaccataacttatattcaaagaggaagtaaatttaactttattattaatcccaataaattatttaattattttttctttaattaaaaatttccttgcacagttggcaatggaacaattttaaaatatgcaagcaaacattgttaattattatttgtttaagtactgtatttatataaagttttgtttgtgttctttttctcaaattggcctaatcaatcaataaaagtaagtactgattgaattcattttgagctccggttagcaaatattataaattttttgtgtaagttcaattattaatggtttttggaattcatacttaaaaatttttaaactattctttgatgccgttttaaatttgaattcttaaactgcaaaattgaatcttgagtaatcaatccccctgaagaaatcacttcaaatctcgcactgatcaataaactagcagctgtttttttaaattatgtttagcaatgcatttattcatatatagatttttcatattttaatgtgtcttacttagtaatatgttaaaatttatttattttatttttattactaactcatataattattgagtaacatatatataacattgttcgtttttatttgtttatttttgaaataaataaataattttcacgaccattttaataatatatttaaataaattttttaatataatcaaatatatttgaatttataaaatttataattaatagtaatataaagagaaatagtttgaatatttaaaaaaatatttttctccgttaatcatattattttttcccgtccaaatactgcagagtggctcggttgggatcactacccttgatctgatcggacaacagacggacattgtccaaatttacttctttttattttattaaactatagagtattcttcgtgaaattaaaataggagttattttgcatgcctttttaaatttaacgcacatttcatctaacacaatatgatttttttaattacttttttattgttttgtctgccatgttaattacattttcttgaggcctattgcccatattatctaaatatttaggtaatgtattcattcaaatttttattctatattcgtcttgtctttatttaataaaattacatcttatattttaaatagttttatttttttcaattttaaacatatttatttatcaatattattntaacattttttaattattttttaantttatttcattgaaaattttactatt

SEQ ID NO: 5045 - DNA, 5374 bp, Heterodera glycines
aaacataataatccgaagagagcaaacagtcgcaacccaaaagcatcgcaaaacgctgcagcttttgcatgcccatcagaagaaaaggaagaagaagcagcagcagaaacactcattccattcacagcgcagcaaataatcaactaaaactaatcatatctttgctggtgctaatgaacgaaattttggctccttctttggcgcctcgtttctttgtttgggtcccagtttagtgaccgtttaattgaaaaggcccccggcccaacacactctgaatgtgtgaagaatgaatgatgagtggcggggtgaacgtcaatgttgcgttgcgcgttaaccgacacttggttaatgcggtgtgcattcagtgggatggggtggaaaatttgttgccgtatgtttaaaggtggggttggtgctctgttgttgcggtcaacaacaaacgggaatggtcctatttgctgttcaaattcaacatttcgagttggggtagaagtgcgcggtacatggaccaaattttgaggaaagtttcctattccattattcatcaaatttgataagaaagtgtcatgcggcctcctttggtgggcaaatgtttgaccatttactccaaaattcggtcgtccatcattttccctgattgcgtttcgcaaaccttcggcgttttctccatttccggcatttccgttggctggcggctggctacgttcaatgctgaccaccaacaagcgtctgcgcaattcctcttcggtcatatttggttctaaaacaagagaactgtcatcaccattttccccattaaagcccgcgagttcagtgggtgagattggcgagttttcaatttgctgattttggggaaaactttctccagcactgtgattttggcgttgcagcgagttctgctgatttccaccgacattaatctgatgtccatttctgtcaacggcaatctccaaattcaacgctcgttgccgtgtcaaaatcggactgcgtgtgatgaccatccagcgaagtcaaatgtaaaaattcggcgagaagacggagaaaaactaagcaccgacccggtgtcaatagtttatacggcgatgtagacagaaaaaaaggttcggcccgaactcaaattttctgataaacaataaatttttcggtgcgctggagttttttgtcgctttttttaactttccgatccggaatagtcaatttccacttcacaacttaaatatcgtccggtccggactgatacttaatacactccaaattaaaacccgtccgaaaaaattttttattcccgatctcaccctcaaactctttaaaaatcgccgcttttgtacctgtttcctcgggagcgccaaattgtacttttgctactgacttaagacagggacgcaattataccaaacacagagtaggccactgtcaaatccaaacactttaattccaaaagacaaatatcgatgagaaacaatttgacgaatatcaattttaaagtcaaaagaaattggacggcacaaaacaataaaaattaccagataataaaattggtatgaaagatagaagaaaaaaaacaaagaatacaattttaagtgagaaaaaacgcgaaacaagacattatgccaaatttaattaacactaatgagtcattataattaaaattctacaacaattttaatgttcggattgtctatctccaaccaaggacaattcaaaaaaccgatagatattttattcgaagatatttattattcaaaacagttgatcatacattgtcttcgccgcttgacaaccgaggaggcatgaacgagctgtgttttatgggccttttttctcataataatttatatcaattttaatatttctttttctatcccaaaatttgttttttattttttgctttaaattattgctgaaagttttaattgcaaaatttgtcgtaggagaaagtgaaacaatttcaaaatttacagtgatcacaataaaaagaaaacgtccattatttattgcatttttgaagataatcattttttatttaaataaaaatgtgtaataacccaaaaatttaaaaaaatcagtcagtccatccatttcacaagcagaaagagcgcggcgagcagcgagccacatcatttaatggtggtgccttttgtcggcggaacttggtcgaacttgttgatccaacactcaactaaaaattcaaaataaataatttttataatttttttttgcttaaaatttaatttcattcttaaaaaatagcttttttacagtattcctgcattctttcaatgtcagtcgcctttctgttgatgataccaccctcaatgatggcacaaataatggcaaataagaaaagcatcggaatgagaaatttcatcgaatagtgaatttgaaaatccttaataaaaatgggaaaaataaaaaataaattaaaaaacaagaaaaaaatcaatattcatttttagataaaatcaagaaattacgaaaaaggttctttgtcttcactctcgagtcgaaagattcttcggatttttggagcatcgctctgagctttcaaatcgagagaaatttcaagcagtccccaatttcatgcaaattccaaatgcggcgccagaaaaagttaattttaagtgtctttggacccaattttaattctaaaataatttttggacaagctaattgagcttggcaacaaaaaagtcattgagctagacgctagaatggccggcgccaatatgacacgcgctgaatttatttagttgtccaacaagggtttaattaatttaaatgatgctcaagaatctcggtctcgagaatggtctcgaatttttcggtcccgataaatcactattatttagagagataaatgattcgtaggtatccgtccaccattccccaaataataataatgtttggaaaaattaaataaaaataaatttctaaccagccaatgcccactaatggaaaattatggaggggggggggggagtggaattggggaaagtgtagtgactaatgaatgatcatcgaaaagcaataagaaattccacaaattctttttttacacattttatgaatttttaatttggacagatggctgggaaaatgggaaagtaataattattctgctgataaattaagtcattgattgatatattggggtgttcggaaagttctttcatagcggacaaaaatttatttgaaaattcgtaacatattaaccaataaaccaattttaatcaaaatatgcaccattattctcgaccatcttctcccatttttgagattttaaaaatgatctatcgattaaattcaagatagttagactcaaataaactgatgggtctacttaaaaaagtggacaaattcaaccactgatttcttggccaagaaaaggctaaaggtacaaaacaaattatggttttgtagagcaaagttgggactatctgacaagctgaaaaagagccaccaagaccgacgggttattttttaaaattgtcctgtctgaaaatgggtgctcaaaagtgccaagattcagcacccactttgtacaacattgttctgaaaggacctaataaaatgaaattgatgttttcatgggcaaaccaaacccggagaatccgaatatcgcctcagatttagtcagttgctgttctatgaccctgtactgcttcaacttcttttcaacgacatggagcagtacaatgccagagaaaattcagagatcaaatctgaggccagatttggattctccggacttgatttggccacaaaaactgcttttaataaatttccaactgatcaaagcaaagttttgacccgtacaataaaagtgatcggatttgggatttagggtgctccattgggataattttaaaaaatcaatttgaatggggaagaacgaaaaatggcttttaaccgaagcaaaaatgtctgctctttcctataggacagaaattgatcggctgtcacttgcggttaacggtgcaaaaaattccgattagcatagcataagaagggtgacagaacttatacaaccccccccataaaaaaaatgaagattaatttatttaatattatttataagttctcctttattcgtacacaatcctaaaataagagattttaaattcaatttactacattaataattacatcaaaaataaataatttgttaagtgcatcatatacccctaataattgaaaatttttttcacaaaaactgtcccaaaagttatttatttatctttgagaaaaatttttgtgtccttattcgaaaaatcttcaaaaatttggaaaaattgaaattttcttggagtaattcatttaatttattgttgaaattattaattatttttttaattcattaatattttaaaaattaattttgttcattttttcttgtattaatgagtattctcgcaagatattcacatgcacagagtcatcaaatagtaacatgttttcttaattttttatagtattatttgttcagattctcacataaaagcaaattttcagaaattcgtgttttcgacctattgttcgaatttgggttcggggatcggaatatgcccaaataatttatgatcagcgaccttgaaaacccccggtgcataaaattgaaatcattgtatggaaattggtgataattaaaaaaaaaatttcaagaaaatcaacacattgaacttatatttgaaggaggcctattcataattttctcgcatatggtccaatgaaaaccaaaatgatcaagatttgatcaatcattacgtgcacttcaatatggaattgacatgaaaggcttcgaaaaaggaattaataatgaatatctatcaattcttattctataaagcacataaatttattttaatcagagcgcaaatgtctattttcgctgtacgacgcaaatgtcgcggcgcaaatgtcgtttttgttaggcggcgcaagtgtcgcggcgcaaatggcacggcgcaaatgtccgcggcgcaagagtcttttttgctgagcggcgcaagtgtcgcggcgcaaatggcgcggcgcaaatgtctgcggcgcaaaagtcggctaaccgaagccaatagtgactaatcatatggaataagacaacgaaaaatttttatatagtttttattgattatggatatttattaagataatttaaattgattatatatattttcacatatttagacaaaataataaaagatttatatatcattataattaatttcaaaaaaacaatgaataaaataaaaaaataaagattaattctagcaattaatgatattttttggaaaataataaaaaaaattgtattcaaaagaatacttatttattaggaggagcaaaccatattaaattattaaatgcaaagagatcg

SEQ ID NO: 5046 - DNA, 5676 bp, Heterodera glycines
  misc_feature (30)..(30): n is a, c, g, or t
cgaaattgtttatttcaatgggataaatancgcgtacaaaccttttaattgtatttgtaagaacacacaaaacaaaaataatagacaaaaataaatgaatttatgattaactatatttggttaaataaatagtaaataaatgaaaaatgagaagagagagagagagacaaagagaattaattaattgctcattagtgcataatgccaaaatatgaatgggcgaaaacccacttctccaaagcgtaaagagaaaacaaatcaattaattaattaactaatataataataactaatggcagtgtaataattttagcattttgccaaaaatggattcaatttttttccttttaaactgccattttacaacactcggtcagcaaaaatttaggattaacttgacgggaattttcgagagaataaattcatcaaaaagcgcttcccttaaaattgaaaaccctcgaaaactcccgtaaattttttatgaaaaaacaaaacaaaaaaaacactcgaataatttgggcaattgggatttcgcacaattcattttttgatcaaatgtggtgttaattagaaaaaaagacttgaaaaattacaaaataaaagaagagaaaaaagagattctataggttttccagcgccattttaatttttaagaaacggaagtggtaggaaaaggacagaaaatttcaaatttaagaacggaaaagaaaaggtgaacctcgttgaggtaaaaatgaactttacaaatcagtgaatgaatgaatagtgagtataaatataaaacgaaataaaaaataataaaaaacaaattaaatatgtaaaaataataatgtaaaaataaaataaatttaaagagtagaaaagcattgcattgcaaaaacccaacacacaaacagtttagcaaatgggaaaaataatatagatataaccatttaataatacgaaatggataaagcccaactcgtcatttattggacaccgttttaggagcaaacttttagattttaatttaaaaattaataaagaatttagaattatcgaataatacaaagcaaaaaatgtttaatttatgtttatgaaaaagttttgacgattttttgtcgaaaaaatgcattatgaattgggggagtgtgaggtgtgttttaaataaaaagcacagattatcaaaaccaattggaacatggtgaatggggatgaatgtttagcaattttaacaatggaacgacatacagtatactcaataatataatatcatatcagtgccgcagcaaattgcgacttttgtgcggtttcattgttggcattgtgttgtgtgaggtgctgttttcgttttttgccgttctccccttttccctctcttttcgccttttccacggtgttcaaacagtaccagcaacaccaccaccaccgttctgttgtgctgctccctccttcgccgtttccgctgccgccgtccgcgttctgctacgcgtttcagcaccattctccgcttccgtcgctgttgcggtggctttgagtgcgcatgttcggtagaagaacaggttgtattcgtcaaatgcgcgcccgcgttgccgctcgtccctttcgcaaaggttggcggaatgtccgatgcggaatctatatgattctttaatatatatactatatgatactttaatatatatactatatgatactttaatatatatactatatgatactttaatatatatttttttttcaatttaaaagctaaaaaaaagttgaatccgaaagccttttttgcactttgctctcaaattttttttaataatttttcaaatttatagtcatagtgggcgactaataaacttttagtaattagcaaaaaaaattaaaaatttaaggatttagtcatccggcagtacctcctgggataattattgaaaatcacagaacataattctttgacctgtatgcgctctgtaaaaaggaggcagccgacagttcgaaaatgttttcggtcacctgaatggcaaaaaacaattattgattgattaattggacgatcgttttggctaatgtctcccatattaaatgatctgttgctaattaggccaataatgatgattggatttgttccccactctgttcgtttccggcggttgacttcgttccgagtcgtcctccagttgaagctgtttgttcccatattgttgacatggcttatattggaagccgttcaatccgccacaatcatcaacaaatagcgtcaaatcatcagtgctaaattagaaatttaaaattatttaataaatttaattaatcgttttattttcacctaatgcgtatttgcagcggaatggtcgggaaatgttcagagaccggcacaaacaaattgaaataaccgttccgtgcatcgcaactttcgttgaagcaatagcgcgcatcgatggtgaagttcatattcagcaccttcaaaatcaattaggcattaatttattaatgggtcagttttttttttgaaaaatgttattttttttttattaatttttataaatttaaaacagcaaaaaactttgaaaaaaattacaaaataataataaaattcaatcaactcagagatgaataaatccatataattttttttacctcaaattttgctccgtttgccaaagtgttcatttgacctattccgttctgctgatccttaaaatttgattaatttttaatataaaaaaagtaaaacccaagtcaattcattaaaatttgcaatttttggagtgtaaacacttttttttttgaatttgtttaatccaacatttcgaatggctaatcgatgcgccaaaaaattcgttcctctattgatcatataccaatcatacaatgtgcttgtaattatctaattataattttttgccattcacttgtgtcagaagtaattgtggcgccggaggcacaacattttccgccacttttgacgccaatgcgacccattcgtccacactcttcgacagtttttcaccaaagttctcttttgatgtagccgccaatttgctgtttattccgcaacagtaatggggacaggtgccgtggccaaccagcggtactgtaaagtatccaattagtgctaattaatgcgcgtattattctcgtgtcaccaggaattagtgacgagagtgaggccatcactgtgccagcgccgccacagaatacggtcaacggcggcacattctgcggccgatcgggcaatttccactccacaaacggcttgaccattttgccgggctcaatttgctgctggtgtggttgccggccatggtcagcagcagccgaatcaggcgaggacggggacgagggatggtgatgatggtggggcaagccgttgtaagagtcgatcagacggacgggaaacacgtaggtacggttgtaccagtccatcacgtacagtgtgcacattgtgaccagactgaacgaaggtgtgtaacagtacgatcaattaggaggaagataattgattaactaattaaaggttattaattgttttaaagcacggcatattttacaataacaaaggataatttattcgtatttttatactttgcccttaatagcccatttattattgttttgctaaaaaagaaccaaacttgagtgttttgagttaatttttttaaattttagcaaatttgttataaaagttttcaattttcaaaactatatcttacaaaaaaggcatcatccttaccaaagtgccatgatgatcacaagcgttacaattgtgccctgagtgaactttgaggtgcacaacggcgaatcgacgacgagtgcacggaccaccgcctccaccagcgccaccgtaatgggaccggttacagtatgccgaggccgacgaataggagcgacaacgatgatggtaacggtcggatgatgatggtcttcgactgaaaaaagcacacagaagattaattgttctcggattcgagtttcgagaattggcaattatccaatggttcgagagttggcaaaatgcttttttggcgccaaattttgaatttaaattttatgtgactgtcgggcaaccttttgccactgccaatgtgttgtttcttcgccttttcttgcacaatgtcgtcgttgtcgtaatgcgtcgttgttggcattgtggtgacggccgacgcaagcgaagtgcgggaataggagacgcagctttgcttgtccccgtccgcaccaccgccaatgccggcaccatcgaggagcgattttgtgccaaagaaagtggagaagtcgctgaggccttaaaagacataattgtattaaaattacatccttttaagcatccaatagtctcacccgatgccattgagccgagttgccgccgtttctgtgcgtagcgggccaatttttgcgagattttctcgacctggtcaagcttactgcccaaattgccggtcaaactaaattgttacaaaaaataagcataattatggggtcattccacagtttaaaacctgttcacatttctctgattatttgcccatttctcttaatttttctcccaccggtataattcctgcgctgctgctacagtatcgtagaacacgcgagtgtcatcgaccgtaagaaattcgccgttgtctttcaccgcctcgggcaacacttctgccaactcctaaaaaaggccgatcagaataagagcactgatcattgggaatgtatatcaaatgctcgcctgcgcaatgacgcccacccggtgcctgtcctgctcggtaaggccccagcgttgggcaatgtccggtttgtaggcaaattcgacgaggcgcatctgtgccacccgggccatcgcttcggcagtgctgacctggacaagtgggtcaattattaattaactgatgcgagtctcgagccttggcaagcacacggcctacctcggcaatgtcctccttcacgcgccggtccgatgggcgtgtgatgttgccggtcgtggcgatgttcccgtacacagtcagagaggcattttcgatcggtttgtcgccgccggcgccgatgcacacttggccagggaaggccaacgagccatgttggccctggcgccagttcaaatcctgatcgggctgctcaaattggccagggtttgacgccttaattgtcggggaaaattaaaattattattttttggcagtgtttttctcataattatgccaaaaagtttctggattcatttaaagtcccaatttggttgaattaaattaccaagaaataattgttacatactcgaacaatcacgcgatcagaatggaatgcttggatgagaactgaaaagagggagcgaatgttgattttaaatttgaaatttttcaagcttttccctggtgagactatcggtgcgccgctaccgtacccgcccccttccccaagaagggtgtaaattctttttcttcaaattttatcataaatcattagtgtattcaaaaatttttccaaaaaaccgttagaaataattaaaattttttttaaattaatttaaattttttttttaaattaatttctttgaatttaaaaaaatcgaggggggaagacctgctccccccaagtaaacttcaaatataacgaaaaatcaccataatatgaatttataattttaatgtccgagtctactgattacaaatataataaagaaataaaaggtaattttattttaatataatctctgattgt

SEQ ID NO: 5047 - DNA, 1484 bp, Heterodera glycines
cggattggcagaaattagaaggacaaataaaatatgctcttattttgaaaaataattgagttagtaaaagaatgaaaataagtacctaattaatttaaaatttcctgaaatgattattttttaaatgcggtgaaaatcaacattaatttagcaatatttgaatattttggattaattcagccacctgttgttggccattggtggaagagttggccgaacttgcggaagcagagttcaagtcaattgcaatgttgacggtaatttggaaatggttcttcttctgattcacaaagcaattatcggaagcgctgtaattgaaccctttgtcggcaacaacggcaactgaaaatgggggaggggtaattagacaatgaattgggcaattaggaaggaatcatcagaaatagttaatcaggaccgtttctattataagaacagtttaagacactaaaagtgtcaccgacttggcattggctgcaaaggacgacggttgaagtcgtacaacacattccactgctcacgcaagtacggttcaaactgaaaggagtgttgaagttaaactaataatttttgttttgttttttcaaggacggtcccccaagggggagggcaaacaccaagggatataagcaaaatgtcttaagaaaaaagcaaaacgaagcgaccaaaagccatataaaaactccttaaaaacaggtggtcaaagtcaaaatcaaatcatgggatcgttattaaaattataattaaacactgaaacaaaaaaaataaaataaaaaagtaaaaattcaatttaacaattgaaacttgctacaatatttgcttttgctataatatacaataccgataagtcggtcattgaatttaacttattttcttgccaattccccgtgcgaccctcattaatcacatccaaaatgccctccctgctcgcccaccttgattgtcctctgtgagttgatgttctcgtccaagtcgtcaaagctttggtggtgcgactggggttgcggcgtttgttgctgttgggtctgaagcagaagcatccgttgttgttgttgatgttgctgatccgctgctgatccaatcccggcattggcagcgcaattcgtctgctgatggtgttgttgtggcgatttgtgtgccgaggaagtgccaccaccggcacagctgctcacttcacttttgatgttcggcaaattcgtgctgttccctagcggcacggaggagtcgcgcgaactgtgaatgaataggataaaaatacaataaaaattggtcggaaaagtatggcaaattgagaaaataaagaacccattgaacttttatgagtggttttggtttacaagggcgaacttgccattattcaaggacagtttcataattcaaatgaaatacttattaaacactaccccggtgttgcggcggagctggacattcgtcggcgcttcagcccgtgcgacgagtgattgttgtgactctagaggtccccg

SEQ ID NO: 5048 - DNA, 2840 bp, Heterodera glycines
aatttttcgaaatgccttcggaaatcaccaaaagtctctgcaatttcctagctaacaataatcatcggtctcgttaattttccttttcaaaatctcaatggtaagtcaatcacaaaacactgactttataaagaaattaatttaaaaaaataaaaatttaaatgttattaaaacaaagacagcgaattcctttcccaaagaacggacaaaatgtaaaatgaaatgaatggtattgattctaaacaacggacggcagaaaagtgaccagtggactgcataaatatgaacaaaaactcagaggacagcttagcacacagatggggcgaggtggaccaattggttggccgaaggacaaaaaaaaaacaatgttttttttccttcaaattttggtcctttaaacctctcaaattgggaggggacgccacagaaaatgcaatcatcggatgttccatttttaaaagctttcttaaagggtgaaaagggttaacgaatattttatcggttgtacgaggagaattgaaaagaaaaggaacctttttgaaaaaatttggaaggtggaaaaatgctttttatggggggaggggtgaacccagcaaatccaaagcgcacaagtactgaaaatttctcgagatttgagaccaagtgacccaaaaatcgagattgaatccgagacttaacccagggagtcgacaccgagacttgactcagagacaaggacttggtcccgcaactcgagaccctaacctgccgagacttatctcgagtcgagactctggaacagcactaggatacagcatcagtaataatttatcatatccagtacaagaatgaatatttttacctgctgtgcagagtgatgggagccgggcgtcgactgtgagggcgggtacgggctgaggaactcggagttcggactgtgcagacattccgctcccgtggcctgcccatcgcctgagcggaaaatgcaataaacatttacatttaatttgcaagaagaaaattcaatgcaaaataaagaaatgaacaattggtaggaaaatcattcacaccttcggcacaccctccgcccgcggcattcccgccacagattgacatgccggacgaggcccggtgaaggcctccgacgccgctgcccatcatttggtgtcctcccatttggccgttgttgttgttgctgttgtggtgatggtggtggttcagcagcagcatgtcgccccgggggtgttgttgaatgagcagcacttcaccagcagcggtgccgccgttcatctccggcgggtgcatgtaacggtattggtcgggcgagaacggactggacgaggcaccacctgcgcggaaaggcatagaaaaatgatgatttgaacttttaaaattaagcaaattttaattgcttttaatggaagacggaaaaacgggcacagcaaaaaagacggcaaaactttattagttgctagcggaacttcgaataattgcgccaaaattaaggcgttcaattagggtttggccgagaccgagagggaaattgtcgggatttcaagaatcggttccggttttggtgcatttatctttctcgaccgattcaatgcttatatttaaatttagaattcattttgtaataatggacacattttttcgcccacgaaaacacacccgaactgccgggcgaaatggaacttgcgccaccggatgcgtcggtgatcggcgggctgtcgggcaataaacgcgtttgaccagcggcgccgccacgcggttctatcactccccgaatgcgaccagcagcggcagcaggttcaggcccagtacagttgttgttgctgtacatcatcaacccgacattatcgagcatcatggcctgctaaaattggtcgaatgatagccatgactttttcggggccaccaaaaaaactcctatccagtgaaatattgcggaaagctgagacgctgctttaactaaagagcagaaaacgattatgggtaccgatgaatttgtttagaattccgatcaaagattccgttgatcggattctcccccctccaacccgtccccctctcatggagtaattcttaaatgccatatcccctcgtgatcaaattcggatggcattttgcatttcattccgcacttgcctgttgttgaagatgatactgctgctgctgttggatgtggtggtgttgctgatggtgcagtccgttgcgatgttgcgctcccccacccttcagcatctgttgttgattttgctgttggttgtgatgttggtggttgtgttggtgttgctgcagttgttgttgatgttgctgtactgctccaactccgcccgttggtggcgcgtgcagtgcctgcaccaattcgctggcagccgcgttcaacagttggtgcggatgctgatgttgctgttggtatatgaggtgactgctgttgttgttgttattgttgcaggcagtcgctgcgccaaaggcagccggactgccactctcgggcgtacttggtaaggagaaccaattaattaataattagtcaattaccgacaaatttgtgcgtttgtttgatcaaagtgttaaaagagggataaatcaccaaactgatatccatgcaattagcgcaaattggttaggatcaatttagaaactgttcgagaaccaaataaagatgtatttcgtcgagggagggggataagctaacaaatttcaagataaataaacgaatatgcatcaaattttcataaaaaaccaggtaccccaagccaaaaaactcactcgccagctccgatgtattggaaaatgtcaaagttgtcgtcgtttccgatcagagagtcgccaaaagccggattccttctataaaa

SEQ ID NO: 5049 - DNA, 6603 bp, Heterodera glycines
cgcctttaacggttcacaaacgcgccaaattcttcgcctccctctctgcatgccttaagacattcgtatcggtcgattgccaatgatggcggatgcgagaataattttagcagtcgggattttgtgtccgcaaaattgaatttcgtgatttcgtccggtagacaaaagcgcttgtactcgctgaacgccgtcggagacaatttggtcatcaacaatttgaccttctgttcatcgtccaaatttgaggcagcacaatccaaagcaaattggaaacgttccagccactcctcgaattcttcagcactgtttggagaaaatgtctgaatgtcaggtaatgtgatgttctgtgctgtttgtgttgtggagggcgcattttgttgctttattgcctgggtgagtttttccaaaatatcggcgagagttttgtccatcttgattgacgatttgaaattgttgacgaattaaaaccacagatagtggaaccgcaaccgcataggtatcttggtttttgatgattccgcgaaatttaaaaatcagcacgagatttttaaatttcccaaaactagcaattcaacacgagaattgcttgaaaattgatgagttcgggcgtcgccaatgttgtgcttttagggtcacaaacaaatgttgttgaacacaagatatttattaaaacaacaacaaaataaaaagcagaatttggagaataatttggggtcaatatttagcggagcacaatatttaggcgagtccagaggagagccaaaaagagaatgaattgggggaaaagaggggaagagacttaatgagcagaatgggcaaaatcaatagtacaaaggacatggaaaagaggaatgataacaaacatcatttaaatgtccttttccaacatacagtttggagattattcagcttcagttcgaattagactagattttgctatcacatttgctcataagaacatgaaaagtggtgttaggtatttacaaattcaagtcaatctttgccatttacgacaccgtcaaaaattacaaaatgaaaaaatgtcacattgggaaaatatgaccaaatattgttgtataatcttataataaatctcataaaattatgtaccgaacatacagccggacatattgcctcaaaaaaccaaaattaataaaacaatttcttgttggatttatatgggaaaacaaatttgatcggaatttttatttctttatcgcgttaaatagcctggatcattcttttttcgacgaagtttcttctcaaaactgttttttccatcttataatgctattttcaaaattttttcaaaaaattttctattgggaaaattcccggtggtcccggtcccggcttttctcgcggtcccggtcctggtcgaaaaacttggtcccggtcccgatcccgacttttctggtcccggcaagtcccggtcccggtttttgtcaaaattcccggtcccgaccagccctactttttaggaatcgaccagccacgggttgtgctattaatgcctccctaatatcggtccactcacgaatggccttgttaatctgttctgttgttcggtgctatgattttttggtgtttgtgccgtaactaattggacttcataaaaaataaaaaccatttgttcttcattgatcgcacatcatcgtttagttgatcaattatttaaaatattttactgaaaaatgtcaaaattaatgtgatatttgaaatattccggttttcgtgaattctgtttataactttttttttattggtcggaagattaattatagcaattttaacgcgcttttttttatacatatattattaaataaataaaaatggaaaaatcaaaataaaataaaaccgaaatgcttaaataaattacacacaaaaataaaaatatgattaaatctttttgtgctttctattttttaacaaaattcgcaaaatctttgtttggttcacttgacagctgcttcatgtacaaacagacgtcagatcaaaacaaattcttttatttagcaaataatgaacatttgtgctttctttttggtttttcctatacacaaatctctgcatttagcaatcgattttgatttattttgatagatttaaaattgaaaaaaaagaatttaaaagggaattttaataaattcttttaaattaaaacaggggaaataaagcaacaaaaaaacagttttttgaaaaacaacaacctattgacactttattttaatttcaacaccttatggtttttttccgtttatagcgcatattttcggttttttaattattttaacagtttttttaagtttttagaacagttcatattttgattttagcacataaatcgaagttttataaacttaaaattaaattacttaataatgacatccaaaaatgatgtcacttttcttcaaaaatctccttcaatgagcgatatgaagccccttcgacttcgtagaccaagcattgtcagcaccagcagaagcggacttgggaatttgggagtggtaaaatacaaaatattacaaaaaaatatatatttaaaattatttttaatttatttcattatgatattttacctcttaattagagtttcgaatgttgagtctgtcaacataactacaagtataatgtaaggattgttttcagcaatgtttgaaatcccgacacttttcttcatgtattaaaacataagttatctatttattattaaatttttctaaaattttttgttgtagttttatttgaattaaattattctgaacaaataaattattcatggaaattatttttaactgtaaaatattttatttaaagttatctttgattatgatcaactgtaaaatgttttatttattttcaaattgttttgcggtgcttgttctgttgcgaccatgatttccaattctcttatatacagttcgcccaattatcggtcagcgtggccatggcgaatgttccgtgacttttctctttttattttccaataaatttgcatttttcccattttttcatcatccgttattcttttacatctttttgtacaattgtgagtttttcttcatcagtttttgatttgtatttttgaagaccaaattctttaatccatttttgaatatattgtcgatttgtccccaatttttttgctatttttgagttaattttactccattctttggctgaatattttcttcctttttgcttaattttctcttattttgtagaattttccaataatttctctttttttcttctcatttcgttgtttttcttctttttcttcccatttttctccaaatatttcatcaaatgttttctgttgcaattttttatccactgattcaacataattaatattaattaagacgatcaaaaaaataattaaagtgaataataggcatagtttcatattaattctttgattggttcttaaatattaattattttgttgttatctaaagaaatattatttgtatgttttaataatcttatttaaaattatcttagtttttataaaaattaataacgaatgattataaaatgaatagtaattattcgtttaagcttatttaaattatacattttccgcagaatgcattttattgcaaattattttaattgattttatggtttaataatgttaatgaaataattttaaaagtttgctaaagaaaatatattttatatttttgttattcagaattttttcttaacaacaaaatcaattaaagcaaaacaatgttaataataaatagaaaagaaaaaatggaaatttttaaggtcattcaacaattagatttttatgaaaattgaaattttggcataattttgccattcatttgtgtaatgcattcatttatattttatttacaattcttttttttacaaatattaaattcaaattgaagccttggctaaaaaccattgaaataataattaaaaataaaaatttaaataaataattaattaatttcttaatgaccaggcatgagctgccaccgaagcgttttttcagtgtgtttgacccatttgatgacgaatacaaacattggaacaaatacggctcaaaacggatggacgagcgattgaacagacaatgctattaccacaacaagcggcattattttgttggataaaatgccaaaaaaagaaaaacataacggcattattttgttcgacagaatgccaaaaacgattgattgatttcaatttttttgttatgataaaaaggggatctacaaaaccacatcctgggctaaatctctttgcaaaaaaaaaatagggctggtgatttaagccacgaaaaatcgccaaaaagtcgactaaaaaaagttttaaaacagcaaaaaaggcactaaaaagccataaaaagacgaaaaaaagtaaaattaaaaagaaatatccaaattaacaaaaccaattaaaaaaaaagaataacggagccaataaattttcattttttctattttttgttcctccgttattcttttacagcgaattccaaattgtttcttccattcttaattatgtctcggccgactccaattttcttacaaatttcgacataattttgtttccattctttttcaacatttttcggcgctaaaatttcatttttggccgttttacgttttacaccaattttctgaaataatgaaatttcataaaatctctttaatttttctaaaatctctttacattgtgaatttattttatttttattgaaaatatgtttattattttcgaatgagctccagtagaaagtaataaaattttatttaatcattaatttaccaattggcaattattttgtcattaagataaaattattattattatttctttgaaattaaacaggatttccttattttattaagtaaaataatgatttattcagttttttaatcagaaaaaaaatcatttaaatgcctcaaaaaatgaattgccatttaattgaagaaaaataaaataaaatcatttcgagacgataaaaatgaaattatttccgctactattattaattatattatttttaattgtcaaaattggagcagaaaagaaaaaattgcaacaaaagtcatttggcgaaatatttggagaaaaatggcaagaaaaagaagaagaagaacgaaatgaactcaaaaaaagagaaataattggaaaattttataaaataaaagagaaaataaagcaaaaaggaagaacattttcaagaaaagaatggagtaaaattaattcaaaaatagcgaagaaattggggacaaataaaacatatattcaaaaatggattaaagaatttggtctccaaaaaaagaaatgctataaatcaaaaactgatgaagaaaagttagaaattgtacaaaaattcattgaaatgataaatgaatataagcaaaaaagaaaatattcaaccaaagaatggcaacaaaatcataaagaaatttgtaagaaaattggagttggttatgacacaattagaaaatggaagaagcaatttggcattagcaagaaaataataacgaaggaagaaaaaataataaaaatgaaaatgtattggcaaataaaaaaagaaaatccgaaaatgagtgacaaagaaattggaaaaacattgaaaattagtcgaagtagcatttttaattcgaaaaatcaattagaaaaagaaagaacggaagaatgaaaaggaagaaatttactttttcgcatttttcgatttaactttatgttctttccttagcccatctcgaatcgtatagtcaatattaaaaaccacaagcatctgagaattgatgttggacaatgcgatcgttaaagaggattcggtcgaataagttaaggtatgaacttaaatattcattgggataatcgtccaatgaatcaaaatattcaatttctgtcggcgaatttacaaaacaggcgacccagtgttcacctatcgtgcccgcccggtcagtattcgccacaaagcagtacggaaaatgcctgtccttaaatttaggcatcttgtcggaagcaaaaaccccgataaaatattttcgggttgtcagatgtttggatagaaatatttcaatctcatgagaattcatcatatgcttccgtcgctactgagcacccgattagcattaatagacaaaatcgaatcaaatttccccagaacgatcatctcaacgggcgatatcaaaattaagtttcaccattgtttcacatttcgcaccatcagcaaaacgtgacgctctgtttttaaagccgctatttgtataatcatcctggtcgacatcgtcgacataatagcaagatgcttcacagagaccctttttgacatcttctgaaaatcccaattcagtcatcatatattccctaaacgcatagtcaaatataaaaagaaaaaaattcgcttttttcgtaacaaatcaggacagtcagaaaattttatatactcaagaaaaaacgggtcagtagtacttgcatgaaaaaaaaggaaaatcccaaaaaatgagtgattaggaaatttaattgtaatttttattattattatttctttaattcaaaatatacttctttttcgcatgtgcctgataataaatgctcaattgcatcatttattag

SEQ ID NO: 5050 - DNA, 2323 bp, Heterodera glycines
  misc_feature (2177)..(2177): n is a, c, g, or t
  misc_feature (2288)..(2288): n is a, c, g, or t
  misc_feature (2295)..(2295): n is a, c, g, or t
  misc_feature (2313)..(2314): n is a, c, g, or t
cttcaaaatttcttctcctaattgtttcttccaattgaaaatgctctttagatgaattttcattatttttgcaattttattatcactcatttttggattttcactttttattctccaataaattttcattttttccattttttctttctccgttattcttttattgcttatgccaaattgtttcttccattttctaagtgtttctctgttaactccaattttcttacaaatttccgcataattttggtcccattcttttcgtgaatgttttctttttcgtttaaattcatttttcatttcaatgaatttttcgacattttcaagtttttcttcatcagtttttgatttatagcttttctttatttgtttttgaaaaccaaattctttaatccattcataaatatataaacgatttgtccccaatttcttcgctatttttctttgaattttatcccattcttttgctgaatattttcttcctttttgctttattttttcttttattttataaaattttccaattatttctctttttttgagttcatttcgttgtttttcttctttttcttcccatttttctccaaatatttcatcaaatgacttttgttccaactttttattttctgcttcaaattggtcaaatttgatgattaataaaataaatttaaaaaatagcgggaataatttcattctttataattctttggtaaaaacttttaaattagcaattttgtaaattaatttattcaatttaatgattgaatttaggtaattatgctgctttatgaattatttatgaatgtatttaaacgttacaaatgagaatttattgctttgtattgattataaatatggattaatttaaaagtcaggaaattattcggctaattcagattatctaatgcaaattattttcaaaattattattcatagtttttcagatattttttaaggaaaatttcttcaatttttcttaaaatccctcattaaaccctccaaaatctcttttccaaattgttttttccattttgaaatgctctttctatcaattttcatcattttgcaattcccctttgattctttttttggattttctctttttatttgccattatttttacattttttccattttcggctatttcattaccacgaaatgccaaattctttctttaatcttttaattacatcataatttactccaatttcttacaaaaagcggatttggcaaattttatagaaatttataaatttcatcaataaaaaaaatggcataatcccgatcctgtgctggcacaggattcgaggcagtaggtgcattaatttgcaccccgctgactaattatgagtattactgttaggacatttttgtaggagggcttgtaaaaaaaaattttttttaatagaaaaatataatataataattcagatttcaaactcactcattcgtttgttcgttcattcattcattctattaatggccccaagtaaaaaaactccccccccccccccccaaaatgctccgtaaacccaaaaaaacttgtaaaaaatgtgagcgttgccaagaagtgcggttaatggcagaaattaaaaaagagaatgtaaaggcaggaaaatgccggggagagcatctcccaggcatgatcatagaagcccacaaaactaagcccacacaattcaaagaattgtatacggatggggatggtgtgcttgaaaaaatattggaaggtattccgagcccctacagccggaatatttttaaaaaatattgaaaggtccagcagttgtgcattgcgatgaatgtgccaatgactttgcttattataaagatttgtggaattgttcggggagtatggactgtggatggggtccgggcatctcatggattggagaagattgtttagtattgcattttataaattcttttccattgtgtacatttattcctaaaacgaaaagattacaaaatttgtttgtccattaactgcaaacggtgctctaatttcagtgaggttctaaatatatttttaaacaggaaacattactgacaacttgccctcggattcgacattgagtgcgttgtgaaaaaaaataaaataaaaaagctaaaatggattatttttttaaatgtgcaaataaagtgacttatgcaataggcattactgccttttattacgncaaaatagttggcctttttttcataaaaaaaatcgctaatcattgtaacataataaacttagccaacagcaaatagaattatataaaatctaatcatcatcattatcatantaatttnatgcattacagaatttanngaaaatgtt

SEQ ID NO: 5051 - DNA, 2172 bp, Heterodera glycines
ccccccccccccttcagagcccgacaaatatttcacaaaaaatttgaaaaattgactagagcaatcaaacgctaacagacgacctaaaggaaaaaaatccccgaaggagagaatttaattaaatcaattccttcgggggtccgtgccgggtgccgcggggtaagcagtgctggtttcgtttcatcacggccccatccttttgactagtcagccagcgttgcttaacttgtcagatcggacgggtacgcatgattccattttccaagcaccccaccgaaagttgaacgaaataaccaaaatataaggaaaaaatttagaaacatttttattcttcatccttattcataatataagcctaagaggaccttgttaacatgtaaataaaatttggtgcgtttcagagcacgttctgaaaaaattaatatgaattaatttggcaaaaataaaaatagaagactcaggattttgaaatttttataacaactgatgacaagctaatgtgataaaacaggttaattcttttcctttcagtatcactgcaaagtttggggcgcttctgataagtttctgaaaaaaaagttaagcctaaactttttggcatgtttaaaaaggaattaaaaatttttaaaatatttaaataagagtcagagtgccttattcaacttgtaaataaattttggtgcgtttcagagcagtttctgaaaaaaaagttaagcctaaacttttttgcctgtttaaaaatgaattaaaaatttttattcttcaccatttttcataatatacgcctaagaggaccttgttaacatgtaaataaaatttggtgcgtttcagagcacgttcagaaaaaattaatatgaattaattttgcaaaaataaaaatagaagactcaggattttgaaatttttatattcggtctccccataaatctgggcgcatcggttcggggggactgccccgaaaacaaaaaaatcgattttttcaagtgtccgtttggggtactcaaacaattatggggagcaaaaatctatttttttttatttttctattctttttttttaaggattcggtctccccataaatctgggcgcatcggttcggggggactgccccgaaaacaaaaaaatcgattttttcaagtgtccgtttggggtactaaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaaaaaaaaatcgattttttcaaggggccgttttggggactcaaaaaattttgggggaagaaaatcccacccccaaatttaaaaaaaaaaatataagggaaaacttttcccgaaagggatttgggtccccccataaaatttggggccattgggttcggggggggatgtcccccaaaaaaaaaaaaaaaaattttttttaagtgtcccctttgggggaatcccaaaaaatttttgggggagaaaaaaaaccacccccaaaaaaaaataaaaaaaaaataaaaggggaaaaattttttcccgaaaaggtttgggctccccccccaaaaaattttggggggggggctgggtgtgggggggggggggggggccccccccaaaaaaaaaaaaaaaaaaaaaaaaaaaa

SEQ ID NO: 5052 - DNA, 2604 bp, Heterodera glycines
  misc_feature (1755)..(1755): n is a, c, g, or t
  misc_feature (1765)..(1765): n is a, c, g, or t
  misc_feature (2564)..(2564): n is a, c, g, or t
  misc_feature (2587)..(2587): n is a, c, g, or t
  misc_feature (2598)..(2598): n is a, c, g, or t
caaaaatccaacgcagaattaaagtacagactatagtgttgctattcccgaaggattcggtctccccataaatctgggtgcatcggttcggggggactgccccgaaaacaaaaaaatcgatttcttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaaattttctggaaataagcttaatagggcctagttaagctgtaaaaaaaaatttggagcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaattggggcgatttgaatgagaatagaaagagccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctataaaaaatttaaaaatgagaattcatgcgagattttctggaaataagcttaattgggcctagttaagctgtaaaaaaaatttggggcgatttgaatgagaatagaaagagccaggttcgatgaagttttggtaagccaaaaaaatatccaaacatttaaaaatctataaaaaatttaaaaatgagaattcatgcgagattttctggaaataatcttaattgggccttgttaagctgtaagacacccaccacttttgcacttaaaaaagaaaaaatttgatcgttcgataaataattggtaagccaaaaaaaaatccaaacattttaaaatctataaaaaatttaaaatgagaattcatgcgagatttttctggaataagcttaatatggcctagntaagctgtanaaaaaaatttggggcgattagacacccaccacttttgcacttaaaaaatttcaaaaaatttgatcgtccataaataatttgtaattgatcaggggctcaccaaattttgcagagatacgtatcggaacactacaaaagattactaattttcctagatttattaaacccggtgaaaattttttgcacacacccaccactttttcacttaaaaaaatttcaaaaaatttgatcgtccataaataatttgtaattgatcagcggctcaccaaattttgcagagatacgtatcggagcactacaaaagcttactaattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggaacactacaaaaccttactaattttcctagatttattaaacccggtgaaaattttttgcagacacccaccactttttcacttaaaaaaatttcaaaaaatttgatcgtccataaataatttgtaattgatcagcggctcaccaaattttgcagggatacgtatcggaacactacaaatgcttactaattttcctagatttattaaacccggtgaaaattttttgcagacacccaccacttttgcacttaaaaaatttcaaaaaatttgatcgtccataaataatttgtaattgatcaggggctcaccaaattttgcagagatacgtatcggaacactacaanagcttactaattttcctagattnattaaccccgntgaaaa

SEQ ID NO: 5053 - DNA, 3347 bp, Heterodera glycines
gacgccaatttgtgccacatttgtgctccattttctcaactcatgcgtgaacaacgggatgtcattttttatttttttcggcaccatccagcacgcatattccatcagttcgggcttcattgtctcctcattattcaatgctgtctccggcgcgctggtcaatttgatcattatttagtaagttcatcattaatgaaaattagataattatctcttttaaatattatcaaatatgtttttcaaaattgtttaaattaaaaaaaataatgtttatataaaaaaatattcagattaattcttaaatattaaataaattaaacttaaatttataatatagtaaactataataataaagatgtccctagaaaacagtgaactttttaactaaataatgattcaaatcttttgttgaaaaaatagaaattggaatgttggactaattatttcttaacgaatttttctttgaaaaagcccttcaaagtgcgagtttttcgaaatggttaaatcaattaaagtcttttttttagaaacagctttttcaaatccgacagttcttagaaatgattaaaccaattaagtacagtcttaaaagcggccaacccaacccaattcagtacaacattcctagaaacgatggacatttcttagaaaatgggtcatccatttaattagttcctgaaatacaatgccaatttgagtccttaaaaactatcattttttatcgtgaaaatttctcaatttaagccatcatccagtgctgaagaaaaaggccaagaaatggttgttgcgcattgttcagctgccaaaaccccgtgtggacgatcaaatgcttgcaacaaagcgcttgagtcaaccgcgaaacatttatggccaacatttgttgaaccgatcggagcgcgaaaatcatttcaaaatgttgcaaaaccagtggatgcaaaccagcattgatgtggccacaaattttactagtgatcagtaattattgtcgttcattggtgtggtgttttttttggttttgtttatttttacgtcagagatgtaatgatcaaaaaactttcaaaataataatttcgaggcttcaaaaattttcggaaactcagaatttccgctacatacctgatgtacagtaagaatttcattttacaaaaaacaaattttcatttgtatgtatttttgtgtacatatgattttttgcttttcgtttcaaatatttaaatttttctatggctaagattgtatcaaaaatatttttaaaaaatttcctttttaaaattaaattttcaattgaacaatttgtctaacaaattagttattcgaagagtatattttagtatttactctgaattatgaatttaaaaagcttgatttatatttgaagaaaaaaatagaatattaaaatattttcgatgaatcactcaaatttgattttatttctctttattttatgtgacaaaagaatttctctcattttcaatttcttgttgagtgaatgtgaattttgtaagtggttgtctattattgtgttcttgtgagacacatttctccgttattgtcaccaagttgaagtatatacaaacataaattcattttcccatatttaaatctttacttttcactattatgcacaattttttaatgcaacaaaaaataaagttaatttaattgaattatattatattgttattttattattttgaaacctgacctataagttttttttgattttttttttgatctagttttggtaactaatatggatttaggttttttacgacccctttaggcttagaaaaaattaatccttatttttgtccggttttcaaagctaatttattttattttattttcaagaaacccttttaaccaattgtgttttttttatcttcggggccaaaagtgatcagaaattttagaatgacatttgagtaataactgttttttgaatgtcagcaaaatacacaatctttggctggaaattttggttgattttttctgatcagttttggtgctggagccgaaaatttacaatagcccatgctatactcaatcaaagtgattttaaagtgattttggcacttacagttcgattgctgtctattaattgtgcttattttagcgtattataatttttttgcgctattttttttttttgaaaattatcaatttagacaaaaaaaaattaacaattagtaataattttaaagcaaaatcagcacaaattaattctttttaaaatgagtgatttaagtaattttgcaaccatcataattgaagtcgtgctgtgcttcgttttgccggtacaaatttaaaagaatttttttatttaagtaatatttttagcccgttgctattcttatccattcgggggaatgcaacaatcacgcactcatttcaataatactctggtattattattttttttgtcaaattaaataattaataattttaaattttttaatttatttagttttttgttgtggctgcccgctgttcttcacgcgctttggtactgcttcttccgttgaatgagcgaaaagaggaaaataatattatgatttcttcaaagtcaattttattttttgatgcctcgttaaatttaatataaatttaaatttattaaaaagaaaattttttctttatttgaacaaaaaaaaaaaactttttcattttattgcatttttattaaggatttttccgtaaatccataaaatctacgccaaaataacgaaatatgcattataaaattaatcttagaagcttcaaaccaatataaaaacgcgttttttgtgcttatctgtgagttattaaggtgcgcaaaacaaaaaatggttaatgaaccggttaaataacagaaaaattatttgtgaacgaattaaatattcaaattaaaggggaaaaatgcaaaacaaaggtttttgaggctttttaaagcaaattctcggattcgagacacgagaatggaaacgaaaaggtgctaggtcgtttcttaaaaaccgccacattgggcgtttcttaaaaccgccagggcgtttcttaaaaccgccagggcgtttcttaaaaccgccaactcatatgattatgtatgtatatccgttaaattaaatatacaataatatctattaatttttatttgttgtgcaagtaagtgtcagccggaaatattattagtctagcagtgacagactaaaaatctttattaaattaatttacaattatttacttaatttttatttggttgtaccaataggtgtcaccaggaaatatgaggctggtagaattattacaatttaaagggcataaatagctaaatatcaattgcatacatatattataaaaaaatattattg

SEQ ID NO: 5054 - DNA, 3955 bp, Heterodera glycines
aattggccgaattattgggacattccaaaacgatcattagcaaatacaaatcggattttaaagaaaaataagatgctttgaatacagaagcgaaactttcatttttttaaaagaaaatataaaattattcattaatctcgagaaatttttacaaaaaatcactttttcgaaaagtcctatctttagggggtcatcaaggtcaatttagctgatgggggtctgttctaatagagttttttggaaaaatgactctaattatggacataataccaaatatgaacaaatatggcgggctaaatcgcgaaatatggaaatagaactccgtccaagaagcttcaaagtaagcttaaaaaaattacgtacgcctaccacattccagcaggaaaaaactatggacattttcatataattttatgccttaataatgaataatacacaaacgacagtatgattacgtttacaatatctcagtgtttgtcaaatggtatgctgtatcctcaatttccgctaagttatgataaaagtcccaatttttgttcgcaaacacaacaaaagaaagtgtttttcctactatttagaccatgtaaaacccaggaaaaaaagatgtatttaaataaaattgctagccttaattatcagatagtttttttaggttcggcccttagcacgggaagatgggaaaaaaaactatttttaatcgaaaatttcggaaagtttttcaacaatttttgtccagacacttttctttttctccgtcactgctttttcaaatttctccaatttttcttctaattgttgtaacattttttgaaatttcgaattgttcctttcattttgaaatgaattcaaaaattccttcttccattctgtcaatttttcttcaatttctttccatttcttgccttgatcatttttataaaatgccaatttcaacaaattccattctatcatttttacatcacttaaattggcaaagtgccaatcctcgtttttaatcatttctttcaaatgatcaatcaaagggtgctaggtcgtttcttaaaaaccgccacattgggcgtttcttaaaaccgccagggcgtttcttaaaaccgccagggcgtttcttaaaaccgccaggtgggcgtttcttaaaaccgccactttgggcgtttcttaaaaccgccagggcgtttcttaaaaccgccaactcatatgattatgtatgtatatccgttaaattaaatattcaataatatctattaatttttatttgttgtgcaagtaagtgtcagccggaaatattattagtctagcagtgacagactaaaaatctttattaaattaatttacaattatttacttaatttttatttggttgtaccaattacgaattagcaattttatattcgaaaattttgcagttgataattgttgctataaccaacataaataaatatcagaaacgttacgattgtgatattaaattttgcaattgccttaatgaatatcctaattgctttcaaacaaaagtctgttctccaactcatatcttaaatattttattttttagaatatattatgctggtcagttcatatttttggagaacgttttaaagaaggataaaaataattattttattttaccgtcactagatatgcatatgtattttaaattttttattgttatgtaaacttctaatatatatatatatatatatatatatatatatatatatatttatatacataatcatatgagttggcggttttaagaaacgcccaaagtggcggttttaagaaacgcacacctggcggttttaagaaacgccctggcggttttaagaaacgcccaatgtggcggtttttaagaaacgtcccagcaccaacgaaaacactatactgagaaaaaatatccgggaaccgcactttctttttatggataatatcaatcccgcattccgtgttttcaaatgctcatccagcttcatccatattttattatgtgctgttattagatgattagagcctataagtcagtcactcagatttgtttgctgcgcaacttaaatttatagaatagaaattttttgggattcctgtacataaattgtacaatctttttatttatttaaaattgcatttttaaattgtaatgtaaaaatcaatcaatgcaatcaatgcatacttctaaattgtatagtaaatacgtcatttgcacataatgcgcttcattaaaacacgtcaattaagcctactctatttgttgaataatgccaattgtggccctctcaaagtgcctctccccatgtttcatgccaattttgcctctccccacaatgatgccaattttgcctcacgccctctctatctctccctttctctctcactttctctctctctctctccctttctctcgctctctccccgatgccatttttgcctctccccatgttttcgtgcaaataattttgcttctttgttgtcaattttgcatgcctctttcctcttgtttcatgccttatttcggccctctcattataatgccaacgtgtgatttattgaaaaaattctctgcaatataattttgcataaaagcaaatataattcaatttggcatcatttttttgttgctcattttggtgatattgaaagagattcttttccttacaaagctttaaaatagtaaaaaaaaatttagatttttttttgaaattgaaatgttttccacagtttccattgcaacactttttttgataaatgcttacagtttctattcaatcacggcagaagaagcgaatattggcaacattccggcaagcaatgacaaaatgccaaaggatttggcgagtgatgacaaaatgccaaaggatttggcgagtgatgacaaaatgccaagatcaggtaaagtgcaaagcgaaaggggaatggaaacgaatttgacaattggaaacaaaaagccaagcaatgacaaaataccaagatcagctcaaataccaagcgaaatgggaatggaaacgaattcgacaattaaaaacaaaacgccaagcaatgacaaaatgccaaaggatttggcgagggatggcaaagcgctgcaaagcaaagtcaaaacgaaaaagaatttgacaattggaaacaaaaagccaagcaatgacaaaatgcaaaaggatttggcgagggatggaaaaacgtcaaggtcagataaaatgtcaaacaaagacataacgcaaagcggaaataaaacggaaacgaatttgccgaatgaaaataatttgccaaataatgacaaaatgctaaatgacgatacagaattacttgacgaattcaaaggtatttttggtagaatttttttttaagtttaaatttttagcattactgaagagtgacacatataagaccaaaggagccaagtaaatttaataaataatattcaaaataaatgtcaaataatttaaatttattagggtagggctccgatcatttggggtgagaaaagtcggagttcgtcggtgacatttaggcgagatcgggtggaccaaaagggtctgggtttttcaatttttgccataaattaaaaacaaatgcagccagaaaatttaggaattcttaatgaaattatatatgttttagacttttgaacaaaaatcaaaaatttgacaaatatattttaaataaaattttgaattttgccattttaattttttttggcaaacggaatggaaccccaacaagaattaattaaatagtgtaatacaatactaacaataagcacaatattatcgaaacaatactcggcgaaacaaaattatattttgatcaaaaactttcggccaaagataattaaaagcgaaaaattgaacaaactttttttcttttctctccgtcgttttcgaattccctaattgccttaattctcgggggcataggccttatccaaatattaaacaaagctcacttttgaatttaagcgttttgg

SEQ ID NO: 5055 - DNA, 1516 bp, Heterodera glycines
gcacggtcgtacgagccctctggccttgagaacaccccctccgtatcttttatcgcctcgcccccaacactcgccgatttatcagaaaattttatacggaccgtcgaaatcaccgtttcgccgcgaaaacgtccgctttcgaaaagtccggtagcctaaacgattctctcttccgacaaagaaatagaatttttatccgtttgcttgttaaagttcaaaacaaagaaaaatcatttaaatatgtacaataaatataaatcattttgttccctgaggggttcaaagtgtcatgccattcttcttcatcttctgatcagatcagtcaactcatccggctattgttttcacacggatgtgtttaggccgagcagttggtgcctttcctcttccgttccgccggcaccgcgggttggcaccgccgcggcatggcgcgccctcagctcaccgccagccgatggttcgggcactgcagcgcggcgcggtgcgccagtaagcagcatcggatgcgctacgccggagccattttttgcagcattaggcgaagtagctagggaggagctgaggccactcttcgggcgcaacgacgtctcagactcgagactcttgagcaaaacggcatttttaaaatcatccgatcagtcagaacggacacaaaaacgggagttttgttcggttggaatcggggatgttctgggttcccgagacccgatttttccgcgaccctaaacccgtagactttttcccgacccgaaaaaccagctgttgggaccctcgggcacttacccgagggaattgctgtcgcattggtcgcccaccggcggactgttcttgttccttgcgacgacgaactttgacacaccaacagcacaaaaagcagagaatcagcacgagaatggcaccgacggttgacagaatgcctgtcagccaggtcaactgaatgtgcaaatgtaaaggtgaagttgactggccaattcaaaagtgcatttattgggtcattcgcaaaacggacagaaattcaaaaacttaaatgccccaatttaccatccgaatttaaatgttcaaaatttggtgctgcattgtaatagaaagtgcactcaccatgttgtccatctctcgcgaacggcaccacggctgggagcctttgttccattcaaaacgccacatttgcggaaagttgtagtccaccacttgggtacctgaacttttcataaacagggagaaaccttggcacatttctctctagttgatcacagattactttactattttctgtctgtctaattctacctgtcactttaatttggtactttgaattagggttgctccccgtccccgagctccccgacatttttgggcctattccccgccccgacccccgacatgtcgctccccgaggtccccggcccccgacattttgcccccccccccccccccgaggggtcggggacagggacggtcccaggattttggcttgggggggggcacctccccccgggcgacgaccaagggttttttt

SEQ ID NO: 5056 - DNA, 1932 bp, Heterodera glycines
ttttgatccaatcactgtgaccgttattaaattatcaattcgaatttggcagtataaatttcatcagattgttcctgatcagtccctggcccaatcaaaggagtcaaaaagctcatatcccatgttttaattgttgatcgtatttcatcacatttaaactcggcatcccctttgatccagtgagtttggaagcactcgaaacgcgcaatgtccccctggaggtagccggaggagagtgccggagttttgatcagatattccgggtactcaatgttgatcgggccacaactgttatctgcgcaaattagggacaagacgattacaacaaatttggcattccgtttaaaattggaatttgcgccaaaaatgccgtacaattttgaatggcggaccaacggtcatggaagaacgcgttccacgtgtccttcacttcgttgcccaacacttccgcgttcagcagcgtgtaatcgtacagacaaggcacattgtcaccacattcttgcaagatttttccgggattgtccgggcattggctggcccagtcccagtacatttggccttggtacggctgaagaccaactgaagagttcaagctgtactcagttgggtatcagtagcagcaggagacagcccgaataaggtgacactttgataggtcatgtgaaatattaaagaaatgatttatcatcgagagccgagaaatggcttcaataatgagaagcctctttggccccaagattaagaccgagaatttatcccgagaaccgagacggtggaaatgacgcgaagtgtttagaccaagaattagtcccaaccaaagggtatgcgaaatttcgtgttgttttcgtttcgtcctcttttttcgtcactttttcagtttcgttttcgtccatcaaaatattttcgtttcgtttttgaatttaaaaattttaaattttcgtccttttttcgttttcgtcaaaatttttttttgtttttcgcatacccctgtcccaacggcctttattggcaatatttagactctggtgccctccccgtcaaactcacttgtctctcggttggccaaatcgttgcactgctgcagcatttgcattagcacagcgccggtccgaggcacaaaacgatactgaggcctaagtcggatggatcatttgtccgttccccctcatagtttgtttatttttcccctattatttattacgtttcgtagatggccgccgttttgtagatgggctcacttttgatggacgcctcggggaacgcctcgaacttcttgtcctcctccttgctggtggtgaacatgttgtcggtggggatttggaattggttcaacgcctgctgctgatagtccgtgaagcgttcgccggagcccgggattcgatctgcggaaatatgccaatgtcaattcaaaagccacacacaaaagatgccaaaatttccttttcctgttacagtaaccggacaattacagtatcccaacaattttgctaactgtataattgaaaaacctacagtagttgatgatctgttgccgtatcgcctccgagttcacttcgttcagtgtcagggtcgagtaaatggagccggtggacgtgtcggggaacggcctcatcaggccggacacccgtggcaaattgtaacgttggcgtgtctcctgctcccgcgttttgtccccgtccggttgctgtcgaaattcaaaattttgaacaaacaaattgccacactcctcaaacttaccacgccgtactgcggtggcaccgacagggcaatgtccaacatgcccatggactcttggtacatcggcatacggtcaatgtccaccgcgtaggactctctgatgcggaccccgatctgagcttcttccagcacaacgtacacctcgggctgaccccgctccacattgttcacgtagaccagcacaccttaagagag

SEQ ID NO: 5057 - DNA, 3646 bp, Heterodera glycines
ccgaggtacggtagcggaaccggcgcgtgtctccgcgtgccatcacatgcacgcggtcggtgccggtggcctccagcgtaattcctatctcatgaattgtaattagccacctgggcgattgattgggcggagcaattaccggtgattacagtggcgttggtcggctgcaccaactgttcctgggacaggtagcggccgagcatgccttttttttgggggggggggaacatattcattttttccccccattcccagccacaatttgtcgtactgaaatcgacgcgtcggttcgggtagcgctcaagtcggatttgaatgcgtacttccgggttgttcaccgtcttcgggatgtacaacagtgtgtacacaccgggctcgttgaacacaaatttgtcattgtcaattgtgtggaaagtgccggcgcccatcgcttcgcctgcgcaaaaattatttcaattttttaagagattgaattcacattgatattcggcacttaaagctaaaaagaaatgttttattaaattcagggcggcccaggcctgggtttttcctggatctgttgggcccgttcccagccattttcgacaaaatgggtttttctattttttaattcagatcaaacatagaaatcaatcaaaattcaggtacagattaggcttattaggcataaaaaatctgaatttcttggataaaattttaattttatttcaagttattaaaaaatgttaattattaaataattaaggaaaatataattgtcagttagataatttagatgttcctaaacaattaacagatttaaaaaaattaaaactaatttcgtgaagtctaagcctggatccaggccttgacaaactttcatatctcactgtttacaaatataaaatcaaataatatttcagtgcaatccgtggcgcttgattttctattgttttggcttacatttcaaataggcaaatacacttttcttatattggtgcattaatttcatttcaaattggcacaaatttccccccccccccccccaaatgccattaaatgttgcccatgtactaccgttttgccttctgtgcttaccaatggccggcggttggtactgttggcatccgctgcttggccgccgccagtagaacagttgacagcgaaacttggcaaatttgcagcacagaaagtatggcatgtagtcgtggtgaaacgcggacagtccgggaacttcgaactgtcccatgtaaggggaagtgccgaattcgtaggcacgcaacggatagcccgggttgtacggcgtttcttcaatcactttgataaccggctaaaaaaattaaaaaacatgatcatttgatcataaaggcccgaaggctttttttccaaaaataggataattaaaattttttttacaattattttaaaacaataaatttatcaaaagttaaaataaaatattttttcatgtttttgttcattttctggaacaattccgaatgccgagctctttcaaagatcaatcccatctctctgatcaccttttctttgctttaaaattacgcttttatattaaattctgctaattaattgaaggtgagtctaaattgacctggtaagtggtctgcatcagaaagcccttttcgtcataacagcacacttggccataatgcgtgggaaaacggctggacaaatgaaaaatgttttggaatgtttgatcaatgaattttcattggccatttatgggcccattaggtccctaatagtacttcacccactttccctggttcctctcccgtccataataaccgccgtaaccgaatggcccagcgccgccgccttcggcaccaccgggaggcacgccttcgtcgcggaattcacggccaaactcgccgtaggcgtagccgtgaccgtaatcaaaatgctggccagaataggagccgtaaatgttggaggcctgtgaacaaaaaaggatttatcagaaaacaggaaaccggaaaacaataaataatcaatgatcagccgatcactctgaaaaaggtgatagaaaaaggggtgattaggacaaaacaatataaatgggaaaaaaagaagggactgatcagacagaaaacgtagcaaaaaaagagaacatatcaatgtgggggaaagataagaaaatttatcatactgattaaaaaaaaactaagatcaagtgctgatcagaaaaacatttggataatcaattggaaaaaataattttttaaaagtattgattgatcgggcagaaaaagttgagtgatgtcagctgataaaataaaaaaaccagaaatggtttttagcttcacgatctctgatcagactgacaaagaatgaaaaagaggctgtgctgatcagcgatgacaaaatgcaaaaacatacgctcatgtagcagtttttggcaccgatggtcgacgtgcaggcgatgtcgcggaaggtctgcgagcagcgcgggtgcggcatgaagcggcccaagtcgaacttggcctggtgctccatgcacgggcacgacgcgttggtctccacgtcgcggatgaaattccacctgaacagaatgccaataattttttttaacccaaaaaatggcacttactgtgccccgtcctcatcgtaccaatcgtggcacatttccttggccttttgcgaaatgaacgcctgccgtgagtccgcctcctgacgtgaaaaggttgtggtgtcgtacatggggttgccgctggtccacaaccaatgcagtgagatgggtgccgacacaagcctatttgtacagtatttatatcgtattaatttttcggtatccctcaattaatgatctcgttccgaaagtcgttaggaaatcacaaaatttattgctcgatggcacggttttaggaacatgattttaattaccataatctcctgatagttagtcacacgtgttgtattagattagaggattaagtttatttggggaatcttgagacccaaattttagcattttaaatatcattttttggcttaatcaggcatgatatcctttaagagaaaatggcaccaaatttcttgttatatactgtagaatataaacggtaacgcacccgcagggttggactttaaccaacggcccttccaatttaggtagctcaataacttttccggccacggtaaatgttctactggtaaccgctgcgctaatattcgtcccacccacccggacagcagttgcggtgccacaaatgcttgttcgttggtgcgcagcggtgccaacttcaaatagcccactcggtaggtgaacagttcgttgatgcgctcccagtcgttcaggtaccactgctccacctggttcaaattgatgcgctctttctgcgcattccaccgatattcgtaggtgttccgattggaataggtggccaagcggcagagaacgcgatgttcgggccggaattttttgatctgaccgggacaaacgatttaattttttgcttaaatatttttcggaatttataaaacaaatcacaaaatcagagtcaaaacaaaagccaaataattatagctagaattttgccaatttcatagaacctaatcatcggaatgggatttcaaaaatctgccaaaaaatttcggaatttccttgcctggaatcacatcccaattgaagcatagagcaaaatga

SEQ ID NO: 5058 - DNA, 7237 bp, Heterodera glycines
  misc_feature (26)..(26): n is a, c, g, or t
ccgatgtgtgggaaggcgcaactcgncgggagaaagtcgccgaagtcagcgaaaggaggggcggcaccattctattcggcattggaacgaactgttgttgtgttggcaacgtcaacttctcagtggaatcgttatgccaaacaattttggaaaattcgctttttgaactttgattcgttgactttgaaaatctgtttatttttgccgggtcaccaaagtgatcattttcgtgacagttttgcaaagagtcgctaaggggtcgcggtcggacggaatcgaagctgcgagtcccaaaaagacgaaaaagtcgtcggtcggagtgctgctgttcctctgcagcggttggttcagctgtcagtgttagccttggggaactgaacgattgataaggcaaagttggacaaacacgcacttggcattctcatggaaatgtcggctgctccgttggcatttctccgtcggtttccgtctgtttttccgattgctcaccgactcccactgctcctcttcttcctctatctccagcgtcattcgacgttgttttgccactccgtttgctgccaccgcaatttggtatgcttcgacgctctcctgccgttgaaacccggcgaatgccccgcccatcggcgtcgaatagtgcttttcccaagtttcatcgaggccgccttccttcgttgaaatgccgcccattccattgagtcgcggcacgtccgttattcgaggcaccggagagggaagcatcgtggctgccaatttagccgggtcccaactgcgattgtcgtctttggcacattgtcggagcacagattcgttgcgtccaactgcaaattgtacggaacaataagcaagcggcggctcagaatgggcacggcgccgttttcggaagaggcgaaggttttctttttcgcacaggacaagtgaactttcttcgaaacaaccacacataacgccatcaaaagtcacttgagcacattcgccaaaacattttcccccggcacagcgaaagccatcaaaatgttggccaacaacttccccattcttcggcatttcctccagcgagtggcaaaagagacggcgaagagtttgatgaaaggaagcgcaatggacagagtcaccttaagacaacgcaacactcaaacgaaagccaacgaatggggaaaagcaaaggaaaggaataaatgacaaacactccgaagaaacgcaaaagaaacgactgacaaagaaaagaagggaaagaggcagaaacagaaaagagacttaaaatggtctttgaaaatgcgaccgttgtggagaatgggctgtgtaaagaatgaagtcggttggggcactgccgtcgttggcagaggcgcggccgaaagtgccaacggtttaaaggtcgccctgggtgaatacccgcactgtgccaatatttgcccgaggtcgaactccgtcctttgttgccccgccgcgttgtccgcttgtcggccgctgcttgggctcggtgtgtttctgttgtgctccgattggtccgtgccgtggtgtccgtgatggactatcagttgcccgcgcagtgcacccccattgattgtcaacggaaagtgcgtgtttccccgtgccaatgaatgaacgtcggcaccgatcggagcaccgcccgttttgattcgagcctagcacaataagcctttttctaatcaggcatttcgacagggagaaactgacaaagacggggtttccgttgaatgtttttccgagtgtttggagatggaaaaatgccatttgagtgtccttttcagaggcaaaagtgacgtaccaactgaaaacatttgggtgaatggaaatgatcagcagaaatatatttgtctttgctggaggttccgtcccatcgcaaaaccgaaattccttttccgcccgggagagtgaaaaataaattgagccacgaggactcaaattgtgtcatttggcactttcacctgttgttgagtccgtagaaaagagttcggaagggtgggcatccgtcgccgaacatcgcttttacctcctaaattggtccttgcttcgagactgatcagtctccaagcccaacaacaatggctaattaattgttggtccttcgaatgcactgactttttcgtcggcgtctgcgggaatctcgcgcaaaatgatggtgcaccgtcgcgacaatggcctcaccttttgaccactctcatcgacttgcaattggggcgaagctgaaagtgtaattaataattacgatatttacgatttgtaaaatgaaaaaacggaaaaagagacaaacatttgagaatgtccacgattaggttcaagtcggtgctcagttgtgacacctttgagaaaagaaaccgtggcaaattggaaaaaatgggagacttttgggaaatttgcgacgattttaatgggcacgtattggtcagcgtccatttggcatctcagataacggtcgttgaccaggttttcccttcaaaacgaccactgatttcgcaatctccgaagcggacctgctgaagtaatattccaactgtcgtcggatgcgttgtcgcaattgttccgggctcatcggctgctcgccgacgctcgacggcggacgcgtgtcgggcgtcggcacgcgttcatcgggcggtggcggcggcacgcccataagttcttggcgacattcagcggtaaaccaccagggaagcattggcaaaggcgagttggaagcgcaggtggaaagaccggcgaagggaaagggacgcagcgcggaaggaaaagcgggcggagaagcggaagccgactgaaacaaaaaccattaaatggcattcgaagaagcattgaccgtttgagagggccttctcatggcaaatcccttcagggcgtcgtcgacgtcactgagctgaaaagggaacaaatggcaaggcattcactgctgtaaatttatgcaagtgttgtctaattggttcatctcattggatttaattatacttttaaaagtgcgaattggcacattaaaggcatagacagcattcaaaaaaaataaaattaaaaaataatttttaaaatttgcaaagacaacaaaagttccccaattcgcaaaatgctctgatgagaggggggggggggggggggtatttcacaaaagccaatcttgtccttccctgtccatgtatgtacctacaatacatcgtagggtcggggtcattttggcgcagacaagtttaaagattcataactttttttaattcgaccaaataaaataatgttgatattaattagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaactccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctaatattaatcaataggtctaaatgttctttattagcctgcaaaatttcaaaaaattatattaggttttaaaaaagatatggcgcgctgcgccaaaatggccaggaaaatgcaatttttgaggttttttggccataacttttttgtttctcagctaaattttttgaaactttgcaggttaataggcactatcaagccacttaaaatcataccaatattatttaattttgctgtgaaatcaaaatgatatagagtcttgcgccaaaatggcctgcgccaaagtggccgattcccatacatcgtatgagtctgtcttttgtttcaatttttcaaaattttaaaaatcttctatttatttttaaattattttctcttttcctcgtgttcattttttctgatgcgtcccaaccaattaataattacgcgtttctttaatccttcggttccgctcattaaaccatttttcgttgctgcaattttcacctgttgaattgtgtagcatcgtggcgaaatttccgtgcacatgaaaaaagcaccgccgtccaattcgaagccgcgcatttttaaaaagtaacgggggaaagattccccctttccttcgtatatccgttaatatcagaaaagaaaaaaatgagaaaggatgcttccgctaagaagcttaacagttctattaatgaagagaatgcttctgaaagtgaatggatgaacaaaggcaaaaaaggagttgagtagagggaaaagcctacacggacagcatagagacagaagcgaattgacttttaaagaatacagaaaaagagagaggaaagagagagagagagagagacgtggggagggtgggaggatgagagagaatggagaagaaagagagagaggagagagacggaaggtgagggagagagaggagaagagagagagagagaccgatggtgcgagagtgagagaggaggagagagaggaagactgggagaaagagagagagacggggggagggtgggagaaaggaaagaaatagtcgtttcatttaaaaccctttaaattgtgaatggaagaaaatgaaagtgagcatggcataaggtcgggacttgcataacatcagcacgaccgaccgtgaaaacagtcgtttttccttttctttttcctttgcggcgtcgtttccgtctgtccctttccatgtatgtctctgctttattcatcctctttcgtttctgttctttatatcgaacatctctttcattgtgcaatgtttaaaaaaaatacaaaatgacgagaaagagaaatttgaaaagaaaatgagaaggaatggaaagagagaaagggagagagagatagagaaaaaataaaaaagagacagggaaaaagaggaaggtgggggagagaggaggaaagagagagagataaagaaagagaagaaggtgggagagagagatggggaaagagagaaatggagagagaaaaagaaaaaggagcgagagagagagatagggaaagagaaggtgggagagggagatggggaaagagagaaaaagaaaagtagcgagagtgtcccacatcgaagtttcaatccaagttgaaaatgcgttttttgtgaatattaggtaatcctaagtcacacaactaaatacccgccctattaacacatttgctgccagttttgccaactctgcgaattcaattttgtcagtttaacctttaaccctgtcaaaaaggaatttggaggactcattgctgcggaacttatcaacatgttagaaaagaaagagtgaacacgtcatcaacacattgtcaatgacaacgaatgattcgcttatccgacggaggcgagggacgggggaaacccgccgaagagcagcagccaaccaaccggttatgctgaatatatctgcacaatcacttaagaaatgctgatgatgttttgtttctgaaaattatgttcgtaaatggaacacaattagtggagaaaaaagcagcgaaaagggaataatgtgaaaaatgggaaaagaaagcgaggatctttttactataccctcaaaagagggggagggggtgggagagggtctcttcgtcaccgccgaatttaagtgccttagtttgttccttacaattagccaatttaagcatagccggtatcattttaaagtactttgtgttgcgggcagccgcgcaataaagtcaaagttacgatgatggatggcgaaaaacccaataaattaatttttaaagatttttggccataattttgtaactaaaaaattgcagtttaatagagtttgtcaactcgaacagaagaaaagcctcgttttgaaaatttaatcggtctctcaaaaaccacaaaaaaaggcaaaagcctcacatttgttgccagcgctgcttcttatatacattgatatttttgttgtcatacatatgattgaatgaggaataagaaatattctgtggaagaaattgtgatgcttatggacgggagggtgcgcccttttgaggctcaaatgatgacttttggacgaccgttacaatcgaatgattaatgaatgctccacaaattaacgaaaagcaattggccaagggaaatgatggaaagaaaggcaatgaatgacaaccaaatgcattcgaataagccaaatatgaattcgttttcaaccatccttatttgttgcccccccccctttcacattttgttgctgctggcgacgaatggtaggatcgtgcacttttcggtgaaaaagcgcgccataaaaggtgttataacttataagcaaaaaaggttgttaatttgcatggctagacccagttcgtaaactaggagaaaccggaaaatgaaaaatttttaaatgaaaaatgggaaaatctatgaaaaattatacggcgctattttaaaagagtactacatatgtacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaatctaaaaaaattcaggtaagcataactttggatgctgatcaaaaaaggtagcaacaccaagttgatcagatcactccttcatggtgatctgatcagcccattttggctgggaacgaggggtaaatttcaaaaaaaggtcctagggggttgggaaaatttttctggaaattttgagt

SEQ ID NO: 5059 - DNA, 1069 bp, Heterodera glycines
gccccccgaaaacaaaaggacaaacggcagcagcaactggtggacacaaaagccgttcaaaatgcagaagcgatagacaaagtccaaagattttgaattgaatagacgcattgcatcaaccaatgactattccgtgcatttggatcgattttgtgcaataaatatgcattttggtgaaaaatgaaattttgattttttgttcgaattcgggtccggggttcggaattggtcgaaatggatgtcggattcgtgattagcgaccccgaaaaccccctaaaacctgtttttaagcatttttaaaaattttaatttttttttgaaaaaggggggggataaactttactattaccggttttttgggtcgctgatcacgaatacagcacccatttttacaggaagtataaaatttgaaatttgtatggatgatatccttattggcaccttgcccatgagggtaaccttggtacagtaagcctatcaattctttgtccctatacagctcatgtagtgaacggtagcgctggtctgagcccggattcgtgatcagcgacctcaaaatgtatgttaaaagtatcatgtaaactccacaagtaccatctttccgttaaattgaaaaaattataatgctttttaatcattgtgctgcttgaactcacctggggtcagcagttggcccacatttgcacaaataatcggccgttttcccaaccgcgcgggcgacggcgttttgaataaatcggcagagaattcacttatcgcactcacagtttcaacagtttgttttggagaaagaaaacctccccagtttttgaccggtgaaagaaacggaagttgccgaagagaaggggagggggcgcgcaccaaaaggaccaaatcggaggaggacggcacactccgcccgaactcagtgccattgccagcggatgaactctgcgtctcatcggctctttcgtgagtcaactaaaatatgcattctcttctatttaaatagggtgagtacaaaaaattggccaaatcgtattttgtgttagataaattggatggcaaattttttattttttttaatatt

SEQ ID NO: 5060 - DNA, 1836 bp, Heterodera glycines
tgcctatttaggactggctgtttacgctattcgtttgaatagttttgttatatgtttttttgtgagttctatcaaaattggatgagtcagtcttccgatgccaccttcgtcatcgtcagcaagctgtttcagcagcttatttgataatgcagaaacacaacgtcgtactgatgaagaacgtttcatcggcgaagtggccgaggaaggcttatgacgacgataagaaaacgtagatgacaacggtgtttccgactgctcttgtgtgttgatgttattgtgcaagcttttgatgaggcagcaaggctgatgctgttggttgagagactgttgcagctgttttcgctggtcaactgctgtcaaccgctctcccaaaccttttaacggctcgctcaacgaacattgaacctggcgacagattttctgttacattcatttatatttttgggtccatgatttttgcaaaaaaatttgccgtttatatcgcatgaaaacccttcgatagaacgtaaatattttaagggatgtggctacaaattaaattccacttggcttttgacacgctgtgaaaaattgcggatcaatgtgcgtgaatcgtcgacccgagcagcttttaacagcagtgcgttgaaattctctacacttcggccttgctgatgctgctcctgttgttcccgagtgcagttaggtaataacaactctttacgtgtgatggatgcggctgtgaaagaggaattgccgccagaagtgcgagtgatggacaccgtttcagcagtatcaacaaaatgtggtgactgacggatttcagagtcacacatttcgaaggaattggacaccaaaatattattaataaggattttttaaaataaagtcgatgtagttcattgatttatgagtgagatggtggatagaacatgaggaaattggacaattaacgactgctctacgggatgaatgactgtgagagtatgaggcaaccagggaacgagggataaatgtcggaaaggccagtcggcattctcccttttcaccctctaccgctgttgctgtggccaattagcgtgaaagcgatatgagagggatgaagcgggccgcggagcaagcaatgagcttgaagagcaaaggaatgaatgcctcttcactctcttaacatgcagaaagtgaatgggataaatggcacaaacgggggagtgataaatgggggagggagcggagatgagtgtgtgtgtgggggtggacggacggttgccgtgatgacggaaaatgaagttgtaagggaattagaagagaattgacacatttggattagatacgcgcaaaaaacatttgacaaaaactaatatcgattaagaaaaaattacttggtaatattaacgcttaaaaaccaataagcaatttcggcattaatatggttcgttgcgcaaatacaatttaacgatatgcttaacaaaaaaaacagagaaaataaagtaatgaaaagaaagaacaaaaagacagtcattccgtaaattcattagaaaagggcattaaacgaacgaaaaacgacccaatggcattcattaccctatgcgaaaaggtggttgcccatagagaaaccagaaaacaggaggaaaaaggcagaaaaggaatgaaagggataaatctttataaaaagcaagcaagaaacgaacgtatttacagtttacattaatatatgtatatcaaataataaaaaataataattaaatcccactgcattaacacaaatatccatttgtattgtatgtataaatactaaatacacacaaaattaacaaaaacaacaagacctttctttgtcgaagtgactgtttgttcgaa

SEQ ID NO: 5061 - DNA, 639 bp, Heterodera glycines
tgttcatgtgttgcttatgaactgttgtctttttgcgctgtatcagctcgccttcgagactaaattgggtactttgtgcagcatttcggcagtgcaaaaatgagttgttgcactgtttgctgtcattgaccggcgattgctgcgcggagtaagccaatttcataaaaaatcggtcctttagactcagattatcagaagcaaactgttggacagatgagaaaacttctgttgtttaacaaattgacgagggaatttgccgttccttttctgtgttgtcgggaccattttaggaaaatgaaaatatcgtaaaagaaaacgagataagaaaaatggcaaaaggcggcagaatgaatttaaaattgaattcgttcttccggtcttttgttatccggaagtgagaaaagagaaagagcagatccttaacaaagcggggatgggcagcccttagaaatagtgacacaaacaaaaaagagaaaattaacttttctgacattgtcaagctaaatatgttttaatttactagtagttcaacattttaatttggacttaatattgttatctgtgtaactctgtccataataccacaatcttttgaattattaatattcatatgaaaacgaactcaaaattatggagcta

SEQ ID NO: 5062 - DNA, 2118 bp, Heterodera glycines
caaatcctacattattggtatcattggcaagcttatcatgtttcgaagctatttctaagctatcgcttcgcgattagactattaccaaaaaagttatacatgaaagttgcgaaaaagccgaaattagtcaaaattttgaagttttttcttagtaaaattttttccagactagaaaatttttaggttttttgaaaggctaatagagcatctgaagagctttcgaatgataccaacaatgttggatttggatgcaaatgaaaaagttatagacaaaaacataaaatatttttgaaaatctgtacacagataacatataagtaagtacctttgatttgactgactaacactcctgttaacccttcgtcttgcatattatttattaataacaagcacttacaaaactctcgtccatgaccatgttcatctccaattccacacattttcatcagatcctcatcctcatcatctgacgacgaaattgatcggccctccatttgattcaatgttctttgaggaaaagacgattgtgctgccatttataattagaaacctctctctatatgtaaaaaaatttttggcaaaaaattgtgtatttgaccaaaacagtgaattaaaaagaaaggaaacgataaaacaagcaaacgcaaaaacaaaatcaaaacattattcattcacagaagagaaaaaggagaaaaagaaagctaatttgtaaggaaaagagaaaagaaaacatttaaaaagaaggaatttaattgaaagaaatggagagagagagagatagaagaagaagaaaagggagagaaattaacgaaacgaaaaagacacgggacaaagcaatttcttgtggggttggaaagataaaccaagcgaaataataaaatttctataatctttattgaacataaatttaaactgtgttttttagcttttttatgaatgtgggtcttaaccaaaaaagaatgatgcgattttccttcactagactcctaatggaccctatcagccaaaaggtttcgcccaattgtaacagttctattcgaagctttctttttaggcatgtctttgcttcgccgtttccgctttactgatggcctttctgatctattcagtgtcggtaacccgttctttggtccttactggacttgcttggctctccgttttctcactctttgtcattttttccacaattgtcgcttttatctgtgctgccagttcgtcaaataaaaggtcactcactcgtattacaaacatttcgaagctcattaagatcttgaaatatttcaggtacacttttggcctggctcgagcacccgttttggccgttttctccaccactgttctagctcaattatccgctgtgtttttgacaaaagaggctgttgagcggttatttgattctgggcaacaccatcacaggtatttttgtaagtgttaagttttagtaacaaatgatcttaacagtcaccacggaggcgatgccgccccactcagtggcggagatattttgaaaactgaatatttgttctatccagcggctcttgcctcctcttccacaatgcttatagtggcttacgcactcgctaaccaaccattcaactacgtgcttaagcatgcccaatcttcggtgatccaggtatttgtataaatcgatgtttttcagtttaaatttcaatcaccaatgtttgtctaggaacatttcgctgatatttgtgcggcagtttgttatttcgtgccaggattggcccgtctgttgttgccgcgcattaactcgctgactttgttggcatttatatccacttgttgtgctattttcgtccattggtttcgtttggaattcccttgggttgactctgtcgcctcaatggtactttctttcacgattttcacttcaatggctccgctctcttcgtataccggacgaattcttttgcaaactacgcctcctcatgttcaaaatttgattgacaggtatttcaaatagtacttttatatttgatttctaatttttaaggtctatttccgaagcttctacaattgatggcgtgctcgagttgattaacactcatttttggcagttaaactttaatacgatcatcggcacagttgacgtattagtaa

SEQ ID NO: 5063 - DNA, 2170 bp, Heterodera glycines
ttagtaatcgattaaacaatttttacgttttcaattaaggtacgtgttcggagggacgccaacgaacagcacgttctaagagatgtacgcattaaacttggatcaattgttaactactgcacaattcaggtaggaaacaagcctattttatcaatttttttttggtaaatttgtgggtaatataggaaaaggccgaaaaattttaaatatcaaatcctgttttctgcataaagcacatggttaaaatttgatttggacactaacagttgggggatttctccttcattgggttttttttgttgttgttttatttaatattatctgtgcaggtgttgaaggattctagcacaaattgggcattacatcggcaatatcagacaccgctctatcagccaccttcggcagcaccgacacattcttcaccatatcaccaaactttgccgaatggaattgctttcagggatcaaagcttaggcagccatccgcaagagatgcattcccatgatcatcatcacgggcattcccatgatcatcacgggcacggtcattcacataaatgaattcattctttttcccgaattgatattatacatctgaatctgtgaaagttgttttctgaacagaaatctttttcctaaaagaaactggttaattgtaagccaatgttcctttgttttttcaattctaacacaaaacgtccttaaaattagattttggcctcaaaaatctgaattttttactccgcccttcaaaaaaatttctgcagtaggaagagagcagcagcgctgccgtcaagcgcagccggaattttggaattttaattaagtatttattctcacaattcagaacaatttgaaaaacaacacctttggaaactttgttaaagctaacatttctaaaaattccttaattattcctcaaaaaataatttttgaaaaagtgaatgttaaagattatacgagtcaaaaaagggtcaccgtggaaggggtgaaaaatttgttagtcgcttgagatggttgattcccctcgatattcttccgctgtaccttcgaatccgtgtgttgcattgtgatcattcatggcttttctttgttgattgttattttctgtacatgttacaatactttttaatttattttacgctgaaatttttttattggataaattatctgggcacaaggagaaaatttattttcttttcgttttagtttatttatctcttaaatatcttacacgaaaaatcatcgctttcatgtgttttacgcgatgattcctttttttattgaattgagtaattctaacaataagctatgtcccctccattttgccttattctgcattttagcggtgtatgaatccagaagaaatatttacgaaattggagcccatcggacgaggttcattcggcgaggtgtacaagggcatcaacaaccaaactgccgaagttggatatttttttgtttcttagaatttaatgttttcctccattttggaacacataattggagagtgaaccgaatgtgttcaaaatttaatttgttcattacgtaaaattatttaggttgttgccataaaagtgttggacctggaagaagcggaagacgagctagaggacattcagcaggagataaaagtgctctcccaatgtgacagtcctttcgtgactcgctatcacggctcctatttgacggttggtccgtcacacttaaaaaattaattaagacgcagtagttcaggggtcaaagctttggattatcatggaatatttgggcggtggctctgcgttggatttgacgaaaagtggtcgcctggaggagaagcatatcgcggtgataatacgcgaaatcctgcgggggttggattatttacactcagagcgcaaaattcatcgcgatattaagggtaacatttcccccatttgccttacaattaaattttgttttcaaaataattttaatgaaaagcaaatttgtgttattgaatttgttaagctgcaaatgttcttttgtccaccaacggagacgtgaaggtagctggtaggtccccgaaacaacgaaattccttccattgaatccaattattcagactttggcgttgccggccaactcactgagacagtgcgcaaacgaatgacttttgttggcactccgttttggatggcgtgagtttt

SEQ ID NO: 5064 - DNA, 1479 bp, Heterodera glycines
  misc_feature (48)..(48): n is a, c, g, or t
  misc_feature (95)..(95): n is a, c, g, or t
ctcggatttgtaattttcgatatttcgttgatttcaattggctttatntaagacacccaatgcgagtgctgtttttgatccccaaaaacccaccnccgcagttgcacggcacacaatggagcaaaagtttcagagagtttgtggaactctgcttgaacatggatccagagaatgtttgtatttacaaattttaattgtttttaattgagtcaaaatttgcaacaaaaaaatgttaagcgcccttcggcacgcgaattacttcggcacaaattcattctgacggcaaagaaaaatgaactccttcgcgacgttattgagcggagtaccgaatttcggattcggcaacagcaacaacagaatttgagcgctgattcggacgtggactccgacgttggaaatgtgctattctgttttcaaatttaaaacaaattcagggcaatgatggcactacttgttgggaatacccaactctaaaaaacacagacattttggaccatcgacaattgtcggacatcgaacgggcagtgctcgatgcagcagacaatgttgcgacaattaaggtaatcagcattaattatgggttttggacttttattttggttgccataggtttcttcttcttccgctcatcagttgcacaacaacgcatcaataattaacattgacactgtccgtttcacttcgcactcaaaagagaatgacaccgaaaatagcaatggaagtgatttcactgtgaataatgggggcacatttgtgaggcgaaaggacccagtagaacggaaagtccaaccgaatgtgaacccgtcttcaaaccgtaattttcgtgttttaatgcttctttactttacgtttttcgtcagcttcgtcctcttttacttcccatgaccattacccaccggtcgttagtgacggtgatgaaactgccgacgatggcaccggaactattcgaatcatttctccctcaaaagcggtccctccaataccacctcatcattttcatcgacaacaacaacaacaacttcagcacaaccaggtcaacaatgtgccatctacttttgttgccgatgtttcggttggcattgctccgccaccgcctccaatccgtggcgttcgctgtagctcactagagaacacactgcttcctgcactggatgagttgactcgaactcggcacggtgccgcccatttggacacaattgctgtcgcactgaaacgcgctgaacaggcaagccccgggctgtgcgatcacttagtcaccgaattgatcaccaccatggcacatccccaatgcacgaacgcggagctgcgcaaggctatcgaccgattgaccacgcgaagaaacgactgatccttttgtgcttctgcaataattctttatcagcagctattactttcaaagaatatttgagattttaaatttttttgattttcttttgagggagatacgtgcacattcgctcattgacagcactttttgtt

SEQ ID NO: 5065 - DNA, 1873 bp, Heterodera glycines
  misc_feature (71)..(71): n is a, c, g, or t
  misc_feature (224)..(224): n is a, c, g, or t
ccattcatttgatttgtttcccgctgcgatgatggatggtttggaggggccaaatcaacaatttctgctgnccaagcatgtccaaatgggttcactctccgagaaaagatggacaacccaagcgattgcgttgcggtaattacaacgaccaaacggactttgattggatcaacaatttcaaggaggtgtggcataatctcgacaaatcactgttttttgtttcnaaattgtttagcatttcttcgtgccaatgccatttcttccgtcagttacgaaattcatttttatgttcatgtgccgtcaatacaaatggtgccattcgaattggtgaacgaatggacaaaggaaaagctgacattggccaaagcaaatgaaaatgaattggacaactgttggataatgaaacgctgcaaaattattggggagaccgcgacggttcagcggcaaaagaaaaatgaaaatttggacaacagttgtaacaatgtgtccatttggctttatactaattgcattgggtgagcaattaaaaaaagcatttgatttttatccgaatttgaattttgcgcttaatttaggcctttgtctccgccaccggaagaagtggaagatgaagcgggacaaagcatcacaaaggggccgtcttctgctgacaaatgagtgacggacaaaagaacaaaaacagtgatcagccgcagaagaagaagaaatgaattaattaagaatgaccgatcgatcataattcaaatcagtgatcaaatgcattttatgaagaaaaacctctcaaatatatataaataaatcggatatataaaatggtttgctatctatcgaatgaatgaattttcctttcaaaaatgtgacaattatttttcgggattttggcgggggatttccgacatccattagcaatacttgttccgttgctgctcctttttctcctccattttcctctctttctcttccgtctctcctccttccaatgttcttgcttctgctgatgttgttgtttctgctggtgttcagctgcaattttctttttcctcttcttcagttgctgctcctttttctcctccattttactctctttctcttccgtctctcctccttccaatgttcttgcttctgctgatgttgttgtttctgctggtgttcagctgcaattttctttttcctcttcttcagttgctgctcctttttctcctccattttactctctttctcttccgtctctcctccttccaatgttcttgcttctgctgatgttgttgtttctgatggtgttcagctgcaattttctttttcctcttcttcagttgctgctcctttttctcctccattttactctctttctcttccgtctctcctccttccaatgttcttgcttctgctgatgttgttgtttctgctggtgttcagctgcaattttctttttcctcttcttcagttgctgctcctttttctcctccattttactctctttctcttccgtctctcctccttccaatgttcttgcttctgctgatgttgttgtttctgatggtgttcagctgcaattttctttttcctcttcttcagttgctgctcctttttctcctccattttactctctttctcttccgtctctcctccttccaatgttcttgcttctgctgatgttgttgtttctgctggtgttcagctgcaattttctttttcctcttcttcagttgctgctcctttttctcctccattttactctctttctcttccgtctctcctccttccaatgtcctgcttctgctgatgttgtagtttctgatggtgttcagctgcaattttactttttcctcttcttcaattgttgctcctttttcctcctccattttactctctt

SEQ ID NO: 5066 - DNA, 3433 bp, Heterodera glycines
tcaactcggcctcaaattggcacttctttcgccacgtttcgatgcgttggtggacaaacatttcgatggcaaaagcgaattgactatttggagaccaatcgaaattcgtcgcaaggacaaaggaccagaaccgaagctgtctgtacgaatcgattacgaatttgtgccatttccattgcccgaccgtccgttgcccagcaaaattcgctttaagaaccttcggattgagtaattaaaaatcagagagctatgacaataaaagcattccttccattttcacagttacatcgatcacttcgtcatcgcttttcttcgtttaaatcaccaaatttttgagaaaagaggcaccgatttatatttgtggatttcatcatcacactctacgaatggccagccgatttgggatgtttttgttcgtgaaatttggcccattttttcgacaaacattcgctgtttgggctttaccggtggtgatcatttggaccatttgcgtcgtcgcacttcgccaacaattctcaccgatctcaaccaattgaattcaatctgttcctgtgatttgtcgcccgctgcgtttggtgatgattttgatgggccaaattcaataatttctgctggccaagcattgtccaaatggttgcactctccgagaaaagatggacaacccaagcgattgcgttgcgaagactttaaaggacaaacggacttcgattgggccaacaatttcaaggaggtgtggccataatctcgacaaatgattgatttttgtttttccaatcaaattgtttagcattttcttcgtgccaatgccatttcttccgtcagttaccaaattcgtttttatgttcatgtgccgtcaatgccaatggtgccattcgaattggtgaacgaatggacaaaggaaaagctgacattggccaaagcaaagaaaaatgaatggggcatcggttggataatgaaacgatgcaaaattggagaggccgtattcgttcagcagcagaagaaagatgaaaagtggatcaacaattgtaacaatgtgttattttggcttgatagtgacactaattgcattgggtgagctaaaaaaaggcatttaattttgttaagtaaattaaaatttcgcttaatttaggccattgtctccgccaccgaaagaagaagacgaagcaggacaaagcagcgaaaaaggggcgtcgtctgctgacaatgagtgacggacaaaagaacaaatacagtgatcagccgcagaagaaatgaattaattaagaatgatcgatcgatcgatcataattcatccgtgatcaaatgcattttatgaagaaaaacctctcaattgctaaataaatcgggtgtataaaatggtttgctatctatcgaatgaatgaattttcctttcaaaaatgtgacaattatttttcgggattttggcgggggatttccgacatccattagcattacttgttccgttgctgctcctttttctcctccctttttctctctttctcttccgtctctcctccttccaatgttcttgcttctgctgatgttgttgtttctgatggtgttcagctgcaattttctttttcctcttcttcagtttctgctcctttttctcctccctttttctctcttttcccccattttctcttccttctcctcccccttcgctgtttcctttttgctgttgttgatttcgtgtcacgacatttgcggccaccagccaaaaacgacaattgcggtccgtcttttgcggcccgacatttgcgcctcggacatttgcggcccatttcttaagggccattttcggacatttgctgccaaaatcaaaataggtctctcatcgaaaatcctttttttctcttcaaatttatgccgaaatttactcaatcgagtaattctttctcgaaattgggcttgttcaaaaccccatcagagcttaaaagttttttattaaaagtaattatttggaactttttcgccactatttttgccactatttagttaattattttgggatttttgccactaaaaatccgatccctacttctaacatgcattttttgagactttttttgactttttacactttttcggatttttatgacttttttgagtttttgcgacttttgttcgtgatttttttgacttattgaggcaaagtttgagttttacagaagaaaatgccaaaaaataaaattttcggtcgataaaaaggcaatgaaacctggatgaattttttcttaattattggaagattagaagtaatcattaagcagaagctaagagatgaatcatctcaccaaaaagctatgatttataagacttaaaaattcaagaaaatcctaattttttgtaaactataaatcaactttttggtgagatgattaatcgcttagcttctgcttaatgatagcttctaaacacgttgagctttcgttgaaacaaattttgaagaaattaaatgacgaacaaaaaaattatggccattcccatttgaaattgtacgaactgccttgacaccgaaaatcccggtcccgtggcactctacttaaaatagtgaaaatttactattttggcgttttgtcaatatttttttactatttcgacattttttggaaaatttcgcaacacaaatgcaataaaagcgaaaaatacacttttaagaatcgaacaaaaattgagccaaaaatttattatttactaattgcagttgcaaatgagtaggactgggatttttaaggccaaaaaaccaaaatagttacctaataaataatttttaaaaattaaaaatttttgccaagaaagtgaatttttgagaaaattttttcatttcttatgaaaaaaaagaagttaaatcacgataagtagcgaccctagtaatttgtctgccaaagaaaattggttttctatgccaattaattaatccccgacatgcaaaaaagacattctctaaagcataatattttcggctctagtgcactttatgagtccaatcaattgacaatcccgggtttttatacaataactttattcatgtttgaacaacccctatctttttggcatcattcgaaagcacacagtctaacgaagctaaaacatataaaatcgcagcgtttaggcaattatagaattgacgccaattcctacggtatcgcctgcaccgtaggaatattcgacatttattcctgtttctttcccattaatccaaatctttccatcactgtcaattgcataagtgccctttcggcttcgaattgttccatccaatttgttctgctgtttgactgcaaatccgaagctcatccaactgaaaaattaataataataataaagaaataataattaaaatttgaatatttctgaaaaattttatattcaaaaaataaaaaaatctctctcttaccatttcaaatttccaattgaaatttcgtagtaa

SEQ ID NO: 5067 - DNA, 3688 bp, Heterodera glycines
  misc_feature (3654)..(3654): n is a, c, g, or t
  misc_feature (3673)..(3674): n is a, c, g, or t
  misc_feature (3682)..(3682): n is a, c, g, or t
tcaatgggaaaattaacaaaaatcataaatgaatgaccaatataagtgaccgcatttttgaatatttcatcattcagaaagcatccaaatcaaatttgaatttgggcaaaaaattcgcctcaattttgtcaccagagtcgcgcaaagaaacgaatggataaaaagaatcatcaccaaaagatgaagcaaccaaaagatcggaggaatctgtgaaaaagataagcgagttcaatttgcacaaattagacaattaatgaaattatgattttaaaaatttaatatttttatttgccaacccaattgttttccatttttggtgaaagtgatctgccgaataacagaattgacgccaattcctacggtatcgcctgcaccgtaggaatattcgacatttattcctgtttctttcccattaatccaaatctttccatcactgtcaattgcataagtgccctttcggcttcgaattgttccatccaatttgttctgctgtttgactgcaaatccgaagctcatccaactgaaaaattaataataataataaagaaataataattaaaatttgaatatttctgaaaaattttatattcaaaaaataaaaaaatctctctcttaccatttcaaatttccaattgaaatttcgtagtaaaaattgtcagacgaatttttgtccagcaaaatcggatgttttgcaaaggcagaagaacagtaaccttttgaggagaaattagtaaagtaaattatttataaaaataccagaaaaatttctcttataatggacaatgagacttttgttgccaatgatttggaggttctcatgacgaaaattggcatcccaataattttgtcggaaatttgaaaatgccttaaaataatccattttaaaataaaattgttttattatttaaatatatttttttaccccttaatttaccttcctctgctttggttcttgctctaatgcactgattgtttccacaattttcttctgatcattttgaatttttgaagttgcttaaaatcgaattaatttttaataaatgtaaataagcatttaaattgataaattttattttcgttttaattttctttccctcaccttttgactgctctttttgctgtttctccaaaacactgattttttccaaaattttcttctgatcattttgtaattgtgagagcttttcatcgcaagcttaaataggtataataaattatttactaaaatgaataaaagaaatataatatcagaaaaatgattttgtttttgccgtttttctcctttttctgttcaattttggccattttttccttcaatgccttctgttcgaccatcatttcctggtgctttaacttttgttctagtgccttctaaaaataatttaaaattttttaattttagtcgaattttttatggcaaaactcctcacattttcgagttccaatttggccattttcaattccatttccatttttgcaaacttttcacggaattcctgaattttattaattaataaaaattttggtacttatgtgtagggcgtgtaattaattatatggacataaaatcgcaaaatatggccataaaatggcaaaaatatggacataaattttaaatatggagaggtaaattttaatttctgaaaatatggaatggagactgcaaaactaaataaaactttgttttggggttttaaggcagggttcggatctgtccttatttgtaagatttgcccttatttcggctattgttcttattttgttcttatttcttaaatatattcataatttggaaatttatggccaaatgttcttattttacctataaattttaaaaaatttccaggcggcgcctatcggcgccaccggacgcccctgtccaacctccaaaatttttaaaaaaatatcgcaaaaaaagccttttacatttaaaaatggtcgccaattgtctcaaaatcgcaaaaattgataatttttgatgaaaatctgttaacaaatcaaagaaataacaaaaattttttgtgtcggcgcctatcggcaccgccggacccactcccctcccccgttctccaaaatttcttagaaaaatgtgccgtaaaaaatttgttaaaaattttattttttttagataaaaattgcactaaatttgctatttttctccccaaaattgttaaaaataatcatgggaggtgaaaaatataatatttgatacatttttgatcgaataaattgtaaaaatatctgatttgaagcaattttgcgaaatgttcttatttttgaccatgaaatcttgttttttggccttaatgttcttattttgaaaaattttcgatccgaaccctggtaaattttacacccataaaaatgaagctttttaatgcctattttccatttttagttattttttcttcatcatccatacattaattactctcttttcttttgatatgaaattttccaagaaattatttagttatatttattaagcaaataatctaaaaaatcaaagaatgtcctgcatttacataacgtgtcctaattttgaaaaagccaataaacaggcgaaaatttttctaatttacgtcatcaaatttatggattatttttaataatatattcaaaacattaaacaaattctgccaaattgtgcattttatttgaaaaattagtaatattttaaaagaatgcatttgaaattgtgcctattattcttttcaatattatttttgatcatccgaactgatcagatcggatctgaaaataaaaaattggaacaaaaatcatttgatgaaatatttggagaaaaatgggaagaaaaaagaaacgaagaacagaaaagaagagaaataattggaaaattcaataagataaaagagaaaattaagcaaaaaggaagaaaatattcagcaaaagaatggagtaaaattaatggaaaaatagcaaaaaaattgggcacaaatcgcaattatatttatgaatggatcaaagaattgggattaaatcaaaagaatttttacaaatcaaaaactgacgaagaaaaactcaaaattgtagaaaaattcattgaaatgtcaaatgaatttaaggaaaaaggaagaacatattcgataaaagaatggaacaaaaattatgccgaaatttgtaagaaaatcggggttagccttttcataattaaaaaatggatgaagcaatttggcattagccgaaaaataacggagaaagataaaattgaaaaaatgaaaatttattggcaaataaaaagagaaatgccgaaaatgagtgacgaaattatcgccgaaaaattaggaattagcggtagaagcatcttaaattggaaaaaattgtactgacgaacaaattatgaattgttttgcttttttgcccatattcttctgttgcggaccattttttgaattcagttttctcatttttatctgtccaacattccttctttttccacaatatttaatttattcgacttattattattattttaaaaaaatgttaaaaatttaaaaatattcgataaaaagtttatgtcctgtctcaaatggaaattaaacatttagcataaatacacatcacaaattagccagaaaaatggacaatttgaaacaattctcttgggatagggattatgcttttttaacgcanaaaatagcaattggaaaanntgcgcaangtaata

SEQ ID NO: 5068 - DNA, 4055 bp, Heterodera glycines
atcacacagctaaaaataatccaaaaaaatttttcttaaacaaattaagaaattatacatattattcacagtttaatttaataattttattaaaaaataaattggaaatttttaaaatatttgaatatttttaaagaatttttatcaattaagtttaaactgcttttcacacacaaaataaaagttcattttaaaaataaaatattttttttattcctttcttataaataatttttttttaaattataaattagataattaattaataatcgaacataattttaataaattcttttaaatgttaaaatttgccattcaccgagtgcatggcttatagcacacaaattcagcttcacccgcgcgcacataaagccaccggtcttcgtcaaatggtggcaatcctccgaccaccaaatttggccgaaaatgtcgcgcatccaccgaaatttgctaaattttgaaaatttaaatttaattttaaaatattttattttattttttgcctgtgaggccaaatgggcattgaggtcgtcgacagaggcggatgaaaatgccatatacccggtcaagtccatataagcaatctgaaaagtgcaaatgcaaaacaaaaacagggggaaaattcggggctcccggaaaatgcgtcagtgcaaattttaatgtcataaaaacaagttccctgcattttcgaggtcactgaccacgaatccggtatccatttcgaccaattccgaatcccagacccgaattcgaacaaaaagtggaaaaccaaaatgttcgcatttaggcactattgattcaaaataggcttgatggggctttcagttagtttccgtgtattaaatcgatttttaaccaaaaaggctaatttcgaaaatttggaattcgatttctttgttcgaattcgggtccggggctcgctatcaaaatgatttcacatagaatttgacttttatactacaagaattttaagagaaaataattggaccaatttaacaaattttgccaaacaattttccaaaattcgaccaaatgccacaaaaatacatacacaaaaattgttgtttatttcgggccaaaatcagtttgaacagtaaatagggctagtaggaggggtaatgaatgattaattagttcagttttttgaattgcctaaattacggaaaattgccaaggacgatcggcattttttttttttgaagaatttccacggagctaaggatttactgtacccagcagtgtacaattaggtatttccgagtctcgagaaaaaaaagtcggacttcgcgttttcgggtttcgggtagagacaaatttcgggtctgtgaacgaccgaagaaaattcggattggatttcgagtggagacaacaaaaccggatttcggctaacctggcacatcccctggtatgaattttgttgtgccacaccttgtcctgcacatccggcaccgggttgttcgaccaccagctcttgtccggcttcgggtcgcgttccgtgtacagccagtcgccaccgtagtaaatcaggcgcagctttctccctaccgtaccaccaccactaccgtcctctgtcgtcgtcgccgccgctttgccctccaacaaaaactcgtccaaagccgtggccacttcatccccacagtccaacccatccgtttggaggtcagaaaacagtctaaaaaccggttttgggagtcaaaaaatggcattttttgtattttttgaaaaaaggtgtgccaatatggttggtccctggcattttttgggcggcgccgaattgacgggttccaatttcctgggcccaagccgaccattctcaactgggaagcgggccaagacctgtgtgtttgtttgtgtgagacaacatgcagttgggagaggaggtgtgaaaagacgaaaggaaacgatgcagccgaatgagtgccggcattttcagtcccggcaaaaattcagtcccgaatttcacccgagaaatttaaagggcggattcgggtgacttttgtgtatttttatggattcagcagaatctcggcattccgttgaattcctttagcgagggcccgaaagtcagtccattttagataggaataaatgccaccaaaaaccatggatggcatggcatttgatcaaccaaaaaaaaaaataattgcaaattccctcgggactcggctcgagagcgaactctcgaggaaatttctttggttttctttatctccagctggtttttttggcaagccatgtcttaagactcaaattgtgacccttgaggggtcaatttccggggttttgccgtttcttggtaccgattctcgacagtctttgggtcgagacggtggatttttctgcaaaacttttttgaaaataaacgaaaaattttttcgaaataaaatgaagaaaaaaaaattcaaaaaaaatagaattatttttttttaaattttgcatctaatagaaaacaatcacttaagctattctattgtaaggatatccttccatttgaccaagcccccgaggcaaaattactgcctcacttttatggaggcttacgttttccgattttaaaatttgccacctttctgttgctgtggccaaaaacaacttactttgctcgtaggacaatgtttcgctcttccacttccttcagatttacctacaaaaaaaatgaacattttgccaagatttttttgccaatttaaaaattattaaaaaattacctccacagggctgcttcggttcgggaaatcaacacggagtacgccctgctcgacatggacactgatcagcaacatttttgggtaaatgcggccggtcagcatttgattttgccgtgccgaatcgaccaccaaaaagtgccgatcgcgctgttctccatgggcacaacctcgctcgccacaatcaagccagtcaaccggaaaagcaattagcatttgataaattaaaatatcatccaattaaatgtgcatcattaccgtatcccatgtgcattgtataccgtattacacagaaagagagagaggggaggggggaggaagagagataaaaagagagagagaaagagagagagagagaggtgagagagagaagagagcccgtgggttatgattttttgaaatttggtgctgtattcagttggaaaagactttattcgggggaatacggtctaatacagtatgtgaatgccaagaggaaatatggtacgactactgctgcatcggctgctgctcactttgttccctcgacatgacttcattgggtagatgtaaagctgttcaacatgtccagctcgtacatattcttctgtgttgcattgtctatgacaaaatgaataataattttcggacaattggacacagtggtggacggacaattcgccaacggaaaatagcgccaaacaaaaaaggccccagaataacattaaaagacttgcgggtgttggatgaatggtactcgagattctcggtctcgagttgagaaaaatttttgggtgccattttggtctccaaaattatcgaacatggatggcacactatatgaatttttgttggatttccccaacgtttcggaaattggcacaaaaaataaaatggggatttggattcggagtcaaacccgaaatgtgatttgctttttcggcattttgtcaaatacaaaaaattcgatgccactcgaaagcgccccaaaatgcatttttcgttcgcgccgcattatttcggcttcagatcgaacaaagcctttccaatcaaaaacatattttcaaatttattaattaatcagtgggctaattgccacccttttggactatccaaaacagtctttggcatttttgttgcttttctgatcgccgctttacctttgcttcttcttccgctgtacaagcagcagcaaaaggaccgctaccgtacccagcgcgcacacagcgcctaccgtacccacaattttggactgttgctgatcactcataattaattaatgcatattaatacaatgcttaaattgtgaaaattgtacaattagcaaactcttttttatttttatgaaattgatggttaattaattcgtcc

SEQ ID NO: 5069 - DNA, 4198 bp, Heterodera glycines
  misc_feature (881)..(881): n is a, c, g, or t
cccctcccccgtccaaaaatattgcgttttgttttgttggttggatgggtttccctccggcgcattattttcgcctttcccatccatcggccggcaaaaatgtgctcccccctcccctctctcactcactctgtttctgatgggaaattcccagggattgtgtgtggggcgggagggggggggggagataaagattttggcggagaattggggtgggaattgggcgaccagcgagggaatggacgaggcggggggggacgatgggcggggcggacgcaccaaagttgtcgctcgggacggaggtgcggtggacaagccgaagacggactgacggaccagcagggcaccacccgggcaggttctgtggcattttgctgccagttgccgagagtagctaaaatgccattccatttttggcattcggccaattcatagccgacgagcgatcttttttttttttgttccgtgaactgccaaattccgatgatcatcccccggcgatgccacacaatagtttcggacaattttttggtctttgtccgatggcatttcaaaattgaaattggaccttttccgttcattttcagtgggtgaactatgccaaaattaaagtgggatggatcagtgatcggacacatttttctgttgagtgaccgaccgattaccattttatttggataattaaaatttgcatttttaaattcattttagcattaataatttgatcagaataatgaagagtgatcagcaacaacaaatttaataattacaatttcaaaaaccaattttagacacaatttcaagcattaataatttgatcagagagagtaatgactccaatcaaattggaacaaagtgatcagcaacaacaaccgcaacancgacatcaacaaggtcagcagcaaccgtaccatgcgcaactgacactgatcagcaacaactccagcaacaacaaattgttttcgccccctttgctgttgatgaacagtagtgatcagcaacagcaacaagaacaacagcaacaattgtccccttctgctgctgctgatcagcagccccgggttcggcggcacaattgtcaaacagtgccattggcgacgacagtgtcgcagcaacaatggcacggagtgcccacggcaccacttttgcctccggcaatcgctcccgccgacaatggtgtgaattatgctgggggattttgttaggattgtgttgtcatttagataatttgacctcaatcaatgggctaaatttatgaaaattgtttgcgaaatgttatgtcaactatttgaaattttctggaaaaaaattttaattctaaaattcttttagacatctaaaaaattccagaaattttcaaagggccctagaaagattttagcgctaacttaaaaagtgtggcgtcaatgtttgcaaaattacttgtcgtaaatcgtgtaaacttatccccggcggggcttttcggggttgttgatcacggagtttatatcaatttagaccaattcctaatccaaattcgaaaactcaaattttccgaattttgatttttttttttgtgcaaagttagattaggggcttcagaattggtcaatcaaaaatgatgtcagatacgtgatcagcgatccaaaaaattccttaaacaatttttcatagtagacatcatttaaaaaaattattttgggtgccattttttaaagccatttctgccgagccaacgatggaaaatttcttccgttttgtccaattggcaaacacttttggcttccaatttgatttggaccaaaaattgttgcgatggaattcgtcgacagtgccaacaatggtgcctgaagaagaagaagcggaaatggatgccaaaacggcacaatgccaacaacaccaacagcagcagcaaccgatggaaatggaaactgatgagccgactctgatcacttggactgatcagcaacagcaggagcagcagaagagacaacagcagaggcgaaaaggtgggcagacaaattaaaaaaaacgccaaaatgagtgccaatttaaataaaaatcgaacaaaaacggttactgtagaaaagtttgagtaaagtaccgcatttcacaaaaaatgccaaaatgcgtgccaattttaaatgaaaattgaacaacggttactgtaagaaaattttgagtaaatgccgatttcctaaaataaagtccccgaaagctctgtttaagtggagggggggggggagggctatatttttttcggagtacggtattggtgataatcggtaaagaaaactgatcaaacccatcaaaaattcttcaattctgatcattaatgcctgctggcggagtatcataaatttattcactgttggatccgacccccattttatttatattttttgaaattttgaccccaaaatggcaaaaattattcttttttttggccaaaaacggttccaaattcttgtttttttttgtgttccatggcgtttaaatttttaaataacaacggagagaaaaaaattcaaaattttttggcccggagagcgaaaaaaagatcttcgtgttctcccccgccccccttccccgaatttttttttttggctacggacttaattgagttttgatcagtgcccagagacaattaatcgccggcaattaaaatttggtcgcgcaaaatcggccgagataaagaaaggccccccattaatttcccacaaacattaaaaatgccgatggatgatgcgatgcacttctgtggcgggtcctccatattgcacccgcccggcggagtgcagcagaaatatgaggagaaaagcctttttggggggtcggcaaacttttgagggcgctaatccccgccggaggggtcaaatggggcacacaaaggttgaagaagtttaccttcctccttttccaccgccgaaagatcattaagttgagtgcgcgaaaaattagcgcaaaattaccgtattaaatttggcatttcacacaatgccaatttggcgctcaaattaaaaaacagcgaacggcaccgaatgcgtgggcgtgaaaaagtgcaaattttgtgccgattggcttcccaaaaacatgaaaatgaatcattgtccgcggggagggggaccaatgaaagtgcgcccgcccgccgccgctgtcatggaaaagtgccgtcaattttcccacgaacaacgaatcgctgcaacggcgccccggagggcacaaaaaggggggggggaataccgtaatgccgagcggagacagcgggcaaagagagtgagacagtgtggcacgagcggagagacggagaacagtcagagagggtaacacaaagaaatagtgtggggcgaggagagagcggagagaagggtacacaaacaatcgagaattgatgaatgaatgagtgagtgtgtctctgtctcgagaatgaatatgggctgctagcagcttcttagggcctcttcctccccagggcgttggcttggcccaacaaaaggggggtaaacagaagcacaaccttcattggcaaaaatgggttgcccccccttcctccccctccctcaacattggcacatgcattgcgctctcggcaccgcccccctcccactgggccattttgcttcgtgccgatgctttttacccattatcccctcccccacttttgatgctttttccctctctgatcggaaagccaaaaaagcggtgatcagagccccaatcagtcaattccccattagatgccatggttttttttgtgccggacatttcattcgagagcgagcagtgccaatgccacaaaatgttttgggttttgccgtgggattgtatcgcctccctcccttcccccggagatccccacaccatcgctcgtgtgaagatcccacaaccggcaccggcaggcaggcagcccaaatcgaaaatccatccccagagccaaccccgaccgacccctgcttttgttgtccccacccccggctctctggcgtccagtgggagcccattcccatcccatgcccgtgaacaacacagtcccatgccatgctcttaattcgtcctcctgctgctggtcccaggaggagggggccggggagggggaggggacgccatgactgacttttacgaggcacccaccgcaccccccggggggtgtgagagattcccatcccaaaataacacatagaacaacgataacaggctttggcactggcactgctctgct

SEQ ID NO: 5070 - DNA, 1834 bp, Heterodera glycines
atttttgtacccacctataattaatggtggtggtaacggtagtggtgagcatgagtacggtagcaacaacgggttttatacggtgggccagcaccaactgctgcacaaccagtggaagcagtctttggccatggccgctgttgcaactgttggcaaggcggcggcccgggcacaaaatgcgggaggaggagggcataagagagggtcggacggaaagccaaaaagtgaatgaacgaacattttgaaaatgccgaattcaaaaatgccaggggcgtaaaagcgataaaatgccagaaaaaattccagaattgagagcgaatgaaattgaatgccaaaaagggaatggcgctaaggcgagaaaattgtgaaacatgaatgccaaatttaatgagtgccgttttcttttttgggtatgtgaaaattccaaatttgaaacactaacgactaacaattctaagaaaccaaattaaaaaaaaaaattattttttcgatggacggaaagccaaatttttataaaaagccaaatttgatggcataaaatggaatttttgaatttttcagcctcgaacacttcgtccagtggtcatttgactgtgccgtcgacctcgcgccgttcgtcaagcgcgtcgacggtgaaggcgcatttgtcccccgctaccgtatcgccggtgcacagcaatgggccagctgagtatacggtagcttacgccagcagggcgaggggtgcgaggagacaaatgccaatatggcaagacttaggcctatttatacaacattttttcgatgggaggaggtgaaaaaaatgtgtgaaaataccagccagggttggtacggtatttaccgttttaaacatcgacacggtagcgcaaaaactcgcgcaaatcattgcccacccatacaagaaagcattgaattaatgaaaaaacggaacctggaatcccgtgccgaattttgcggaaaacggaaactctagccctaggggcagggcgaaatcccttacagtatactgtaggttaagtacagtaagaaaaagggtaaaaaacttcttgcagtcgccggcaggccaattcttcccgctgcttgcccagcttgggcctgcccaacgattgaccacgactgtggtgcgcgactatttgtctaacccggcccggtacgattgtgtgctgtggatgtaccatgccaaggtggcacagaagagttacggcacggaaaagaggtgggcggcaaaatgccaaaaaccggtggaaggcgggggtaattaaaattaaattaaattctgagttagagtgaagcattattggtcaagaatttgcgtttttttgacatttttgagcattggccgtttgcttttgtcattaaaagggtgatattattattgttttttaatttgaacgttttttaatgcattaaatttgaaattttgaaattttgggtcagaaatattccaaaaattaattttcataattttattttgaatttaaattttattttgatttactattttcaaatttttaatttataacacaaaatcattttttaaaagtgtaaatgatccacttcattctccagtctacaatcacaaaaattaattaacccattttttcaaataaacccatccaaatttcgcgcatttttttctaatactgtacattcaaaatgctaataactgccccactcggggtaaaacataatgaattcctctaattgtataactgtgccattcatttaagctgccctccttcagccagaaggctccccccggggattgggacatattgtctcggccaagtgtcccccgagggttcatcggtccccctaatgggggggggggggg

SEQ ID NO: 5071 - DNA, 867 bp, Heterodera glycines
tagggcttcctttttaggcacaaaatcgcgaaatagacacctaaaaaggcataaaaaaatcgcaaataggcattaaataggcacaaaaaccttaaaataggcaaaaaaaaatttttttttttattaacgcttttttggtattaaacacagcggcccaattttgggctccaagtacaattatactggatttttcgtcttagtggtctgtgagttagtcaccaaaaggggggtcccaggttcaagtcctcccctatgttgtgtgttaatttcaatttcttcttttaaagaaggcagaattatttttttattaataaaagttttcgtgtcaataaaaaatcatattcaaaaagcgttggttacgtacagcatcgacaattttatgaaaattttttagcttataacttggtgaatactagagcaaataaaaccattttatgctcattttgaagggaaaattctggagaatattgtaaattttaccaatattttgacctcctctagcgattccaagtttattttatggaacttaagtttttaactcgagatcggctcttctaattttacaagggaaaatcccaaaaaaattttaagttttgcaaagttttggcgttctgattactaaataaataataaacctatttgcactgagagcccaaaattgggccgctgtgtaaaacaagtaaaaacttaaatatttcaattgtaaatgaaattattaaataaggacaaaattttaaaccaaaaatttttattaagaaaaaaatatattaaattttgggatcattttttgaaaatattttcaattcttagtggtgtattttctgaatttttttttgggtcatttcttaggggtgtgtttttcgtttt

SEQ ID NO: 5072 - DNA, 3232 bp, Heterodera glycines
gtgtatttaattgtaatttgcttaagaaaaaacacattttccggatgtatttttaattgtaatttaatcattagaaaattcgcattttacgtatgtgttaatgtaatttgctcatgagaaaacacattttccggatgtatttttattgtaatttaatcattggaaaattcgcatgttacgtatgtgttaatttgcgaatttttttagatattttcagcaaattctttaggtattcgattgtcgggagccggcgaaatgataaggaatgagattttttggaatttttatgcaaaaacacttttgatattccaatgtttaatattttagcaaatattttggcatttttgggggttttagcacatatttcagcatttttataacaaattttattacatatttcaggatttttagcaaataaaaaacccagctctacttatatgcaatttcatacttacagttcagcatgttcccttgtcagtgagacaagtcgaattcatgccttgtgaaaagaaatttttgccttgtgaaaagaaatttttttttttggaaaacgggggcggggttctatctattgagggcgttgtaacttctcatcagcaaccatagagaaacacgaaaagacatctcaacgaattttgaacttaaattcccttttccatagcaggaaaatggagtgcaacgtctcaacagacagacgaacccaaatgaaggtagcgaaccaaaaatggaagtgtgttgaaactacaaaatattcagccttttatacccttttgagactcataaagctatttttgcaaatttgtagtttttgcgggaaatgtatgtataaaagggcgtgcgtttttccttttcaagtaattgtccttaagatttgacacaatttgcatttcatttcttcctaatttttgttctacatcgaatcatgaaacgcccaatggactcaacagcaactccgccttcttccaaaaccacacgtatttccgcggacgctttggctggacaaatcgactcactttctgctgcagtcaacgcactgcttgttcaggacgacatttcacaggccgtcaaacttcagtttggcgttctgcttactaccctccacacgtgccaacacgtcatcgatggtctgaacaacaacgcaaacaacaacagtgccgaggaacaggaacgccgccgttccttggtcataatcggtcttccggagaacccttcagcccgtccttcggagcgtgttcgagaggatcaaaaggttgtctcggggattttggacgaattgggtgttgaggcggtgccaacgacgacctaccgaatgggccgtcctgatgttcaccgtgcctcgccacgcttggtcaaagtggtgctgccggcctccgtccatcagcacattgcactcggcggttggaaaaaggagcgcactcgcctccgttctctgccaaactggggccgtttgctgattcgcccgtctctcagccgtgaacaactccaggcggaatacgaacaaagacaggccaaacgcaacggaatgaccaaccatccgccacgtgccaacaatgctagcgccatttcaaaccaactgcacgaacttggacaaaaaatgcagcaaaattttcgatgatttcaaggtttccggggtttgtgtgtaacgaaacccaatttcaaaaaaatttacaaaaattttcaacacacacaaatcccaatctttctttttttgttgattcatttgatcatttttcaattcgatctcatacaccatcatttactttttctaggacaaaagccacttctgttatttcaaaatataatcctgaacttcacagatctccaacaatttcagacaataaccaaaatttcaatagatcaattccagaacaaaaatttataggaattttatcaaatgttcgatcaattatgaacaaaattgaccccctcataaccacacttaatattgaaaaatataattttatagtattagtcgaaacatggttaacacctcaaaattttgatattttacatgcagcaattcctgaaaactatcaaatcttttcagcccttcgtgaaaacaaacgaggtggcggagtttcaatcttaatagaaaaaaaattttccgtttattcagcctttgcggaatcagtttttggatgcgaaattgttacattgaggcttaaaaatctcaaaaatttttccattatcggtgtctaccggccccctagcacttccctttctaactccaaaaaattctttaactatattgaagaaaaaattaaaggacaaacactaatattgggagattttaatctaaatagtaaaagcgttaaatggcacaataatacaccagccccttttaacaaaattggacattactttgtcgaattctttattaaaaatgaattatctttgcactgccaaacaccaacaagaggtacagagatgttagacttatgcctgacaaatgattaccgattatcacttgaaaccgaaactagggatagcttgataaattctgaccatgaatcgatctatctcaacctatctatctctctaataaaaaatcccagtacaaacatttctttccgtaaatttgactcaaaaaatactagtttaataaacgcattcctaactcacaatttagaaaatgtcacccagacagaatataacatagaaaataaatacagtcgatttgttaaagaatctctaaacgggctaaacctttttgccccaaagataacgttcgaaaagaaacctaaatcagtcaattatcctaccgctcttaaagcatcaattaaagaaaaggcagctctttggaagaaactcaaaaaagaacctgaaaaatatcttcccctatataaatccatagcactccacatcaaaattcaaactaggaaattccaggaaaaacaggaaaaaaaattcttagaccaaaaccccggaaatatatataaatatattggaaaagattttcagcgttgggaaataccacccatctctcataaccaacaaatcataactgatgacaaaactaaagctgacatttttgcaaaccatttttctgaatccttccaaatttatcagaataccccaaacctccctccataatttctgttaatcaaccttcaatttctgacgttcatttcaatgttttagatgttctcgaaattttaaccaccttccaaacaaaaataatacatctcctgacgatttaagttttaattttctgaaacgttttcatctaatt

SEQ ID NO: 5073 - DNA, 2339 bp, Heterodera glycines
tcaaacccatttaactcgaaattaattgcaagagtatttattaaatctaattaattttaagtgtgatatttgtcgattattatgatggaagaaacagaatcgacacaaacggagggatcggtgctacattttgaggaaatggcgacgaatcttttgcacaaaacctctgccgattgctctcaaagcaatgaaagaactctagcagtgcatttcgtcaggacaacacattcccgaattacttcacgctgctgacgaattggttggattttgtgtgaattaaagaatagcaaacgtattaatgcttcaggtgctttcgattccacgcgaaacgaaaggacagatttcgtatgatgtggcaactccggtgctatttggtcaactttttgctttgtcgctgtgagggagagcgaggctatttaaagaaagcagcccgacttgcacaattcaggacgacattattggtatatcggattctccggtccttagaactccttatactatcttctcacaaaaactcttttcagatttattcaattttctctctaaaatccgggtaaactacccaccgtttggaaaacctcaattattctaccactatttaaaaacggagataagaatctagcatcaaacttccgtcccatttccattacctgttcttgctgtagaattttcgaaagaatattagccaaaagaataacagaatttttactcggaaaataacttaatttctcgatcaacaattcggtttcctcagaaagcgctctaccaccctccaattaatttcgactctcgaggattggtataatgccatacttctcaataaaaaaatcgactgtatttatttggacataattaaagcctttcgacaaagtccctcatgaattgctaatttataaaatagagaaaattggaattaagggcaaccttctaaattggcttaaagattttctaactaacaggacattcaaggtcagaattagtcagcagttttccaaagaatttcccatcaaatcaggtgttccccagggatctgtcttggggccaattctatttttaatttttataaatgatctatccccagtaatccctgacggaatttcgctaaaactttttgccgacgatactaaaatttatttttgctatgacaccgaatctcaacgtaaaaaactagacgaagccttacattgcgtcagccaatgggccaaaatttggggtctacaattttcaccagaaaaatcagcttctctatacctcggcaaagataatttcaaaattccatacaaatttaatggaaagactattaaagagacccaaacaattcgagatcttggaatcttaattgacaacaaactgacctttaaatcccatatttctgctattcttcaaaaagcctaccttagaagcagaacgctttttcaaaaaattaaatcaaaatcatctaagacatggattaaaatctataaaagctatattagacccttacttgaatattcatccgaaaattggaacccccacattaaaaaagaaattattcgccttgaaaaatttcaaaaatttttcaccagaaaagtgttcttaaagtgccatttaccggttttaccatattcagaccgattaaaataccttaatatttccagtcttgaaaataggagaaaatatttagatctgatcacagccttcaaaattattaaacaagaaactcacctaaaccctctaaaattatataacatatctcaaagaagaaattcaccttttcccagattaatcactaaatctaaaattactaaaactgaacattcttttaccaatcgtaccacaaaaaatttacaagaattaagcaaaacaatcgacctttcatcaataaactcaattcaaagttacaggaccaaacttaaaaaactgttggagatctaggacatttccatatgtgtaagcggcttttgtccttcatttggattcttttatttgaataaatttgaaatttgaatttgaaaagaaatttttgccttgtgaaaagaaatttttttttttggaaaacgggggcggggttctatctattgagggcgttgtaacttctcatcagcaaccatagagaaacacgaaaagacatctcaacgaattttgaacttaaattcccttttccatagcaggaaaatggagtgcaacgtctcaacagacagacgaacccaaatgaaggtagcgaaccaaaaatggaagtgtgttgaaactacaaaatattcagccttttatacccttttgagactcataaagctatttttgcaaatttgtagtttttgcgggaaatgtatggtataaaagggcgtgcgtttttccttttg

SEQ ID NO: 5074 - DNA, 2922 bp, Heterodera glycines
tgccttctcttgctccttttctcgctgcttttgctgctgttcttctcgttgctttctctgctgctcttctcgttgctttctctgctcttctctctgctttctctgctcttcctgctgctttctctgctgctgctcttctcgctgctgtcgccgtttatcctcctcctccctctcttttttgtctcgctcatgcttcaagcgaagttgatcaagttttgtgcgatttttcaacggatttaatggtgcttcttcaggctcttcctcctcaacgacttccatgtcaacaatctccccctcatccgggtattgtattgacctttttcgggtcaggtgtcgttccatttccgctatcatgccgtggtgcattccccgttcaagctgctgaggcgaaaggaagctgccccttggcactctgaaccggaacttgcgaccaccgcgcaggtgcaccactacgtattgcctctccagggtccctacagtcgcccagctaaactgtacaagggcaatgagaactgtacaaacccactcacctgttgggatatattatgccagacatgcccaccatccatcccggcccatcaaacactaatttctttggcaagtgtactttgaatttattcgttttattgccgacaaatcccggcgtattgctgggcaaaattacaaagaaagagttactcattttaacgaaaaatcaatgaatgaatggtcaaagatcacttttccgtcttgaaaaaggtgttcagtcctccgttcttctgtggtccatcatcctttttttggtgtttcatgatcaggtcggtgcagtcaaagttcaacttggcacagtcttggcagaatgtttgggtaaactccagcttctcttggccactgccagtgttgaggatgaagcgcttgtcgcctcgcttgaagttttcgttacggcattcgttgcacataaaggtgaacaccccatactgcaacagaagaagaacattgtagggctgccaccagagcaaacattacctttgggcgtgcgagcttccagaaaattgttgggtagtcgaagacgttggctgctttgcgttcgtcgacatctgtgacttcaacctctgcggggttggacttctttgcgttgttcacgtcctccagcagtttttcccagcgagactttcggcccctcttcttgagcgcaggacgttcctctgcgtgagatgactgcgagtcaaccaacttgacgtcatcatcactatctgaaacatggaaaaatgagaaaaaatccaaaatttttgtaaaatttgtgaaaaattttacccattttatgttttctttggttgttttgtgcttcttccacgtggttcgcttctataaaatgcttatatttgtgttttattttaaaatttactctggatttcgtccaaaaactgctcattctgcttacgaggagccattttcgaggaatatttttgtgtgttaagatgaaaatgagaagggaaaagtgtgggggtactgtatgtaacgtgacggagagggcggggggtgtcacgtgggaataggccactcccactcaactgagagcacgcagggacctccagacgggaggatttcgaaatccatccacagtatgccctcctatgccacgccccttatcattcacttccctgtcagtcatttagatgcccccactgacaacagccttatccaagctgctgaactgtaaagctgagaatttggccgagtacctgaataacccagaagctgttaacaaggcgagtgcatacctgcgaggaaagaagctcaagacaacctactcgaacaagggcggcactacaaaggaggtcgagtttggcaacttctcgctaaagtctgcttcggagacgtacgccttcgagggattccttggcaagtgtcctttctgcaaacattcccacattttggaaagttcagaggtcaaagttcaccagtacttctacataaagcaccggatccgcctgctgtacccccagctgaagtgcatcgttgagtaccacagcaaaggtcattgcaagtattatccgttgggtaagctttaggctgcgatgaatgcccataatctcgcacggtttcagagttgttggccatagaggacagtgcagagataacaggcgaaaagccaacagacaccaactacttggactacctcggcttccgaagtgtttggcagccaacccccgtttattgacccgcacagagatgaagcgttcgagaccgtcgcaggagttccccgagattgattttaacgtgaacacgatgggtgtcacggtgtacagccctcgccatctgaagacccctcggtttgtgccatgggatcagccgggtcggtgtacacgctgcaagagtgggaacgtggagctggactacatcatccagccagagggagtgaccatcttctcttcacggctcaaggatgacggagagaactttctgccatttgatgagatcggtaagggtttggactattgcgaaaaagtaatcagcagcttaagtggactttggcgacaatgccaagtttcgcgtccggtcacggaacaaaatgttcaccctgccactgagacacccggaagtttaccaagctgcacaagtcgcagcggaagcgaatgaactgctggcagaagttccaccaatggctgataacaatgatgatgatgataatgttgacccaaagtgataactcagtgtgttgataagccattttgttatcattcgtgatggattacccgtgaataaatgagcgtgaactcaagtttcccattccctccgggattgttgtcagcgggccctcctcttcgggtaagacgcagttggtccttcgcctgttggcacacgccagcgagatgtttgatcccccgccgaaagtgatagaggaggacccaatgccatgagtaatgagcagtccccttgggt

SEQ ID NO: 5075 - DNA, 4277 bp, Heterodera glycines
aatgagagtgccaaggtccaatgcgctgtacatctttctgatgcgtgcgcccagcgatatgttgagcatccgtaatttgtccagccaaatgtttcctcgcgagcaagggtttctgatggacgcgtacaagcaggcgtgtgccgatccgtacgggtatctgttggtgacactacacgcaaacacagacaacatattacgactgaggacaaacattttcccagacgacgaagataagattgtctttgtacccaaaaatggttaagaagcaaatagtcggacagcgggtgttggacaactacgagtatctgaagtcccttgggaggacgacatctcacaagaagaggcgtcatttgttgagcagtgcaggttgtgaagagctgttgactatggtggagatttgcctaaaccttctgaacgggtccttctgtttgacacggaaacagaagcaaaagttgttgccttttgctaacaccattcgacggttggcacgcgtgagaagtgtgagcagagtgcgagaaagccgatcttacaacaacagcaaccacagcaggagggaggttcactctttgtccctttgttggcacccatactgttagaggcagcacgttatctgctgcgcaaagatggccaataagctcattcttctgccttttgagcattaccgaggattagttgcatcgagagagggtgtcggccttgcgaaaggagacgacgatgtggcagggcagacaaatttgggattcgtcaaacgacagctggagaccgtgaagaggaaacggacagcgaatgtcagcgaacgaaatgtactgtacaaccagcagctgaggagatatttgaagctgagaaaggaggcaaacgacaggccttccaactcagcaacggtgctcaactgatgaataacacggtggagacgggcgtacaggtacgacctggcccctcgaaccgaaggacaagtccgtattgattgctggcgaagatgaagagattgaagtgcctacgccaataagtcagacgccgggaaaaagccgattgcccaggaccaacaagaaagcgatcaagcagaaagaaatgaacgaaaagaaggaccacctcttgcccatcattatgtctgatccgcagagattcggcgctacggaccgtgggaaaatattaaatccaaagacggggcgggagttcatcgactcggacctggcctggtcaattgaacgcctagtggaccctcgcccggagaatgccccttcaccaagcggaaccaaagagttgatgaggaaactcgcacagaatccgctcgccagtagcctacttaatcgactattcgttgggtctggacaagtcaaacaaacgggaggatttgttccctctaaatggacgaaaaaataaacaaaatatacaccgacccggccaatcccggtgggtttgcgggtgcgagtgcactctatgcagcggtcaagaagaagcacccaaaactgaataggaccgactttgatgactttttgcagcgtaacaccacctacacgctgtttaagccaaagagggagaagtttcagcgccttcgcacagtccccggagggttcatgaccagtgagtttgtccacgttattttcacgtgatcggctcagacgttcaggcggacttggcagacttccaagccctttcgcgaaagaacagcggctatcggtacctgctgttggcggtggatgtgttgtcgcggcgtatgttcggctcacccgtaaagagtaagaggccggcggacgttaaaagggcatttgaggaggtgtttggtcaaatgccaaagcttccggaaacactgtacacggaccgtgggctggagtttgtggccaagcccatgcaggagttcttcgccgagaatggcattaagaagtatgagaccagctcaaagaagaaggctgccgtcgcagagagagccattcgtacgctgaagacccggctgtacaaatatttctctgccaaaaatacctctgcgtgggtggatgtgttgcccaaaagcaacttgttgctggcgtctcctcaccaattggagcgagcggctcgcgcttcatctcctcgtcaatcaggctgatccagctgggatcctcctcctcatccgcctttttggtcggctctttgttctctttgttggcgtcctgtaagtccatttcgggataagcgttgtttatccaatcggtggcaagaattaaatccatttaaaatctgtgaaaataaaaaaaaactataaataaaaagaaggcaatgtgccagtcactgtacacagcggtgtcccacgcgcggaacaagtgcgggagtgtgccaaaaaagaaaaaaccttgctggtgctggatgatttggtggtgggtatgagtcaacaatataacattggttaaattgatttttttgtttaaagacaaataaaggattcaaaaattattacaactaacgcctaacaaaaatcacaaacaaaaataacacaaaataaaaaaacaagacgacaaatatattaacaaatatctcttttgaaatatattttatttaatgttttatcattggtattttattattttaatcgtatcctctaattttgcaaatttatattatgcgcaatttaattacttgtttagaaattattcttggaaagttaatgcaatattgtctgatgcacaaatgcatttagtaaatatttctgttttctattatagcttaatgtgagacaaaccattctgctggtgttctgtgtaatcgagattatgtattaaaattgagttgtattcgtttgatatttatttatttatttataaagtaggcaattgcattcaatgttttaaaatataataccctcaaaaaatcttttcaagcataataaagttaggtttatacattaacttttataattttcaaaattataagggctttattcatacttgaataaatataatgaaaaatattcgatggttgattaatagaaaaattctttttatggatttttcttctttttattattagtccttttaattgtttaattataatgaaaacaaagatttcgaattaattagatcaaatgcgaccgaccatctgacattctaaacatcggtttgaggtatatttagatggaaattgcgcaagaaaatgaacaaaattttacttctttttatttttatgttaattttctactttgcttttggttgttttcgagttgagcgatgcgctgaatggccgcgataaagagtcggatgctggtgaaatgtcggtggcaaccgctttttgacgactgatagaagctctgaaatatctttaaaacctatttgttttaacggaagaaaatatttgtctgatttaattcattcccgtcgacaacttttcgtgggagaatgcatttttatgataaattcaaaaattttaattagagaattattagttgtattatttttttctatataaattgtatcctttcattgtaatgacttgaatatatttttgtttaaagaaaatattattgttgggtatttgataaagataatatttttgacaattttgggaatcatattttgaattggcgcctttcgcaatatttcattttttataattatagatcttttttgttaagttttgttatacttcttattaattaatacctttatttcttcttttcaattgaaacattgactaatattacattgaaaaaagattatgaaatttcatcaattttttatatgcttaatttttggagtaactaatatttgatttataaatttaaaaaagaaccttaatgattttaattatgtatattaaattttttttcaaataatattaaacaatgtgtaaatttgagtttgttttatactgcaactttctttcttattgtttatatttattattatgtttcaatatactcgtcttgcgtttatttttttacgactatatttaagtaaaattaatcaggcaattaattctctattcctttttatatgagatttgcaaaaattcttgctcaccgcatctatgccaactattttccagaaggaaaatcctcgtactcagttgaaaaaagcgttaaaaataaaatacaaaaataaatttattttaaatattgttgtaattgtgaaaaagagataaatgaaaatatcggccgatgtacaatttttgttgaatatattaattcgacaataattgataaaacatttgttactaagacacttctgtacaaactacactaatatacaaaagcgattcgaaaaaccccagattgactttaagaaatataatcattagccgtaataactaat

SEQ ID NO: 5076 - DNA, 1236 bp, Heterodera glycines
aaaattagacaattcagtaccaaaataatactgaaagacataaatattttgttttataataaactattttacgaaaaataaataagaatcataaaaattggcaagaaaaaataaataaggatgaaaatatatatgtttattttcatttttaatgttatattatttttggttattgttttttgtttttccttgtttctgcttattttttatcattggattatttttaaattgtctattttcagatacatttttgaattctattttaccttcaaataattttcgaatttgatcatataaaatgcttttaaattttttttttttaatttttttttccgttttgaaaatttaatttcccatgacttttctttagtatgctcacaaattttacaagggtaattttgaaaaaaaatgcggtgatataataaagttggtcattgtaatagaggatattattgaaaaaatgcccatatatgtgcataattttttttttaatttaaaataaaaaaattatttttttgcgcaattttgcagattttttttcttttataatacaataaataaaaaatattaaaaaattgtcaacagtatcaaacagcttctaaatttttatagaaataattgatttctattttttagaaaattatctcccaatttttttctaaaaatgcttggagcgcatcaaagtttaaatagtcgttatattttcccaattaaagattttaagaaatttatagtccattttctattttaagtccacacttttttcttaaaagaaatatttttttcttgttttgtattttgtttaaataaaaaaataattaaaattaatagttattgatttaaaaacatgcacagttttttaacattctatttgtttttttgattttatttaattatatctggttcaattccattaaaaaattttattattatttatttgtcaacattgcaacacaataataaaaattaatttattagttaagattttgcatcacaatattctttatgcacggatcattgaagatcgaatctaaaaaatataaaaataatatttgttaaattcctaaataatttttaatctcgagtacagttacgcacttccctgtgttcatttctgaaccccatcaacaaaacggtgtttaagcgaagaattcgcgtaaaaaatataaaatagcgataacatcgagaccattttgaaagttgtttctcatttttcaaataatatattttttaaat

SEQ ID NO: 5077 - DNA, 841 bp, Heterodera glycines
aaagtaatcctaaaaatgattcattttttccggccaatattaattttaagaaaaggagacaaaagaactgaccgcacaaaatgtcaaatgagccaaatgatttaaaaatttgccaaaaaaacacttttactttgtattcaaattttcaataattctatggcttatttcagggttgggatttcatgtttttaacaatatttcgagttttcgtatataatttttttgtggtcaaaaatttgctaaaaattcagtaaaacctaaaaaaagaaatatgaaaaatttctaagagaaaaagtttctaatttttcttgccgtgacgaaaattttaattaattttgacaaaattcgtctggaaattattaaaaaatatttaaaaaaggtaaaaattattttttatgaatttttaagtaggagaataaatttgtggtttcaattgaattttttgagtaaaattgactcttttgaataatttttttctttatttgtgatgttcttatcacaattttgtcatttttttgagtttttagcaatattttgagactttttagcacatattttattatatatttcgcgattttaaaagtgaagatggatttttttcccacaactgcaaaaattgggcccatttaaatggaagagaaaattggccgaagaataagccaaatgaggcattaatagtgaaaagaatgacattttaaatttttcggccattaatatattttttattatttcatagattctattcaaaaattaagtccgctaatggatatttttttcgactctaaacggttttcccggctttacaactgtactcctaccgcgttgacgatgttccgtttga

SEQ ID NO: 5078 - DNA, 3146 bp, Heterodera glycines
  misc_feature (46)..(46): n is a, c, g, or t
  misc_feature (48)..(49): n is a, c, g, or t
  misc_feature (55)..(55): n is a, c, g, or t
  misc_feature (58)..(63): n is a, c, g, or t
  misc_feature (66)..(67): n is a, c, g, or t
  misc_feature (69)..(70): n is a, c, g, or t
  misc_feature (89)..(89): n is a, c, g, or t
  misc_feature (93)..(94): n is a, c, g, or t
  misc_feature (98)..(98): n is a, c, g, or t
  misc_feature (3055)..(3055): n is a, c, g, or t
gcatttcaatgctcgcaattttcttccttttttcccttctaggaanannaacagnaannnnnnaanngnncgcccgttcgccccccttnaaanncagnctctccatgctatttgtctgtatgcaatgcgcatattcatggcccattcgtccgcttacaaagtgatgtttctgatgggagttggccatatttgttcgctgttcgtcaccgctttgctcaccggactgttttcactctgtggcattgtgttcatgttcggcgccctctttgaacttttttgccggctccacggcactctgttggtgccactaattaagcattagttagctcattaaagcattaattatctcattatctattaagtctgctggtccctgaccacctctctgtccgttctgttggccttcgagcgttgcgtggaacagactttgcccaatttggccaagtcactgttccaagggtgccgaatttggggctggtgtttggccattttggcctattccctttactacggcttcttcacaattccgctcacattcagcggcatcaccgctaattggcagttcgacccgcatgtcggttatttggaggacagttcggcgaatggccaaaatttggtcagtttttaatgggaaatatgaccgttaaatttcaaatgtagggggtgtaaattgatttgaaaaatttcgtttcgaataaaattaattgcccagtgcaccaatttcattaaaaaatcaatattttgtgaaactttttgaattttttagatgtaatttttgacaatttttgaacaaattttttaatttttacataaactcaatttagggatatacttttgaaaaaatttatgtcatttctttgggtatttttcgttcttcttccatttataacctaaaggctttttttcattgtttcaaaccaaggagcgttctaggaaaaaaccatataaaatcctagccctaattcgtgacaattaacggattaaaattttaagtattggaacagcgttgatgcaattcacacaattgtcgtcgccattctgttaccgtcgctatatttgctttttgttgtcatgttttctctgaagctcactcaaatcaataaattgccaatggcggagtcaaaacatcgaaaatcggtcattaataaattattaaattaattacattaattagttactgaatttcaacatttttgtttttaggtgttcctccaagtgtttattctgtcatttgtgctcaccatcttctccattaattacactcttctcaattttgttcccgtccccgacctaatgatctccgtaaatatgtacctttgggtgcttttggatggtaaattcaatataaaaataattttaattaattttttttaaattttacaatttttggcgttcctccgtttgtttacctcgcgttgaaccgttcaattcgtggggaatgcgttcgcttctttcgacctcatgtcaatgcgccacaaacgcttaaaactcagctgataacacgacggcatcaaatgccaaaaacactccgcaattttggttaataattttgtcgatgctgacaaacaacggacaaaaacaacgacagttgaaaatgtaaagcatttaataaaacttttaataattaaaaaatatttggacggttttggagtttaattgtgaaaattttcccaccattttcaagcagtatatgtgaagcattggaccagcaaaatggtcagtcagcaaacaaattgactgacaaatgagtgcgtaacaaactgaacagtgaaaattattgttttgcataattttatttaaatattggttattgttgactagttgattaaaaaatatctgtgtaaaacatgtaactgactgtgtaaaaactaattcatcaaaatttgcattaaaatgtcccaataattttttagtgtttttaaaggttagccgacttttgcgccgcagacatttgcgccgcgacacttgcgccgctcagcaaaaaagactcttgcgccgcgacatttgcgccgtacagcgaaaaaagacatttgcgctctgattaaaataaatatatgtgctttatagaataagaattgatagatattcattattaattcctttttcgaagcctttcatgtcaattccatattgaagtgcacgtaatgattgatcaaatcttgatcattttggctttcattgggaccatatgcgataacaagccttcgtattgcctgatcattaagcggcggattttaagcgaaaaaaataggtaaataaataagggcataaaaatttcgaaataatgcgaaaaatggtaaaataggagcgaaaatttgaaaatcagtgcgttttttcaatgaaattaaattaaaatcgatgaaaataacttattgagaaaattaattacaaaggaattgaatttcattcttttttcgaagcaaaaaaataattggggtttctacagaaaattcttttttttcagttttttgttagtttgtattattaatcattttttcatatctttgatgaacctattcaatgttaagattttaatggttaaaaaattgaatgtcaatctttgtgactagtaattttttcgaattttcaattagttatttttgtcgatggcttatagttttagtaaaaattattgataatagtggaatttttatgaatactataatatttttgacagcgaggcgcaaaagtccatttttgctgggcggcgcaaatgtcgcggcgcaaatggagcggcgcaaatatccgcggcgcaactgtctgcggcgcaaatggcgcggcgcaagtgtcgactttgctgagcggcgcaaatggtgcggcgcaaatgtctcatcacgatttttaaaacgatgaaagtaatagaaaataaaaacgtgaaataaaatgtttacatacataattttaaaaatatattaaaaaatcccacactctctgctgcccgggatgtgaacgcaaaaacccaaaaacccccggcaaatatccggttttcagcgatacgtgatccgcgaccgcgggatttttctgtcagcgctgcacccctgtgtcctcagctctncgcctataagagttttcagcttccctataaaaaaaaaaaattttttaatttttaaattaaaataattttttttatgaatattgttttactg

SEQ ID NO: 5079 - DNA, 4802 bp, Heterodera glycines
tgggccatttttctaagaaaaaaataggagtttttggggcatggcggtgcaaataggcgccgccgggggaaaaattggaaatgttgaccatttttaaacaagttttcactgaaaattagcctatttatagacaaaattttaggggaatttaattcctcattcttagggggtgtaatagtcgcatttcgtgcaaaaatgcgaaacgcgaaaaacgcgaaagcgaaagtgacaaaaaaaagcgaaatttgcgaaagcgaaaacccatccctgatgtaatggtaaaggacattcaatataatggcatttttcaaaaaaattttcaatttaaaaaaaataagaaaaaacgaataattcaaagaaaacatttaaaaaggaaaaaagaatgaatgatttgagccaaaaaatgggttcgtactgatacaataatataattattttgcaatgtatgccttctttttttgaacgatggttaattggatggagatatttgttaaaaaattttaggtttctatcttgatgaaaatttacctatccttttaaaattcttgcatttttagacaattaaaaaatatttttattttttaaatccttaaaaattgtccatatttttgcggttttgagccaatttttagtagttacttgtgcagattttcgtcgttaattttcagccccgccatttcagtcccaatggaaagggacgtttcagtaccaaatttaaacctttaaaaaacacctataataaatatatccaatcccagaagaggtaaataattgaaaaaacatctgaaggataaaacccaaggccaaatcctattagagaagggaaagggaggcagaggatgggcgtcagctgtcatgccttatggggaagggaagggacgcataccacctgagcgctcgcgtgtgtgccatttaagcgctcgcgtatgccatttgagcgcacgtagggaccatttgagcgctcgcgcgtgccatctgagcgcacgcaggggccttttgtgagcccgcttgttaaatttgagcgctaaaaataaaattcgagttaaatgaattagaattaaagttgataaaactaaaattatattaaattaataaatgaaattagattaaaataggattaaaattaaataaaagttaaagttcaaattaattgaaataaaaaaaataaataaaaaaaagattaaaaaataaattaaattaaaataaaataaattataaattaaaataaataaattaaaaaaaaatttttataatttaaaaaataattgaataaaaaagctaacattcattctctctatatctcttctgtctctctcactatctttcttttctttctctctctcactctctctctctctctctctctctcactctctttcttttttctttctctctctcttatatctctcttttctctctctcttttttctttctctctctcactctctctcttctctctcactctctcttttctctctctctctcttttctttctctctctctctcattctctcttatctcactctctctctctcactctctttcttttttctttctctctcttatatctctcttttctctctctctcttttctttctctctctcactcttttctttctctctctcactctctttctttcttttctctctctctcactctctcttatctctctctcactctctctcttttttctttctctctcttatctctctctctctcactctctctattttttctttctctctctctctcattctctcttctctctcactctctctcttttctcttgctctctctctctcattctctcttctctctcactctctctcttttctcttgctctctctaataccacacaaaaatataaataataataaattaattaaaaaattaaatttaattaaaattaaattaaataaattcaaattaaattaaataaataaaaattaaataaattaaaataaaattaaaataatagataaaaatttaaaaataaatgaaaaaatataaaattaattaattaaataattattaaagtcaaatcgtattggagggacggacatcagctgtcgtggcctttggggagggaagggatgccaggccacctgagcgctcgcacgtgtcacctaagcgcccgcatgggctatctgagcgcccgctggtggtcatttaagcgctaatgactgaccgtggatggcataaaatgttggtcatacggcgactcattttagtgtagtgtggcatagcatgaacaatttagttggcaacctgccaaatggtggtcgtataacccaaaacttatttgaggggtgtggtgacatgtggcgactggaggggtggcaaatggtacttgtgtcataacccaagcctaatgaagagatgaagagttgtagaaaaaataaatattaaaataaatttagtaaaataataataatggtgatgatagttaaaaataaggaaataaatgaaaataataataataattaagaaaaaagcgttaagaatttcatatcagatgggaggcggagaggggtagcgtgcatatatggaattttttacttattgctaagcaaaaacattttaatgatggaagaaagaaattttatattgaaaaattaattaataaaatgatatataatatgaagtatacatatattcttatcattatttttagattttaataaatgaattaaacttatttattaataaattatattttacaataattaactactaatattttattaagttcattttgttaaaaatttcaagttaaaatgttctttgattgcattaaacactacaaaagtaaaatattaatagaaatttcaaagaaataaacaattaaaacaagtaaaaatattgaaaatagtgaggatatcatacaatgctaaacggtgcacggttaaagtaccttttatgccgtgctgagcggcgaaatagcctttattggatagaggttctgaacaactcctttaaattaactgaataataaataaagtaaaataaaattcaaattaattcaaataaaaagtaaaataaaaataagattaaaattaaaagaaaataaatgttaaataaaaataaaaataaataaaactaaattaaaaaattaaattaaaattaaattaaagttgtattaaaatataataaaaataataaatacaatagtattgattaaaattaagtaaattatacctaaaattaaattcaatttatggtgttactgacaataaatagtaaaacttttctcctcaatttatttaatatccccatccactaaaaacaaccacataaatctttcaaatataatgaagggtctaggtacaaattctaccacaactatcttctcaactggaaaatttgtatttacagaggcaattaatgagaaaaaatgtaatgacattgaaaattttaatgacagcgctggtatcgtttaggagggaattatttgatgtctcaaaggaactaaggcattattaagggaaggcagcgtcttttagtatccattgatgtactaaaggaatgtatgactagtatacggcctgtatgcgatatttctagatcaataacttttcaactgaacacttggcaaattgatcattattctgtggatgaatagttggaaacagagagaactgcaatagaagtaagcggatatgtttagcatgcctgcaattagcgctacctagaagatgtatattaatgtctaattgaaaaaaataaatgataaagtgcgggagaggaatgtaaaacgttatgaatttatacgaagtcaagttgtccatccagttgtaagtgtattaggctgcgagatcgcgaaaatgttaatgagcaacaaataaatgagcggatttgaagacggaatgaaaaaatttctatgtgacttcatttctctctaccccttcgttaattttactacactctactcgattggtaaaccaatgtacatgtgctgaatgataagtcgagttaaatacccggaagataaacactaccccttgacaatactcaaagttttggatgattcctccacgaaaatgcgatgtgccagtcctacccgtcaaagtgaatggtaggctctgattctctttatttatgaagtgcaccaaaaacaatcaaaaaggcaggatagacgtaaatacatatgcaaacataatgacaaacaatgagatggctgagcaatctgcatttcaatcgaaattaatgttactacggttgaagaaggttacccatttaccaattgatactgacataaaaggaaatggtgagaaggaagctgaatttgtaagagagtgcaaagagaaattagagatcttaacccaacaaagatagctgtgaaccaagaagagtaggattgttaaactatgcttgaacaatttgtgcgacatatttctttacgaaattacagcctttaacagactttacttcattaatgatgtacttgattttggagaatatttcggataatagttcaatagacgtaatggccatcgaggatttggacatggagcacattttgatcacctacgaaaataaaaaaagtgggtaataaaactattcagaaatgatgatatagccggggcgttaagtactctccaccgacacggatagtcttgttttctcacatctacgcgatgctttttagctgaataagatagacaaaacagttcattgatggaaatagtagaattctacactgctggtgcaaaatagtatgcgttggctttaagacgtataaatgttctacatgatgcggaaatggaatacgtgcttaaactccgtggatgacactcaatta

SEQ ID NO: 5080 - DNA, 1394 bp, Heterodera glycines
agccgagcttcgcccacccctgctccggagtaggacaaaacgtcgtcagccgaaacgtcgttgaacgaatttttcgaccataacttttttcttaaacacatagagctatcgaacaacaccaaaaattcttaatttgattgacagcgaacaaagttatggttcaaaaagtcttccgacgacgtttcggccgacgacgttttggggtgcaccgattcccctctcctcccccttttttgaaataacgtgaaatgttaagaccaagtccagtttattgggataccgaaaaattgagtcccagtgattgaaatgccgaggaattggtgagatttgggtacagaagaaaagtggcgaaaaattacgaatattgattcagattattgcaaaaaagcaataatatgcaaacaaaattggacattttgttgaaaatctgttaaaaatgcggacaccccgatacgacgcttttttgtgcttctgctaaaaaatacagccctaaaagataagctcaatgcctaagaatgtttgactttttcgacttttcaaaattatttcgttttgtgtgagagaatcaatataaaataattcattggttaaatatttatttccaaaacggtaaaaaacaagttataataaatcgatttatccgctaaaaacaaagagatagttcgccaaactgagagaaattacaaagaaacaaagagattctacactaggtttttctctgcataataaagttgactaaatgtaataggataaaaaattcttttttacgatactttttcttaaaattgctatagaatttagaattttaaaagtctaatgaatcaatttggtgtccaatttctcgtccatcgtcttaagttggcacatggaattcccaaagtttcagcaatttctttccaatttatcattggatttctttttctcatctcctcacttcttttcgcatattccattttctcagcatccgagtaaattttccttttctcttaaattgaatcaaaattaattgtcattattatattaaattcgattaaaatttcaacataactacttaaattggttgtaataaaatgttactagctatagagtccaattttcttttccaagcagaaattgtgttcattctagcaccaattttttccgctattttttctttaattttccaatttggttccaaactgaaattttttgcaaattcttctttcactttttcaaattcttttactttttcaatttgttgttgcgttgaaaatttcttttttataccttaaaatgagacaataaataataaaaaatcgaatatgccattgatctcttaccaatttccaattccttcttccatttgtaaattttatcccgactaattccaatttcaatagcaatttcactttcaa

SEQ ID NO: 5081 - DNA, 4438 bp, Heterodera glycines
ttatctgatcatcagacgaaacattctgatcaacttgctcatcaaacacattttctttgcttaattgttccaattcaatttttggcacatttaattttgtccgtaaattatccaatgttttttcctttttaattttttgcaattcttttggctttatgtcttccatttcattttcattataattttcggattttatcattagtttattggcattttgttgtttacaattttcattattatcaacagtttcttcctttatggcattaatttctacaaatttttgttttttgatgttttttgagtttgatggctttaggtttttccacaaatcatcaaataaatcttcatcaattccatcaattagaacgaataaaaatgagaagaaaataatcattaaattaattttcagcatttgatgcaaaaaaaaaataataaagaaattaaatttgaatttttggttgctatttacttcctcccccgccgcttattgcatcaatatttatttttccaagcttgttgtttatgatttttatgtcaatctttttgtaattaattttttatgtatggcttttttaattaaaaaaaattacaatataatgttttaatgacgagataattgatttaaacacctaaaatttaactttacttcttcctgtttttaatttgaactaattttattgaattacaaaaaagatataatagataatgataaaagaaattttatgccattaattttggaaaatttaattaattttgttatttcagctatattgtaaatggaataaataaaaaaatctttttttcattaagaaaaataccatttaattgcaatttatcgtatttttatgacgaaataattgattaaaaaataaatccttttcatatttataaatgttgaaaataatttatttattcaaaaaattagaaaaaatttaagaggaataaatattttcagaaaaattttaatttataaaatttaattagaaaaaaaaacaaaaatgcctaagtatatatgtatgtaaaaacctttgaattctaaaacagtaaccaaattccaaagaaaattttattaaaaataaataaattttatttattttttctgcaacagttgatcattggaaattgttttttgtattttttaactaatcgctttccgtgttttttttaatatttttcataaaaaaatttcgaaattttccacttctaaaaactttaaatttccattatgatgccttaaaaatgctttacagttttacttacagttaagaaagttaaagtagaaatatggcgagattttattaaatttaattaggggaaatcaattcgtaaaatctctgacaaaaattgtgccaccattttccaatttgtgctgtgcaccgctatggcaaaatttgttgttaggtttctcgcctttacgggtggtcaaaccgtggcacttggccacaaacacatatattattggtggcactggccaacacttttggccacggagtgccgcagcggccccggccgcggtgctaatgagcgtaaagtgccacggcggaaaggtgcttcctcttccgccaaatttcagtggagtgaccgcaacgcaaccccaaaacatcgagcgactaaattggccattgctttagcatggaatttttattttattacaataaataaatatttaaatttaattttatattttttaaggtaaataaaatttgagactctccaaaatataaatattttttaatttaaaaataattagttttattgaacaaatagcccaagttttgtaatttttaaactatttttaattgtaaaaataggggctagtaaaagagatacaaacaaaaaaaaaaattctttccgtctaaataaattataaaaaatatttaaaatgcaaatgaaaaattttttataattaaaagataaactttattttaattaaatgactgaaaattaggttcgaaaatctgtaaaaagtattttggttaaatcaaacatggcttaaaacttttaaaattattcttccaataaatttaaaaattacattttgaatatatttaaaaatatttgaataatttttttttataatcccctctcatatcttccaccaaaagtaagctaatcctccctttattttactggttggcttatctcttatacaaatctcagttctactagacacaatggcactcacaatttgcattatttttaccatttgatcccctgtggtcattcattttcattgagtgccgcgtgtgggagcggtcggtttctgtccccgcaggggatgaatggggcggcatatggccactggcactcggtcgccgcctttgtggcggtgccggtgccgttcatcttgtcgtgtatgtcctttaaaatgcccaattgcttagattagtgcagagaaacggagaatggcactctcacccactcagcagaattagagaagcagaataacggttcataggcttatcccttctctgaccagcgctgttcggcacggcatcgcccacgagggcaccgagtggtggtcatttttaaatggcttggctttgtgttggcttttgcgcactgactgaccgtcgtatgccttttctgcactctgtgtgcttcatctttgtatggcttctctggcacaacaacactctagcgttttttgtttctctgctttacacgcgatgccgatgttttttcttttattacttctctggccccaacgcttgactgaacactctcgctgtttggccacacagttcatcattctctctttctgtgccagttttctctgctgctgttccattttatgttgtttgcatataggcagagaagcaaaagtgagaaaatatgccctccggggatgccatcggccgtttgtccattctgtccattcgtctcccatcaaatgtaagcggctctaaagctgaatgaccaccattgttcgttcttctcgcgctgcttttggtccttctactgtcacttttttcatcgatctttggacatcttgctgctgtgggcgtggcactaattagctaattactctcgaattgtgtaagtcgaattaattgtccattttaaagaattatattattaaatttggtaaaatttgatttttaaaattttattatattttttaatagctttctattttatgttagcttttttaatattttttttttaatttgaatttatttggtgctcttccacgagcccgattacttatccataaaaaaattcgtatccgattttttaaatcttcttggattttatttatttatttttgtactttagccatttaagtgcactttgtgccgttgatttgtagaaaaataaatgttaaattaaaataaattagctttttaaacactaccaatgaccaaacctgcgctaattttatttgttttaatgctcttctcgttaatgtaaatattttttttcaaaagtgagattgatcactgatcaaaaaggtggttccaattttatcagtgctttcttagattttttaatgtgttgacttttaacacttttagctgcacatttaatgtgttgaccgttgcgagtgtttatttattttggccaatttggcccatttatgcgctgactctctgttcctctcccatttgaggctaatagaatcactcaaatgtcattaaagattcggccagcagacaaaataaacaaacaaagtgtcaatgaacttttccacctacactcactaacaattttgaatcagaatccggaaagcaaaagccaatgttacaaaattatttttcaaatttgttatgtttgatttttttttcttttattttggggacgggtaatatttttttaattttttttttacatttttttaagttctaaatttatggttgataatttattttcgtttttttttgcgaaggcactttttcctatggtttttcgggggtcattgaccttataattcggactcgaaactttggatatggaaaaatgtggatttttttatttcccattttattttttgttagaattatatacccgaaattttgtcagaatcatcaccaaaaaagtttttccacattttatgtttcaattgctctcacccaattaattgtttttaaccaattaaaaattacatttttaccgatggatgtctagcggagccaacagttatccctaatttaccataaaaattagcttttgcgattttattgctaatattatgtccctaacatatttttggcattcgaaatcgccacccagcaggcggttccgaaaacctcatttcatatctcaatgaaaatgtgggtgtgtactttgccatttgagtctgtctgtccatcagcaatggtccactccaattggccactaataaaatgccaaaatgccatgccgtcgtcctcatcggctcggcttacaattccccaccgcccagcaggaataagaaatgggggaagggagtgacata

SEQ ID NO: 5082 - DNA, 4798 bp, Heterodera glycines
ctttccaaaattcaagcaaagcaaataaaatttaaaatttttacgattgaagccgatgggtcgactgaatttcatgggcttttatggctttcgttgctctcatcgcgtcacaaaatttatctcttcagcccaatcactttggccgacattcgtcattcatatttttattattatttcttcacaatcaacgcacaatttcttcacacattcgtacaggcatcgtcgaaaaacgtatctttgggcaaacatacaaaataaatacataataataataataataataataataataaaataataatataaatgcgtgaaaaagcgcaaattttaaccatacaaaaattttaattaaagattttagaatttaaagaaccaattaattttcgaccttttcaaatttttcaattaaattttaaagtttttcgaatttaaaaataacgacaattaattaattaattgatggcaacaattttgcaccttttcaggttttaaaattaaattaaaaattttcgtatttaaaaattgataattattaattgagagctgagagaagaacaaattttgcacttttcatattttttaattgaattttaaaatttttcaaattcaaattgccaagcaattaacttaggtatggtccttgggggttccttgggcttaatttcagctaattttcatagcttagttaacacaaaccacttaaattccaaattacatttaaaatttgaacattttttaaaaattttttttcgtattagaaacaattaaacgacatttaattaaaatattagtgggccccgctggattggtaaaattttaatgactcaagccttaatttccgctactttcaagaccgaacaaactaatcactgaaatattattaataataaaagtaaaaataattattttttatacaaaatttaaattttgatcatttaaattcattttgcatcaaagatcgcattttaactttaagccttttattttgttcattttgttgaaatgataaacaattttttgtttgttttcttttaatataaaatttcaacaaaattttggtgacaatgaatttcaattttttttatttattaaataatttcaaaataaattttgtcatatataatttttacacccacatacaatatgaaattaccatttataacttgtattgaataccaaattttcttatacaacaatcctttatttaatatttacttcaaactatgattggttaaaatttttgtatttatttattaaagcggacttttttcattaaacaatttgtaggactaaaagaacgtggaatttttgaaaagtcaaaaggccagcgctgggctctgagagcttagaatggttcgggattcctggattaaaaatctcattttacctggacttaaattcctggtattactgtatttcttcgaatagattttccccgggggttttatttttcaaccactctctgaagggagctttaaccgaaggggaagggggctctaatcgaggggctataatagatcaaactctgaggtggggctttaaccgaaggggcgggggcctctaatcgagggggctatgatagattaaacaaggtattagttttatacataaaaatcacagcgacatcccagtcccacccagacccttgaattaacaatcttattaaaaatatttatttatttttatttgtttctcccccccctcctttttcaatttttattatggccaatttaagcggcggataaaagggaggacacttttcgtttttttccatcaatatgtacacacatacaaatctcacaaccattttacacaatttgttgtcactgttgtcgtgctgttcctcctcctcctccaccactatttttatgacatatttttgcctttttctgttcatccctatcattcgctaaaaatcttacgactcaattttttgtgggagtattattggaatagaaacaatttgacattattaaaaacatttttatttttgttttggtttgttgatgatcacagtaaaagttctcccgcgattttttcattttaattttacatttaagagaattatttatttatttttttaccttttttattttttgttaaattcttacctatcaaactataattttattttgctaaagagattttggactttattttaattatttaaaaaaatttttgttattgcccattttttttattaagaattaatttttaatttttttgcatttgcttttaaattttctttatttatttagttaatttccatatttccccaaatttgctcattgttttcacaggaacaaacttttctttctatacgaattccatttccaatgttcgtacacagtattattttgtttgttgtctttctctgtcgggttcaaacttggctttcgaaaacaatagttacagtagctgcttacatcacgcctttgatcattattaaatccataccgtcaaaaatttttatcagtttttacctgctatgtttattagatttgcttcatcttgtcatcatctgatctcatctaatgattccatttgtctttatcactgttaggttttggtctgatcaggtaatttaggtagatctgattgccacttcaattttgtctatttctgatcgccttctcccttctctgatcataccaaagttagtttctgattcaaaatccttctctgaacaatctgaaattgtaaagaattcatcttgcacaccacaaaagaaagtagtataattttgatcagcgcgaaatgcaaaattcacggctaattgggcaatttgtaaatgatcatcgccaataaattattttccaaaaatattttcgggctatttacatgatccaatacaagcatttcgctaatattttgcataattttaatgtaatttaagtgttttcaatgtaacattttccatattttctcctaaaattggtgaaatttcaaaaatttcatagacaaacttttcttaccaccagacaaacaaacattcctcccaaaataattgccattaaaattagtaatgtaaaattttaaaaaaaataattgtggcgcgataaaatttttcggaaatttccccccaataaattttcctcccaaaaactatctgatcaaacaaaaaattgttgttcattcgccattttcctgaacgaaaaacgaaactctcactttctccatggtccgtcccggccttgacaaaaagtcacatcaaaaggcaaccacaaaaattttattgccgaaatttaattgttcgcccatttatttcactttttttttcttcggagttaatgtgttgctcaggccatgtgcatatttaagaccaaatgatgggagagagaactgtgcacagttcagcattttcggcctgtaattttactctttcctatcagaattattatgtttttgtttttttaggctttccgtcaattacatggaaatgtaggaaaaccggaaatttttgcgggagggggaacattaggcacctgattcttgaataccgaacagggaagaggaatgtttctgaggctaagcaatggaaaagaaaacaaaaaaaaaaaattcccgaacccaaattagaaaattcgagacagaattaatccaaaacccatgtccaattgtcttcacgcgaattaaagccctgggattgggattgagctgtgtgttaaatctctgatctcgaatcctactggagataagtcaaataatcactgtaaatcctggtttccgagctcaaaattttgaaaatccttattttccctatttttaaaaattgaacaaaaaaattttcttatttcaaccaaaatacattaaaatttttaatagctcttcctcaatctgccataatctgttgatttgtttaaaaaattttccacttaatataataaaaaattaatttattaggcaattaaatccatgttatctttgggacctacattaggcaattttttttcgaccaattaatctcatggttttccaaatcgtcgttttggttgttgcgccgcgccctatgtttccttttttgggccattttgcccggcggccccaccccaataaataaaataaaaaataaatttgtcgtctcatcagtctcagcggcggttgcgctgcaccaacacgccaaaattgctgcacaacataacacaaaaactgttgtttacaattacttacactcacatcacaaatgacacgcataaatgcactttagcgcccattcctgatttttttttttcaaaattccttcccgaaattgatctgaccacgcctgatcagtcgagtccgccggagggaaatgatcggagtttgggattgggttatttttcgggcggtttgcccttttccgttttcgaaggactgtccttaacactcgaaggtattcttacgatgcttgagcggtccgccggaggtaatgacggaatttggattggattcaaatgaatttcctggttatttttcggacggtttgcccttttctgttttcgaaggactgtccttaacactcgataaaatgttcttatacgccttatcggtcggtccgtcggagggaatgatcagaatttgggattgggttaaaatgaatttcttgtttttctcgggccgtaaaaaaatttctataattttgcgacgagactgtgagtttctatgaaattctcttcgaaatttcgaggtcgccttatcgatattgtaaattcgaatactgatcacttgtcgtgactcgtgagtatctcgatttagatatattatctctgtgaaccgatttattaattaaaatatttttaattactttttttaaaagacc

SEQ ID NO: 5083 - DNA, 8439 bp, Heterodera glycines
aaagttgcgcattttgccgctccctcagactctgatcgatgaaagtgcgcgactttttcggcaattcgatgctgccctttgtcgcctttcgttgtgccattgtctgtcggttctcctcaaaattggccacacagcggaagattttcatgcacagaccacctcctaattgagtgatgtttttgtccgtcacacccttcgcccccccccgcccccgcccatttccccaccaaaagtggcgatgaccaaaacgccctcctcgcgtcccatgcgtagtgctgttcgagaccaaaaatttcccgagactcgagaccgagactcgaccccgagaccgaaaaccccgagaccgagacccaaaaaacccgagactcgagacttttttcaaaaattttcctattcgcttaaaaatcgttaaaaacattttttgactctattcttaactaatttttggttttttttttaattttgattcaatttggtacaatatttatcatttcaaaaacgcacaaaacaaaaattcattaaaatttaagtgcaatttgttaactgatttagtccaaaaaatgaaaatattttacgaatttaattgttaaaattatgattgaattcccaccgaaaaatgaataattttatttattttcttgaccagatgcaattgtgcgggcgaaattgataaaaaattagtcactttaggaatttttgtgcataaagacactggattttttcaatttttaacacttatttgcgcacctattttggaatttttgacaaaagtgtgctgctaattgacacaaaatgaaccgacgactttaagcagaaaaaaaaatgtgaggcattttcaacttaaaagatttctaatgtaaaactcggttaatcacggaaatgaaaaagtcttttgaaaaccgacaccctagaaagtgatatttcttgatgcgattgaaaatttttcaaaatcagaacatcgggcttaaaaaaaaccagattttggggtctaaaaccagaacatttagcgaaattgcttcaaatcagttatttttaaaataattcgaatagatcaaaaatgtattaggtaaatattatattattcgcctccgattatcgaatttagcaatgataattcaatacgagatcttcccaacagaaaaatacattttgtcctccgttttgcttattttacagtgacatcaatggccaatgtcactttgtcctcttctttgttgtaaaatcctttgctcgggtccatcaattccttaattacccataattagactatttaatggattactcactcaccgcaaaagtaatgaaaagatggaaacccaaccaattctttgtgttgttaatgacacggtcacttagtgtccccgtggaattggccgctttactcttttgccagacaattcgaaaggttgccgaatattcgttgcgccaattaccctctcctattcattgcaaattaattattattttaatgattagggcttatatgcgcaaaaattgtcaaaaatatagttgccaaactgatggtaaaattttccaaaatttcttaaaattcgttaaatataatttaaagctaaattattaatttagaagaaaaccaagtaaaaaattatttttgataaatttacaaatgttttcaaagttaataatattctcgagaaaatccttcggcgttttaagcagtccccattcaaggaaaaaaatttgcaaatatttgagaagcccttttaatgaaaatttaattttaattttattaccttcctttgaagcatcataccaaaggtaaaagcccaaatattttgctttgccttcactgttctgtctgatttgtgcttcaatttgccatgaaactccatttatatgcactgcatcacttattcggcgactccccactttttccccggcaaattccgacaattttccaatttccaacgcaagtgtcccccttcggttgcccttggctgtgttccaatcaaaaattcgtccatggcttgggaatttcaaggcgtacaacagctcgtcgggtacacgaagatacaaatatggatgagaattgtattggtaaatgccgtacacttcttccattgttagcacaccaaatggaactgtaaaaatttcaaaatttgttaaattttccgtggcggtacccccgtagcatacattttaaagcattaaagataaaagctaataaaaaaaaccaattaatactgctaatttaatctcccgatccaaaaaattttaccgacgccttttgaaaactcctcctcatgaatatttggaaaacgaattttgaacagtgccggaccgagtacagaacgacgattttccgaggaacattcaatgccattctgaccacatttttcatcggcccaacggagtgccaaaaatgaaaaaaaaaaatttaaattcaattttaaaatcgaaattacagctttccaaatttgaaattcatcgctgaacaacaaaagatcactttcgataagcccactcaacattttttgatcaatctgcaaaaagtcatctgattcgaacaatttagccgcattttggcaaatgtaacgtaaacattggccggaaaaatcctttaaaaagtaataaattatccaaaatgatacaaaaaaagcctgaagtccctcaaaaactaagcacacatattacaaaataagaatttaaatctgtccttcccacctccaattcgaaaaggcaagcataggcataggcaaagaaaacattgtgtaattcggagatgggaatttgcaatgatgggccgacaaggccagaaatgttgtactttttggctaattagggaattcattaattaataaattaatttccaaaaaataaatttaccggcataaagcactgccattgcattctctccgttcacttcgctcaaatcatccgtgtaaatgaagctcaacatcactttaaaggctgctgcttcaacgtcgggcacctccacagcagaagggtaattagctaattgcaaattaatcgtgtaatgagcacaactaattgaaaattaacaaaaattattaatctttttttaccgttttcggcttgttctttgttagcgtcaaaacggaacattgcctcgaatacgtcggaagcatgcatcaaaacaagtttatgagctggcacaagcttaaaaagatttttaatttgaaaaatggaattattttattttttattttcaaaaatcgcctctttttcttctccatcccccaccaaaaagtgcacatccgcgtactctcccgtgctcagcatcaattttagcccagcaatccccgctttggacatgataaattgaaatatttgctaaattatgacagataagatgatgttaaatatgtcaagtgtctcctcatgagataatacaaaataatatagtaaaaaaaaaacttaaatccattttcagagaaaagaaaacatgaaaatagtatgtagataacagagaatttcttgggtttccaaaaaaaaaaccgaccaaaaaaggagacttaaactaaatattaataccaaaaaaaacaaaccaatctttttttttgttgtattttgttgaaattataaattttcaaataaaaaatgcttaaaaaagatacaaaaatgaactttcttattggggaggggacaaataaatactgcggcaaaataatgacctaaaaataggtatgataaatgaacttatttgaagtaatccatcttttttaacaaagatgaatttgattaaaatgtaccaaataggatttatgaattttacaagttttaaaatcgtttttaaatgaaaaatgcaacaacaaaattaggcgtaaattaatcaattagttaattatcaaggataattaaaaatttcacttttcggtaaatattgatcataggccccaaactcaaaaatgcttaaaaacggtcagaatcgatgtaaaaaggttcgaaatgggttggaaaaatagaattaggggtcaggatgaaaagtgccgaaaatggagtgccaaactcagctgggactcaagtgaccgcattataaaaagcagtcaaaagacatttaaataatttttctaaggtgatttttggcgctgataacgaatgtgacctttattttcaaaattccgaaccccgaacccaaattcgaacaaaaactcaaaatttataaataaaagaaaacatattattaaggggttttgaggttgctgaacacggttatgacatccattttgaccaaatttgaacaccgaaccctgactcgaacaaaaaaccgaaatttaattttgacaaaattcaaaattaagcctaggcttaggcttcagcttaggcttagggataagtgtttatctgagctcccaaactcaaaaacaccccaaatcgaagacaatctaactttcgcaaaagggagcatgcgaagacggagcaagtagtggggcgagacggagggcggaggaatacattgcgaggacgtatccaattgttaatttcatgattatctgataaaccagctctggatccagcgaagtcagctggattattgaaatatcctatttattcagttctgatatcgaaaaaaatcaactatgtatagcttctagaaatttatacgaatatttctaaaacatagctaagaattaaaaataaacaaaataaataggcaaaaaataaataaaaataaatatgatgtgatgtgaatttctaatcattttcataaaattcactcatcaatttcctcatcacaaacaattttctcgcagtaatttgcgataaactttcacataatttttcgacatttgctccagggaccagcgctgttcgacaatttggcgaattttggcacggtctagcttcgacacacgggcaaccagttgcttgacattgataaagtcgaaaatcatttggttgtcttcataatcgaacgtcacaccgttgacgtcatcgatgacaatctgccaaatttcagaacattttttaaatttgacacaaaaagcgccaaatttggtgaaaatatgttaaaaagtcagccaaaaatttcttagttttccctgcgggctaatgagcctcttattagtctacgaaggttgaaaaaaaattaaaaccctattttaaaacttttggtcacaatttcttttaaatcaaatgaaattttttgaaattttataggctcacagagaatcttagagatattaaattatactaagaatatttaatttggatgaatttttgacaaaataatgaaacgcttaatttgtcattttattttatttttttgtgaagaaattttttggcaaatttttgttaatctatataatgccaccctaatgaaattttttttaatacattaaaaattaatttgaaatcttctgatattttcaatcctttcctttttataatttatattaaagccattattaataattatgttttatacttcgccgaccgccccgcgttgaatggcaatcaccggcgtgcccgtggccattgcttcgatcattccgagcccaaacggttcgtcccattttggcgtgaacagaaatgcggtggcattgccaagaaaatcgcttaaataaaaattatttaaatttaaatatttaaaaatgcttttcgctccgcccactttcgctgttccggcccaatttcgcccacatattcgatcagatcagcatgcttttcactgatcagcggcagaatgcgcttcatccaccattttcgatggtcgtccacaatttgggcagcaattttcagcttcatgccagcctcgatggcaaatttgatcgccacatcgacgcctttgtccggaatcattcgtcccatccatgccaaataaggctgctgctgctttggcacttccacaaatttgaagtcgtcaagattgatgccgttgtgcaccgagccaacccagttcaaatcaagcacttaatttaatttttaaaagcaaaattttggtgccaaaattagggaacgctcacatggataagacccactaatgatgtaattaaacgccccactaattaaatgattaatagtgtctttaccaattggtgtcaaccgctgttgctcttcactgatcgaaatgtgcgggacgtcactgaacaggccaaagaagacggtgtcgtccacgggcatgtgccgtgtgtggaccgcgtggttcaaaaagtgccggaattcgatgaaacttgacgggtcatggaagtgcacaatgtcatattcatgtgcatgtcgtttgaccatttcctggagtcaattttttgggaaaaatttattgtttagtaactatttttgggttattttttatgattttctttttgtaaaaatataaattttaaaatcgataaattaatagaaatcatattaatttttcacaaaatttccagtattaaatggtttcttatacggttttttagtccagttattgtccccagaaaaatcggtaattaccaattttctcgaaaaaaactcggtaacaaatcggaaatttacaaaatccgattggatgaataatttgaccgtgccgtgccgaacataaatgtttattacacatttaattacctgattgtaaattactggcagttgacacttcacccaattgtctttgcatgcccatgggttactgaaaaaaagtttttttccaaaaaatattaataaaatttgtacgttttgaatggaatttcaaacagttttgcactcgtttctgaaccagacaatgcaagcaaagtgacctttaattgaagtcaatttttcttttaaattaaattaagccaattaaatggtgaataattaattaatttcgccttaaatttgagtcaattgatttttaaattaattagccaattaaatgggcgaatttttaattttatgccttaaatttgaagtcaattgtttttaaattaattacccaaataaatgggcgaaaaaataattatttttttttaaatctaattttgaatttttattaatgacttacgtcatggccaagcttgaccagcgactcggtcaaagcataaatcattatttcagttccgcccgcctttttaggcggaagtgtgtcaaaaatgggcgacgataccaccaaaattttcagtttttgtccgctcaccgattttttgcactaaatttttaatttgaaataaatttatttaattttaattttttaccaatttgtgtttgtccgcttttttcactttttgttgcatatttgcccattcagttttgttttgttgtgccaataatttcgcataaatttgttcatattgtgccgtcaaatcttcacttccgtcttcattcactgtgccaatcacatttttccaatgggctgacacttgttctttcagctcatctctgaccacaattggcacatttgggaacaacttaatttcattgataaattataataaaaagatttttcatttcgagtttttctcactcagttcgaaattcctcgaaaattgaattaattaattcattaattagatttataattcattagtggtggggcaatttctcctcacaaatcaatcttttacgagccaattatgtaggaactatcttctagcagtcatccatttaaaggcattaaaaatgctttacttccattcacctaatattttcgaattataattttttttattcattttgatcacccccaccccctctaccttaactcttccaaactgatcagtcgagtaataacaactgaggaataattaattaacttagaattaaattattatttttatccgccttccccactccaacactaataatggttgtattgatcatttttttgatcaggtgctgatcaactttttcattttgatcactcgccctactccctccccgctcacctccgccaatgggttcatttccgtcactttcccatccgccggctgatcgtacagcgtggtcactgttttggccacaaaatcgtcaatgtgcggcaagtgttcaaaagtgtggaagtgcaaaatgtcaaatttgtcggcacggcgccgcacctgttcaaacatccatcgataggcatggttgaaaatgccgggcaccacgcgcttgtgacggaaagcgccgctgaaaacaaattaacagcaattaattctaattaattatttttgatattaatgtgaacaaattaagggcaattaaattttcttttattcataatattgattgctttttctataaacttaagtaaataaaattattggtaatcataattaatatactgaaagcatcgctgtttgagagacaaccataggcaattaggtaattaataattaatcggtttaatatatttagctaatgttaatttaatgaaattttttagttaatatgcttttcaaaaattactatgacgcatcggtgatcagatgagcagaagtgtttgagtcaggagaggcaaacagagtaaccttaatcaagtaagaatcattatacgcgaaattacgttggccattaaaatagaat

SEQ ID NO: 5084 - DNA, 3225 bp, Heterodera glycines
  misc_feature (54)..(54): n is a, c, g, or t
  misc_feature (78)..(78): n is a, c, g, or t
  misc_feature (85)..(86): n is a, c, g, or t
  misc_feature (110)..(110): n is a, c, g, or t
  misc_feature (144)..(145): n is a, c, g, or t
  misc_feature (152)..(153): n is a, c, g, or t
cgtccttcccgcatgcccatatgtatttgacacttcagacaataactatttatnaatgatttttgtccattggtcatntcattcnnattaatcacttacggggaaggaanagccaatcaataatccattatcatttattatgcnnttaattnnttccttctttggcatttgtttacccatttacccagtactttttaccatttatttattgtcagattggtattattatggcaccatttttgtgccaaaattcctcaattgttcattgtcaatttttggcattgtttttcccccttttttcacattttcatttgccaattgctttacattttgtgccaaaattcattgccatatttttagtattgttttgtcaatttttgcacatttttgtgccaaatttccctatttatttcttgccaaatttttgcacatttttgtgccaaatttccctatttatttttttgccaatttttggcattcttttgccacaatttttaaccctttcttttgccaatttttacacatttttgtgccaaatttcactatttatttcttgccaattttttgcacatttttgtgccaaatttccctatttatttcttgccaatttcttgcatttgttttccccattttctcatttaaaaaatatttaaattcttggcattctgtttttttcaaaattaaattatggcgttctgtttttcaaatttaaaaattattttcacatcttgggattctgttttttcaaattaaaaaaaaaaatatttcaacccttggcattctgtttttttcaaatttaaaatttatttaaattattggcgttctattttttaaatttaaaaattatttaaattcttggcgttctgttttttcaaatttaaaaattatttaaattcttggcattctgttttttttcaaatttaaaaattatttaaattcttgccgttctgtattttgaaatttaaaaattaattaaattcttggcgttcagtttttttcaaattaaaaattatttttcattaattttccgctttttccaaattttaattatttttggtttccctctttaaaatatttttattttccactcttttttttccttttttattcatttttccccttgttttttattcattttcattgatcataagtactttgtactgtcctttctcaccccattttttgttggtttactcggtactaaacccctttaggatatttgttaagccttttcaaatatcctgggggccatccttaaaccgaggagtcctgccccggtactgggttacttcccagagtggtgggcacgggcgttcactgtccacggggcttattccgctggtatccagggctgcggcagtgattgaccgaaaccatgtttccgtcatagcccgccgggtgtcacagcgatgtttaagcccagccagatagtcggtctggtgtggacgggggcccttcactcgctggccttgagggtgaaggtgtgcctgttcctagcagcgggggtggcggttcctagccctaatgtgccctgcctacgggctgcattggtacagcgagagaataaccgggactggctggcccggaggaccgtgagtcactgagcagtgtcgaacgcgcagctgctcaaactcaacaccccggattaaaatccgcgtagacggaacacatatgtgctgtgggcgttggcgcaaatgctctgtgaagggagtaattacccgacacagagatgcctacaccatacctccgcactttggtatggtagtgccacacactttgtgttccatgagcggttccataatcgcttgctatgatagtcatagttggtgggcatttttcttaaaataaaataataatactcaattcaattttagaataaatgagccaattttccgacgattccctcccccctacccttgatggaccgtattcccctgtcggggatgatggaaccgaactgatggatgatgcgccgccgctggaaaacgtcatcaaacacctgccaaacaccgtacgtttttgcgaaatgtttttaaattttcttttctaattttgtgagatcgtttcaggttgtgccgtctgaagagaatgagcgcaagacccgcagggagccatcaattacccgcgaattggacgcggaattgttcaaccgagatggatttgtgtgtttatccgccgcacaggcggaagcgggacggttcaaaggtgtggttgtacaacttttttttaattttaaaatttctaactttaattaattattcgctttatgctatgaaaagtatataaaaatttttttttatttgtactttgattaattgaggtattttaaatgatgtttagcgtttcgattcattggccaatttttgctgagcctaacgttcggcgctgtttttccggaggacattctgcgcaacctctttaccatgtgcctttcctacgcagtcgagggggccgaatcgatgaaaatatctgcggaccacttcattttccttctgacgtcaaaacaccttgactacgaagtggctgtacactttaaaaaaaatcgacaacacggcaacggagaggattctgactcgttttgaaatggtcgaccaaagcaacaaagcgaaagaaagaccgtcgctcctcgaagagccttttgtaatagacataacggcaatcgagagcaagtgcgccaaaccgaaaatggctggaaaagggcgtaacgacttcaacatcgactaccgtattgccgatggtgcaacgtatgagcttctgaacaacgacaatctctgtctcttccggtcatttgaaatgcttcggatgaaattcatacttgcgcaacaacgtttttcggaatacaaaagggatgagagaaagcagcttgaaggcgttcatgctttgtgccgggggtgcaacattgacatcaacctacccttctattcaattgaggaatacggagaatcaattcaggcaaataatttgtttattaattgactttatttttaagcattatctgttaaggcttattatgaggcgatcaatgccggcatgtttcggcttttttgctttgaaacctttggcaaaatgaaaccttcatggaaatcaactgtggacaactatacacatgaactttccgttatttttattgatggtgaagacggcggtgaagggcactacgacccggttaaaaatgttggaaaacttttcagtgcacgcaactattgttttggggtatttatagat

SEQ ID NO: 5085 - DNA, 4804 bp, Heterodera glycines
  misc_feature (177)..(177): n is a, c, g, or t
  misc_feature (3821)..(3821): n is a, c, g, or t
gatgccatttcatcaacaaacgcaacacacagcaaaatgcaaatggaaatgccacaactgcctgcgtgttgggtctgcctttcgaggaaactgcgtccaaggcaatgacaacttttttgagacctgcttggggtgcaataaagtaaagttatttgagtttcgtttcaaagaattttnttgtttagacatttaaaagtcgtgaatgctatgaacaccatgccaaatgtacaaactacagggtcaagcgtgacaacgaacatgaaattgtgggaaaatcaatttgtaaaagctcgaagaaatgcgtcgactgtggcgtgatttaccaaattcgggttattataaaataaaatttttttattttattaattttctcttaagcatcaccaacaaaaagagcatgtttgcggtcaaaaattctgcaaaatttgtctcggcttccatgccccgcgagactgctacataccataccggcctaaagtcaagaaggagaagcgcttcgtcttctttgactttgagtgcactacggatttcaagcccgacccgcaactcatgcggttcaagcaccaggtaattattttttgaattcaaacacaatttaaaaaaaacaaaggtcaacttctgcttcgcccatgtgacatgcacccgttgtattgagaagggcatatgggtccaagagcttgaaagggcttgtgcgctctgcggccgtttccgaacttatgcctggtcaccctttgaattttggcacacggacgtggaatgccacaaggtcgtcgaggacccgcttgctgccttcaccaagtggttgttgaacttcgaaacggaagtcctcggcatggagcccggagcgaagaagcgcagaaagaggaagaatgccgaaaacaccgacggcgaagccatggaatgcgaagaagaagaggatgccgtagatgaggacgccgagaacaactggatgctggggtatgaagaagccggggagaaacccgagtcggtgacaacgtacgcatacgcccacgccggtatatttgaaaataaaatttttgtaaacatcgatatgatcacgtgctgatttatggtgaaatgttgcgcatgggagtccgccccgaactcatccgccaaggcaaccatctcctggaaatgaaggcgcgcaaaacaggagtctacacacccaccgtgtttcgggacaggtaaaaattcgaagatttaaattatttaaagttctattcattcagttataagctgataccgatcaaattggcaaattttgtcaaaacgtttggtctggaaattgagggcgtggaaaacaagaaatattttccacacaaattcaataaggtaaggataatttattgaaaaattgataaaaaattaataaaatttaggcggaaaactacggcacagtcttggaaaccttgccaccgatggaggactaaggggagttcaaattcggcaactacagcttggatgggatgatggagcgtccagatgaggacaaaaatttggccattgaggtcaatgggtaaggaaagaattccgaaaaggtgccaatttccccattgaaaaaggtgctattggcatggatgcccaagctgcttccccgacgatgcggcaattgtgcgcggaggagaaacagccggtgccctcagggcccgtgatgccaagcgaacccgggacattgcgcgggagttcgaggtggaaatcatctgggagtgccacctgaacgcaatgctggaggacaacccagccatgaaggcgtacttcgacaactgcccggactccggaccaattgacttccacgacgccttctttggcggtatttttgggtttaaatttgcaaaataattttgggcacaggtcgaacagggcccgaatatttgggcgcttcggtgatcaaccctgagacgggcgactggaagagccgtacgatcaaagtgaaggactttaacagtctttatccgtcgcggtaagaaatgtcggaaaaaaatgaatagttgaaaaatctttggcactttaaggaatatgttcaccaattatccggttggccacccgaccgtggtgcagtttgacaaggacgtggaatggaggcgtccagaggacgttgttggcgacgacggcatccgccttgagggcatcatcaagtgcttcgtagtgccgccccgccactgccactacgatatcccggtccttccgtaccggctcaacaaccgcacgctgttttccctctgccggacgtgttccgaaatgtacccgcgcggcttgatcgaccccgagtacaattgcgatcattttgaggactctgaaaggggtgagtttgaagcttgtaattaagcaaatattttttcttaataggcttttgacaacagtcacacacattgagctggaagccgctctccgctcgtggtacaaggtgacgcatgtgtaccgtgcctatatctggcctctggcgtgcgattggagcaatgggctgttccactcgtacctgctgaagtttctcaaaatgaaatttgaaggtaaaatttaaaaaaaattaataaaaatcattaacaaaaatttaagcaagcggatatccggcgtcttgtacggaggctggcatcagcgaggaggagtcggaacggcgcaagcaggaccacatcgacaaggccaaacaaaaggcccacgttcatctggaggctgaccggatcaagcacaatcccgggctccgctacctgtccaagttgtgcttaaactcgctgtggggccggttcgcacttcggtaaaattttggttaagaattatgaaaaaatacaaatcctacagaaaccggcttacccaaactcgaaatcgtcgagtgctatgccgaggtggccaaactgctcaccaactccaaaaattgggggcagcagcatttgttcaacttggcggaaaaagttttggatgggcttggttaaaaggggcaaaaaagagccttggggggggaggccccccccaaccaaggggaaaaaaaaaatttttaaaaaattttaaaaaaaacaaattgggaattttttcccaggggggggcattggccctttggggcccccccctctttgggggggaaaacccctttttttgggaaatacccaaaaaaaaaagggggggggggcccccccccccccccgggggaaagagccccccccccccccccccctcttccctccccctggggaaaaaatataaaaaaaaaaaaaaaaaaaaaaaaaaggggggagaaataattttttttataaatataaaagaccacgcgggccccaagatttttttttcttataacctaaccctccccgccccgcccggtggggggggggcacccacccccctccctcgggggggggggggaggggagatcgtgggggggggcgggcgccccccgcccgccccacaccccccccccacccccccccccccaataaaaaaaaataatattttttttttttgtggggaaagaataaacatacaatataaaaaaaaaaaaaaaaaaaaaaaaaaaaaaaaaaaaaaaaaaaaaaaaattgtttttttttttttttttttttttttttttctctccctcggaggaaaaaaaaaattaaatattataaaaaaaaatttaaatttttaaaaaaaaaaaaaaaaaaaaaatatttttttttttttttttttttttttccctaattttggaaaattttttttttttttcttcccacaaacaccaccctgccgggggggcttttttttttttcaaaaaaaaaaaaaaaaaatattttttttggggggggggggggggggggggggggggcgccccccccccccctcccctcattccgtcntaatagggtaaaatgaaatttttccaccgtaaaaactcagtaccaagttgcgtgacgaccaaaatgatggtgtaacagaaatgccgacgtcctcctcgtggatggcgaaatggttgtgcttttgttgtgtcgacgaattttgcgacaataatttttcccaactttcaagggtactgttttcaaccattttttttgatgatgcctccttttttgaacaaactttgattacaaaaatgggattttagtataagtgaaagaataatggaaaaatgaatacaaattgtgtacagtatattgagtaatgaatgaatagtactactgtaatatgccagagatgggacagaatttagagagcaaatattaacatttttttgtggcagttaaattcgggttttcataaatttttgaaacctcggaatttgttttaagaaattttaggcatttacgcctaccgtatttaaaaattttctctgctaagtgccgcctgagtttcatttttgaaggaatgaaaagtattcattcaaatttgcccaaacaatcacaggtgaaaaatgataccaaataatgttgctcgcaattttaaactgtttaatgttaaacggttctccgatgggttggacaaaattgggataaattaaggcatattaaatataaaaaatgaatacgacaaaatcgggtaaaaagaaagtatagaaaaaaaaattcaaattttttaaattgaaacaaaaaaaaaattttttttttagaaacagaccaaaaaatttgttttgtcgcctccctgccccaccccgtcccctcttcgaggaggagaaagtgctggcgttccgcactttttttttaacactttttgatcccccaacaaaagaagattttgatgagtggaaaatgggcagaggaggtgtgaatgacggacggacgacgacggttcagtgattagagaaggcgcgcaaaatttatttgtgttctgtgtgaatggtggtgat

SEQ ID NO: 5086 - DNA, 1759 bp, Heterodera glycines
atttaggtgttatgaagccttaaaaatgttaattttccgactttttcacaaatttttggcttggcgacattttgactcattttagcttgggcgacatttcgacgcggcgacattttgacagcgcgccgtttatacgttgtttggcaaaatgaacattgttaataattaaataacaacctaaatgttgatctccgaagaaacaatatttttcttaagaaaaagttgttttgtctttctctactcccgggtctagtacgagttgggtttgtccggtataaatacggccacttttttgaccttgcctatcattccaattctcatcatttttttttgttgaattcttcgctttctctggaaaaatgtttacggctacctaaagcaaaaattttctaccaaaaaaattttcaaaaaggttctcttttaaactagcgccttatttcgagccctagcaataattaaagcctaaacggaaatcaggtcgaaagaaaccaaataaaaactattaattatgagtgggcctcagatacctaaatgaatacccatttatatttacgtatacccattttctttgtgtggttaaaattctttgctgattttgttattgtttagagcaatcataggcaatggagccggtccatttatcgagcccttcgcgttacactttgtgagcattctcccattatttctgtttttatttctgatttttcagataccacttctctgatcgcttttatattgagccaattgcatcgaaaggttatgtcgattcccccgccgttggcacaaatttggagattgatcgattttccagcgaactaaagctcagtaaacagtttaaagtgcttgtcttcatctgtactttttcgttttttagaacaaagtactgcgccaatttcagttgacagttcaaagattcagccgattgatggcctcgttggcatcattcagttggtgtccggcccctatttgatcgttatttccaagtcgacgagtgttggcacgttaaacggcgcggacatttaccgagtcactcgtactgaactgatccctttccgtaccagcgaagcccatctgagcgaaaacgaagtacgaacagtggcggaagggagataaaccgaatgggttaaaccatgaagagaaacccattcttccgtttttaatttaaatttatttgatgtatttttagcgcaatgccaaccaattttttgtggaaatgctcgaaacggtgctcaaatgcgatgcattttactattctcatcggatggacatttcacacagctgtatgtgtgcccttgtttttgatttccctactaatatttttttaaattcctttgcagttcaatggctttccgaaaatgcgacgcccaatttccatcagcagccgctgtttcagcgaattgaccgcaattttgtgtggaatacgcgcctttgtgttctttttaaaactgctgaggtgtgaggaatgaatcattacggggcattgagtccctcaaaaccgaatttcttttttaaaatttgccttagggtttaaattaatctcctccggtggtttttgttattcaatggtttatttttcattcctttacagctttcctccttcgccattccgctaattcatggcttcgttggcatccgccaatgcgttgtctgtgtcaaacccttcaaattggcactgatttctcgccgttctgtccaacggttttttcgttcactttggaaatttaattgctctttttcagtgccggcgttcgtttccaca

SEQ ID NO: 5087 - DNA, 4930 bp, Heterodera glycines
gggatccgttaacacaacggaatgtattcaggaccgtagccaatgaatttttttctaatttaaagagaaaatacataaaataacattcaaaatgagttcccccccccccccccccgaaactttttctggctacgggcttggatctattagtacaaatcgccgcgttattcgtcttataatctgtcccatttggtcatcgtccgtcttcattttcccctttttcagattcgcgcttccatccctttgttttgggcccagcggaccaatctccggtggcagcccgacccttctcttttgtcgcaacccgacgaacaaattgccgcttaccgagcccatcttaacgcactgacaaaccgttacggaaaggacgcaaagaatggaaaaccgcgggaaattgtgagtgaaaatattgtaatttaaacataaaaggagaaggaaattgaccaaaaataaggattgtttacccaaaggaatgtaattcattacatttaatttacttttcctgtcgtttcatctttttcaattaagttcattgtcaatctgatcaaccaatacggccgtgaacacattttgggcaaattattccaatcagttgccaaaacggttacatttgacaatgtccgttttgaacacttcgacttccatcgccattgctcctcgctgaattgggacagattgtcgttgctgcatgagagattggcacccgaagttaacaactttgggtaacatcattcatctttttacattacgttttcattattttcagctttttcttgaccaaattggagcgtaaaagtggtggtaaaaagtccgacggtctttgggaggattcgagcgcagttggggagagaaaatatcagaacggattattccgaacgaattgcatggagtgagttaaattaatcattttcctaagtaggcgttaattacttccccaatttcagttgtttggacaggacaaacgttgttcaggcacttttggccatggaatcattgcggtagttttttgggattttactataatacgccattttcatcagtcttcaactccaaagcattggcattttgcctcaaaatgtgaaaaactttgatgcctggcccggctttgtttatactttcaagaattgtaaatcgttcatatcagtggtgaattcgttttgataacgtttgttcagtgtgggccgataacggcgatgactgcagcaaacagtacgcgggcacagcggcgctgaaggcattttttggggggtgggggaatgatttgttcaaatttctttcgtcttttacagacggattacacacggatcggacgacggacattcggcggggcattgcaagacgcacacaattcacttatgcgctatttcaaaaacaattggagcgacgggtacagacaggtcaatggcattggcaaattggagataattcaccaatcaatgggtggtgtttaggacgcgatcaatctgttcctcggcaattacgtggtgaaccgatacaatttgcccgctgggttggaccattcgccagtcgctttcgatttgaatggcttcgccattgtgttctccgtgataacttttgccatgacaatcctttgtcttttggtgtccggtccgttttgcccatttttcctaatttttccccaaaattcagaaaaccctttcatcgctttgttttggctggctctttctgtgatgatgctctctttcatttggctccatggcgaagacttttccgaccgtcctcgtcttgttgtgtctggcaactgatgctaactcatcaatgtgccaattttggatgtgccgtttgaactccaaacaaagaaaagaaagttgtgaattttcccccaaactcgttttctacaatatgccgataagtacagtattcaacataatgtccggtcagttcggctttgccatataactcattaatgtatgtgtgtaaatgtgcttattattaggttgttttgaataaaaaaggactgcccggtgaaaagttttgttgtttggattttttcaatattttatatttcttgttaattaatagtctttctaaaatatatagaatctctccaccgttgtccatcccaaatgtttggcattgggccaatttttccattcattaattggcacaataaattgttctgctgcccattattttgcccatcattctctttccctcccttttcctcttcccattgaccactccacccgaatctctctcttccctcaccccctccgaacaatcgccgttccctccttcacttcctttccatccctcgcggggatggaacgcgtccatccgtcgcttaccttttcctccgcgacccccggggagagtgtcccctcgcccctctttctttgttgttcagtccatcaaccaaaaagtgtgtgtccctccgcccttcgctgtctgttaccgcccttttcttttcctaattatatttccttcccttttcactctcttccccactctttcccttggggcgacaaaagcgaagccaagccaaagaaagaaagccatgtgcgacgaatcttttggcgtccctttcgcctctctctcttcattcattttgtgtctcgcctcatttcaaaatgccattgatgaagttgggcttttgttcgaattgtgtcgaattatttttctccaatttggactttgttagtgctaattacccaattagtaaattctatttaaataattttactgtcccttttcctcccctaaatttttgttaaattttaataatcctcaaacgaatcagcagaagtaagcatccaaataaattgatgatggatgcgttgggtcggcgatccgtcgtcaaatcgtcgatattccccgccccaccaattaattccctctcgttttatttcaaaatttcctaactgtaattgaatcaattcacttttgctttattaataatacatacctaattaactaactctttttatcataataagaaatcctaatttattgcatattaaaaagtgaaacgaaagggacaaaaaaaggcggcgattttaattcgaaatggtcagtttttaaatgatcaaagaaattagaaattggttggaagtattgcttcagcatccgtttgttttaagccaatgaaaaagcggacgccttcgcgcggtcgtcccccggggcgtcgcagcgaatcgcaaggccgacgggcgcaaagcgcagcacgacgagtcgcagcggagcagccacgacaactgcggccccgcgaagcgaagtcgccgactaaaaagaaaacgacgacacccacgggcaaagtgccaacgcggaaagtgcgtccacgaaaggcgccagcgcttaaatggaaatttaattagaatgcctttcccggcaggtggcgactgagccggcaacgcatcgaagccgaagcccggcgagaagtgcaacaaggctaacaaaaacaagcacctcattcatcggcaaaagcttgccaaattcacacggtacagacaacgccacggcgtgccgtactcattcccgtaaagtcgacagtggtcgttactgtcgattcccttaggcttagctacccattctcttgaaaattctatcgtcgtatctgttcaggaatgggccgagtgagtgccgcgtccttcaccgtttcctcctcttccgcgtccttctcgcgctccccggcggtgccctccccgtcgccttctctcgccggtcgtccctcgccgccacagctccgttcgcgcgcaatcgccaaacacattgaacagttacaacaacagcagcagcagaaactatcgctcaaggcaaaggcagcggcgaaaggggcgccggaggggtggcgagtggcggagacagtcaaagcgacgccggcggcgatcggtcgccaaattggcaaactgagcaaatcgctgcggggggtcagctaaataatcagtcaattaacatcccctcgcgtatgctttgcataatttgtttctccccagggcccgcgtccactgctgaagcgcacgggcgcccatttgcgacggcattggcacttttggctttcgctgctcctccttttgctgctcggcttccttctgctcaaattccagcgcgaagtgctcgccaatgtgcagcaaatgcgcaaacagctggtggagtttgtcaacgaacagtacgaacagaagcgacagatcttcgggtgagcgacggcacaacagagagagaggcgagcacggcgggtgggtgggcggtgatcgatcggccaccaaattgccatcaattaacgaaaacaataaatgggaccttaattagggtaattagtggggactgacgaacgaaaaggccccaattaaatctaaaaattgaaaatattaatttttattcatttgacattcttgcagcatttttgagattgtgaaattttaaatgttgcaacatttctcactttttcaagcgcttttcagtgatcaatggcaacgggcgatgcaaacgatggaatgggcccgtcaaaaatacctcgtccagcagcagcaaattccccccaccactccgccgaactcggcaattccaagtgacaaaaaatgaacggagaaagcatccactccactgcgatatttcttcattcaaaatttgtcattcaatgacctcatttgttatttggggggggggggcgcctcactaattgaccactttttcgctgtcacaaattggccctttcccttatattctatcaaccataattattttttgtttccattgaataagaaaataatcatttccacgactagaatctgaagcaaaacacaaatattattattatcattattcattgatcaaatccttggtggggaacaggaagaagcatctgatcgagctttccgcgcgcattggtttttaacattgggaggtcctttaaacgcgcccaaaaatcgcacactaatttttcattgataaggctaattgggggggggggggg

SEQ ID NO: 5088 - DNA, 1219 bp, Heterodera glycines
ccccccccccctttctctctcttttttttaaccattggcaattcatttcatgacaccaaaagtccttttcctctattctttcattcgcaatttcgaattctcttcgttttcctttttgctgtttaaaaatgttaccattttggtgtttttgcccaatttatgattttacattatttattttccctttttggccatttcaattaaaatcctttcacacttttgccatttcaatttgaggacacgacaatgccaataaatgtgtacaaattgacccgacttattatacgattaaatattgtttattctgataattattaatttttaccatttgatatttcccttttcattttctaaatttggcaccgattgaattcctttattttaatttattgaatttaatgttttttattataaaaatcggtatcatttcacttttttaatattgaatctgctaccaattgtgccccccccccccggggatgcacggaatttcgttttcgttttgtcctacattttcggcactttttgagtttcgttttcgttcgtcaaaaaattttcgttttcgagtttaaaattttatttttcgttttcgtatcgaaatgccctttttcgttttcgtatacgaaattttttttaaagttttcgtgcagtcctgccccccacccctctcttccctttttggccctaaatgcttttcccgttttattccattttaaaaataaaattaattttcttccttgattgtccaataaaattatttgaaagtgttcaaagaatgcatttccttcccctaaacttaccttaatttccgattccttttttggggtgccaattctccgccgtctttgagttgttttttggttttgtttgttttttgttcctccccaaatcaggccgaaacgagtgcaatattacaaattgtgccgcttttcaaatatggcaaacgtcacagcctgactgagaggaggaagcactttggaggagtgaataaagagaataaaataataataacaataaatatgattaaaaggaaataatgttggcggctttgaatttttctgatcgaattttgggcggaattcgtcatccatcgcccgcattcattcgttgccacaatttggccgtggcctctccaccccttttttcgcgtcttttgtccgtccgtccgcccacttttctccgattgggaacttttgagggtccatccaaacgcaaaaac

SEQ ID NO: 5089 - DNA, 574 bp, Heterodera glycines
aaattggggagaggaaagccggttggaggatcaaagcggggggggggaggggttgcacaacaacggcaggatgagcagcagcaggagggaattgggagggtggaaaaagttagggcggggaacgcatccgtcggccgattgactctccccccaatgatcagctgctgactgagtgaggaaggtgttgagacggaccaaaggcgacgacaacgactttttcttgtccttaatattattgtgaaaagatttatgaggaggggcaaaggcggccgcgcattgttaactttgtcatcccccaaaaaggggacctgtttacagaacacttttggatttggccccaattaatagttccctaatcaaagattacgctatcaaatcgcttaatattcagttgacagccaaattaatgggcagtagaccgaattagcaaatgcaattcatttcaattgtaaaaataaaaatggaatgaacttctgaccaattaattttgttcgttacttattccgttcttttgtttaaattatttttctttcgctattcatctctttggctgtgttttgtgctgactgttgcg

SEQ ID NO: 5090 - DNA, 857 bp, Heterodera glycines
ttgccaccgccgcatttcattccttttgcctttgccacttttcccccccccccccccctctcccacattctttcaatctttgacctgtcccctccgttttttatatttttattcattcataagcgtagtcaattcataatttaagaattaggataattctctcctccatttcatctttgatcactttctgtactttaaaattggcattttgatcacttcttctcctcactcattcgtccctttttcatccattccgtcccttcacttttttatgccacttccatcggcattatctcgcttttactcatcggtccccaacttggttaaggtgcctcccaactctttgcaagcttcctcctcctcagtttcttctggcaaaaagaggggcggaagagtgcaccaccaccaccacaaacagcagcaccaaaaccataatcattaccaacaacaacaacagtccgagaacagtgacgcggtcgactacgacaacacggcatatgacaattacatggacgaagaggaagtgaggccaaaagagacaaaagtagtcgaattggcaaagggagaggggaggaatggcagccaatagggggacaaatggaggaatgaatttgccaaggggtggccaaattggggggaaaatggtcaaaaacgggggggggggggggagtgatcaattgaaaatgcaaatcaacctagccccatatttaaatttcagatgaagcccacaaatgaggacttcccaacgcacgagacgggcacaagtgaccatcaccacgacgtgtggcgagttccaaactccgccggagggtccggctttgttccgatgggaagagcgggcgaatcggacggacgat

SEQ ID NO: 5091 - DNA, 7194 bp, Heterodera glycines
  misc_feature (12)..(12): n is a, c, g, or t
ccccccccttanaaggtggtgaatccgtcccgtcctcagtctctgcgctctcttccgtcgacactctttcgctgtgccgcgaggactgcgatcagttgaaggtgccaacaacaaataaactgatcaacttattggtcgttccttctgcgtttagaacaacgtgtgccccaacgaatttgcgatggcggcacagcacgatttggtgggggacacgccgaaggcactgctgcccaattgcgacgcattggtcgccggagtgccgaactgcttgcacgtgttggacaaaagggtgagatgccgttgttgaccactccgtctatctctgctcccaaatacatgttcagtctgcccaatttccatccgcagtcgttaacttcggcccatcgtccccctcctcctccccctccccgtcgtccaccacttccgaccattggtgctttgttggtgctggcaccaaataccaaggcaccgcttcgaccacgcgcagcaaaaggccatgcatttattggcccagcacgccgaacaggtggcatttaccggtttcaataatatctatgacttggcaattcagcgagtttaacacggacagtcatccgcagttgcggaatgccaaaaaccactgccgaaacccctctcgccgttcccaattccacgaaccgtggtgctacaccgtttcgcctggaaattcgttggttgccgagccttgcaatgtgatgccattcccctaaatatagctgatatggcttacatttcttctccaggtccgccgatgccccccaaatgcttttccccatttgaacgactcaccctcgccggccttcgactcggccaatgcgctcgcctcattcgccgccttttgggactcgctgtcctcccagtctcagctgctcattctctccactgggctcggtgccgttgtttttgtggtgcttttgatcctctgtttgttctgctgccggagggaaaagggccatcggtcggggcgaaggcggaaaagcgacgcccgggggatgacggcacagcagcagcaggaaagcgcgtcgtcgatgctttcgggcagtgttgcggcttcgcagcacaaagtgcccgtgggtgctgctggctccatgcaaaatgggcacttgccgcaaataccacagcaccatcaccacatgttggtacagagttgcaacggcgggtccaccatcacaaacaggcaaagtttgcatttggcattgtagcactatgccaatgagtaaagccgatcatttttattgcttaaggctttctcttttgcggtaaacaatcggaagattaatccaatgaaaaatcccatcaaattaatttccctttcagcgatttgaacagcgctttctaccgcaaagtacaggacgaacggatgcgtgccgcgggtgtcatgccaaatgatgagctgctgaatccgttgttgccctacgggggcggtggcggcgacactttggaccgacacattccgacggcgccctttggcccaccgcagacgatgttcgagttgaagcactcccagcagcaactgcaccatgcacagcagcagccgtaccgattctgggaaaatggggcgacctctgccgacacaatgcattcggctggcgtgggatggcatccgccgtattacgttcaacaacaaccccaaaagcaatcctacggcagtgcgagtgccaacaccgaaccaacccaagcggagccgtaccaaatcgcgagcatccaacaagaacaggtcggtgacgacgagttggagggcagcaattttacataattgggcgattaactctcgagtcatttcgttatttttttttcttgcatttagttgcgtttctcggatcagatgatcggcgaggacagcaccacttttttgacactgggagaatgggaaggggcaatgatcagtggcgccactctcaaggcatcaatcgataaatcaatcgatcaaataaataaaacctatcaactaatccaatcaattttacctaattattaaccgttttttcctccaattttgggttgccattaaatcgctgaaaccgaatgttccgcacatcgccgttgagcagttccaagaagagattaaagccatcggcatgttcgagcatcacaacgttgtccgcctgttaggcgttagctttttgcaggcccgggaaatgtgtgccgtgttcgatcacatggtccacggggatttggtggaatttttgaaagtgcgggagccccgaggagggacagagtgagtcactgcaatggtacttctgaggaaaagcttcattttagcaatgatgagcaggaaagggcgcgaaacgcggaggactttctgagaatagccactcaaatcaccgcgggaatgcaatatttggccaacaaatgtttcgtccaccgcgatttggcggcacggaattgcttggttgccgatcagcaagtgatcaaagtgtccgacttcgcgcggatgaaaccgaaatatgcgagagactattacagagtgatcccataatcaattaacaatttttagcaaaaaaatgtgcccgttggctcacctcttttaattgcaattcaacactcagttaaatgccaatgcccacggcgttccgttgcgatggctttcccgcgaggcgctcaacgagggcaaatacagcgaagcgtccgatgtgtacgcctttggcgtgtgcctttgggagatttacacttatgcgagtgagtagacccaaaattgagacacatcactcctcaattttgttgaaggacaaccgtaccgaatgttacacggacgaggacgttatcggactgatccgagatgaaactctgctggaaatgccggagtattgtccgccggcagtgtacgcgcaaatggtcgagtgtttcaacgccaacccgcagcggaggcccgccttttccgagctgtactccaaattccaggccgccactcgccccccccccccgtttttttttaccatggagttttcctttagaaatggcttgcttccggccagccttctgcccttcaaatgcagcagcatcgagcgagttcggttcattccggcggttcgagcagtgcagtaaatggccatctgatgaacggacagaacgggcgaatgctgcgccaaacgcatgcccatgggacctccgtcccttcgccggcgccgaacggatgctcaacgattttggccggcaccgggggaaagacggcacaaatggccaaattggcattgctgagcaacggaggtgcctcaatagtgcacagcactccgatcggtttgtagaaaggccatattgcatgttgccaccatggaaatcattctttgatttcggcacatttcagtccaaaaatcatcggacgacgggtcgcagtcgaaacggccgattccccggaggcgacaaccctcggcacacaacagagtggcatacacggaggaggaggacgacgaagacgaggcgatcagttacagcagtgacgagagtcgggacagctgacagacaaagtgaacaacgaccgaacgaaggacggacggacggagaaaaaaggaaaggcggacaaacggatgagatgccccgggggaattgtgcctcgcttttaaaagccaactaaaaacacctcttaagacttgagcttaattacctaatcaccagcagcccacccccaatttcctttttctcttttctttctcccaattctttcatgaatctctccgccatcccccaccaatcgagcattatcgtgacttgtgattttccacactttttcacaaatatttttccacaatttttgcttttgaatggaaaagaattggaagaccgtagaataaaaataaattagtttaaaattgcttaattatttccctaaaaataataataaatatttttcttatgaaattcgcataattatttatttattttctcattaaaatttcatttgatgcacaatttaacacaccgtaacccttgtgaatgtttttattaataaaaacaacttgatttatttattgttgatgaatttttctgttttaatagctcatgctaattatattaccccttgagggctctaaaaataaacaattgtaaaggggaaggggggttggtagagtgccaaaatttacaaatcgattcatgaattaattgaattataaatgcttaaatagcttttattttttgtttaactcttttttatttatttattgttaatcaatattcttattaattttcaattttttcgttaaattaattatcattatgttcactaccgtacttcttcgattatagccccccgggggctctattgttcaacccccctcaaaaggtgggctttattcgagaggggaatctaatcgagggggagttttatagttcagccctttttttacaaaaatctcacaaaaaattattattttttgtaaaatttcgaaatttttcagtggtattaattaaaaatgttattttttcattttcggcaaagaaattttgtgcaatttttttagaaatacctatctaccaaattttcatttaaaattctaccaatacctaattgtttattttcaaatttttaggcactaaaaacaacaatcattttatcagtacttaattatggacgcagtaaaaaccgtgcctgaatcatcgactcaaaaagtacctctacctattaaaaattcttatcaacattatcagtagtataaagccccgaaacctcgcgggtatctcgcgggtgtttaccgcacaaacccttacctacgggaggggtgttttttttgaaggtgccgcccgctcacaaacccgtgcctattggactacatctgaagctgccgccaagaaccaaaccctatgggaggggcgcagccctttgaagttgccgccccggacattttcccgcacaatcccaaacctatggaagggtgcacccctttgatgttgccgcccgggacatttaccgcacaaacccgcgcctattgaaggggtgtttttcctttgaagttgccgcccgcgcaaaatcccgcgcctattgaaggcgtgttttcctttgaagttgccgcccgcgcaaaatcccgagcctattgaaggggtgttttcctttgaagatgccgccttaggattattacctcaaaatcccgcgcctattgaatcctgagcctatgggatgttctttgaactctgccgccttgtggattttaatttccccaaatcctcgcgggtgtttttttcatttcccctccccgcgccgcgcagtgccgcggaaggtcatcaatcatccgtctgtcacgaaagtgacaggtggaggaaattcaattcttgcaaattaattccaaggaaattcaattcttgcaaattaattccaaatctttttgctcgcgcgcaaaccttttgggcggttttattttatgaaatcctgagattttttatcatgattttttatcctgaaattaaactatttttgaaaatttgctaaaaccgtgcggttttttgcatatcttcccttcgccgcgcagcgccgtcatcaatcatgcacctgtcactaaagtgacaagtaattttcaaaaattcaatttttattttgcaaatttaattccaatttttatttatttattttggattttaatcaattatttgatcccccgttttccaattctcaattatttttgccagctcccccgagcccctaaacctcgcgggttcctcgcgggtgttttccgcacaatcccaagcctatgggaggggcacacaaacttttgaagatgccgccctaaaattccatttccccagaatccgagcgggcgtttaccgcacaaaccggtgcctatgggaggcgtcaaacttttgaagatgccaccaagatgcaaaacctattatggcaaaccgaaaacatttggattcgttaaaaaggtgctatttttaaagtaagtacccaaaaccgtgcgggtttttgcatttcctccccgccccgacgatgaggcacaatgcaggcgccgagtaaattaattgataatgaaattgtagaagtgcaaatttaattggtaatgcagcaaataatgccgataaataaattaatgaattggacaataaaattaattatttaaaaataaataaattaggatgggaaaaaaacttttccaaaagtaggtcatgttctttaactgaacataaagataaagaaataatggtccgacgaaaaattttaaaataaaaataataaaataagacgaaaaaattaaacgtaaagataaattaaaaaattgaaattttcaagtgatggtgttgtgtaccatatttctttccaaaatcgaaaactatttcgcaaatttgaccaacaatttctgcaaaactgccaagcaaaattgattgatggatttattatttcgaatttctcatttatcacgcaatatgcacgcgatttacattaaaaatgagttcaaaatataggctgcccaatattttgaaaatttaagcaaaattaattaattatcatcagtcagctcaatgacccaaagataattcaaatcccatttaaaaaaagaataaaattgaaaattctgaatgtatgttgtttaaagtcattcgtagcaatttataaaataatttttcttagtaattttttttgcttccttcaccccttccccataaattgtttttttttgttattcatcattatttttagattctggatttagggaagttaaaaataattactcttatgtctttgccacgtaattctcgttgttcttctttctatttcaaatttaattgaattcccaaactaaatggtaggggattttcatctaaagttttcccgctgagctaatttatatacaaataatgctctggtaaaagattcccttttaactctttaacgtaatttattattgtttttgcatttaaaaatttgaaatatttcaataaataatttaatatgaaaaggcaatccttttgagttcccgaaccttttcttttgaatatatattttaaccgttctacatttttggatgtttaaattataatattaattttcttcccttgaaaatgttttttttgtgacataatacagcttttgaaaatgtctagataaatgaaaacacttcccaacttagaccttttaaaatctccaagcttaaggcattgaaaaagatcgggacgatattaagatattgattactcatgtaaaaaccccaattaatatattagtaaaaacaaaaagctttaaaagcgcaa

SEQ ID NO: 5092 - DNA, 2424 bp, Heterodera glycines
aaaagcaatagcagcagcaacccaaagtcggcgggtgcttctatgatgaaaatttggtccacccccttcgtttttcatggttcaaatcggctaaatttttagataatctactaaagtggttaagaaatttaacaaatttcaaaaaaaaaatgggcaatccatctacattattttttaattgatttatcaatttttttttttttttttgcacaggttttcaacagaggcgaacattcgctgccgcggtgcccaacgaaatccctgtggagccgaacaacgggcaacagcctgacctggccaacagcaaggttaaatcgtagtccctcgtctatcaaaatttcaattttctcaaaaaatccgactctgagcccactgttgtcttttggcagaggctcaaagtgcccaaaagtttttttcaaaagaattttttttcagtgccaacgttctcattcatggctaataatgtgtatttttgtaaaaaaaaaattcaaaaattagcgtttgtagggtccagacaagatttgccaattttaggggcccaaactctcaaaaattttcaaaaaatttatttttctttgagtgccagccaacaagcccattgcttataatgcgtttttgtaaacaatattaaatttttttttgcctttttacagtcgaaacacactcaatttgcatgggaattgcaaattttgtaaatattgtcatttttaggatgcaaaacccaccgagtcgttttgcatgaatttgttcctgggccgtgcccagcttggccaagtgtttccctaccctttgcggttggacgacgagcagcgcgaaacgctgcaaatggtggtgacgccgagcgccaaattcttggacgaggtcaacaacccggataagtcagtaccgagtaggatcaaaaaaaaaaattatggaaatttaaaatgaggagcatccaaaatcacggagtttcgcatattttagtggttggaattctttggcgtggccagaaatatttcaatttccatatccccccccctcgcccgaattcctcaaaaaaattttaagaaattctcaaaaaaattcttagcaaaattaataaaaataaaaattctgatactttcgagcgattttaaaaaaaatttagtaaagcattataaaattgaaaaattcgccagaaaaattttcaaaaaaaaaattttttttttcctaaatttttcggttggattgggtgttttaccgtaatttaattttttgatttgcttttaatttaaaatttccattttcctaccccccccccccccttccccaaggaatgatgaacatgccacaattccgcgcgaagtgttggcccaatttggcgagttgggcgcgttcggtgccttggtgccggagcgatggcacggcgccgggttgaacaacacgcaaatggcacggcttgccgaattggtgggcgccagcgatttgggccttggcgtcaccatgggagcgcatcaggtggaaaaagagggcataaattaataaatttgaagcataatttgcggaagcctttggaattgtacactttccatcgaaaaattttaaaaaaagcaaaaacttttttgaaacaattttcggtttctttttttgttcggaaagctattcaaaaaagcttattgatcttgcatgactttttttttaataaataaagaatttttcaacattttttttggattgaaaataaatacaacccgcgcaagcggactcgaacccaaaccccgctctctcggcaaacctgcccacaccccacttagcaaaaattttcagtcaattggctacaagggcattttgctgtacggcaccgacgcgcagaaggacaaatatttgccggacttggccaccggcaaaaaatttgccagtttttgcctcaccgagcccagctcggggtcggatgccaatgtaaattttttttaaaaccggactgcaaaaaaaaaaaaaatttccagtcaattcgaacccgagcggagaaatcggcgtgcggcaaattctacacactgagcgggggcaaaatttggatcagcaacggaggctttgcggacgtgttcactgtttttgcgaaggtcggtgtttttttttttttggttggggatgggcttgaattactttatttttttggtttacatgccattgtgaatcccccatccaataccgaaatagaaaaatgatttttttgttaaaaaatcgagaaattggaaaattttagctttataaattgagccaaattaaaaaaaaaaattttttttttcaatatttgagacaaatccgccaaaatggtcacctttggatcaaaaatgtttaaactgctaaaaagggaaaattgctcttaaaaattaatattatttacgatcaggttttggtactttaaaatggctaatcccccccccccatcccccaaaattttttttc

SEQ ID NO: 5093 - DNA, 3207 bp, Heterodera glycines
taaaaagggaaaattgctcttaaaatttaatatgtacagtcgatcaggtgagagttctttatagtcgttaatccccatccccccatccccataattttttttcccattagacacccatctagcaagcggatggctcctccaagggcagagagtcggcattcattgtggagcgcggctttggcggtaatctttttgggactagagaatcccaatttccctcccccaatccctaaatttcaaaaaaaaaaaattcgaaatttgttttaggtgtaaccagcggcccagcggagaaaaaaatgggcatcaaaggcagcaacacgacggaggtgcactttgacaatgtgaaagtgccggccgagaatttattgggcggtaagaaaatgaacgggaagatttatttaaaaaatcggaatttttttagggaggggtgggaatggaaaattcgtgaaaaacaaaattttcatttcattcttcagaagaaggcgacggattcaaggtggcgatgaacattttgaacaacggacggtatgcacatttttttgtttccaataatcgcaagaaaaattttttaaatttttttttaattacattttttataaataaattttctagggtagtgaaaatttgaaggtttaaaaaatgttgcaaacttttaatgtcatactaaaaatacatttttcagctttggcattccggccgccaccaccggctcaatgaaattttgcatccaaaaaacggtgaggcagtgaatttttgtgcaaaatttaaaaaaaattcaatgcttttggttaattatttataactcaaaaaagtgcagattgagcatgtgcaccagcgggtccaattcgggcgcaaattgtgcgaatttgtccgtgtccaggagattctgtccgacatggtcgtccgccactatgtcgctgagagcatcacgtaaatttttttttttgaatttattactgttaaaaaattgttccattgttaagttacatgttggccgctaacatggaccgtggcatcacggaatatcagctggaggtgtgtggtgttgtgcttttagcatgcattaattttcaaaaacccgaaccaaaaacgcgaatttttcgtcttttcgtaaccccctccatttttgggggtcttagacctaaaaatcggcattttcagtcaccctgcacccattgcctaggcctaaaaacacaaaatgagcctaaaagcataaatttcgtcatttttttttaaatttttccctccctaggccgccattggcaaggtggtggcgtcggagaacgcgtggcaggtgtgcgacgacgccatccaactgcacggcggcatggggttcatgcgcgagtgcggcttggagcgcgtgatgcgcgatttgtaagcaaatccgggagggcgaggggggggggggtaaaaatttttttttaatttccgccatttttcgaaaaaacccgctagaattcttcccctccctatccacagacgcacccttccgtattttcgagggtgccaacgacgtgatgcggctgttcgttgcgctgaccggcatgcaccacgcgggcaaacggctacaacagttggccaaggatttgaaggcgtactccgtgtccagccttttcggggagctgaagcggcggactgtcgggtaaaaggaaattcaaaatttgaaaaaatccttaagtttttaataaaattttgttaattttagaaaattcagtaaaaaatgagattttattttttctttaaaaaattccaaaattttctgagaagtcatcgaataatcctataaaatttggaaaacactgaattcctagctcagtggtttgtgccttttgaacttaagtggaattgcttgggttcgactcccaccacgggttggcgtacatttttagcaactccgacattcggaacatcttttttttttgaaaaaaaaattaaagttttgtgagaaaaatttttatggttgatgttcagcgaagcccaggcccaagcagcggaccatgtgcacccgtcgctgaaggccagcgcggcgctgctcaaccaatgcatcggcgactttggcaaaaccgtggacgcactgatcatggcctacaaaaaggatgtgatcggtgagtgggggggggggggggaaaccgggcatttttatgaggaaaattcatttttgaaattattaaattttcaaaaaattgtgtaaaataccgaaccccgcttgaaatgcctatcgttggcacagtaccgtacctcgtttatgtttgccttcacaaacagatcgccaatacgaactgatcataatagcaaacgcggcgatcgacatctacagtatggcaggtcagtcagtacagcgcagtacaagtaccgtagtgttttttttggtccctggggcagaaacaatgcaattttcaaaatgaaacaattttttcttcgacaacaatcattggccataatatgtttttcagcggttctgtcacggtgcaacttcgccattgaacggagcggcgcggacaatacgcaacatgaccaggtcggagagagagagggggagggggggggggaagcagctaatttctacccccgaaaattttttataagaaaattatgaaaaaaatttaagaaatttttctaaaattttatttttaatttttcacagggaaggaaacgatagggtggaagggtttaaatgcaattttaaaattgcgaattaaacaatctttttttcccgctactttcagcacatcaccaatttgttctgcagacaggcgttcaagcggaccaaacacaatttgtacgtaataaaaggaaaaaattttgaaaaaatgccatttaaatgtcaattttattagattttcaatttattgcagaaaggaggccaagacgcccagcgagacggaactgtcactgatcggacgcatttcggaccaactccgtgagcagcaagcgatggcgcagaagcatccaattgaacatttatgatgagaaaacagagttttcgatgtatttaacctcctcctcctccccctggcatggaattatttttacacaaattttgcaccatttagtttttttttccttttttgagtatgatacggccggcatacactgtagttgggcatcacggaaagagaattgtattattttccagggagctatatgatactactgtatttgttcattgactataaatattttaagaataaagggccgcgaacgaag

SEQ ID NO: 5094 - DNA, 1963 bp, Heterodera glycines
tggggggggggggggaaaacccccgcgcattttttatgaggaaattcattttttgaaattataaattttaaaaaaaattgtgtaaaataccgtaccccgcttgaaatgcctatcgttggcacagtaccgtacctcgcttatgtttgccttcacaaacagatcgccaatacgaactgatcagaatagcaaacgcggcgatcgacatctacagtatggcaggtcagtcagtacagcgcagtacaagtaccgtagtgtttttttttggtccctggggcagaaacaatgcaattttcaaaattgaaacaattttttcttcgacaacaatcattggccataatatgtttttcagcggttctgtcacggtgcaacttcgccattgaacggagcggcgcggacaatacgcaacatgaccaggtcggagagagagagagagaagggcacagctaatttcctcccccgaaaatttttcagaaaattctaaaaaaaaaatttttttttttaattttcttctaaagaactcaatttttttaaatatttttcacagggaaggaaacgatatggtggaagggtttaaatgcaattttaaaattgcgaattaaacaatctttttttcccgctactttcagcacatcaccaatttgttctgcagacaggcgttcaagcggaccaaacacaatttgtacgtaataaaaggaaaaatttttgaaaaaatgccatttaaatgatgaaaaaatgtcgtttaaatgtcaattttattagatttttaatttattgcagaaaggaggccaaaacgcccagcgagacggaactgtcactgatcggacgcatttcggaccaactccgtgagcagcaagcgatggcgcagaagcatccaattgaacatttatgatgagaaaacagagttttcgatgtatttaacctcctcctcccccctggcatggaattatttttacacaaattttgcaccatttagtttttttttccttttttgggtatgatacggccggcatacactgtagttgggcattacggtaagagaatttgtattattttcgagggtgctatatgatgatactgtatttgttcattgtactataaatattttaagaataaagggccgcgaacgaagcatgtagcacacatagcaaattgttcaacatttaccaaataaataaaacagagaaaaatttactcgttttttaaatgggtatacacgcgcgcacacagtaagtagtacagtttacggtagcgtggcagcaaacactaaatgtgtgcgcgctgtgtacggtatgtcatgtgtatcgtatcgtgttaacatattgtgtgactgggttgttgtgggtattttcgacacggtaaaaagtgtgtctaaatgaaacaaacaaataactaattgtaaggtaataaaataaataatgtatgtatgtgtatttcgataaatgaaaatgtgagaatggagaacaaacaaaacaaaaagcatagcacgcatttttaaggagagtttctcaattcgcacacacaaaatttaaaatttgggcgcaaattttcggctgtaaaatttttaaatttcaaaattcatacagattttaagtttgtcataaatagttgaattaaaattttcataaatttgatttgacataaattatttttgaaattttttgaattataaaaattaacccaaacgtgacaaaaatcgttttaaattttaaaattttacaaattaaatttgccataaaataaattttgtgtgcgcggaaaaagacagagagagaggcttaacaacaaaacaatgggggcgggacatggtcgagagagagagtgttgagcttcggaaaaagaaatggcggcacttctcgaacattcccggaggggaaaatgcataaaaaattaacaacaaaaaaaaccaattaattgttaaagtgagtttggccattgcgctttaaaattattaaaaattaatttt

SEQ ID NO: 5095 - DNA, 899 bp, Heterodera glycines
gcgcatttttctaacccagaaaaaatacaaagaaaatttttaaatttatttttcgacgaaaccacaaaaatgtacctttgccgaaactactggaatgggtaggatgaaaattgatcatttgattttagcggacagtcaattgatggacacttgtcggaggtcaattcgggttcgcgtaggcaaggagcgagtcgatcgtattggagaactgaaccttccgcctaatctcatcaaataccttcattacaaataaccatgaacgacgacactttccttaccaccaatgtttcctgttcctttttttcctgtttttcttattcattttcacttaatttttctgttgctttagcctccattttctcctcttcctgaaccatttgatctcgttattccactgctttcttgtcaaatgctacttgtgataagtcagaaaataaaacattcattttatttttttcgtttatttacggtgacatatcaacgaattagggacggtcaacacattttgtttaatgctcattgatacacaaatggaataagttttgcttaaaatccgtggattttgcagttgtcctccttgacgatcccgaccttgcacagaaagtccttgatgtgctgcctttggtcccctgtcagttgaatcacttcgccatactcggggtgctcgacgattgtgccgttgcaattgtattcctaaaaagtcacagaattccgatgcaactattttctgactcaactatgtccgtggtacctttttgaggtaacgaacaatctttttcaagtcgtattccggcgctattccctgcaccgttgtgatcgtttttcgacccgtcctctgctgaattcggatgtgacagaatccctggcgagtgccctcctcttcctccaattgttcaaag

SEQ ID NO: 5096 - DNA, 2961 bp, Heterodera glycines
acaattaaagctaattaaggaataaacaattagtaagatccttagtttcttgtcagtatcacaatccacgggctcattgatgaggaaatgggaaaatgtgaatggaaaattcttgaatctcgcgaaaagcctttctccgtaaggaatctctcaattctatggtacacacgttcataagcgacaatgatatcggcatcgaaaaggctgtttttgtaccatttgctgtttaaccatccttccgggtccttgtaaaatttatctgtttcatcctcaacatccgcatcttccttaaaattcataatattttggtcattgagaaatttttttcagtttatgctgtttaagcagtaaattttaaaaagtttttaagtgctgtaagaaatgtcaatttttgagttttattatgtgtcaaatcattctaagccatttgtattgaatttggaaaaaagaacacatttagattttttgcttgtcaaatattctcacgtgagcaatccggataaatgcaggagaacagtccaacatttgaatgctcgttttattcgaaaatggatgcaaatgagcgtattgcggcagcgaaaagcagggcctaaaaatcaagacaaattggggcgggaatcagcgctaacatcagctgcaaaattttgatctgttctctgttgagtccccaagtgtcaatgagttcgatgagacggccattaacagccgacggcccccgctgatggacaaggcctaaaaggtaaacaattgccagaaaagacaaaagatggcaccaaaataagtggcaagtagaaggtttaacccaatgtagcaatatttgagacaattcgtccattttgccttgtaattgttgagttcgactgccaaataggggaaaatcagtgggagaatgggcaacactgacaacggactgatcagaatttattcaaaacgatgaaaaaaacgactcacaaaatctgtgctctttgtgcgaaatgaacgaatgtcccaccaaataaataaatgccgccactgcgtatctgtgaacaaataataattacgattaaactttaaaaaataaataaaatacgcccggattaagcccacctctttttcatgttcaagtgaccaaagtgagggagagaagtgagcaaagggagcagcaaaagggtgaggaggggcggcacggcgtgcgtcaaataccacgaccaatggtggacaccgaaattggcactaccgccccggaggacattgaagtggagaaagttccacagacaaagcacgggtttgccgtagaaaattgaatcgaaaaacagagagaggccgaaagggagaaggaaaaatggcgccaatctgaagaaaaatgaacatgagaaaaaaccattcccatcgaaaggagtcaatgcgtctaattataagctaattaaaaattatattcagactcataaggggactatatcagttaaagcaaacagaatagccttttgctatacatatttaaaacatgcaaaatttggccaattcggacacatttagtccctaccaaattccactcactttgacacagtgaccatcgctcctgaaaggccttcggcagtgaacaaatgccaaatgcgcaaaagaattaattgggcccacagaaaaagagttgtcggccgtaaaacggtagcaacggcgacgagaaaaacgcacagaaagaaactcttttgggaattcgatgtcacagttttgccattcttcgcccctttcgtttcgccgctttcgtaaaaatacaacgcaataagcgaaagagaacattcgatggaattggaaagagtgcgagtggagcaatacaaaaggaaccaattgcacgcataaagagtagtagtcaagcgaaagactgaaaagggagaaaatcgaaggcaaaagttggaaattgaccaaccattatagctcagtccgattttgcggatccatttgaggtaaaacgcatccgttaacataaacaaaaaagcgtggaaaagatgcggtgcccatcgaatcgccgggccaaaatcgaggcgaaaagcgcgtagggtccaaaagataacagcgtaaatgaaagggtgcaacgaggaacgcaaagcccacgaagggtccccttaagggagggagacaatcgaacacagggaaaatgacgaataatagagcaatttgaattgcacaccgaaaacatacattcccaagccaaatgaccatgtccataaaccatgtgataagcgacttcgacgctctaaaaaacagtgtgaagtattgcgcatttatggcaatacgcagagacctggaaaacttcatcgggtacaaaccaggaaatggaaaatgccaaacagacaaatcgaagtgcgatgaaatcaagggggttcgaaattgaaaacatcaaaaaaggcaaagaccgagtcggaaaaaaatcagaaatatttcgaatattttaaataatttattgaatgacgaaagaataagcatttacaaaggtttttaaaacccgtaaattacgaagaaatatcaaaatctatgcaaaccgtcaattaaaatcgcttgataaaactaaagcggaaatgctaaaacaaataaaaaaggtgatatcttcacctatttaaaacagaaaaaaacattttgaaagccattttgacttgtttaatgcaaaattataggcctttttgaccagatgaatttcttccttttagttgacttcgtatttgagaaaacgctgcatgtgaacattcagtggaagtgtgtccaaaagtcgcgcaaattcggcgtgaaactcgcgcagattgtccgcttgtttctcggcactaagacacgaagagttctcctgaattagaacaaaagatagactaatcatccgtttctcttgtttttattgtacgtttttttgcccaatggaaaaggtcgatgagtcatcgtcgtcttccgtcgcacattcgcaattgtccgctgcgacttgctcatcactcacactgc

SEQ ID NO: 5097 - DNA, 2458 bp, Heterodera glycines
cagagtttttgtttgtcgacggtttgtcctcggcagtaaaatttttgcgtgaaaagactcgcttttgctgtggcgaactgtccactgaatgtgaacgccgttgtcgtttcattgaaatgcgcgtgccgttctctccattgctttccttacattcctccgaattgttggcattggccttttgacttatcacagcttaatgacagaataaatgccttttccggtattggccttgaaatgctcactttcagaagcggactgatgcactttattctgttctgtttcaaccgttggacttggcttggattcgtcttcatttttacaagtcccttttccgttgttggctttcattttgtcttggccatcactttcagtggaactcatgccgacattgtcgtcggtttcgttgtcttcttcttcctcttctccggtggtgttttgcgtttgttcgatctctcttccctcttcgctattgttctcgttttggtcatcgtctgcctcaccattttctcgtccaaaggcaataatgttagggatttgttggttgtcgtcggcgttaagattgttttccgagataaaacggaatccctagagttaagaaaatcaacaaatcatttttcaatcggaaactggcaatttttagtattttaaaaccatttggtgtgcctattagtttacattagaaaatggcaataagaatttgttggtggtgtttcctcccctcgaaatatctactggatatgggcatggacattgtctgtttgtattacgtaattaacgtcttcatttgttgtcggcgatggattgacagccaattccaaatctctgtcaccaatgaccagtcgaatccgaccccttatttgatgggcctcctgacgagcacgcgcagcgtgatgctggttcaaccggtcccgagcaacaagagcaagaaaatgtcttaattggaagtgacacaaatgattaagacagttctagcgttacaatccgtataaaattcaacttataaaaatcagttttgcataaaaaattcaccgcattgggttttggtggaaatttggaataatgcgcggttcatcgccctcctctgcaggctcttcgtcttcattgtcctcttctaaaactttaaaaatgcaatgttttctgttggaagtaaccatagaaatgaattgtctgtaagcgacgacgtcgaccaaaagtgcgtctgttgttgttgtgttcctgaattcggcgagaaacccaattcagctcaaggccttctctttcactcccattccgagttctctcttccttcgctgattcgacacacaaaactcgcatttccactttgtgggtttgctgaacatttgccctgacacagcgtctgacactgaaagaaatgatttaaatttaaccatctttttggtctcccttttaacgtacacatcacggcaaatcgaacgcaatgagtggggttcgagaaaagggagttttatgggtcgattggagagcggattatccggattgacggggatcaaatgtgagaatgtcactgtgcttatgtcccgtgtaagaaattcaatttccgattttctgacaattctttgaagcttaataaaaccattagaaaagcaggaaaatgcaacatttaccacgtgtccaaacggcaaaatgagaacgccgccaacttttagaagggaacaaaaataggagcgatgggagtcggggacgagagcaccacagtaaatcctaaatggacgggaaatgccatttttaaatttccaataattgaaaaaaattgtcgctaataaatccacaaaaaaatttgaaaacctgtcatatttcatttgagcttcaatttgaaaggcgttcccagtttcgtaaattggcgtgcacctatttttaatttattagcccaaataaaccgaagccaacaataagacgcacagaccaatcaaaggcacttgcttcaccggactgttggatcacagcgacattatcgtttgcaaattcggtaacattttgatagagttccaccccgtgactaatgcccttttctcctaaaattgtaatatttttttgctttaacatattaaaataccaataacaaatccaaccatcgaactaagatacccagttccagaaccaatgtttaaaaatgacattccagcatccaggtcaagattttccaaaaccttaaacaaatacaattttggaataaatatttatgaattccatacgctagcataaatacacggcgcagacatatggaaaaagccgggatcgcctgtcggtgacttccaggctgtgtctttgtaagcatgttcacgttcagttcctggtaaaaattttccacgatccaccaatcttgaaataaacatcatcatttattttaaaaaatcatggtacttatgttatctgtgggcagattttcaaaaaattttatgtttttcgctaataacttttttctttggcatccaaatcc

SEQ ID NO: 5098 - DNA, 1500 bp, Heterodera glycines
tatcgttcgacagctactcagatgctctattacccttccaataatcgaaatgattttctatcctgcaaaaaattttagtaagaaaaaacttcaaaatttcgactaatttcgaccttttcgcaattttcatgtataacttttttggtaattgtctaatcgcgaagtgatacatagaattagattcgaaacatgttaagctttcgaatgataccaacaatcttggatttgaatgccaaagaaaaaagttatagcgaaaaacataaaattttttgaaaatctgagtacagataacatataagtaccaaaatcattaacctcatgatcttttcgacgcgttctgttttcaaagagtcgtttgacacgagattgtcaattagctcgtcattgtcttgtccaacacttgctgtcaatcccattctcgaatgaggaatagtcaacggataaaaataaagttctgctaaaataatgcaaattctaagttagactttactatttttcattttgggctcgtaccctattttaaggggttttcgaatgatgctgattacgaatcttaactcggatttacccaattccgaacaccgggaccgaattcgaacaaaaaaatactctatttcgaatctgatagtacattgattaagctattcaacactataaaaatacaaaatctgtcgcgggcctttctttaaaagaaccatgttaatacaattgctagcaatggtgcagaattgtggtgcctaatttaacttttatattttggtccaaaattactattcggtgggttttcgagggggttgatcataatctgaccatagatttgactaattacgaaccccggactcaaattagaatatgtatactggatttggactcgaaaattcgtaacacaacccaatattcgatggtacaaaacacttcaaataaaaattttattttttaagcaaaattacatcgataatgtagcgcacagcaggaaaaaattgattctgacaggcttagttctaaattttgaaaatttttaaaaaattcttttacggcgccaaaaaagtcattttatatagggcgccaaaacggccgcgccaaaatggcccgcgccaaaacctcgcgccaaaatacccgcgccaaagtgaccccgaccccttcggcgccctatataaatggctttttcggcgccgagaaaattttcaaaattctaaagcaagccctatcaaaagcaaaaaatttagtgtgttgtgtggtttttgttagacaatagtgtggtgtgtggtttatgtcagtcaatcacattagtgtggtttgtgtaagacaactacattagtgtgcatgttatgtgtaattattagaaatgttttgagatacactactgtttctataattcgagaccacacaaatgttgattttgtaaaaaagaattctttgttgttgtattgttttgagatgcatactaatctgtctttaatgttttagaggttcacaaaagtgttgaattctgtcataaag

SEQ ID NO: 5099 - DNA, 7105 bp, Heterodera glycines
cgttaggtaaagcaatttcagtaaccattcatccgtcgaagaccgtaacattacaacaaatgaacgggccaccagtgtcacactgtaccgtcttattccaaatgccagctacgcaataagagtcgcggcccgtacaaatgccggagtgggtgccttttacattggcgaaccggttgtgatgagtaaggggccaatttcccaacaaatcacttacaattagcacaatgttttgcagcggaagaaaccctcaaccgacacattcgcctttttgaacgttctgagaatgtttggtatcgacagccgtggagtgttttggtgtgcggaattgtgctgtggtgtttgctccttcttatgatggtccttttttggtttcgctgttgtcatcaaaagggacggagcgcagcggaggccaaggaaagggaatttatcaaaatcagagatgggagtgtagcgaacagcacgaccatggtcggtggcgatgcgcgaaatgctttttgggtggcacacgagcaattcaatggtggcacggtggaaacgtccagcggaacattggccagagttggtggacagcagaaccaccagcaacatctcagctattttcaaccgactaattactctgctgatcgtgttcctggtccacataacgacgctgttaacagccagcatcacattgcactttcaaatgaaatgttcagcaacggaattcccatggttggccgaatttgtcccacggcgactcttcaaaggcataatggtggcgactgctcttctcctaactcgcctcattatcattatgcccatttgccgttttatgctgaacaaaataattcgctctcaactttccttcagcagcgacctaatcccgaactttatgatggtatgaagatggcattttcattttttacattgattatttcattacgatagatccaagtccgtacgcaacgacgactttggtttctcccactggggtaattacacaaacacttcgacccgccgtacgtcaaagcaaaggaccggcacttccgttaaaaccggcaccaaaagaaccaccaaagaattttttatgctcagcggcggtgatgcatttgacaaccaacagtaagcagcgtgtcaatggcaatttggaagttgtggaacaacagccgaacagcagcagttgtggagctttgttggaactcaacagagaatggaagagacagcagcgcatcaccgccgaggaacaaaaaaagcgagaaacaccgcagaaaaagggtggaacaacggcacagcggagagaaaatgaacacgacagagacatgggagagaatcagacatatggaacaacgggaagagggacgagaggaggagggggcagacggagtcaacgaagtagcagtgcgaacacggcacagaaacaatcttcggcattttgttcgctcaggagagtatcacacaaggagaacggcagcgaatgtcggcagaatcaacaggacagtccacagacggacatttcatatttgcaatcgtctgacggaaccaacggctctaataacaataacaataagcgaagccagcaaatgaatcgccaagtgaaatacgacgacactgcacccgaatatgatccggttatgacggactcattgagtcaaattgtgcacagagaagacattcgaaagaaaataggtccttactttacactaaaacttgcgtatttaattacaaatccgctgtcaaacgctgcaggtcgtgagaaggctaatcgaattgtacacagcaacagagtcagtttgattgaggatgaaggacaggaggagagggacccgctgatggaagatgcctttggtggtgacgaggacgaattggacgcggatggggaaatgagcgaaaacgaacacagcggaaaagagagtgaccgaagggcgaaaaggacgactgacccaatgaaaaggtgtgaagaagagtgcaatgtcgctaacgagcactattacgggttctcccccgccccgaaaaggcctaatcgacagccaatgatgggtatcaatatcagcactctgtcgggtgagagaaaataaaaatgacactttccatagggatttcaaattcagttggtgtggatcggaggacaaccgcctctccggcccatcgatgagtcagcgcccttccttctccgccagtcatcctcgtccatcatcaaaatgatctcattgtcagtcatgttttattttataaatgtattctcacattgctctccaataaactcccattttacttcactcacatttcaaatcgatttctctttttatgcgtttgtttgtttgtttattcgttgagcattcccccatttttcctttactgccgcaacatcgaattcgcttttgatgaaatcatttttcagttcgcctttgttcccatttctttcatccgttcaaattcgcttcaaatcaaccaaaattacaatttaaaattaaccattcttaatggttgagctgtccgctgtatgttttgtgtataaatccttcatctgtcatcttttgtatgtcattattcattatatatcattgcgccttttgtctaattgaacaaaattaaattaacgatcttaacaaaaaggtatttattgaattaaactttgatcattttcttaaataaagcaaatattttttgcattttttaacgcaaaaataatacaacacgccacataaattcaaacatggacacacacatacatacaggggaccagagcgtttgggccccggggtcgttttggcccccgtttttgggccccggggtcgtttgggcccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttagccaatttgatgtacattctgatttggacatttttcagaaatggctatttggagatgcgagttcaaaaaatcaatttcacattattttggagtttctccggggaatttctcgcaactatcgaatgaacccgtgaatttctgttaatttttacattttttattgttaaaattattgttgaatttatttttaaaatgtttattttacatttttatgctgaaatttaaaaagttgtttttactgtgatttttcatttttctgtacttggggcccaaacgaccctggggcccaaaaactgtggcccaaaaactgtggcccaaacgcccccgactccaaaaacttatttttaaaattttaaataagaaacaatcgcttcattaatcattttcttttacctatattttttgttttcactagagttgggcgggaacgggaatcccgcgggaaaagacgggaatctcgttcccgtttcccgtcttttttgcctgacgggatttttacgggaacgggaaaaaggcgggaatcccgttcgggaatcccgccccgttctttttcgttttcccgttcccggaaaatttttttacccaactctagttttcaacatgaaaacaactttctgggcttttctgggttgctgtgcacgaatatgacatccatttcgactgatttcgaactcttgaacctaattcaaacaaaaaattcaaagctgacaattcggttaaaaactgaaaaaaaacgaaaaactcaaaaaattctcggtcgaacggtttcggttaaaaaaccgaagaaaatttttcggtttatttcgatttatcggttttatttgaatctgtttattttttttcaaaaaagcaataaactattctattaatagaaaaagcaaaaattcctctgagtaaaattgtagagctattgaagctctatcaatggtgtactaaaggtttggaaaatgatagaaaaggcagccaaaaaacatgtgtttgctccttgattctaaaaaaaccacaaagattagttttagcgatttggtgccttttttggcgttttttcccgaaaaattccattaaaaattcaaaaaaaatggaaaaataaacccctaagaaatgatctaaaaaaattcagagaatatacctttatgaattgaaaaattttcagaaaaattgttcgccaaaattcatttttttcttgataaaaaattttaggtttaaaaatttccttattgaaaaacattataaaatattgaattatcaataaatcagcaaaatttagtttttggttagtttttacgtattttgccccctaaaaatcattaataaacaaatttaaatgccttttttcatgcctttttcgggatttttgtgccttttttcagtgccagtttgcgctttttggcagggatgcgatcgaaaatttttcaaaatcaggacatcgggcccaaaaaatcagattttggggtcaaaatcagaacattttgcaaaattgcttcaaatcttttatttttacaattaatttaatcaaaaatcattaaaaattatatttttcgcctccaattatcatctttaaaaattttggtgaggaaattaacaaatcgtaaatttcagtgcactcgggatcaaaaaatcagatttttaagaattttttgcggcgtatttttccaaaaaacttttgggaaatgggcgagggggagggtccggcggtgccgataggtgccgccgggaaaaatttgtgattttagtacgatttgttaacagatttttgtccaaaaaatgaccaaattttgccataaattttatatttttttgtaaaatagtgacattaggccataaaattttaaaattatgagtttgtttaagaaatcagaacaaattttggtcgttaccccaaaatcagagcatttctgacaaatcagaacagatcgcatccctgctttttggtgccttaattgtgagctcaagccataactttatggccggcggtgttgataagcgccgccgggaatttttttttgtaattttaatgctatttgttagcagattttgtctaaaaataccaaattttgagattttgggctaattttttaagaaaagatagctttttggggggtcggttgtgccgataggcgccgccggaggaaaattttaagaatttttaatgaattttgttaaaaaaatggccaactgaattcaataaattttgaatttgaacagtcgcagcggtgagaatcgttttttgatgaaaagggatggccacccgaactttattattttatgtgttattattatttgttcagtaaggccaatttaatttctgtcaaaattcattgaaaagttatgaggagaaaatattattaaaatttaatcaaatttattcagctttaatttttcaatggaaaacggacggaatggcctttataagccgaacaaattaacagaagaatatcataaatttaaatttaaattaaacaaaatcaaatgcatttgattaacttaatcgccctctttttcatgcttttcggtaagtcaattgtttaaattcattagcgggataattgggtaattattttgctaatcgtttccaggcccatccgtccagcaatacacaaaaacgccgacgaatgaggacaaagaagcggctgtcaattgtcacaacaaattccgatcgcaattggctctgggcaatgccgacaataaatcggggggcaaaaaaatgccaaaggcgggcaacatgcgcaagtttgaatgggacgaaaacttggccaaacttgcggatgaatgggccaacaaatgcacattatcgcactcgtggaacggctgggcaggcgaaaatttggcaatgaatggcggaacattttcgaacagttcgatacaaattgataattgtggctactaattgcctgcttaagaggatggcttcgagtacgcttgcggtcgctggtgggacgaactgaaccgttacgggttcaacccggatctgattatgaccggggaaaacttcagtggcatcggccattggactcaggtgaccaactcattattttggcctttctcgtcccattattgctaattagatactaattagttttctcttcgttttgttcagatggcgtgggccgacaccgaccgaattggctgtgccatggcacaaaactgcccaaataccaattggaaaacatatgtggtctgctggtattacacggggtaataatcaaccactgataaaacataattagtttactaataccccttttagtggtaattactttggtgcgcctgtctatttggccggggagccgtgcagcaaatgcaaagcaaatgacaaatgtgacaaagccacgggactttgctctcaatgaaggatgaaataatatgaaaattgaattggtataattattaatcattagtatgttcaatatggtttagtgtttcggaaaattttcacatttttttgtctttaattgacaatgaataaataaatagattaaataatttttaaattttaattcccgcggttttctgagttgtgccaaattttgtcattttttaacgaaatttgttagcatctgaatttatttattataatttaagaattaaaaaatatattttttattttacattcaagaacacttgtgaagaggaaattgccttcgaaagaattaaaattaaattgtatatgaaataattgtttgccacgttcaattatttttttattttccttttcacataaatattttccaattatgatatcacctatttttgacaattcttctgtccataaggtaaggaaaggggcggaaatgtttttgtgccgttttggcactttgtccacgttaatttggcattcatgtgactcttatgtttttattgccaaatttaatgatgccatcttacctaaattgggttatttaagtcggcatttttcaaacattccaatcccaatttcccattcatctcactcactcataaaatgctccaaaacggccttaccattctgcttctgatcagtgttgtgatcggccattccttggccaaccttggcccaaccatcaaacataatcctcattttaaaaccgtacaaactgcgcatcattagcatgatgccattgcgaagaagcacgaggcgagcaattagaggaggggggaattttgagtgaaaattcatttcgaaataa

SEQ ID NO: 5100 - DNA, 1303 bp, Heterodera glycines
atataatttttttgaatgacattatttattaagttgttataatgtttggaactattctgctgaagccataccttcttctggccggcttatgcctgttcatatacggcaccgaggcatggaaatgcaagcctggtaaaaagggaccgaccggtccaccaggaccgcttggaaaacctggagcacctgggaaatgcccgacgaagccaaagtacggcaaaacaacaacacccaaatacgacaccacgacttccaagtacggcactacgagaccaaaatatgacatcacgacttctaaatacggcacaacaacgccagaatatgagacaacgacatcgaaatatgggaccacaacatccaagtacgacaccacaacttccaaatatggcaccacaacatccaactacggcacaacgacaccacaatatgacactacgacttccaagtacggcaccacgacgccagaatatgacaccacgacttccaaatatggcaccataacatccaagtatggcacaacgacgcagaaatatgacaccacaacttccaagtacggcactacgacttccagatacgacaccacgacttctaactacggcacaacaacgccagaacatgacactacgacttccaattacggaactacgacttcggaatacgacaccacaacttcgaaatacgacactacaacttccaagtacggcacgaggaccccgaaatatgacaccactacatccaaatatggaacaagaccgcccaagtatacgcctagcaaaagatcggccatgtcggagtttgcggtagaatattagatgggaaaattttgaaacaaaataaggaaaaattaaaaattgtacaggatgcggtagtgatcagagctgctcgggctgagtttgccgacaaaaaatgcccagtggggcgccccggcgatgccggccccgcggggccaccgggccctccgggcaaaccgggcaaatgtccgtcaccggtggaacgctatgtcaagaaaagcgaagagaaagaagggtacaagagaaaggaggaaacggaagaaaagaaagaagcggaacgggagaagcgttatgatcatagcgttgaaagcgacgggttcgattttatctcaattctcagtttcgagtcttaggttctaatctcggtctcgatttttggggttgctcctagacgcttggactcaattctcaggggttaatcaatcgtaggggattaaatataggtttgaatctcgtgtccatttcgttatcaactcaaaagctttgtcattttcgacccttatgttctaatctcg

SEQ ID NO: 5101 - DNA, 6627 bp, Heterodera glycines
ttaggtatcaattcttttggtcttttctcagttccaccctttgggccattttggtctcaaattccttggagtgattctcggtctaaattctcgaactcattataaggcttaagccctaattatgaattattatttcccatttttcttccagcaattacaaggataatgttggaactgcgggtccgcctggacctccgggccccgacggaccgcccggagagtgcgaatgctattcggaggaagcggcacatgaagaagtgatgccgaaaaaggaggacaagtgagcaacaaccttttgatgttgaataatttaaaattttgaaacaaaaaatgcctcagggaacaacagcagagccaatcagtgcgcttcaaagttatgccccgaattggatggatcaattctgctggcagttcgagcacctaatttatgcgatggtgtggaaatcgaatgcatatgaaaggagagagataaaaggagatataaaaacagatttatccagaaaaactttgttgttcattaaaaatatggatttaaatgcgaaaaattgaaatgcaaaaatatataatacagcaatttttattttccaataaataaaaaaatcatttctataactaaatcaaaaaaaaaaattctgaaaaaaaaagaattttttataaatttctaaaacaacattttatgaaagcctaaaaataagcaattttataaaaaaataaatgaatttcctatttttaatgcaaaaaacaaaatgaatttataacaaaaattaatttatgtttcgatttgtttcattacgaatcttttcgaaaataaaaaataccctttattaaataaatctaattaactataagcatgcattaaaagttttgatcaaatttgctgatttgtctttcagttctttttgctcatgtctttctgagtgggccaattgacgatggcatttctcggtccagcatcactttctgtgccgatcggaccacaattgcggcacgacggcgctgctctgcgcgactttgatcattgatccaaaacacgggcattgtacactctgttttttgtaattgttatcgaaaaattttgccattttttttgtttttgattgaaattaaattttaaaaattttaaaattgacataaaaatgaaaaattgatatttttcatttaaatttttacccttttttcacagagacaaaaataatttcttaaaattcattaaaatcactaaaaacttttagacgggaaaaattggtttaaaatagaaattcataattcaattttttaaatagattaattctcaagggaacatttttcgtttttttggcaattttttgaaatattgaaaataaaaaataggacaaaaaattttgttgcaactcaaaaaccaaaatataaaagtgctacaaacaaaatttggaatgccaatttcggcaaaattccacccaaaaaagcactcaccaaatatgaacacaatggcaatcacaccgattgcgtacagtaacacaaacagtacaagctcacgcccgcgcaaggtgtgcaccaattccggccgattgaacgggtcgcgatggaacgccaagctttctaattggcgaacaaaaaacatttttttaaataaattaggggatttaatgggatgggatgactttggcaggaacaaataaatgaatggtcctaatgccgacaacaacctgtcctctgtaataatgaaaatggcttttcattacatggccattggcataaagtggcggcggcaaacaaagcaattagcaaataaattggcacacatctctttgcactcagactctctctttctttctctctttatatatattaatctctctctccctctgtttctctctccttgttctttctctcgtctatctctctctctctcgctaccttattctatgaattagctatttattttcacaattctttatgcctattgtatctccaatttctgccacttttgtctctatgctttctctattttcaatttctatcgctctctctctctctctctccctctcttctctctctctccccgttctctttcccacttccgctctgcatctataattttcattttctctctcccgctcttttcacattcatttcatttaattcttgagggatagagtgcaaaggtacagcaaatatgggaaaaactggggaaaaccaacttttattaaattttactgagaaaaaattggcccaaaaatttacaaaaaatttgataatttatcgaaaatttaaaatttttactattcatttcgagaggcaggaatatgccatgcccatcaagctcatgggccaattaagttgtacttacttacctttggaccgtcttggcattttcagtctgctgcttggcactgacaaagtcaccgagtcccggggcaatgacaacaatccctcctccatatttgccctcggacttccgccctcatccgttgaagtggccattggtgctgttgcttccattaaataatgaagggcacggcacgacttgttccaaaatgtttataactcaaaatttattttcttatttttaaattttaattttgattaaaaccggtttatgggaccagtgaatgctcataatccagatttgcatcccgcattacgccaattttcggggaccgaaatttcggcattatttattccgttggggaccgaaattgcggcattatttattccagaaatttttgcgccagaataatgtattactcgctcagataacttattatcgggactttattaatattcttgagaatagtgatggagtatcataaattaaaaagaactttccatgaaaatcaaatgccgaaatttggagcaaatcccaaaaaatggtttcgaattttccaaaaatttgccgcagtccgcaatcgcacaaattttaatcaagactggtaaaagcggcaaattttggaacccccttttaattcgaaacacaatgacggcacttaacagtgccgctatccaatgaaagttcaaaatttcaaatttaaacaaattggaagtcggcgacctgcgctaatgtaaagattgaagcaagcaaaaagcattatgttgaagcagaaggaaaagccaattttacatgctgctgatgggtgagggagggcaatgtacgacaattttaagtggcgggaattaacaaaaaacaaacaaacaaacagaaaataatgtagtaaaactcttgagaaacttctcgggacgctgaatgaagaatgaaagaacagcacagtcgccaaaaattttgttgccggaaaatgaacaaaatgagggggaaatttttgtaatgccaacaatcagtcagtcgtcaatcattgggcaatgtttgatcagtccatccttccctccagcatttttgtaaattgatcaaaaaaaaattttgttctaatcattgaatgatggatgattagtaagaagggctatctatatgcatagaaaatcgtaaaaaaatgcgcataaaaatgagtaacaaaaaagagtgaaaaaaccttggtcttccaaatttttcacatatccatcggctatcattgccatcactttccaatgctcataactttttttttgagtagcatcacacatgtgatagccataataattactcagtttttcaatgactcatcgctgcaattccatccctcaatcatttggcgccaaaagtacgtttcgcccagtgcctttgccttgatcatgtccttctcctccgcctccggtgtgtcatcatcatcttcaacctctcaaatgctgcaattgtgccacaaatgatcagagcgaacaacggcagaatgacacatgaatgcaaaagaaattgactcatttttctgaatgaaatatggaaaatttagcgggcaaaatttagatcagtcggtgcccttaggcgccgccaggaaaattgtttggaaattttaaagcattttaaaaaattgcttaaaattttaaaaaagttgtcttttttcttgaattttttttaatttttcatttcggggagcgggggggggggggattgtccaccctttccccttgttgatgcctgatttatgttgtaaaatttacagagcatgaatgtgaaatttgtgggtctgaggaaaattgtgatattttgtagagatgcgccgtgaatcacggtcacggttaccgtgaatttcacgggttttttcactcacggtcacgattcacggtaccaattcacggttattccgtgaaaaatgtacactggataaaattgaatatttacaaattacatattgttttcatagagaaatttagtcattttttgggaaatttttgctaagaaacagagcaaaattttcaaaaatttccccggcggcgtctatcggcaccgccggcccaatttaaataaaaactcattaaatttctttaaaactcgctcaaaattaggttatggcaaaagcagttaacaaatcccaaaaaatttcaaatattgtccacattaacccttattttcttaataattgggcaaatatatcttatagatcaaaaacaaaaaaccatttaaaaaaggtcggaatcgattttgaacgcaaaatgatgataaatatgcaaatttgggcgctccgcgcgtgccaatggtagtgctgttcaagaccgaaaattttcctaggctcgagaccgagacttgaccccgaaactcgagaccgattttttatggttctcattttttggctcattttacgaacaaaatctgttaacaaattgcaatcaaattttagatttttccacccggcggcgcctaccggcaccgccggactacaaaaatttattattttataaaaattggcaaattcacaaaatttggccatttttgtacaaaatattgtatttttatttaaaataaaataaaatagtttaattttttttttttccctaatggacgggcaacattcatttttagcaagcgcaatttgcttttagcgaattatttagtgatacgatttttagtttagttttctgttattaacaacgattttctagttttttattttgagagccttaaaagcttaaaaaatttcgaaaaaacctatttgacctatttggccttttgcccaaaatttgttaataaaaatgcaataaaaacgaaaaaaaaaatacaaccctaagaatcgacctaaatttttttaaaaatacacccctaataaaagaaaaatttctcaaaaatttatctccaaaatttatttattttcttgacaagaatttttgatttaaaaagtttttatctcaatattgatttgtcctaatttttaaaaaattcttgtttatgccccactctgctttggctggccatacctcgccagagagtggagatagaccctttgttgatacatttggaaatgtagagcccgcctagcgcattcgaataacacaaaatttgtttgcatttgccaccaaacaatccgcttatgacgcgccgaaagaaaattcacgaaaatttggcatcggaaaaactgcattttttcatgggccagcatagtaaagtaaacccaaaatgtaagggaatttaaattggtcatgagagatgtttagttttttatttgtcccatcgtttttctgggaaaaaacttttcgagaaaagctgaaaaattttccaattgcaacagaagcagactcaaattcttcaacacataatataaaaatattacgcaagaacttatttttacatcctttttagaaatgctgcatgaatttttattgtaaatagttacaaacaaactttttttcactgccaatttctaccagttgcgacacaaaaaggcgatagttaagcattgagatataaaaaaatcgtctagaataattatctcaacaatttgtcgggaaagctttatttttcggtaatttttatttataaaatcctttacattttttagtttatagaataatgttccatttgataaattctgttacaaaaatttgattcgacctattctaatttgggaaattaattcatgaaaattacatagacaatatcgaaagaaatctaagtaattataattaaccaatgtcaattcgtgcgtacctatcaattatgagcgggaccgggaccgggaccggggcgggaaatcccgggtttttcaggtcccgatcctggtttttggaaaaacagaaatcccggtcccggttttgccagtcccggtcccggcgggattaaataagcactggtaagaatggtggtctgggtgagaaaagagaagggaattggtgagggtgtccagacatttgcgtcccggacatttgcggcccggacatttgcggctcggacatttgcggccccagccaaatcggacatttgcgtcccggacatttgcggcccgacatttgcggcccaattttttgctgaattttgcggcccaagccaaaatcggacatttgcggctttgccctactttcttcagcataatatttaactttttcaatacatcaattaacacacaaaattcttttattttctaatgatttgctcaatgtttaacggtcttacattttcatacaattttaaaatcgaaattcaaaaaaaacaataaaccaactgtgcataattattttcctattattcaattaacccaaataagtatcgcctcgcaggggggcttcatgaat

SEQ ID NO: 5102 - DNA, 1336 bp, Heterodera glycines
  misc_feature (1233)..(1233): n is a, c, g, or t
  misc_feature (1254)..(1254): n is a, c, g, or t
ccccccctctcactgtccaaaaaagtttttgaaaaaccatgccacaaaaacagcgattaaaagcaaaaatttaaaagattgtaaatttatttaaaaaaatacagaattttgggactcagaaaattccaaaaaccccccctgaaaacaaaatttttaaaaattttcctcgaactcgtccaccaaaacgtaaatacaaaattttattggtacatttttgaatattggcaattttcgtaacaaagtgcacttaaattttcaatttttttcaaaaaaaattttcacttgggaaaagtcccggttggtcccgggttttttcgctgtcccggtcccggtcccgacttttctggtcccggtaagtcccggtcccggtttttgtcaaatttcccggtcccgctcaactctagtttttagagcctaaaaatatcacccctaattattacacacattggcacaacaaaaagagtgttgtgaaagcagaaagggaacgaaattgcccctttgaagaagcaccgctttagaaggaagaaatttattgattttcaattccttggccagtgccaaaaagatgcttcttccttccattgcgaataatataatctttgattttttaaaaattaaatgcaaaaaataaaaaaaattgcttatattttattaggttaattaaaaaataaaatattttaatgtaagagaaacgttttttaaatttattaataaaatactcttaaaaataatacccaataatttattaaaaaaattaaatatttattttgcataatcattggtgaattattttattgaaaaaatatataattttatttatttttaaaaattaaatgggaaaaataaaaattatttatttgtttataatttgataaaatgaattatttggtgtgagcgaaaatgttactttatttattcataaaatattctccacaaagaagtcttcagataacttataaaaaaattttttattttgcctaataattggtatattattttttgcaaaaaaatataatttttaatttattttttgaaaaaaatgcgaaaaataaaaaattcactatttttttacaaaaattgataaaatgaattattaggtgtgacagaaaatgtttctttattaattcaaaaatactcagataaatttaaaaatttttaaattttaaaaaattttatttttcctaataattggaaattattttttgcaaaaaatataacaaattagtgctttanattgttttaatttttcatatntgcccctcatttttttctgtccaatgctttcgtgtttgaaggcataaatacaatggtaatttgtgtcaaataatctcatttt

SEQ ID NO: 5103 - DNA, 2908 bp, Heterodera glycines
tatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatttaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacacacaaaagcgctcgagcatgagagggagggcggtgcacaatagccattttatttcacagaggattttttatttagaggttatcccagaaaaatggctatctctttttttgagaaattttatacacatacaaaagcgctcgagcatgagacggagggcggtgcacaatagacattttattacacagagaatttttaaatttagactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgagaaattttatttccaacaaatttcattttcgcctaaattattttaaatatttaaaatttttattaattttttgctccaccaattaggccgatcttttctaattgtttttgatcgttttcatcaatttcgccagaatcagacccaatttcaacgcctttttcttctattttctcgacacttttcttgttttttcctttttctcaaaaagtgcttttcctttttcagttttatttttcctttttggcttcttttctctctttgaaattgttttttcttgcatttccttcgcctttaaaatgcctttttcatttttctcttttggcacaatgccaatttcgctcctttgcttttgatcattttcatcaatttcgcctgattcagaagcaatttcattgtctttttcttctattattttttccccgtcgccaattggcggcatttccttttcactttttgtatttaaaatgcccttttcttatttttcttttggcactgtgccaatttcatgccatttctcatttaaattttgcgctaaatcatgcgaatttagactcgtatgcgcttcttcattgagatttatgccacctaaaaacacatttagttttaataaaaaattggccaattatactgatgttttcggctttttttatcattttcatcaatttcgcccgattcagtaccaatttcattaggttcacttctttttgcgctattttcactttttccaacttgctcttttcctttttcactttaatttttcctttttgtgttatttttacgctttgaaattgttttttcttcgtttccatttggtggcttttccttttcactctttgaatttaaaatgcccttctcatcttcatttccttttggcataaaatcctttaaatatgatgatgtacgatttgatcaacgacgtgagcggaactctgcgggccacggaggagaagcggaacatcagctgcatttcctatgcggggtccatgtgtctgaatgcgacgtgccgtgtcggtcagtccaacaaaatcggccggcgatttctgcggcgcttggcaatgcttttcgtccacagacagtcgccatgcctatttggcctatcaccactgcgtgttcaacggcgagtacgacttttgcgagcgctttaatgcgcagtgccagtcgctgaacggacacggcgggtgcaacctttgcgacagccaccactgcaacacggcaccggaagaagcggaggaggaggaaaagcacaacggcgggggaggggaggaggagaagcggggcaccgctgcgcatccgcacgacgaaatgccaaccgaaaaggcggtaagcgaagggaaagtgccagaaactgttggaattgcagcaaaaaatggccaatgaaagtgcgccgccgcttctgccgccggtcaatccttctggtaactgacaatgagttgaacagcagattttgatcagttccgcttttaattcttcgaccttttcactttccaaaagatgtgaggcaaattgtggttggtccgtcgaattccgccggcgaaaaaacggacgctctttcgcaacagcagcagggcaatttcggcgggggcgccaacgctttttgggactttgtgttcttttttggaggtaaaataagaaaaaagaaaagaaaaagcataatcagttcagaagggaggggaatttaagacaagccaagggcaattgaaacggaaagtgtcaccaattgaaaggggcgaatgagtcatattgtactaattagcttacagacatttgcggacaatcccatatgaaatatttgaaaaatgaacggaaagtgggcctcttccaaattttaaataaaactgatttatcattagtattaataattcaaaactaatatttttaaaaattgtaaaaaatattttctttggattttatttatattttaattgttggattgtttcttccttttttgttttgttttgtgtgtatgagagagggaggaatagacgaagaactcttttcattgtttataatttattttgaatttggaagagccgtacttttgaagcccacaatctttgcgttcattcattttttctaaatttattttcccaaattgtcccatttcggttgtaattagt

SEQ ID NO: 5104 - DNA, 4282 bp, Heterodera glycines
aatcccgcaatcccgcacgccttacatcggaattttaaatgcgggatttgcgggattaatccctcgtgatcccgtcccgcaaaaaattttgagttccagtcccgcagcgggatccgcaaatttgaaatttcccgtctctagtgattagtattactaattagatgctgcctttacactttgttttattaattattatgcgtcgtttctgttcagtgtttgtcgcctgcgttatgttggccgttttcggctacaaagaacttcggaagagaggcttttttgtagcggacggagaaagacagaacgaaaatttgatttagaagagagccgaaataatatttattcatttattttttaatttatggggcatactttttttaatgacaataaatacataagcaatttggctgtactttagaattggacctgctgttttacctatttttaaaccaaccaaaaacataaaattagatggagtttcaccatttactcctttacgaaattgtacaattccaatacaaattcaaacattacacattaattaatagcgacaaatggggacatttctctcgacaaaagccctaacgaatatcaaaaataaataaacgcgcactgacagaagaatgaccaatgaaaaccgaacaaaaattaattgcgtataattgggggtacaaagctcatgatgatggcaattacggcacaatgaaactgcttgatttgatggtcgagatcaaattgaagcgaaatagcctccgggaattaacaacccaatcatttcccctcataaagctgtcggatttcctccgcgaattttctctcgatgttcttgcgcttcaacttcagtgcttcggtcagcattcccgagtcggcagtccacggctccgcacagataatgactttcctcgggatttcctccctgcgcaatttccctgaaaaagagttgtttaataaggcaaaggttggccggaagaaaagacccgaaacaaagttttggagttccttttccagaagcttggccatttctttgttggcacaaattgcctcccaactcgactcattgacggcattctgaagaggggagaagcgatggcttattaattatatcattgccatgacgcgaaacggttgttttccgtttttgactcccaccttttcagcaagtgcttgcaagtttttgcgatttgggaccacaagtgcgatcagatagtccttttgcgggttgccataaacgcaaatgttgtccacgttcggattggtcagcagcgccgtctccacgcgccccaaagcgatgtattcgccgtgggacaatttgatcaaatccttcttccggtctgaaaatgagagagaaattgccaacaacactcactaattaaaaccaataatgcagagactgccatcctcgcctaaacatgaacaaatttgtcattatgccaatgcttttggtggcagtcaattgcttacggaattggccaatgtctccggtggcgaaccaacgcttcccgtccaactcgacgaagtcctccttggtcttctcctcatctttgaagtaacccaacgcgacattggccccgtggatcagaacttcgccctgaggaggcgaatttgtgggcaaataaccagctgaaaaagaaagatatgcatttgggaataaattttcaattacgtccgccattggacctaattatgccgacacaaacccccccccccgaaaaaataaataaattaatcttttgggaccgtttcaaaattgaattttaccttcctcccattctctaagccgaatttcacaactccgaagcggcggtccgaccgaaccggtgctgaggtcgtgttctgaaagtgaaaaaatgcttttgcttagactatgtttttttgaatgaacgaccatccgccaaagtggcgccaccgcaagtttccgtcagcccatagccctgaacgacggggcaacagaagcaaatgttcatgaaccgctgcgtctccggattgagcggagcaccgccagaaatcacaaagcgaaggttgccaccgagcattttgctgattttggcaaaagccaaactgaaatttgaaaatggcattacaaaaacgcactttttaaataattaaatttgccgttgaatcccttcggatccaggacgggtgggagacgcaggagaagaagaagcattgcccttttgatgttcagaaaccaaaacctgatggactacgtgttcggcatgctcgagcagtacgccagttcactggagcaggaggtggaggagcgcaccaaagagttggtggaggagaagcgcaagagcgacattctgctctatcggatgctgccgcggcaggtggcggacaaactgaagctgggcgaggcggtggagcccgagtccttccaaatggccaccattttcttctcggacgtcgtctccttcaccactttggccggcaaatgcacgccattacaggtgacaaaatcagtgatcacatcagactggggaagctgagtgatttgttcaaaacttacaggataatcactctgatcagtctggggaatctagtgatttgggcagaagaaatgtagttggtgataacgaatgggacttagtctgactattgtgatcaacatccattctgatgataatatgattcttacgtcctccccctctccgccgtttaggtggtgaatttgctgaacggactgtacaccgcctttgacggcctcatcgacacccacgactgctacaaagttggtcagtcagcggccgatcacttccatttgatcattttacaacgcatttccccgcacagaaacaatcggcgacggttatttggtgtgttccggcattccgaagcgcaacggcgaccaacacgcgaaggaaattgcggaactttcgttcgctttcctccgcacggtgtccaacttccgcgtcgaccacctcccctccgaacgcgtcaatctgcgcatcggcttccattccggtccctcccctcccctcccatttcaaatttggcattttcaggcccagcagtcgctggcgttgtcggtctgacgatgccgcgctattgcctttttggggattcggtgaacaccgccagccgaatggaatccaacggaaagggtaaaattggggggggggggggggggagaaaacaaattcatttcccatttcagccggcaaaattcacatttcatcgagttcaaatcgcttcttgaccagcgtaatcggaggatatgtgacggagccaaggggcgaagtgattataaaggtaattaggggggggggggaaaggcttttgttaattaattgcctaattaattcattagggaaaaggtgtgatggagacattttggctgttggggcgaattggcgaagtccatttgccggaggggccatccgtgccggaacggaagagcccagcggaaatgcgctgattgacgggaaaattaccgtttaatttgcaatgcttttcctttttcttatttgcccattattctccaattattgcttttgtgcttgtctccctcccttcaaaattaattgagtgggtaaattgtgaatgccaattaaaattaattaattgttccagacggaaatattcttcatttacttataaatgatctcctcattttttttgttgttcgcataatcagttaaaataacgattgttggcagaggactcttaaagataaaaacatcggaagcttaatcttaattaaaggataatgccatcaaatttgacagtgacaaattgtgtctcccgtgagactcgtacaataattcttcatttttgactatttttgcccccggggaattcaatttgatgcgattgacttttctctccattctttgaaatgattcaccgatggtttctccgtttcgttatctgatttgttttttgccaatttgtgcatattaatatgattggatggattccatcggatgatttggtgaatcatttgcctttgctttgctttcactttatttcatttgcttcattttcccccatttttaatcattccaaaattccaataatttagtaaaatgctttttccaatgcttttcgtcctttccttctcgcttttcccaccacttttgggtactttccccgttttttgctcaatttcccccattttccaagggttcaaccatttcctcaagtgctcctcctcgttcatccacgcgggcccatgggaaattgagctgtacgatttgatcaacgacgtgagcggaactctgcgggccacggaggagaagcggaacatcagctgcatttcctatgcggggtccatgtgtctgaa

SEQ ID NO: 5105 - DNA, 815 bp, Heterodera glycines
  misc_feature (17)..(17): n is a, c, g, or t
gatttatttacatatantttgagaggtttttcttcattaaatacatttgatcactgatttgaattatgatcgtccggtcattttcaattaatattcatttcttctgcgtctgctcattgtttttgttcgtttgtccgtcactcatttgtcagcagaagacggcccatttgtgatgctttgtccggcttcatcttcttctgctggtggtggcggagacaatggccttaattaagcgcaaatctcaaatttggatatgtataaaaacaaatcccctttttattgctcacccaatgcaattagtgtcagcaaaaagccaaaaaaacacattgttacaattgttgtcccaatttccgtctccccaattttgcatcgtttcattatccaactgttgtcccatccctttgctttggccaatgtcagcttttcctttgtccattcatttaccaattcaaacggcaccattggcatcgacggcacacgaacagaaaaatgaatttggtaattccatttggacaatgcttggccagcagaaattgttgcatcaaaatcagcaccaaacgcagcgggcgacaaatcacaggaatagattgaagtcaattggttaagatcagtgagaattgtcggtgaaatttgacgacgcaaattgtccaaatgatcatcattgttaaagcgcaagtggcgaatgttttcagaaaaaatgggccaaatttcacgaacaaaaacatcacaaatcggctgctcatccgtgatacgtacacaaaaaatccacaaatctaaattgatgcctcttttgtcaaaaatttggtgatttgaac

SEQ ID NO: 5106 - DNA, 1014 bp, Heterodera glycines
aaaaaaaaaaatgttttttttaatctggttaaacccctttttctggggttttaaggtcgcgattcaaagcttgaaaaatagggaatccggaattgaacaaacatagcactttcaatttttgaaacccccgggaagatgttttacatgacttttttcgaaaaattgggagaaccacaatattatttattaccaatttttccattgcagatcggtggaaaagataagcagtttccgtgccacgagatgcccaacaaaattcgcttctgtttcctccaaattgagtaattcaataataaattttctgtggccaatggcggagaaaattcattggtcccgaattttttgttaattttaagaaaacggcaatcatcaagaatgggggtcccatattttcattttttgttttgggataagaacatgaactttgtttgagttagttagctaaattttccaaaaaaaaaagttttttttgagtgtagggttaggccatcggaaaaagtttggaatttttggccgatttttgaacagattttgagataaattatccccccccccccaaaaaaaagaagaagaggtctcagtgcatcagattacatacttctagaaatgacttagaaaattaaaaaaaaatttcttggtcgatgttctccacctttgccttttctgtgcgtgcgcgcttgcaagggctcatttttcgtctaaatctgttcaaaaattgacaaaaaaaattccaaacttggcctaatctaccctcaaaaaaaaaaatttttttttttttgaaaatttcgctacttaaataagaggccgaagagcaaacacatcgctcgtgggaggggggggggttgcgatttttttaaattttatgatcagttacaagtttttccaaaaaaatttttcccaaaaactacagcatgttgccccccccccttttgtgcagatacgtcgaccaaactgtcatcgaatttctgcgttccaacaagcaaatctttgaccgaaggggcaccaatttagact

SEQ ID NO: 5107 - DNA, 4244 bp, Heterodera glycines
aatgttgcaacaaaaaaaccagtctccttccgacaatttctggttttgcatctccaatttccatattttcgagcaataatagctggaatggaagttgctcctccgcagcgtgggcatgtacgacgagcatggagaagtcctagctgttcaagccattcgtcaaatgcacgtctctgagttttatccatgcgaacattgattattttctttttcgtgcatttgaatcgatttttagcaataaatgtgaattttgttaaaaaataaatttttttattttattcgaatccgggtcaggggttcggaatcggtcgaaatggatgtcggattcgtgatcagcgaccccgaaaacccctagaaattaatttcgggggaggaaggggaaggagttcgactgcgattttcgacatttttttccgcgtttcacgaccgcggcaatttgaatccgcaaacgcgggattcatcgatattttaatttcaaatttttatatgtattagttgacattgcaaaaagaagttcacaaaatgtccgaattgaattgcgtggtccaatttgcattgggtgggtgagcagcagacgacctttttttggtgtcatagcaactcgtacaaaatgcaacagctcatacaatttcttaggctatgcctaggcttaggcctaagctataggctagtccttaactttggcctgctctggcctaggctaggctttattttcctaatacatatttcttgattttcgtacgagttgccattgactccttttttattaattaaatttattggtaattgtttagcggtggggtgaatcaaaatcttctcccaaaaatgcgagattcgaaaattttaattttgagtttttgctcaaatccgggttcgggattcgacgtggctcaaaattaatatcagattcgggttctccgctctttaatttttattcaaaaatttatttaactaattattcttcgaattcaaattttaggccattgtctccgcccgccgaccaaaacaacgaaaaaggcgccaatttgtgaacctatggcaattgatgagaaaagaagaaaggaacgaccatttgattacctctgctggacttgatttgatgctatttactctttgaatgtgcttactttttcttttgtttaatggattttcattcaaaaattgcaataaatttcaaaaatttgatttttttttattgcggcgtcatctgaagaaaattcgcgttccgcgactctgaaaaccatcatatttttctcactaatttgtttcaattgcttttattttaagacgagattaatttttaatgacaccgcctgccgagaaaaagcaaaaacttttgtccgccgttgaaaatcagcagcaatcgtcgtcgtcggcttcttttgtgaaaccatttggaggacggaagaaaatgcgagtgctcagatttcgcggctaaatgttgatatttaataaaatcaacaaacattatgccatcaaaacaaataccaacgcaaatttttaaaatttatttaagtggcttataattttatgtagagcgataacgcaaaaatgagttctgctatctctctccccattttatttttgcgccaaaagtcatttgaaaaaaattgctttaaaatttcaaaaattatcgaaattttaaaaatgatgttgagcctttctctaccctcgagcccattggcaacaatttaaggcgaacagatttgaaaattgttttgatagaaaatgcgattctcgtgtttttctcatcaagtattatcgtaaaaaataggaaaatcctaaaaatccaggctttatccaacgcattaattcttctgctatatattgtgtgacatcattcagaatttggccaaattgtgcttatttctgccaaaaaatgaacaggcggtaaggcatttttttaaaagccacaaattcctcacttatttagcctaattgtttcccatttcagttggatttgcaacgacgtttggatggacattttcccatcctttgaccgtgctcaacttggcctcaaattggcacttctttcgccacgtttcgatgcgttggtggacaaacatttcaatggcaaaagcgaattggcaatttggagaccaatcgaaattcgtcgcaaggacaaaggaccagaaccgaacctatctgtgcggatggatgacaaatctttgcccgaccgtccgttgcccagcaaaatccgttttaagagccttcagattaagtaattaaaaatcagagctatgacaataaaagcattcattcctttttcaggtacatcgatcactccgtcatcgcttttcttcgttcaaatcaccaaattttcgacaaaagaggcaccaatttagatttgtcgattccttcactgctatatatttgtgtgacatcattcggaactcggccaaattgtgcaatttcaaggaggtgtggccataatctcgacaaatcactgatatttgttcctatcgaattgtttagcattttcttcgtgccaatgccatttcttccgtcagttacgaaattcatttttctgtttatgtgccgtcaatacaaatggtgccatttgaattggtgaacgaatggacaaaggaaaagctgacattggccaaagcaatggaaaatgaattggacaacatttggataatgaaacgatgcaaaattattggggagaccgcgacggttcattggaacgacggaaagtgggacaacagttgtaacaatgtgtccatttggctttataatagcgccaataattgcattgggtgagcaattaaaaaaaagtgtttagataattcaaattgcgcttaattaaggccattgtctccgccaccagcagaagaagcggcacaaaacatcacaaaggggccgtcttatgacaatgaatgaatgagtggtgggcccagcaaaaacagtggtcaacagaagaagaaatgatttatttaagaatgaccgaccgatcataattcaaattagtgatcaaatgcaattttatgatgaaaaacctctcaatttcggtaaataaatcggacgtataaaaatggcaaaaaattggactctattgcggttcacacgcccataagctttttttttgcaactttaatgcaccatagctttttcttattaaaaattcttggtatcactcgatagccctaagagaaaaaacggtaatagtaaagctggtgctggggttttcgaggtcgctgatcacgaatccattatccgtttcgctcaatttcgaaccccggactcgaattcgaaccaaaagtcgaaaattcaaatttttcgaattgcactcttttgctcaaattttgtttaagaacacggaaatgaactaaaagtcatcactgcttcagtaaaatggtaatttgaaccatttttagactaacaagtgattccaaaaaattgaattttcgactttttgttcgaattcgggtccggggttcggaatagggcgaaatggatactggattcctgaacagcgacatagaaaaccacaggaaacctgttttcatgccttttgaaaacaaaaaatatttttttcaaaaaaggggggggcaccagctttactattaccgaaaaaacattttccttcgctaattttagagacaggcacgatacatttttgattcagtctttttcgattaactgatcaaaaatagaaaaatttttgtatttcgaatttttaatataaatttcagaaattctttaacaaaagcaacaatttttttattgacgcgtgacatttttgggacaccttcaaaatttcaaaaagtttccattaaataaattctgttgaaaaataatttctccgtctccattttttcgagttttgaaccggttcaaaaaccgtttttttggcatttccgcaactcgagacatatttttccacggtaggggggggggggggtcagttgcgtctggccatttgcgtcttagtacttaaggggccagttgcgtctcaaacattttttatagagtaaaatggattaattaagttttctgtatgctatattttcattttcacagatacattgacaagaaatattcaaaaatttatagaaaaaataaaaagttttaacaaaattaacaaagtttcatttacccatttggtaattgcttgaaattcccctgagcgtttcaataatcgaatttcggttattttggttttggccgtattggtgatcgtcgtcgatttgcgccgggggggggtctctcattgtagcgctccggaatcctcagaaattcgt

SEQ ID NO: 5108 - DNA, 4058 bp, Heterodera glycines
  misc_feature (3997)..(3997): n is a, c, g, or t
  misc_feature (4007)..(4007): n is a, c, g, or t
ttccgctgttaatccattcgcttgaatcatatatcccttataacaatccttacaaccatgaaaagcacatccctaaatgataaatatttttaaattttaattatttcccaccttgaatttcaatgatcttttttggactccaattatgcaatcaatttctaattttttgtcgccaataagcgatatttctcccccatttcctgcgtgcctcgctttaaccccgtcccgatgcataatccattcaaaatattttatcgctatattactctgactgtcctttgtcaaaaatccactctcaggaataatcggcaatgtttcactattttttaaaaatttggcacgaaaaatgctgaaatttatttatttagttatttttattttggtccctaattcatgcatgaagatgcaattgttgtggataatctcataacatcaatcccttttggtgtctctttatcttttgttatatctataaaaatttttctcaattttataagcgctttcattaaaatgtccgtgtcatttgaacaatattcatccaatttttcctctaaaatcaattttgtcacaattaaaatatttttatcttacctaaaataaatccattattgtaatttgcatagtaccattttttaaatttttcatattcttcttcacttaattcatcagggaaataatcatcaaagggtgggagagtagccaagattttgcctaaaattggaattttaattttttttttaatggaaatctttttaccgtaattttcttctttgttaaattggtgtgggaaatataatttcgattcacaatccaatccaaatgtttttggtaaatgagctaatttattctgcattaaaagccaactgtcccggaagaaaaatttcggggatttttcgccctttttaaatttaatttcataaatttttaaatccgcaattgtcaattctggctgcttatatcctaaattcgcaagttccctcaaaataaagtgtgagtcatatcgtcctaaagaaaaatttaacaccttgtaaatttattttattccttaccaccaaaatgtgcatatgcatatgtatcatatttttgaaaatttataatccatttaacaaaacaatttaacgggtcaattctatccatactacaccattttaaatgccgggggccgtcaccgcaaatttcgcactccttaatttctcccaaacataatgaacaggtaaatcgtgcactaataaaattgggtttatgaatagtctcctttttcaatgaattttcatccagaatcgtattcgtctaaatcataaggtattatttttacaactaaaaaacaattaccgtgcattccaaatcataagcgactatcctatatggagccatttttttgattttcaatttttgcataaaacataatttctttgggtcatgaattaaatgacattttctacaatgtttctgatctaaaaatacgaaaaagttttttatttattataaatattcatttttaaaacttaccgcaattatgttctgtgtccgtcctaaattctcctttgcattttttacatttttgatataaagaacatattttatttttgtgatgctcaaagcaattctcattaaaaaaagccctgttacacttctcacagttaaatgtttttctttccggggggcaagggaaaccaaagccttaaattttccattaaaagatttcttttttattgttacctattcgacagcattttttacacctctcttcacactccaaactatgtttttcctcaatttgataagtagtttcacaactaatacaatatttatgtttaatgttaaaaaattgtcctatactttttattccttaaaacattttttattacgaaaaaactatacaaacccaccatcccaatgatttttgtcatgaaaaatacacacattatattttcgggggccattccccttaaaaattggacgaagcccaacatccctagaaaaagcaacaatacgaaaatttcccggaaatttcgagtcctaaataaattaatttctcattaatcctgaatttttatttttacccaaaaatcctgaataatttgtaagtgttctaatccgtatgatttttctttcatatttatttttgcatccgtcattaattgtttaactgcctcccattgtctctgttcattcgctattatttttttgaattggtcccttgaaatggcctcctcatcatttttattaattaattgataaaatctgcttaaagttaaggcgtaaaataaacctaaaagatacattaatatatttattttccatttcacttacaataattgtccgaatttttgacgctaattctccctaattctttaatttcacaaaaatccaatgggttaaatcctaaaatattatgtcaaatttaattaattattttttttacctgcccctcggggtgtactatatgtagttattatacaggaaatgggctcatgctgtaggtcgaactcactatacgattggttaatcctaaatatttcgtgcaaaacagtgtcggcattgttcatttttgggtcccgggccggcaaaatgattgggtcatttagcaactcacaaaacaaatcaatagaaatcctcttaacatcccacccaattctttttttcatcattgcttttttaattaaattttcgattatttttttaaagttttcggagctctcttttcgattttctttttttggatttttaaatataaatcttgtaatattttcttgaatcccgtaatcgggcatacttttttcggttgttgatatttcgatataattattttcatttaattttatttcatcaatagtttttttgaaaaaattttttatatttctttcttttattttttcaccggggacggccaagaattttttttggacctgggacattttttaagtgaaatatgttttttttttaatataaaataaatattttattggtaaatttgaaataaaattcaatttgtaaaatatttttataagcaattttattttttctcgattaaagtgaaatatttttgcgaaattgcgctttttatagcgaccgcagaacgctcaggtgacaggcggaccgcctggcacgtggttgtttttcatgagtcaattaggcgggaccgcgagtattgattggccttttccacacagtgcgtcgcactgactggccgatgagtcacgtgtttattgcgaaataaggtccggtccccaatttgaatgcaaattttgagccatcaatcacttaagttgacagctgtgccagcaacagctggattttccaaaataattaggtcaaaagaggcgccaaatttgaattttgaatgcaaaagaaagttatttttcgctgtgaactcaaaccgtaaaaattccttccgttatttttcatgttttgtaaatcatttatttattttcattttttttaatataaaataaatattttattggtaaatttgaaataaaattcaatttgtaaaatatttttataagcaattttattttttctcgattaaagtgaaatatttttgcgaaattgcgctttttatagcgaccgcagaacgctcaggtgacaggcggaccgcctggcacgtggttgtttttcatgagtcaattaggcgggaccgcgagtattgattggccttttccacacagtgcgtcgcactgactggccgatgagtcacgtgtttattgcgaaataaggtccggtccccaatttgaatgcaaattttgagccatcaatcacttaagttgacagctgtgccagcaacagctggattttccaaaataattaggtcaaaagaggcgccaaatttgaattttgaatgcaaaagaaagttatttttcgctgtgaactcaaaccgtaaaaattccttccgttatttttcatgttttgtaaatcatttatttattttcattaccgcagaacaatttttattatccgatttaatcgtagataacaacttatgaccttccttttnggtttcattntcttttgacaaatatgtcgtttaatcattttgtatttttcgaaagtgacaa

SEQ ID NO: 5109 - DNA, 3860 bp, Heterodera glycines
ttacttatttattttcattttttaaaacttacttcatgcacgaagatgcaatcgttgtcgataatctcattacatctatcccatttggtgtttcctcatcttttgttatttcaataaatatttttctcagttttaatagagcgttcattaaaatatccgtatcgtttgagcaatattcatccagtttttcttctaaattttattttaaacacattaatttttattaattacctaataagaatccattgttataattcgaataataccattttttaaatttttcatactcttcttcactcatttcatcggggaaatagtcctcaaaaggcgggagtgtagtcaaaattttgcctaaaaaataacatttttttgttttttgtatcttattttaccgtaattttcttctttgttaaattgatggggaaaatataatttagaatcgcagtccaacccaaatgtttttggtaaatgtgccagtttgttttgcataagtagccaactgtcccgaaaatgaattttcggaaatttctctccctttctaaattttaattcataaatttttaaatctgctaatgtcaattctggttgtttatatcccaaatttgcaagttccctcaaaacaaagtgcgagtcgtaccgccctaaaaaattcttagatttttttcattgttttttcaaatcttaccgctaaagtgtgcatatgcatatgtttcgtgtttttccaaagttgtaatccattttacaaaacagtttaaaggatccactccatccctactacaccattttaaatgccgtggtcccgtcccacaaatttcacaatccttaatttctcccaaacatattgaacaagtaaatcgggcactaataaaatttggtttatgaatagtctcttttcttaatgatttttcatccaaaatcgtattcgtctaaaccaaatatattatttttagacctaaaaacaaattaccgtgcattccaagtcgtaagccactatcctataggcggtcatttttttgattttcaatttttgcataaaacacaatttttttgggtcatgaaataagtgacattttttgcaatgtttttggtctaaatagttttaaatattaaacactactctttttatgtttaaatttaccgcattcatgttgattttttgtatctgttgtgtattctgtttgacattttttacattttttataaattctgcatattttgtttttatggtgctcaaaacaattctcgttaaaaaaggttctgttacaattttcgcaatttaaagtttttctctcgggggggcaggggaaaccaaagccttaaattttccagtaaaagattatttttttattgttacctattctgcagcattttttgcacctctcttcacaatccaaactatgtttttcctcaatatgataggtagtttcacagctaatacaatatttatgtttaatggggaaaaattgccctatactttttattccttaaaacattttttattacgaaaaaactatacaaacccaccatcccaatgatttttgtcatgaaaaatacacacattatattttcgggggccattccccttaaaaatcggacgaagcccaacatccctagaaaaagcaacaatacgaaaattccccggaaatttcgagtcctaaataaattaatttctcatcaatcctgaatttttatttttacccaaaaatcctgaataatttgtaagtgttctaatccataattttttgcgcgcatattgattttggtttcattaattaattgtttaactgcctcccattgtctctgttcattcgctattatttttttgaattggtcccttgaaatggcctcctcatcatttttattaattaattgataaaatctgcttaaagttaaggcgtaaaataaacctaaaagatatattaatatatttattttccatttcacttacaataattgtccgaatttttgacgctaattctccctaattctttaatttcacaaaaatccaatgggttaaatcctaaaatattatgtcaaatttaattaattattttttttacctgcccctcggggtgtactatatgtagttattatacaggaaatgggctcatgctgtaggtcgaactcactatacgattggttaatcctaaatatttcgtgcaaaacagtgtcggcattgttcattttagggtcccgggccggcaaaatgattgggtcatttagcaactcacaaaacaaatcaatagaaatcctcttaacatcccacccaattctttttttcatcattgcttttttaattaaattttcgattatttttttaaagttttcggagctctcttttcgattttctttttttggatttttaaatataaatcttgtaatattttcttgaatcccgtaatcgggcatacttttttcggttgttgatatttcgatataattattttcatttaattttatttcatcaatagtttttttgaaaaaattttttatatttctttcttttcttttttcaccggggacggccaagaattttttttggacctgggacattttttaagtgaaatatgttttttttaaatataaaataaatattttattggtaaatttgaaataaaattcaatttgtaaaatatttttataagcaattttattttttctcgattaaagtgaaatatttttgcgaaattgcgctttttatagcgaccgcagaacgctcaggtgacaggcggaccgcctggcacgtggttgtttttcatgagtcaattaggcgggaccgcgagtattgttggccttttccacacagtgcgtcgcactgactggccgatgagtcacgtgtttattgcgaaataaggtccggtccccaatttgaatgcaaattttgagccatcaatcacttaagttgacagctgtgccagcaacagctggattttccaaaataattaggtcaaaagaggcgccaaatttgaattttgaatgcaaaagaaagttatttttcgctgtgaactcaaaccgtaaaaattccttccgttatttttcatgttttgtaaatcatttatttattttcattaccgcagaacaatttttattatccgatttaatcgtagataacaacttatgacttccttttggtttcaattttcttttgacaaatatgtcgtttaatcattttgtatttttcgaaagtgacaaataccgaatacctattaatttggaatggttgacaaaattcttttgctttctttgtaaatttatttaacaaatgacaaataaaaagaatcgaaatttaacaaaataaaaaccgattatttttcttgttttctaaaattgttttaagcttaaactctacgttttttttcatttaccttcccaaatgcatttttttcagtttagttattcccccttttcgcgcactttttaattgacttttccactaacgcacgtgatattttgcaactcactcccgcgacccacgtgtccctctcattcaactaaggggatcaatattttatgggtgtaattctgttcatgaaattttctcattccatttggggtgggggggggggcaaaaaataatggaatggaaaacgggggactaaagaattgattagaaaatgtttaatttttcacaataacgaaaagattagtaaatttttatttataatcaattacatgaaaaaagggtggaccaagatatgggtttaggtgggggtatgaagcggggcgtctttatacccttgcatgtatgactggctgtcaataacaccctccccccataggttttcaccattaaatttcacctttgttcttgcatttttcacctcttttcaccacgttttttcacctattttagcaatttt

SEQ ID NO: 5110 - DNA, 1030 bp, Heterodera glycines
  misc_feature (986)..(986): n is a, c, g, or t
  misc_feature (1008)..(1008): n is a, c, g, or t
ttttcaagctattgctcattatttgcacattttaaatgattcatcatccaagcaaagatggactcatttcaaaatataaatggcattcaaacgaagttttaacccattaaaccaattgaaagcgcacattagcaaagtgccgccatttctttcgcctttattaggccaaattcactgggctttgaaaaaaaaagcattttttaattctgttaataaacttatgacttatgatgaaaacaaaaatcaaataaaaacgcatttattggaagcattttcaaaagttcgaatgcatttcgttggaatttgatagaaattaataaatgaattggcctttggtgggaaataataaataatttaattattgacaaagtaattaagacttatttttcgtgcttttttctatcaaaaaaaagctacagaaaaaattaattttaaataaaaatattaaattgtcccacgcttaatttcgttggtatgctaaagaaattttgtccgctgtcattaattcactttattattaaagtgaaaataacacctgctgttccctcaaatgggaatgaatttttatcttttttcgattttttatataaatttttaaaattttcccgacttgggctttctttaacaaagccaaattcgatcgagatcataatatttatcgactaaagactgaggagattctcgagcacattaataggttattgttaatgttttcaatttcattttttcagtgatttaattaattgcttttctctcacgacactttcaattcattttccaaatggcttataacgcatcgactgacgtggtagacagacattaaattttatttcaaaatctcccttttatttggccattgaatatttttgattaattgtttttcagtggttccaatatttcaattcaaatgggccccaatgggtgattcttctggcagcgtatggctttcgagctttgtgggcaacccttggcattatggatcattntggcattgtgtacatcaccccntaaatcaagtgcccctataatt

SEQ ID NO: 5111 - DNA, 2060 bp, Heterodera glycines
  misc_feature (2055)..(2056): n is a, c, g, or t
atcaccctaaaatcaaagtgcccctataattaaaatatttacctaaataaaatcttaaatttttagaagtttgcgcggaagttgcaacattttgatagccatggaaagtgcctttgcactgattttggacctcggctattatgtcagctttttggtggtcatttctggcatcaaatttatccgttacgagtactgtttttggtttcttattgttccatgtctgcttggagacatggcacagatgacgatggtattcaccggggtggaccgactgacatgcgtaatgttccccatttggtatgataatgagcatgcgaaaatcattttaatttaaatatttttaaggcgattaaattgaaatcttattttaaaggtacaaaaagcggaatgccaagtgccatttggcgttcgtttggttcgttttgctttgctatgccacttatgacttcgtcattaattacattgactacctcaacagcaaaaaattgtaatttaatttttcatttttaaattatcgattttcccattttcgcttattctcctgcaccacaaatgaaatgggctacggcggaatgggcactctgatgaaaatcaatgggctgtcattgagcggcacactgatggtactgtattccctgtgctggtttacggtgttcaaattcaacgcgacatcgaaaagtgtttttcaaaaatttgaattaaaaataattatttttaaaattaaaaatcaataatttccgatatgaatgccaacaatcgcaaattgaccaagtctctgatctttatcattgcgctcaatctgttcggcgtgttcctcaaaagcagcgtcaacatgctcttccaaagctttgtcgttgtaaatgtttttgtcaaaacgtccgtttccatcgctttttctttcttcacaattaccgtatacagcgcaaatgcaccagtactgtacattatcaggtgatacggaagcatttttattttttactatattccaaattttatgtaattgttttatgcccttctgattgatttttattttccttcctcacagtaatgagtaccgtaatcgcttccaacaaaatttcccatggcttatcaaagtgaaagggctgggttctgcggtcacatcagtctcagcagtgcaacctcaatgtaccgtagtgagccgaccgtggcaaaacaacaacaataaatacggtactgcgtcctacggtggcactcaaatgtttggcaaattcactaacgctaatattgcgagagttatgtgatgtcatcaggaggagggaatttgacgacagaacgaaggaaaggcactttctttagtcagtgatgcattttaattttaccaccgaattttagctcaaaaattttacaaacgttggtttaattaaaataaaaaacaaaattttgaacaaacgcgtgtcgcgtccgcgtcattttctgtccgcgtcccaactgtgatgtcagaaggaagcggagtgtgaaagaaagtgagataaaggacatgagagaaccaaaacaggcacccgtagctcagtcagttagagcattccacggtgaggaaaggccgtgggttcgagtcccaccgggcgatttatcttttatgttctatacattaaattttgattttaaacctgggttcgtttattgatcatcctcttttccaattagcaaaatatttttgcattttcacatttgtcttctcttttttttgcttggctttgttccacatgtttttgtttttttccatattatttgttcatatttgatatttttattaatgaaaatcggttacttattacttaaattgatgatttgttaaacataaagccaaatctttcaagaatgatagccaataaccagggatgccagatctgaggatttatcctcattttgtggctttttgataggtcaatgaggatttttttttggaaaatgaggatttttgtggcttttggggacggtaggggtcaactccgtcttagtgcataaggggccaactccgtctcagacaaaaaaaaaatatttaaaaatttttttcgacgaaatttttcaaaaaanntata

SEQ ID NO: 5112 - DNA, 2535 bp, Heterodera glycines
  misc_feature (19)..(19): n is a, c, g, or t
  misc_feature (51)..(51): n is a, c, g, or t
  misc_feature (111)..(111): n is a, c, g, or t
  misc_feature (120)..(120): n is a, c, g, or t
ttgctcaatcaaaatacanaaattgatcatttttaaacgtgtttgaataantctgcaaaaatgaggctttttgacacaaaatgaggttttttgcatgccaaatgaggcttntgaaaattntaatctggcagccctgccaataaccaattagaattcggtggaaggggaaaagtgaataattcaataaataaattagtggtaattaaatttgtcttctttttctgcctgtgtatattcttccccgtggtcgccttctgtttgcgcatcggttgcaacttcgcgggcattgccaattcatcaaatcattgtacagctaacgcaaaaaaaattataaagccaacaaaaacagtaacaaatgtttcagacatttattttaaagaaattaaatattttgttaattagtcttaatttgattttcttttttttctcaccgctctcccacaataacccgccctttgtcggtctggacattcggtgcccaaatcttcacaaactcccgggcaaacattgcacgttttcggacagtcgcgaaccatttggtcataggcgaacttaaggggtgaggcgtaagacagttttcaaatataaattgtttaattaagagggcatttatctaaaattgaaaaatattcattaacacaaaataaccttaaaaaatattcattattattttttaaattttcccaaaatcaaataaattccaaaaatgctcacaaaaatattttaggctattacttagggtgtaacataagtttccgcacaatttttttttgacaaattcaaaaattcataactccgtaatttctgcagttattttaataattctttttttattttgttcgtcagaaagtcttctttcatttcatgccattgtttcattttttatttgcttattcaattttttagtattttttcccgaccatgcaaaaattgaaaattggcccactaatttttctcgattttttatggtcaaaaaagtaacctgatataacaaaaaagaaggttttctgtacaaattagaccagtagaatccgaatatggccttaaatctgacctatcttttaaccctgaacttgtactgctccaactccattcggactcagcgtggtcaatttatttagtttaattaaattcggaatttccaaaaccacttaaaacattttgttatttgatggtcttgaaaaatgccgtttttggagaccatttttagactcggccctccaataattcatttttgaagtaataaaattttttttcttataattttttatagtcctaactttgctctatttactaacgttttctctgcctctgtatctcttttcattttctttaaatcagccatcaaaaatacatacctcgaaaatgaccatttttacattatcaactctaactccttaaatacttttctaatgggatttatcccttgcccgataaatagcaaactcattctcaataataatgttagatattgtggttttttaaatttatattcataaaaaaattctttaaaaaaagttgtgcggaaacttatgttacaccctaagtaatagcgcaaaatgagtacagacggtaaattattagaagaaatgatttatttaattatgcaaactgtcaattacacctcaattatgcataagtcagcacgttgtgcacagtctctggccacgtccgcgcaacctcaaatttttagagaaaattatatggccctttctttgtctttgttttcaaaatgcatttaaacaatactcgaatcattggcacttcctcctcctcctccccctgctggtgatggtcccgccggtagtgggcctaaatttttaaattttaattctcttttatcaaacaaaactaactgacaacaatattcgtttccgtcactcattgttcggcaaatttgcgatggatcggacggacaaattccatttcggcatctgtcgacaaaaaaaacactgtttaaattaaaatatgtgataattatttaaaatatccctttattgattttttattttttcaattcactttttctaattgaccaattaatatgtaattcgtctaattatcttaaattattgcgtctcagtttgttttatattcaccttttactacatcgttatttatttccccgttacccgacattttcggcttttcccgaccccaatccaccatttgtcacccttctctccgatcccgactttcttgcccgaaggctcggtagcagcactgtgcttagacagatttttcaccttccattttgggtgccaagtgccacccgcgttggcaccgcgtcgtcacaatacgccgcgcaacagtacgaccgtccgtctcgcgtgtccaactcgcagcccaatgccctcgtgtccgtgcaaattggcggatttccctggcacctttcaaaattaaaattccaattttatttatatttttttctttaccgggaaagccccggctgaccatcacggcaaatgtgttgaggcaaacaaaggaagaagcacaaaaacagaactcccaagaaaagcagtgaaatttgcattt

SEQ ID NO: 5113 - DNA, 4699 bp, Heterodera glycines
  misc_feature (1451)..(1451): n is a, c, g, or t
tttaattttatggtttttttaatagtaaataatataaatgctaataatttccatatggttggcttttgaagtatagttttatacatttatcttgctgcaaaggtttcactttaagcgatgtgtcaaaaaataccattggaattcaacagttataatcaaatcaaagttgatcaaattggatgtgattgtttctatattcgtaaaacaataattggcacggatgatataaaatcttgcactacttatctgaaatgattgaaaattggaaaaataaagttttggcaattgtgtctcaaactggtttaagaatttaaaaggtatcaatgatagtaatgttcaatttcataattaaagttattaagataaacaatgttgacatttagtgtgagatctaggtgtactcctttttatgtattagaatttagcaaatctcaaaaaaagattcgacacaaaccaataaaattaggaaagcttgataccattcgatagctctaggtgttttcgagtatcccgcaaaattacaaaaaatttagccaagtttcaaaaaaagttatggccaaaaatgtttgaaaacccggttccttgtgtaattttggccataactttgctcaaacttgacaattttttgaaattaaggataccttatagtgaactcatagggttatcgaataattccaagaatgtttaatttggttgaccttaaaaaagttataggcagttttatgttgaaaattttaatttaagggttttaaatatatgcccttattgatagtttttatataacgacttcacaccagggatgggccaaattgaaaaataaaaagcgaaatgcgaaatcgtcaaattttgtggtttttgtatcatttttctaatgagaaatagagttttggcgcgccgctgaaaacagtttttcatcaaattaccaaattttgcgattttgtaccattttctaagaaaaaataggagttttgggggcgcggcggtgccgataggcgccgccggggaaaaaaattggaaattttgatcatttataaacaggttttcactgaaaattagccaatttataggtaaaattttgaaaaattttatgggaatttaatccaattcttaggggtgtaaaagtcgcatttcgcgccaaaaagcgaaatgcgaaatgcgaaacgccaaaaaatgcgaataatgcgaaaggcgaaatgcgaaaagcgaaacctaggcacatccctgcttcacacccttttcaaacctctctttgaagtctgactgggttaattgcacattccaatttatgaagggttgaaaatttaataactttagttaatttgaaatattttaatgccttcacatatagaaatttttaagaaaaactattattttttaaagttcatcaaaaattcaaacttttttcattaatcaaattgaaatcctttatttttctctgcttttacatctanaatttatttactagctctttcaattaaatcatttatgactcaaaagcccaataaaaatgctacaaaaaatgccaaaacattagttcgttttagaatcatccaagctaatcatcagctcattgataaattcatatcgaaatatttaaaaaggaaagtaattttaacatgaatataaatgttgagtataaatattaactcaaaaaatctcgccataaaaagttataattttcaaattaaaatcacaaaaataattttaaaaaatattccacgaatatataaaataatttaaaaactaaatatccaaagtaattttaatttattcactatttaaataagagaaactataaatatattattgtctaatgtcagcagaaaattactaataaaggcaacaaataaaaacttcaatttataaatgaaaaataagaaagtaactaaatggtaaatatttatcgaaattaattgagataaaattaatatttaggtaccataagaattgtctaattatgtatttgtaagagtttggtccaattttatatttatttactcaaattaaatatacaaaattaaataatttaaaaacatatatgaaaggttttaataaaaaagatttcaaaaaattataacaatgaattgattgaagaacttatgaataatttaatgaaggaaaattgcgctcaaaaactttactttaatagaaatttaatttaaaaaagaattaaagaatatatagatagtttcgctggttcgacaaatattttcaaataataaataataaatacaaaatcaagaattatctatataatcatatttaatgcattatataaggctaaatattcaggacaagataacgaatataaaatataactctaattttcgagaattgatatgttcaatgaaggccaaagaatgattatcaacaaaattcatgaaaaaggtaaatgttgtaattattgattatatcgatattgcgtaatgttagctcaattctgatgacaagtcaataacaagatcattaatgaaaataatgtaggtaaatgtgacaatattaaattgtgtgaataaaataaaatatatttaataatatttaaatttaaataatatcaaaaaaattaatcaaaaagagggctttttgaattatgtaaaaaaacaatataaaaataaaaacaaaatggatgataaaaaacaaactctaacaaataaattatgtttaacgcaattatatattttaatttgtcatatttaattaaaaataaacaaaaatacaatggataaaaaatataaattagagaaaacaaagaaaagaaaaattaacaaaagagcagcaaattaaactaggtaagggcaatttgattaatataaaatttaattaatatttaactctcatttataaaactaaattcacctaaatttttaataatatcaaggaatacaataatgtaaaaagcatggaataataaaaaaaaggtgaaaacaatgttgttgtttttttgataaaacttaagctgaaatcttataaataattaatgctgcggcaggaaaatgactaaaatcttttaatttgaagaattgtttgaaaaattatttttattaatattataaaaatttactaaacaatataatacaaattattttttaagtaaacataactaaaggattcgatgtagaaaaaaaagaaggaaataaatagataataagaaataattaatattttattttatgaacttttcttacaattaaattaaaagaatgtatcaaaaacttttaaaatcataataaaaattaattaattaaaaacatttcgatcatttaattaaaataaaacaattatttttcttttataaattaatgtaatgagcgcattttaaccattataaagcaaagcgttgaatattggcgatgttgcttgggtaaagaaagcacaaggaaggacgtgaataaaatagatgcaaaaaaggaacctcgcaggtttttaaataaagtaaagataatatgaataagaaaattcatatttgtttaattaatactattattaaattataaaaatttatatgtgaatccgtgatgagacatttgcgccgcgccatttgcgccgctcagcaaagtcaacacttgctccgcgccatttgcgccgcccagcaaaaatggacttttgcgccgcgctgtcaaaactgaaaaaaagaattttctgtagaaaccccaattatttttttgcttcgaaaaaataatgaaattcaattcctttgtaattaattttctcactaagttattttcatcgattttaatttaatttcattgaaaaaacgcactgattttcaaattttcgctcctattttaccatttttcgcattatttcgcaatttttatgcccttatttatttagatatttttttcgcttaaaatccgccgcttaatgatcaggcaatacgaaggcttttatcgcatatggtcccaatgaaaaccaaaatgatcaagatttgataatcattacgtgcacttcaatatggaattgacatgaaaggcttcgaaaaaggaattaataatgaatatctatcaattcttattctataaagcacataaatttattttaatcagagcgcaaatgtcttttttgctgagcggcgcaagtgactatttctgggttagttaaacagtctaaaaacaaaaaataataattttttttaaattgagtaaccaaattatttgtataaaattttatgtaagtctaaaaaggaaaatgaaaaatatggaataatatattttctcggttcacagcaaaaatacttctcacacagccaagcccgtagccagaaaaaattttcgggggggggggggggagagaatctgaaagtggtgccgacatttggggatttgcaacttggggaccatacattttgggatcctgacttttggggattccaacatttgttaataaaataaaaaattacaaaaaatcgcgaaataggcatcaaataagcactaaaataggcaaaaaaaaatttttattaaagctttttaggtagaaaaacacgtaaaaattaatcaaaaaacttattttgcccatatttcaattgttttaagttgttttcgataaaaataattttttaaaccaaaaatttttaacaaagaaaaaatagttgaattttgaggatcaatttttgtgaaatttttttttcaattcttaagggtgtatttttcatttttattacatttttgttatggatttttccagaaaattctgaaaaaag

SEQ ID NO: 5114 - DNA, 4136 bp, Heterodera glycines
  misc_feature (4109)..(4109): n is a, c, g, or t
  misc_feature (4124)..(4125): n is a, c, g, or t
aaaatttttttaagttggcatgaaagtgtagagggaaaacccaactgcgggcaaaattgtttatgtttagtacaataaaatggattttaacccttttgatagctcaaggaggagcttttttggcaatcggccattttttgactgttgtactgcttgaatttgttgttgttttaatttttcgattacgtaaatccattgctaaaaataattaaaaaataaatcaattgtattgatgcctgaaataaaagcccagacccaaaacgacgccacgcaaatgatcactggtcagagtgtggcttacaaaggaaggtctggaggtgtccgtggagtttcggaattgtttaaatcaagatttatctattaataaaaattttattttctttatttataaatatttgacacatttaaatgtaattgtcgaataattgactgatttaattaaaagataaaacaaaagaaaattcgtgattgcaaaaaaaaagtcaacttaaattaaacatgcatattcaaagaaaaacaataaaattattttaattttagttttttccgtgatgagacatttgcgccgcgccatttgcgccgcacagcaaaagtagacacttgcgacgctcagcaaagtcgacacttgcgccgcgccatttgcgccgcagacagttgcgccgcggatatttgcgccgctccatttgcgccgcgacatttgcgccgccctgcaaaaatggacttttgcgccgcgctgtcaaaaatattgtattcataaaaattccactattatcaataagttttactaaaactataagccattgacaaaaataactaattgaaaattcgaaaaaattcaattcctttgtaattaattttatcaataagttattttcatcgattttaatttaatttcattgaaaaaacgcactgattttcaaattttcgctcctattttaccatttttcgcattatttcgcaatttttatgcccttatttatttactatttttcgcttaaaatccgccgcttaatgatcatgcaatacgaaggcttgttatcgcatatggtcccaatgaaaaccaaaatgatcaagatatgatcaatcattatgtgcacttcaatatggaattgacatgaaaggcttcgaaaaaggaattaataatgaatatctatcaattcttattctataaagcacataaatttattttaatcagagcgcaaatgtcttttttcgctgtacggcgcaaatgtcgcggcgcaaatgtcgtttttgttaggcggcgcaaatggcgcggcgcaaatgtctgcggcgcaaaagtcggctaaccatgtgaatcaaacacaaaagatcattagtattttgctactgtaaatagaaaattgaacatgggtaaaaacaggtatcaagaaagaaaaaatattatttctgaatttctttaaaggttaagttcatcaatattatagttttaaaaattaaacgaatttttatataacacatagaatttaagaatattatttaatgtaaaaataaagattggcataaagtaatccttaatgctagatttgaacactcgttttactcctggaccaataacgaaaaccccgtgatttccgtgatccgtgattataaaaaattatctaaataatttttttatttaaatttattaccaaaaaaacgaaattaatcgctgggaaaatacccaaaagatattttaaagaaaccaaaacatataaaccgcttttttttggcgtgcctttttcaaaaaatttttcgaacacttggggcaggtgatgccaatgggcgccgaatttaattttaaattttaatttttaaactaagaatatcatttaatactttttctaattttttgtgtgaatgcactttgttgatttattgctgaaattaaaattggttctttccaattctgtagtacaaatgatagcaaatgtttttaataggcatattatttaaaatggcagattttattttgatatattaaaataatttattgtatttttataattttttatatatattttggtgaaataaagtatttgaaatttttacaataatgactaaataatttataaaatctgcatgacaatcgttatatatagatcataagatattattgatatttaataaaactttaattaaatcaatttattaaaatatatgtaataatttaatttaattttatattattgtttgtcggaatgtttatttttcttgttaactttcattacttttacaatcgattcccatatcactcatttaaaaacgaaaaagatagatggaatctcaggattattaataattataatagataattttgtgttttcttatcgttattaaaattttaaattatattttttcactaatataataattaatatatatataattcaattttaaattctaactgtaagttaagtgatgcttttgcattaagttgccagtattagtaattaattgtatcttcattattaaatttgcctgaattccttaaaggtttttaatattttaaagcagattattttccctattaacaagtaataatgcgtaagatattgaatgatatttaatagaaaatacttaaatttaaaattttcaactttatttttttaatgtttatttatattttctttggtttcataacatttttccacgaaactccaatcgtaataaagcattagctaatttcgttatcgatttaatagttgttttattatattatgattattaaacaatttttacatcaaatttttgaaatttaataagatttttaacgtttatggtcactattaactctaattttcaaacttttgaaatactgaataaatatttttattatatttcttttaaatgttttaaaaacggttgcgttcacagttaacggcacattgaaagaatgcatcaccattcttcaaaatttattaattctaaaaacagttttcagctgcttacacgttttgttattttttaaaataattattttgatattttcaatactccaatgggtctttctaatatcaaattgcattatactgggattaaatcttccataaaaattatgtacattttaaatttgtatcatttatcaatatttatatttttaatgttctaagttatattcttttaattttcaaaaattgtttaaagtttttaattattcaatttgtgcgagtataaacatatttcgacttataaacttatctgctgaataattattttttgctggttacatcaacacaaaaagtgtcatccatccatttagaaagattgtaaactccgtttacgtgccacacccaggcgaacatagctttgtttttaaaatcattaatttttattatttcttaattaatattctattgtcatttttcaaaaactgtttttaattaatcattgacaccataaaatttgatattgtttaaaaaaccaaattcgttatgttatattcattagtaaattgaatgaacaatgtttcaatatcctacttcaaaaattattaacaaaaaataattgcataaaatatgatatgttttacaaattttttaaaagcgaataaataaattaaaatttcaaaataataagattattgtttaatttttattgcttttattatttttaatgctttttaattgtaatcaaaataaacgcacgtttcttttgtcattcttttctaattttttttttatttgttataattgttttcctgttcgtattctatgcgttttatttttttgacttacatattttattaattattaagtgatttattctttcatataattattagaagcacatatattttggttcgtttttaaatttaaaaatcattttaagaaatatttccatttttagttctttattatcttatgctattcaatagaattcgttttaatttttaattggttagttttactctaattaaattgttatgcaaaatagctcttgcataaaatttttccactttgatatttcctgacaacagttattacactgtgatataaccatatattggttaaataatttatgtatcataataagactttatcctttttcattaatagagatcattaaattttttgatgtattaggttcgtgttatcgaaagcctagtcaantgttatcaataaaanntattttgcgaa

SEQ ID NO: 5115 - DNA, 5784 bp, Heterodera glycines
aaagaaatttcccaaggaaatttatttaaattttaaaatattatttgtttttcgcaaattttttttttttaaattaaccggatttgttaatacaataatcaatcaataaactaccgtttcttctccgccagcgctgtgcgcattgcggcaattgcggtgtgcagacgctccgccgtcgcactctctgccccaatgcgttctgtccaattggcgttgcgcattgaattcagcactgtttgaagattctgtaaaaaacgggaaaaatggataggacatacatatattgtatattgtacggtatgaaaaaaaaagagaaacggcttgaaaatttatgactttcctgctgttttttaattcgctaaatgaaaaaagagggaggagggagattggattgtctccagcattgccaattgaaaaaaaaatcatgcgattttccaaaaatatttatggtgaattactgtttttccaaaaaaaaaaaaaaaaaaatttccagggttttttttaatataaatttaggaatacaaaataaaaaaacaatttgccgaacattgtgctgcttccgcagttgaaccaattcgcgttcatccgagtccaacatggtcagctcaacgcgtaccaattcgcccttctgcgctgtcagcgcttttctataaaaacggtgtgaaaaatggcaaataaagaaaaaaattttttttttatagaaaatagaatttttaatttttttaaatattttttttttgatggaattgaaaaaaaaactcaacgctcgaagaaaacgatttttatcaaaaaacaacaacttattttttgaataaaaatcatgattttgccatgaactaatacgcccaattttacggttctatcaattttttgtcctccccaattgctaaattgccctcattcatttactcactcttgaatttcgaccaacgcctccaagtcgggacgggaaaaggtgcgcgcgtacagctcgtccagtgagaagttgggaatgttgaggaaagtgagtggtgggcacggcagccgttttttgccattgtttgaggacggaggtgcgcaaattgtggcaccaccggtgccggtgccacggcgaagggaattgcaccgttcggccatcacttcgttgtaatctgagcaacacaacgaacaaatattatttgaaaagccattagttacgggtgcacacacgtttcgccatcccccgtatctttctccgttcgacaaaattttcgaaaatgtttaagaaaaatgaaaaaaaatccagattttttttttgaaaaaaattctgagtttaaaccattacatagagcagatagatttatttacctatttactaataatgaaagcgagtctcccctccccttccgaaattaaaaaaaaaaatcaacgtaaagaaagaagaattttttaatttttttttgggaccctggccaaccgaattaggtacatatgactcgaatttaagtcccgcattatgatgcgtttgttcgttggtcacctggcggtggtggacggtgctgaacattgtggtggtgaaactgttgcggattgtgaggctgttgtttttggtggcaattgaagaattcgttcagcgcttaattggaaggacacaattataggggtgcactacgtttccctgcaacccccgcccctgccgaaaatttaaaaaaaaatatttttttcaacttcgaaattaaaaaaatatatatttcaattacgaaatatttcaagaaaaaattgaaacgttgaaatttttttaatgttttttatccttgaaaaaaatttccaaagtgcgagcctctgcccaattacagaattatgattttgaattaatttggtatgccgatgaaaattttaggaattctcaaaaaaaaaagtggttgttttagaaataaccaaagatccatgtccttagcgaaactctaacggttttgaaaaaaaaatttttttgtttgtttgaaatttttccaccgggccacccttccaaaaaatttttttgtccaattacttgttgtggatgaattgacggacgggtttgatgtggccagctccacgtcaccctcatattcgagtgacggagccctctcttcccggactccatcaagtcggagcagttcaaacgctacattagcggtcccatgctataaaaatcagagaattttgctggaaaattccaaaatattaagagaaaaaggagttataaatcggatattttagacaaatttctaattttatgtcaaaaaattttcaattccggtgtttttcgaaattttcgcccgcaaaaaaggaaaatttttcgagtgattacccaccattttttgcacaaattcatagggccgctcgtcgggcatgaagcgatgctcacgatcctggacagaaaaaagtggcaattattttattttaaaatgtttttagcacttaaatttacccatagaaataaaaacacagcccttccccgtaaattagagccacccccctccaaataatgcctaccttctgaaggggggggggagggggttgaaaaataattcccactttggggctctattttagggaaaacggtatgtaaaatcatattccggcctgattctcaaaattcctggctatacaaaataccccctgtaggctatgtcaaaaagagggatgagtcatcaatccaatcaatgaattgccaaaaaaaaacaattttttttttacaagcgaagtgccatcgctgtccgttgtcctggccaccaacgcgaagctgcctttttgtcgaatggcatgggcaagagcaaaaacaatttggcaacagctgaaaagcgagtttacacaaacaaagatgagggtacacagaatgggggggggagcaaatatttgccaattaaaaattgattacgtcgtgttttcggtgacaccggaaacgcattggacactgccgcccggcgtatgcacaattaaatccattaattttggccctttttttggaaaagaagggcaaggaaaagaaaattgccgcaagaaagacgcttatatttttgaatttagttcaaaacaaaacgccaaatcgtaaggtaaaatgtcaaaatggcaccaatttgaaataaaatgcaatgagaaaacttttttctgtggtttttgtcttgaaaatccagtgttaaggttggatatgtaggtatacataaaagaaaatcatatctagctggaagcgaggtccaggcttttcccaaaatattgaactctaagatttaaacgcatatttttctgtccaaattggatgccaaaaacacggagagcaatttaatgattttaattttaccatgatttaagattttgtagttcttgttgtttattttcttggtaatatggctgttggaaagcaggtaaaattgttgtaaattgattctgtttacacatttaaaatggacatattttgcagaaaaaatccgcggagaatatcaatgccaggttgggcatggtaaccaagtcgggcaaatactgcctgggctacaaacaatcgctgaaaacgcttcgttcgggcaaggcaaagctggtgatcatctccagcaacacgccatctctcaggttttgattgccaatgccatgtggttggaattcgtaaactggtttccatttttgttaattttgcatcgcgaggaacatggcaccaaataaaaaatggcactctttgaatttaattaaaaactaacagggagaatgaccatgttggtttttaaatttctttttttgtggtaaaagtgaaaactcggaaaagtagtcaaaaactcaattttttctaattccgacctttttttttactttttttttacctttaagcacttaagatcaccaatatttttccaaattcgggccgggctaagagtttcgaattggccgaatcaaagcaatatcccaataatgagcgatgactttctcttaaacgcttgcaattcttcacagacaccacttttagaaatgaaaaattagcgtaattcttaccatgccccaactatacgggttttttacggacccgtaacccgatacgagttttacgtaatacggattttttaacccgaaacccttacccgttatccgaatacattcaaaaagatactacaaaattggaaaagtgccgaaattctccaaatttatttagtccatcccccgaaaaaattgctattttgatgagtttcgccccttcccatttagacgcagtgaaattgagtactacgcgatgttgtcaaagacgggcgtgcacgagtaccatggcaacaacatcgagctgggcaccgcgtgtggcaaactgttccgcgtttccatgctgtccatcactgacccgggcgactctgacatcattcgcagtatgccgacggaggcatgagcaatcaaatgaaatgaacggatggacgtgatcagtgatcattcattcattgatcggatcatttgtcatcctttttttcaaatattttgttgttgtttcacccggaagtgtttcatgttttcggtgaaacgaaagacattctcgttgttaagaggcggttggtttttcaacacatgtgttttgtttcttttcaattctctgatttcattgactctgtttagagcatggaattttttaaaagttaggggatcagtggattcgggattgaaatcccggtgttgctgggatttgaattcagccccgtgttgaaatcatgattttttcgggatcccggcactttttaaaaaaaaaaaaaaactggtctggttatattgacctcgtcctggctcgctctaactgtttttatgcgagactaatgggtgacgaatttaacgcttgaatgtaaatagataattgcattaatattttttcattcgataggtcggccgaacgcattttaaattacctaattagagaaaaccaattaatttcattccgagatttacaggatttggtacataaataaattttaaaaaataaaatttgcttgcccatacattttttatttcactatttttacaataaagcacttttatgggtgggttatacatatatcagggatacgtgcggatgccctcaaaaaatttcggaaatcggaattccgacacatccctggtataatgtaataatcatcggtgatcagatcaggaaactccgttcattgatgatcagcgtttcgccctgtgaacaggctcggccccggctcctcgacctttcatccatcagttcagcattggcattgttgtccttcaaacaacaatttttcatttatcccaatgaacagaaaattttaaaaagagaaaaaataaaatgttttaataattttcgtgtttttccaattttttgaaaatttgggtgggatcccttggaggtgtaccaataaggaaaattgaaaatttttagcacaaatccatgggtttttggggtcactgatcacgaatccggtatccatttcgataaattccgaaccccggccccgaattcgaacaaagagtcgaaaattcaaaatttccgaatttcagatttttggcacgaatccggtatccatttcgataaattccgaaccccggccccgaattcgaacaaagagtcgaaaattcaaaatttccgaatttcagattacattcaaaaagatactacaaaattggaaaagtgccgaaattctccaaatttatttagtccatcccccgaaaaaattgctattttgatgagtttcgccccttcccatttagacgcagtgaaattgagtactatgcgatgttgtcaaagacgggcgtgcacgagtaccatggcaacaacatcgagctgggcaccgcgtgggcaaa

SEQ ID NO: 5116 - DNA, 1806 bp, Heterodera glycines
tttgaaaacaaataaaaattttgaaaaaggggggggggggataaactttactattaccgggttaccccccattcacggcaccaatctcttaccgattgatgacggccattgttgtccgccaccattgtgccataatttggcgattttcgtccaccacccttttcaaacagttcagcaaaaacaaatttgccaatcacttttggccttttctcctccccctcctcctcaattgtgccattttgatgaacacttttgctgctgcttcggcttctgcttttcccctccaaaataggccaaaatgttgcgcatctttcgcaacctccgccggcataaaaattggcgccgatttttccgtcatccgattgagtgcatttgtccaatttgcacatattattgttggccttgatattgttgctgatcatcattggcccaattttggctctctgatcagtttcattattttcgtcataaaataattcatcctctttgtcagtgatttgatcaattggaccgtaaatgatgcgatcaaaattgaaggcagcaccatctgctgaatggaggaggggtgataaatgattgagtgatcagagtcacgaatggcacaatagaaagtgctctatcaatgcttaattcaaaaattggtcaatgaaaattacaagattgatcagtgtgttggtggtaagagtgattgatcactgctaaaggaatttgattaatgctaattgtcagttcttctcaaaaaatgatcaattctaatggaaaacttgcttgatcattgcttattccaaaattgatcaatataaataagaagattgatcaatgtgctaatgtcaagaatgatcatctaatataaaaaaaagatcattgctaatgtctagagttgagaatactaataaaattttcttgggaaaacaatgccggcacttttttggctgctgctggtcgacgacttggagcaggatgaggaagagccgtagaaggcacacaaaggcggcggcgctggtggtgtcagtaaagggcacgacaaaatgttgcgttttggaagcagtccagccgaagatggcaacaaaaagtgatcagaagtggctgatgcgcaggaaaagcgtgccgtcggcaatggccaaatcactttggacggttcagcgggtgccgttgtgccggtgatcagcagagaggggcgtcccttggcggtggcaccgccgccgccgatcggcaaaaggttggagaagacgagctatggaaaatgtcgatttttgataatggattgattagaattatatataaaaaacggaacggatgttagtccctgactgatctgacaggaaatgaaaagccttaagtacccaaaggacattagagattaaattaaattgatcggtttcggggatagttctaaattccgtagatattttggccgaattgagtttttaattaattaaagcatttcattaaatgttttgaataatttttaataaaaacttatactgtatcatttaaaaagttggttttattttctatacatccttaggtataaattgctatatattttgacgcactttaaagtttttcaaatggagaaattaaaaaaaaatgtaggccccgaagattttttggtcctcctaaattccgtgtcccggacttttttttttgagccttcaggcaccatctcttttctgttaaatcagtaaatattgattgtccagatcgatcgtgccggctccctaattgagatcactgatcaaaccgatcagatttagggcccaagaattataattgctgattgaacagacacagtctaactgcagt

SEQ ID NO: 5117 - DNA, 1051 bp, Heterodera glycines
ctattaccttagttttgtttgcattttcttcttaaaagtacgtacttaagtagttactgtccataactacttatctaactactagaggtgtgccgttacttaaaaaacccttgaatcgtgatcgtgaaatgtccagttaatcttgaccgtgaatcaaaaagcccgagaaattcacggttttggtgaccgtgaatttttgagtttaatttttctctggcgtcgacccttttttttgcttaatacaccgtcttttaataatttttgacaatatgaaatggaaaatgtgactggcccttggggcccagatggcggggcccagttaatccggggcccagtcgacccccaccgctcattaatagtctttagaggtcgaatgaattactaaatttttccaaaaaaaaacgctgaaaatttttcaaatgctaaagttccttttccatcataccattccgcctttaattctcatttttcgttcacatttttagaaactgaaggcgatttttcatggcccgattatttgcggcagtgccaagcgattccggcgcccaatgcgctttttgtaagcatattttttaaatttacacttacgctttgaatttctttcatctttttcattgccaggacccacttccttcggcggcaaaacttcagtattttaaggtacactttttcatagtaaaataaatggggtattttgccaaatttgtctgtattttaacattttttgctatactgaattttcaggtcggtgccaaattggaggccaccgaccaatgcgagcccaacttggtctgtccggccaccatttgtgcgatccgcggtcgtctgctgcaagtgcactttgacggatgggagagcgaaatggaccagctgttcgactacaggtggccgggggaacggatgatggggacacgaaaaaattcggaaattttttaggtctcgtgaactgttcccgattggctggtgtgagatgtacgggtacaagcgagttgtgctgtatttaacaaatctatgtttttcctggctacattttcaccttactctctcccat

SEQ ID NO: 5118 - DNA, 4130 bp, Heterodera glycines
aaagatgagaccatcggcgagtgatgatttacggaataaaacaaaattaaattatgcctcattttgccttcgccatggaaaaagaacttttgctggtattttattccgtccaatactttcccatttttcactccttttggcatttttcattgtttgctgtattccgatgcttaaattatgtcatttttgttttacaaattattctttttacttttattcgcagaaattagaagaattccacttcctatgattcttaacccttgatttttgttgtcattttccattaaatgcgctccttttggtaggaattcgaatggcgtcgaactgtccattaattttggcacttgatgttggcacgacgaatttgaaggtgggtggaattcaaatttatccactttccgtttaaccatgggttcgaaatttctgcaaaaatgcggcgattgtaaattttgtccagcgaggccattttaaaatgtcataattttgccaatttgggaccggaaaaggaaaattaattgaccgatggattattacgttgcaaaatcgcctccttttttgcgtagtaaagtgctgtttactgtttagctgtgcgttttcgacgtctccccctccgcgggctgtgcactgatccatggccacgaggagagcatcaaattgttgtgctcgtcggacagcgacaaccgaatggagatggagccggaacagctgtggacacaaattgtggacgcaatacgaagggcaggtagcagcgccagagagcaaacggatttgtagccgttttcaccaaaaagaacgcatttcccttttttttttgattttagtcgctgaaacgaagtcgagaggatctttggtcggcattgggctgagctgtcagcggaacacattcctttcgtggaacaagtaaaaacagaaactgaaaacaatagattttaaagaaagaccaacttggttaattactctttttgattaggcaacttttccgtccgtgccatcggcttgtcacgtggaaggacgggcgctccaggcatttctgcaaccaatggaacgagtcgatgcgaagaaaagtgagaaaacttgcctaaattaaaaaaaatatgctttggttgttgcggcaaagagactattatttcgaaatgccaacgccacccatgcccacttttggcactttcagctgctcaacttggctggcgccgtcgccttctttttcacgcgtgcccaacgctttcgtgcggcgcggatgtttttgctggacacagcgatggtgccgccccgcttcatggccatgcttgaacaggtgccaatgccattgccaatcgtcgactaatttttttctgaaaaagatatttcggtcttttgattacaattaaaacaatttaactgaaaaaatgtttatctctctctatccattatttatatcgcatttaaaccatttaattatcctctctttcttcagaaaacttaaaaatacttccgatttttttctgaaactttttaaaattacatttaatatttcaattgacccataaaacacctttaactctcaaatttaagaatgccgaaatgcgtcgtctattggaagccgaccagcttgcgcttggttgtctggacacatggcttatgatgaagctcagcggctgtgatgatcaaagctttgtcaccgaaccttccagtgcttcttccaccggaatgttcgacccgttcacggtgattgctcattcattttcccagtgtagttaatcattgtccatgcatttaactctaattatacattaattgattttgttctgcattaattaggccgagtggggccgtcccattttgcgtctgctcggcttccccgacccgggcgcggtgctcccgtcgctggtcgacacgacgcggctcggcgtgcacacggcgcccgagctgttcggccgcgcaattccaatttttgcatcggtaaaaaacgacggatatttttttaaattaattttattagtcctatcccacagtcaaaaacaataaaattgaattaattagtgtacaatatttttttttagctcggcgattcccaagcggccgcgttcggtgccggatgcattcgccgcgggacctgaaaatctcactgggcaccggcactctgttcgactacgtgagcgggcccgaaattcacagttcaatgcatggtcggtcgggaattggtattgaagaatgttgttgttttactcttcgaaatgggaaaaaaatttttgaggcgtcccagatttaggacaataaattttactaattgtggcgactgtcagtgtacgatccaagtgctatcgggtgaatggcattttttaattctaaataaatttttttagaaatcttcaccaatttccacaaaatacagcgataatttgccaattggcattcccccgcactttacgttgatcgattataaatgaatttcacttaaaaattaaaatattttttatctaacctctaaaaaaatttttccaggaatatatcctttggtggcatggcgtttaaatggcatttccactcatttacttgaggtggatcgaaattgcatttcctttttaattttataatttcaattttccacaattctcaaagggccgttccaatgacgtggcgtccgcagtccgttgggcccaatccgtgggattgattgcacaaaatttggaggcattgcagtccgacgacgagccggagtttgacaatgccgacggagacgaaggtggacatgacgacagtgccgtttgttttgtgcccgcttttggcggcatccaaacgcccatcggtgacgattttgcgtgtgccgcactgatggggtgagtggcaccacgtagggcaccacaatgagcgcattttttgtcaggattcgttccgataccacgcggcgtcagattgcacgtgccgtgttcgactcggtcgcctttggcgtctaccaaatttggcagtgccttgtcgaggaagtgccggaggcccgcgccggcgtgtgccgaattcggtgcgcatttgcgggagggagggacaaacgacttgggggaggggaatccaaatcggtgcagaatgaaatctctaactaaaacgccgcgggaaaaaatgccaaacattttccaattagcttacttttagcatttcccattgcttctaacgctgtctgtctgttttcgtttttttgcttccatttttcaattttctcctctcttttagcctctgcggcggtgtgtcgcgcaattcgcgcatttgcgaacacatcgccacgctcattcgtcgtccggtggagcgcgtgtgtgagccccagttttgctctgcgcgtggtgccgcactgttggccggcatcggcgccggtgcgtttcccttgaagattcagtctccatttgactaatgcgttgcgcaccctctgccatttttgacgatttcccaaaattcccatgaaatattttcgagtcggaattctcgacagtcgccaatgtgtccatctcccattttcaaggactgtggacacttgaccaagtggacagcaccgtcggcaacggtagtggcggtggcaaaagtttggtcggcgttaagcgcgtgttcgctccgcggaagggcgctgccgcttcggcacttcgccgtcgattcaaccggtggagggatgcgcagcggcggtgtcttcattattatgaacggaaatgatggaaaggacgacgaaatgccaatggaatttttatgatatttttgattttatatgtaggccattcattttcatcactcaatcaatcttttgcctttcatcaatcattcgaaaatcttgccttaattgttttgtgatatttctgtttcaatttataaattctcaattagaattagatcaaagaaaacttttccatattaaaactttgatatgacgggggactgggtaaatcgtacgctttactggtcccacaaaaaaaaaggtgaaaagaggaatttcagcttttaagtagtgcacccgggggttttcagggggcgctgatcacgaatataacatccatttcgaatcccgaacccgaattctaacaaaagccgaaaattaatttttcaccaaaattcacatgtattttccaaaatcgattcaaatgcaccaaatgaccatgaatccttattttctattatat

SEQ ID NO: 5119 - DNA, 1633 bp, Heterodera glycines
ttttaacccctttaaaaattaacccattttgcatatcaaaaagaaattttttggaatatgaaaaaaaaagtatttgaattttccctggatcaggaaggaaattcgctctatatgagaaaaataggcgattaaaccataaagcattgaataactcttcagcaaatgcttggatctgctccgaacaaaagagcacagatgttttttaaggattctctatcgattggtgaaaagtatttttttaaaggtctgaatgaaaaaaagtttcttcagaaattttttgaaaatttttgtccaaaatttttgcacgcctcactaaaaccatcataactattcttaaaatggacggaattgaaaaaagaagggtcgatacatgtacctgagagtgttttctttccaaccgtgtataaatgtttagggttagggtttgggaaataccctaaaaagggatctaattgacaattggttttctgcctttttcagccctgcttttcagaatccggctcagggggatacgcagggaatcagggtgggttttgagtgggatagtaaaatctggcacgttaggaaatattgtttatatatgtagagatcacctacgtgcaaattagcatggggtagaatgccggactcaagattggatcttggcatttttttaaaagcctgaatttaagctaattaaattttttgcgaaatcggtaaaaatggcacatttgggatgctgggctatatatataaagaccacctacgtgcgaatgggcatgatttataatgccaaactcaagatctgtactttgcatttaacactgaatttaaccaacttcttatacaactttcagtacaactttctacacaactttcaaaaaactttcaaccaatttctcaactttataaacaactttcagtcaactttgcatacaactttcagcacaacttttaaaatttaacaaaagcggccgagcgagtaccttaaggttatttatcctattatatgacaaatctgtgtcatgctggccccggtgttgaaagcggccccggcgctttcacagggccccttgtggccctggttcaaaagttggataatatcggaattaagggaaaactgcttaattggttatctgagtttttaaaggaaagaacttatacggtaaaaattaataacaaatattcaaaatcttatccgattaagtctggtgttccacagggatcagttttaggcccactgttgtttctaatctatataaatgatcttccgaaggttattccttcggaaataaaagttaagctttttgcagatgatgtgaaactatatgtttcatacaaaaaaagaaatgagcgcattaagctaaacacagctttacaaaacattgaatattggaccagtttaaatggtttaaaaatctcacccgataaaacatttattatatttttcggcaaaaacaactctaaacaacaatacaaattatgcaacaaattatcaatgatgttgaatcgattaatgatttgggtattttaattgataataagctaaagttttctgatcactatctcaaaattacggtactcatggagtttgtatccccctttttttgggtcgaattttttcaaatttttttttttcttttttattgtcgca

SEQ ID NO: 5120 - DNA, 1926 bp, Heterodera glycines
ggagggggccgaaggccccctacgaggccgcgaagcggccgagcgagtaccttaagcgcggggaaaagccaatggccccggctggccccggtgttgaaagcggccccggcgctttcacagggccccttggggccctggttccctatataagaataatataccccagtttcaagcttaaaaactaatttaagactttctaccgagtgttacgggtcgggaatggtatcattcgatagggttttggactggctataaggaaaaactatcggcatcccaatcggttaagaattgttcgaactgtgttcgaaaaacgagtcaaaatttgcactttttttgggtgtcccatttttgaacgctttttgcatacctaaaaagggtcaaatcaaaaatcgaaacaatttcgcatgatctacaaactcttggctttcgaatgataccagggttgtttgggtccgggtccgggaagtgccctaaaaagggatttcaagcacttttggtcgggattttttccaaaaaagaaggaaaaggaaaagggaattaaaagggatggagacaagcgacccagtggttaagtggttagtgtacctgcctttggtcacgaggtgttgtgggttcgagtcccattaatttattggattttcccgtcaaatattatatttaaattatttggtttaaaatttgtttttaatatttttcttataaaaaatttatgagtgagttaaaagagaaagaaaggcataataaaaaatatggagcaaagcacttttggataaaaaatgatttcattcctttttttatatgtaatgcacactcgccagtggtctttaacctcgccttttcaataagcaaaaaatgtctcctccttttctttccccagttcattatcaattgtttccgtttacattttcagttttttactgctcctacttttattcaataaatatttccaactaaattattgctgttttaatagcataaatttttagtttttgcctttggtggtggtggtcgacggctcgggtcccacctattctgggtgttttcatccataattttattaaattttttgaatgattttatttttttaaattaattaagtttattaaaaataatttattttaaatattaaaaataataattctttctttctaatttagcccaaaaatctattgtttgaccttttttgtgcaaaatcatttaaaaaatggagacaaattaataagttacctaaacataaaattattgggcaaaactgggtccggatatttccgggtccagcaaagccgggtccgggtccaagtttttaaaccgggtacgggaggaacagaaagtggaagaggaacagaaagtggaagagaaagtggaagaggaacagaaagtggaagagaaagtggaagaggaacagaaagtggaagaggaacagaaagtggatgaggaacagaaagtggaagagaaagtgtaagaggaagtggaagagaaagtggaagaggaacagaaagaggaagagaagaagaggaacagaaagtggaagagaaagtggaagaggaacagaaagtggaagaggagcagaaagtggaagaggaacagaaagtggaagaggaacagaaagcggaagagaaagtggaagaggaacataaagcggaagagaagaagaggaacagaaagtggaagagaaacagaaagtggaagagaaacagaaagtggaagaggaacagaaagcggaagagaaagtggaagaggaaaagaaaatggaagagaaagtgtaagaggaacagatagcggaagagaaagtggaagaggaacagaaaatggaagagaaagtgtaagaggaccagaaagtggaagagaaagtgtaagaggaacagaaagtgggagaggaacagaaagtgtaagagaacagaaagtggaagaggaacagaaagcgga

SEQ ID NO: 5121 - DNA, 1303 bp, Heterodera glycines
atttttgggtatgttagccttagcgctgtttggcccctttccgtcatcagaggtcggacggaggatgacgatagataaaatgtgaatgggaaaaatgcatttatttgtccactgttgtgagacgacgccggcggggagaaagggcgaagaattaaagaaaagcaaaaacggagacagatcgatttggcttggattttccatcggaaaattcaaaattttttcagcaaaaaatgtctgtaaaatgaaaaaaattttgtttaaaattttaatattacataccaagacataattcattgttgagtttttaagaaataatgataatagatttttttttagaattttagacaccaaaagaataaaaactccctcccatttacacacattttgtttcacaaaaaaattaatttttcattgttttatatataaaaaaaaacagttggtgtctaacaaataaaatgctaattagaattaatcaaattagtgtcaaaataatttttaacccaaattgaagtaggaagcattaattattttgtgacgaattttaagcaattttttttttttaacttaatgtgaaccaagaaataatttcaggtattttcatgggcaccaggcgatgctgccgagaaattttttgaaaaaatattactgaattcacagtaattaatagaagagagtttcacaaaattttttgctaaaaagtttccaatttttcattttttttttacactaaaataaataagtacaaaaaatgaaacgaattaaatttaattaattaatcaaaataattacaacataaatatttatttttcaattaacgcaaaatcagtgttaaaatgttgtgcattgattattattttggtattggtcactcattcattcattaatcgttggactttagtcgggcggtggttgagcgacttgacgacgttttgtgtgggcaaacaaaacatgacccgacagcagcacaacacaacgggcaaataatatatgagaaggaacaaaatggtggtggaaaatgtgcaaataaaccaaataataaggttattatttagaatggattatgacataaaataatttgaaaataatgcaaaattcccccaattttaaatgaattaattattcataaaattcattgaaatgacaaaattggagttgcgtcttaaagtagtattaaaaagatacaaaaattaattttgaattatttggaggggattattggctaaaataattcgaaaataatcaaaattcatccaattttaaatgaattatttgtgtaaatttcattgaaatccaaaattggagc

SEQ ID NO: 5122 - DNA, 4936 bp, Heterodera glycines
caaaatattacattttaatttttaaatttctacctcaattcgactttggttgtttatgcgaaaatcaaatcaaaataagcattttctatggaaaatctattactaaatgtgccaaaatttcttaatcttcgaccgacgaaaagtgcaaaaatcaaacacttgctttatgtaattgatttttaatctaattaatagatattaaagccaagaaatatttagagcaatcaaaaagttaattagtaaatttttttgctaatttttaaatggaacaaaaataagaaaatattttatggaattgatttttcatgaaactttaactgaaaacatttatttatttattattgacaatgggcaaattgtatcgacattttttgtagcgtttttttggatttttaatatttcatttaattaaagagtataatttataaaataaaacattagtaatatataaataattaagtagaagtgtgaagaaaatcattataaaaaaacaagtagaattttctgatgtgagtgaagccaagtaataaataataatcagcataaatatgggaataaaaatgaatccgtaaaagtatttgtattagattttaatggttttattcagaaatataaaaattaatatattattttcaattttaattttcataaatgcaatttttaatatttattctggaaagataaacgaagaaaaaagttttgatgaaatatttgtccaaaaataggacgaaaaattggaggcaaacggagagaatgaaactgatcaaaatgcaataattggacaaacggatggccaaaatgaggcaaattatggtgaaaatatttcaaaattaattaattaaaaataaatttaaaaaaagttaattaattaaaaatattataaaaatatagcaaaataaatgccataaattctttttgtttttttattattggaaagtaaataattaaaataatacatacaaattaatagaaataatgaaaaaaaggaaaacattttttaaaaaacaattattcaccgaaattaaatttttcaaaattttgtaaatgatcaataatcaaacacttaaaaaatgatataatgaacaaaaaataattttaaaaaaatttgaaaaccgataaaagttattttttttcatttaaataaattaaataaaaaataggaaaaaaaccgtaaacgaaaataataagatgattctcttaattaatttatttttaaatcctgttttaatagtaattttttaataaaaaaaaatttattcacttaatgccaattttttgtccaaaattgagagcggaatgccaatttcaaggccaagacggttttgcattgacgacaatccgtcatgcttttgacgacaaaaaattccgtcgccataattagcctaaaataaattaccaaaatatttcattttaatttttaaattgctacctcaattcgactttggttgacaaatgctcgtccatccaatgtgctctcaataacaattccatggccacgattatgtgaaattgttgagttggcaattaaaacgggaccctaaaaattcgaaaattataaaaaaaaaattagattatttatgctttttttgaaaaatagaatttttaattcaaaattttcttaaaatgacacctttcaaaataattaaaaaaatataatataatttcatttaatcaaaatgagtataatttataaaaaataaaacattaataagtagaatttcgaaaaaatgtaaacattattttaaaaaataagtagatttgctgagtaaagctatgcaataaatcagcataaatatgggaataaaaatgaattcgtaaaagtatttctaatcattttaatgggtttattaagaaatatgaaaattaaaataatattattttcattattaattttcaaaaatgctgataatatttatgctggaaagataaacgatgaaaaaagttttgatgaaatttttggccaaagatgggacgaaaaatcggaggaaaatggagagaaagaaactgatcaacatggaataattggacaaatggatgatcaaaatgagacaaaaaatgatgaaattaatgctcaattattacatgagacacaatttgatcaattatttgatgaaaatttgcaagtgaaacaagaaagtgcaacaaattgtgatcaattggaacaattgccaataaattttggacaaaattgtgaacagttttcaaatgcaattgacaaaaagaaaagagaaattgtggaaaaattttaaaaacaaagaaaaaattaagcaaatggggaaaaaatactcagaaaaagaaatggctaaaattgaaagaaaaattgcccaaaaattgggtgccagccaaagtaaaatttacaaatggaaaagacaatttggaatgaatatcataaacagatattcggatgagggatcaattatatgataaaataacaattaaattaaaagaaaaattgaagggaaaaagagaaaaatgtaaaaaaaataatagcaaaacatttgggcataaatatcagcagcatttataaatggaagaaacaattaaaaaatggaatataaaaaatgatgatgaaaaaagagaaattgtggaaaaatatattacaatataaaataaaaaaaatgaatttatgaaaatgggaaacatcagaaaaaaggaatgggaaaatttttatgcaaaattaaacaaatattgaaagattggcaaagaaaaaagaacattgatgaatttgaaaattgctttttatgtaattagtgtagataataaatggtagaaaaaaaatttacaaatttaaaactttgcataaattttagattttttaagaatttattcttttcataattaattatttaatttttcaattgataaatttattaatttaaaaaagaacgaacaaattttcttacttaaaagtgtgttaatgctctcaacaaaaccattccaaacatatttttcatgaactttacgatatgcccacaatgtttgaatgtaattttgtgcctgaaaattaaaaaaatattgtggaatattgaacgaatttaaaaattaaaatttcaaaattattttaaaattaaatatgatttattattaaaataagttaaagttacctgataaacaatcgctgtgataataatggaaaatattgaccaatgaaaaacaacccgattctgataggccgcaaaaaaatttgtctgaaaacgcaaataatttttttttttttcattttttgaaaatttttttattttaataaatgaatgattatgtgatttgataaattaaaattcatttttcagaaaatttcaatttttaccttaatttttgcccaatgggatggcttttgttgatcacttttcggccgatcaatttccaactgatcagataccttgttggcattcatttgatcaattaatactactgttctatcaatgccatccgatttgggctgatcagcatttttgtttgggtcgctctccaataaaacttgaaaaaaataatagcgatgtgtggaaaacaaaaatattaaaaaatattgcaaaatattgaataaaaaagcaaccaaactttgaatgattgatatcattcaataacagacgaacgcagcccttcttttgtgttgaaagttttcaaaaatttcgtaaatttttttactaaaaatgtttgaaaaacatggtggttttttggtgttgttctttccataacatttcttttgaatattaatggtatttttttgaaggttaattaataaagaacacttagggctatcaataaaattcaggttactagaattataaattactttttttgctggctgaacccagaaaaacccaggcctggaaaattacctgcattttgctgttgttctgccggtgactttttgtcaatttgttctttttcttttttgggcatcggcaacacaattacgatgggaatgagcaacgatgaaacaatcaaagtaatctgattatacaaaacatttaaataaaatgattaattattttttaatgaattaaaaaagggtaaaaataaaataaaaattgaaatttttattctcaaaataatattaaaacatgttattgttgcaattaaaaaaattcgaaaaaaatagtttaataagtatttaattaatattaattttaactggaggaggataatttagctttggaaaacttgtcataaacatcccaatagctttggtcattttaaattgtaaaaaggcaaatcaacattttaactttaaaaatatttttttattaaatataaacatacggtttcccattctaattatcaaagctatttttaaaaaataatttttttagcgggaaaaaaatcggggagagggataaagcaagagagtttgcttaacatccagtacacatacaatggcgatttgcctttctctacttttaaaaaagcggccgatatttttttaaggaatttgcattaaaacaaaaataatttgtgtttttttttaaatttaagtattaaaaatatcaataacccacctcattaagcaataaaaaatcgccaatttttgtggtgatcaaaatttggcctgaagagtaggccagaaatttgccaaccatagaagccgtccgaaagtatgacgtcactttcttgtaatgccttttgtctacaatggcatacaaatatgtgttatatgcaacactggccgcagttgaaattccttaatttgtttattataaaatcatttatttattattgaactttaataagaaaataaaattataaagtgaattttcttgttttttgattattttttattgaatatttttaagaaaatttaaataataaaagattaatttgttttttttaaattattttaagaaaaaaaaaattaaataatacaataataatactaacaaaactatatttatcaaaaataataattgaactttttatattgaataagaaattttaa

SEQ ID NO: 5123 - DNA, 1919 bp, Heterodera glycines
ttagaaaactcaaacaacgtttaaaataaattttcttactgagtatttaatttaaaattcccagacatatgaattcttgaattaaacacaatgtcattttttcaaaaaattgttgcgattttagggggtcgttaaaaggatggatcaatataaatttttgctgatcgaagaagatgataagcagtaggagcaaatagtagttcaaaaaccaaataataaatggaatcgaaagattgttttttaaaatatattaaattttataatatatttagaattttattgcaggattttattattttacaagatatataatttaggtagatggtacgagtgcgcttcctaaatttctaaaaaaaaaaaatcggaaaaggcaatattttcagacatttcaaatccgactgagcactcgctgttttttccataataatgacaattttctttcccctaaataaaataaattaaaatttgtttatttatttttgaaattttgaggtaatgtctgtcagattgggtctttcaatttttggattatgacaaaaaaactaagaaaataagtacgaaaataacagaaattgctttaaaactgcatcgaaaaacaaaatgtttcgctatataaaatttaagataatttaattttaaaattattttatataaaaaacatttcaccttttgaaatattttgattgatgtcaaatttcttggcccataattcaattgtcttataactcaaaccaaatatttgttttatttttatataaaattctttccattctttccgtgaatgtttcccaatttgcataaattcattttttaatttaaaatatttttcaataatttccttttttttatcatcagtttttttatttttcatagtttttccattttttaattgtttcttccatttattcatacttctgatatgtgtgcccaaatgttttgctaatattttttggcattttgtactttttttatacaatttttcatttaatttcgtttttaatttgccatatatttgatcaaattgctttaatatttggcgtttttcatcttccgaatttttatggatcatcattccaaattctcttttccatttgtaaattttcttttgatttatacccaatttttttgcaatttttctttcaattttcaccctttctttctttgaatatttctttcccatttgcttaattttctcttttattttatggaatttttcaacaatttctctcttttgtttatcatttaaaattggaatttgatcataaatttgtccactattttctgtcatttgttccaattgatcacaatttgtggacatttcttcactttcctcttctttcatttccaaattttcatcaaaaatttgattagattcttctacaaataatctttgcacaaaattttcaatatttgttggtccattttgatcattcatttgtccatttattccattttcatcagtttctttctcttcatttttctcctctttttcgtcccatctttggccaaatatttcgtcaaagtttttttcttcttttattccaccagcataaattgtatttaaatttttgagcattaataaaaataataaaactattttaaactccatttttcataaaataaaaatgattagaaattcattttattaattgcttttattctcattgattttatgaaaattcatttttcctcctcatattaattttaaatattgatgaaatatgttatgcatatttttttttgcatattattattattaatattttatctaaataaaatttaaaatttattaatgataattatatttttacaaaatttaaattttgatttttgccaaattttcattttacttttctttttaaattgccattctttaagtgaacattttttccccaatgaattaaaaaaatttctatttt

SEQ ID NO: 5124 - DNA, 2453 bp, Heterodera glycines
taaaatttgaaaattccaaaagtcaattaaatatgttggaaacgcttgaattttatttgggtattttttcattttgttaaataacaaagaaattccttttagaaacataattttctttcttttaatttttttaattttatattcttatatttatttccctgttttgttgttatttataatttttgaaatgttacttcatttttattaaaaaattaaatttattattgcaattatttttaatttgtgcccctcgaatcgctggcaccgcggtggcccgcacatttatcatttaattttcatgaatatgatgctaatgttttccttcataaccattgtatgtcataaacattaaaagacaatttataaagcttttcagtactttatttgctcttttttaaatttattctcttttttattcgtcattttattttaaattaataagagaagaattagtccattctttcctcgaaatttttgaaaaattgaccggtctcgaaaaaatagtaaatggaaaaaaatgttgttcatttattttttaaggaatcggcttgtctcatgaatttcaaaatttttagctttaagagtttaaatttatttttaaatgctagatgctttgaaatattattgttgcactttcttgctcattaaatgttgttaaaattaattctgtttaaattttattttatttgattttaaatataaaaaataatgaatttaattaagtattgtccatttatatccttagtttcatcatttaataatataggggcggccgcaaatgtcggggcacccttttctcgagcctttaagagtgtgattttttttcaaaatatgttcttacaaaataaaaacggaataaatttttttataaataaatatttttgaggcccttaaatatttattattctttttactatttttataatttcaaaaaaattataaatctgcaaatatattattgttttattataatttttttttcattaattaacatattacatcactttccaattgatttaataattatagggtttttatttttattgctatagcattttttcagttttttatggaatttaattttttgtaattattttatttggaatatccttttttttctttgttgatgatttgctttttatgtttcaaagtgaaaaaattatgaaacttgccttcatataatataatattgcttctcaatttcaagcgtaaattttcatttaatttaaatatttttattgaattacatacgttcaattcactaattgcataatttatgctcttattttatgattttcctttattaaaagataaagatttttgtaaattttatatttggaatatcgctttttaacaaaatattttacaaccttaaattatagcgcattaagccgataatgaccagaagtgtctttttacgattagtaaaattttttattaatgcgaaatcttggcttgtatttaaaattgtgctgtgattggcctatcgaacgcttgccctattcgaaattgagcctggcgtggcatttgagggatcccttacctaaatatgcctgccgtatttcttgtttattgggattgcgttatttttcattaaaagatctgttccaatcctgcagtggaattctcaaagcttgattttttataactccgccagataaactaagttttatctttatcttcaagttcaaaaattaggcttctttctaaggtcaggcatctgactccaagaaattagtccttttttgagatatatcccgaccccgatgccatttttgaaggaaaaagttaatttatctttgccataagtttttgaatttgtagttaacgaattgtttcgatggttgaatagtttaatgctgaaaattatttattttttaaatgacattaccatactatttattataattaatttttgttctagatgagaagagatgatattttcttttttaagactgttattgactacaaaattaataaagaatatcatttcttatatttctattcaagattagcatttttaattattatttttcatgtattttttatttaatataattattttatacctctatatcaggggtttgacttgtctcagaaaagacgagagcgagagttcggcgagaagcgagagttcccaaaaagacgagagttggcgagaggcgagactttttcaatttttctttagccttattttttacgttaaaaaatttcattcataagtacaatcatacaatttgatatgataaaaaatagagtgccacgggaccgggaatttttggcaaaaccgggaccgggattaaaaattaaaaaaaaaattcaaattttaatttatatcaagtgaaagtaatgcaaaattatgtggttttttattgaataaaataaattaatgaaaatcttcaaacaaatgttcttcaattatttcaaacaattaatcatttatggactaaatc

SEQ ID NO: 5125 - DNA, 3003 bp, Heterodera glycines
attattaagctcattggtaggattttcatttaaaaaatgataaaatatgtatcaatttaaaaaaacaatgaggaaccatattttctttataggaaacccacgagtatacaaaaaaaaattgaaaataatctaatttctgtagagggattgaaccaggggaaagaagaagggaaagtcaaggagactagccattaggccatttgcatacttgggcagtgttacttttaaagaatatattaattattattttttatttttccctttgactccaattttcttcactaatttttcactcagaccccattcttaccagtgcttgtttttcccggttcccggttgccctaccgggaccgggacctgagattttcaaaacccgggacccggggaccgggacctcggatgaccgggaattcccggcccggtcccggtcccgtggcactctgataaaaaacaagaaaatgccaaaatgtgctaaaaagttccaaaattggaacataattgctcaaaaatgcgaaaatttctcagaatggttttttcgcgtaaatttgaatatttttctgactgctcaaaagttcaatctttaggggtgcatttcacctctcgtcccaaaaaacgagaggtgagaggcgagaatcccaaaaatggcggagttggcgagaggcgagagttgtcccacccctacctgttaaaaacctaaaaatacgggttcaacacataattttgcttaaaagtactaaattttataatcttgatgtcattcgatagcacaaaggcttcttaaggctaaaaaatttcaaaaaataatccgccaagtttgaacaattattgccgaaagtaatcaatagagcccggcaaaaaaatttcccgggaacgggaaaacgaaaatgaacggggcgggattcccgaacgggattcccgccttttttcccgttcccgtaaaaatcccgtcaattttaacgggaatcccgccaggaacgggaaaaatgttttttttcaaaaaaatattgatttaaaaaaaaattttttactttatttatttttcaagtgaaaatatagtattttaaaccttaaaaaaatttttgtttttagtaaatgattaaattgaattttattaatggaaaaaaattttaaaattgaatttttaaattgatttgttttaaaaataagccataataattttttcgagggtactggcaaaactggtaatttttgtgctctaaaattcctagaaaatttttttgcatgcaataattttcattaaaattgtctattatttttttaaattccaaaaattcttagagaatttttctatgtttttcaacttattaacaaaacctgttttgattaaaaaaaaaaatttcgcggtgcactttttacaaaatcttttgtggtacagcgagggggtagccgataggcgccgccgggaaaaaattaaaatttttatctaaatttgttaacagatttatccaaaaaatgaactataattggttaatggcgctttaaaagttgattatagaaaaacccacaaaaataagacaaacccagtaacactctttaaccaaatgcggacccccacaacaccaacagggtttgggccatttcaaaagcggcagttttggctttggtggcttacgtccccgcatttcctgttcaattctgatttcttgggcccgtgacgggccacaagtcggtccagacaaacgcaagattccctctgaattttcagttttttaaagagcacaccaataccatgtttagtttaccatttcgaaccttcgtgtgagtttgcgaagagcctggtggctcaatgtcagggaggacgtcccaaaagtcgtcgtcgtcgttgttgtttgcttccggacccacacttctgacaggaacttctttgtccgaagcaacatcccaaaggtcctcgtattcctctgggctttgaacacggatccccttcttagctttgagacgtttttggggcgggaggtactggttgaagatttcatgtcaccgaaaacaaggattaagtttaattataatgagacagccaaaaggtattttaaatgtttaaacatataaaaggatattgcctatggttttttgctagctatttatgtaagccaaaacatgacgtacccacatggggtgaaaatagatatatagatccttttaatctttgtttgaaccctcatttcttcacaacatcctgaatcttgacggacgccagcttcatagtattgtcgagaactgcaactttttcctggaaagaatatgcagctttgcgagagctcgcttcaaatcgtgctcaaccgtacccactttcgtttggagagcacaaatgtcctgacgcatgtcctcagtctaaataagtcatgtaattatcataaataatatatacaactttaccgcaattgaagaaagcgtttgcgagctctgaactctcgcgttcagatcgctgacttgcacgcccaaatttccagtcgaatcctcaatagccaattgcaggttgttgagcttttcctcaatgcctctagtgtccacggtgatgttcaaaagcgcggaacccccaaaagtttcagaaagcgcatttgatgaatgagagtcgttagccatttaaaacaatctaaaacattaaagatgaacaaattaaagcctacacaaaaaaagaacatcaaagaagagtaaagtaacaaaaatggggaaacaatagacataaatttaaatttatttaaatcaattttagcgtctctgcatttatttcagtgagagctcagacagagaaaagagagagcgtatagcagatagcggaaggagaggagagagagcactgcgtgaccgtgtgctggtggcggtctatactactacaaaatagggggcagcaggagctgacgccgtttgcaactatgcaaagaaaggatgggaaatggaatattgaaaaacagaagaaaggatgtggaaggttggaggggatggggccaaattttggggccggatattgcgacttatactact

SEQ ID NO: 5126 - DNA, 2121 bp, Heterodera glycines
aagaagaggagcgaaacgcgcgtgaatatgaccagctaatgggctacgcgtacgacgacctcatcagcagcctcaataaagagtaggtacggtctaaagtggttacaacacagtcaacactccggaacacgaccacgacaaggacgggatttagcgtttcacagcatgttagcaggacagaaacaacctcgcgacagcgggtgcggtctcactcaaccaccaaaagaaaagaggatggttcttcttatgggaaagagcgcaaatgttcaaattgtgggtccgctgagcactggttgtcccaatgtcccgaaagacaggttgtaactcgtgttttcaacccaaaaaattttgtaaacggcatgttttagtagttctttctattaaggaactgcagcgggttcggtcgcattcaaccaccaaaaaaaaggacgattttccatattggaagggtgaccagcgcaaatgttcaaattgtgggtccgctgggcattggttgtcgcaatgtcccggaaaacaggtcttttttaactcatgttttcagtaaaaaaagattttatggcatattatttgttaaggaacagatgcagtcccatgggctgtatccttcagaagcactacaggatccatcaacgcgtgcttcacaaataaggcgcaaacagtttactaagggggtccgtgctccggcaaagggtgcgccgggacagccacttgcatgttaccattgcggcggaccacacctcgtcaagaattgtccaaaggtgtttttgagcttaaaactataaatcaataatgttttaagcggcaagcaaaccccaagtgttttaaatgcggggggtccggccacaaagacgttgattgtccaatggcgttgaacttgggcaatccagacttgtttccccaacgggactttaacactcgtggtattttttaaattttttttagattttttgttatgcgaattacattaagcaggatgctacaactgtgggggtccgcacaaggatgcacaatgtccggcacgcagcaactttccatcttatgccggcattgatcgagatcggaggcgcatgtatgcgttggacactcatgggggatccgctgggcagtactatcgtcgctcagaaaagggtactgaaacagttttttgtaagagtctacacctttgaatttaaagatccaaagtgcgatcactgtggagggcctcatgaatctgacaagtgtatttttggtccacgaaataaatgcgcaaagggtgggtacgttcatgggaaaacagcaaaatgcgtcgaaacgaccgatgagcatatgggtatgtttgtttctaatatacaactactattattctaataattttaggaaatggctgcaaaatatgcggcgaaatccatgatggtgattgccccgaagcaatgcagaagttgcactgtcctcattgtgggtacgatcacaaatcctatgattgtcctaaccaaccaatacgttagttttttaaaacatatgcaaaaaatatcattcaatcttttcagcactctgcggagtttgcggctctctcgcgcacaccactaaaaagtgccaagagcgctgcgctttttgcggaaggaagcacctgaccaaggattgtcctgattcacaaccaggctaataaattttctacctattaaaataacggtttattgcttatataggcccgtctagttctaaattcagccactgtgggggtccgcatagcgcacggcactgtccgaacatatagaggactgaatgatgtcgaagaagattgtgatttacattgaaagttttctgttcgtacgaataacaaaatacttttgctaatgatggtctgacagaaatcagtatgtctacaaagaatatttgtgggtacgaatttttgtttattgtaataaatgatgtgtagggctgccaaaagtatgcaaatgcatatttttttcctggcttcttacattttcatgcatattttgccattttttgtgcatattttccgattttttgcatattttgccatttttcgccaaatattttcctttccgatttgaatatcgcttaagaaaaaaaatttttattcctaaaattaaatccaactctgcatggatgcgcgagtgg

SEQ ID NO: 5127 - DNA, 7444 bp, Heterodera glycines
attttcaattttttacgattttttgaaatatattattcactggccggggtcgtacgagacgggggcccggggttcgtgtccgcttcggctcgcggtttatttttttacgacactccgacgaaaatcatagacaaaatgaaggttcatgcataatcagaacttagattcgtgatcagagtattttttaacccaaattcattgctaaacttttaaaaaaataactttaaaaatcgaaaaaaatcaagtagttgacaaaaaatcttagataaaaatcgatgattttcaaaatctgagctcagattcgtgatcagcgcattttttaagcctagaaaaaatacccgacaaatttttaaaaaattttttcgtcgggacaccaattcttagattgccatcaaatgtattttgttgttgtgtatttcactataccaaaaaattgcaaaaaaaaactgtaaaaatttttgatttaattatttatgcctttcacaccaccactttgttcatgttcgaacgaaccctatctttttggtatcattctaaagtacaaaatccaaataatagaattctaacatttcaagaaagttacaaatgggctattaaggtaaaaggggtcattaattggagggggccttctatcagatcaaagggggggggggacttcaaatagcggatacggtaattacagcccaagtgatcaaatgtatttttttagttgatgttgttttgtatttcacaataccaaaaaattgcaaaaaaaaactaaagacaaataaaaaattttgatttaattatttatgcctttcacaccaccattattgtgcgtgcatttccatctcttcaagtctcatcccatctcaaattggcatcaaactcagccatctccagctcttcctcgtctatttctgcctcaattttcgcataaaattctttcatcttctcagcttctctacgctgcacactggccgaaatgcgacgcaacagacgaaaacacaaaacgagcattacgaagacaaaaatatttgcaaagatggctgagccagtggcaatgtaaaacacgatggcatggatcacgggaaaccaaaccaccaaaaagggtggatcacggacaatggaaggcacggaagaactgttggaatgaatcggctgaaaaatggatacataaaatacacataagaattatgtagtgctgtagaatttttttggcccgaaaagcaacaaaaaaaaattgccttcgtatttcccccccccctccgaatttttttttagctactggcttatgtttgtttcccattggtaatttttagcctaaaattgacaaacggtgttttttgttcaaatttagttttagtaatcacgttttgaaaacaataaaaatttcaatcgcatttctggttcttaaaaaaatttaggggatttttgaggcctgtgtttaatttttttttttaaattttcgattgtaatgaaatgtctcccgccgctccctcaaaaagtgagcaaacgaacagtgtttgaggtttgagttttatttgaggcacaccagcagaacacagcgaatgaaaggagcaggaaagccaagccaaagaacagcttaaatgaaaaaagattctgaaaaaaaattaattgtaggaattttttttaggtttttctagatttgaaaattcggtatgattttctaaaaattaagtttaatcggtaagactgacatttctgtcttatttttaacatttgacccatacctgaacccatgaaaacatttcgcagaattttgtctcctttggctcagtttccttctcttcgctgtcaattatgcccaatatttctttgatttcgcgcttcaattgggctgaaattgggttaggaaatcaagataaatgtttaaatatatgcgaaaaaatgggtgtcccaaaaaaaagcacgaaaatattaccatttttttccttggcattgtctgacagcggtcgatagccattgccattttcgtttggtggcactctgttctccttcggctccttttccttctcttcgctgtcagtggtgcccatttttgtttcaatgtcccgcttcaattgtgctgaaattgggttagaaaatcaagaaataaataattaaatttgacgcggaaattttcaacggctataggtacttcagtgttttttgctatccgccaccctcgaaaaaattgaaacttccaaaaaatcatagttattttgttaaatcgatacacagcagatgtatattcatgtgatcagcgagtgccctcgaaaaaacaaaaatattataattttttgaattttttcgagggggggggggtagcaaaagactgaagtacccggctctgttgcattttaggcgtccaatcttcagtttgtttgaacataatttttttcttaattggttaatacctaaattcttggcatcaaatgaaagcttgaagtataaattcaaaaaaaaaaaaattttttttttgtatttgctggaaaaatgaccaagaaaaaaaaattcgagtccgggttcggatttcaaacttgagacaaaagaatgccaggttcctcgtgcctaaaaaatgcttccaagaaaacaataaccttttttgtcaatgcctttgccgtttaccggcaatttggtagtgccaatgtcagtgggtggcattttcagagatttgttggcacgccgatttttcaacatttgcaaattgttcagcttcagctccagttcgttgtcgtccatgtcggaattgtcgaggaagaaatctgacatttgtcagcggaattggatctgtgcttttctttaaaaggaaaatgagtaataaaaagtgacaaatgtagagagcaaaattcaaaattccgggctctagtaagcagtaatagaagtaggtagtcatttttttgttcaaattgtttaacttataacattatgccagaataaataagtgacaaatttaatttaaaaataaaaaaaatttttcaatttgttctttccctgggaattatttttgctgttcgggcactccgaaaaaaaccacagggtgagggccctttttatttcgtgaaaacttattttatgggttttcgggggtagctaatcacgaatcttacaccaattttgacaaagctcacccggactcgaacaaaaatcaaaaactactagtaagtttttcggagtttgcttttttgcttgaatttaggttagacattcaaaattggatataatgggtgtcagatccctggttaacgcccccccccccccgagaacccttcagaatttgggggaaccaaatatactaacaataagtattatatgttacccccgaatttgcaaaaattgaaagaattttattatgtagtgaaaatgtgtaacaaaagttggctgccctgtcagttttggagtgtgaagttttttgtttaaaaaacaaaagatattgatcattatatcctatgcagtttccttacagtttttcaattctgtttttgtttaagcgtaatttttaaattaatgcattttttgctgttggggcactccgaaaaaccataggttgagggcccttttttattcgtgaaaacttgttttatgggttttcgggggtagctaaacacgaatcttacaccaatgttgagaaatctcttacccgaactcgagtgaaatagaaaactaagtttttcggagtttgcttttttgcttgaatttaggttagacattcaaaattggatataatggatgtcagatccctggttaacgccccccgagaacccttcagaatttggggtaaccaaatatacaaacaataagtattatatgttaggtttccttacagtttttcaattctgtttttgtttaagcgtaatttttaaattaaaaacggcaaggtcgcagaaaaaatcagtaaaaacttataaatccggtccctaaattataatttatcccacaacaactcctcgttatattttcattctctgactgccccatgttttttgattcttaggtcaacccgattttggttaatccgccagcccctaactcaaactaatctctccctttcctttttgtctgactaattttcaaacaaaaaaataaaataaattaattgctttctttttattaagcaaaaaatgagcacaccaccaaaagcagacgacaaaaagaaggaagtgggcggaattctgaaaatcggcaacacatgctgcatgggcgctgcactccaagcattggccaacgtgacggcactcagcaattttctgatcgaaaagtgggtgccaataatgccaatgtccaatgccatcaatttatgttttcacccctcttttttcagcgaaaaccgactgcccaacaacaaactcgtcatggaatatgtgcaaatgatcaaaagcattttggtgttgcgacaaccggcggcgccattcgaactgaaggtgtggtgaacagtgtgccgtggtgatggtggtgttgcgtttcatgactcgccgttttttcaggaagtcatctccagccttaccaatttgttcgctgattcgttccaacatgacagccgactgcgcgacattccgctcgacaaaattgacatttggtgcttcatgcgattgttcaaggacaaggacgaagatggacagggcgaccgcctgatttgtatcagcctggcccaggtggggagttcaagcagtaccaggaggacaaccctaaccccatttgacattttgccgctttttttagcgcttcactgatgaatcgcattacattatgggagcgtcggacgctggtcaactgcccatggatgtgccgctgatctccatcaaccattgtctcgcggatttcatcaaaccggaagacattgaaggctcacgctgtgcacagtgcagcaacgcaacgccatgtttgactgttgttgacaactccgttgacgaggcggtggagcaggaaaaggcggagaattgtccaactacatcgtcaagaaaaaataggcaggcggcgattttaagcggaattattttgaagaaaaaaaagtgattcgtccggatttttttttaattttttatttgatgcataaattgatcattttttcctacaatcgtttttcatccattgtttttacagtctgatgctgtgtcattaatattttgcatatttgatttatgtttttattttcaaactgtttttgcagccatttgcgaatttattcaaaataagggaaaatggtcgaagccgccgaacagtcgcaacaacagcccatccgtcgccgtgccggaccgaagtcggcacgtcgcctttatgtgaaggcggtgtttaccgggtacaaacgcggacaccgttctcagcacgagaacacgtccctgctgaagcttgacggggtcaatgacaaggtttctgtttgcattaatttggaattgctatgcttgtagttttagtagtagtgagtgaaggttttttcattttgtgttttattttatttatttattttggtccctgaatacaaatgttaattttcatgttggaccgaaatccgcgaaagattagccccctttcttgactattttctgttcacgcatttattccaaatttttcggcgcttcaattagatagttgtaagtgcaataatgccccgtttttagtcggatgccagcttctatcttggtaagcgtgctgcctgcatgtacaaggggcgcaaaacgatcgcacgcggtggtgggccgaagacgagcgattttttggtcggttttataaaacaatattttacttcatttttatgtttctgtagcattagggtgagcagtgcatgatcagtacaaaaaatagaagtaatatgagggctcttctgttttttgatttccaaaagaaaaacatgaaaaccccaaaattaaataactttttatcagtcttttaattaaacacaaaaaagttttggactttttatggctgtatcccctattctacagaaatttcagaaatgtgtatcaacgatttcgttgttgattttttctctcctttaagttggctttgtttatgtgccttctttttgtacaaagtgcttgcgccgaggaatctttttcaatgaaagtaggagttcataaactctttgacaatgcttaaatacattttttcaggacctagcgctggagtacaagataaaatatgacttctttttcgcacctgtgacgttgattttggctgtgttaagcctagcgatggcgttttctgctggctttatggttgtcctcaaccgcatgttcagtttgcacatggatgtgcaggaaaacaaaaaccaagtgaaagaacttcgaaaagaattggacgagaatgttaaaaattttaacacattgtattctgaatttgttaatttgaaaggagaggtcaatttgctgaaaggcaaataggtagattattttataaaataatttaattgtttttcatgcataattgtgttttaaattcattaattgtgtagacagttaacaaaaatccaagtatacatccgccggtgactgggccgttttgaaatttcgacatcagtagggaatgatattttaggctctaagaactgcctaaataggtaggctctaaaaacccccaaaacaggcaaaaaccatttttaagtgtgtaaaatgtcaaatttaattttaaaatattacatatcagaaattgagataaataattttaaaatgaaaattcttcatatgaaaacaaatagctaaataattttggagatgaatttgcatttttgttaataatttggtaatagtgtacctagtctgcccccccccttttttggaaaaaaatttcaaaaattgtagtcgtgaaaacgtgtttcctgggcttttagaggtcgataatcacgaatccggcatccgtttcggccaattccgaacaccggacccaaattcgaacaaaaactcgaaatccaaattttggatttttgtctaaaaaatggtttaaatcaaaaatagaagtcacagaaatgaatgataaaaccttcaaacaaatttataaggtcatttaatcagcaatataatatctaggtaatccgtttttaatctgtgtgtgcctaatcattttttgataatttgaaaaaatatcggtcatttgaaataataaactttagaattttatctaggaaacccagactttttcgtcttttgcctggacctggattttatttcctatttgaccctgaccttgattttcctggattcaggctgatcttagatatgacctgaatgtaacactaaaaagagtgtttgcagttgcagcaaaaatctcggattcttcaaaatgacacagacacagtgattttcaaaaattacacacaaataaaaaaaatcaaagaaaaaagtccattgcattactccttcctctcccctaaactgaaagaattatttattttcaaaaaaaaatggaattaaagatcttgctccacctaaaaaactgagtttacttaaaaatcaatttacctaattgaaaa

SEQ ID NO: 5128 - DNA, 6465 bp, Heterodera glycines
  misc_feature (11)..(11): n is a, c, g, or t
atgaatgttcntgtcttcaaaattactaaaaaattatcccttaaaactcttaaaacatactgctgccatcggcaaatattgtggcttgaaaaaagtttaatttattcattcaaaaaacaatattgatttttaccggctgattcgcaaaattttggctctgataaaatttttgaaaatatggaatattttagaaaatttttacttgattcgatggtttatttgtttcatgctttgcaacgggctaaaaaattgtaaaaaatatattaaaatattaaaactaaattaaccaatggttgacgtgttggcacccgtgtgggagcttctttcaaaattgtctgaatggatattaaattaataattcgcctattagtttgtctttttaaaataattacaaaatattaattagaggattaattagactatcagactttgtcaattgaagtagcaatttgcggctgtggctttacaatgtaaaattttattttttttaatgaaatgaattttaattgcacctgatccttcgctcgtattaatttccgaaactaaaaataaattttagaaattaaaacaatgaaagtatttcatcaaacttgttcacgaggttgcgcaaaacgatgtcgaaattccttgtaaaaaaaattattaacaaaatattaattttaaaagggaagaataataattaatctcacaaatgtgaattaaataattattaacttaaaaaatacaaaaaatataatttaattattcattttttatttctattaattattttgaatattttatttgatgcttttttcgcttaatatattaatcctaaaattaatgtttaaaaatcgtttactttaatttgtgccttaaggcttgaatttgtttttcgttcatcaactgttgaattgttgttcaaacgcgctgtgttcagcttcacaacgccggtaggttgttgctgttgttgttgttgtacagcttcaacccgtcgttgcgataattcttgtttttgttgttttggcaaatttttttggatgaccaaaattttttgctgaatttgttgaagctgttggactagttggtgaatcaactaaattgaattaatttatgaaatcgttcagatgaaagaattcaataattagtgttaccattaaaagcaatttaattatttttgttataaatttattattgttcacggaatttgccttaaatagcataagtttttcctgaaacaaattttaatgacaaaagaattttaaaaaattgattttgcctttaaaattaatattcggtgatgattttttaatgtcctggataatttaaatccatttaattattttttcgttttttcgcgcattaaatcatcaccccagtataataaataataaaatttcatatttaaaaataattattaatataatttttacttgttctgttgtcgcaatgtttttctgctgttcgccaattgtttcattgtcaatttcagcattggcgtcactgtcatttagctttttctttaaacaagcaatgttaacaaatgtgaaatctttttttaattcataaacctttgtatccgtcaaagcaaccgttgttaacaaagtgattacgataaaaagtgttactgtaatgcaaaggtgcggcatactgtaaaaaaactgagtaattttagattattaaattaataatttttaagacactatattaatttgtgaagctaaaatgacaattaaatattgtcactgaaaagtgtggcttaatgtgttaattatagccaaaattttcagccccattaaaaccagttagcgcactaattagttggatttgtgcaacggtgaagcaatccattaaagtcagcgcgcaccaaattttattgtgatcataattgtttcgttatatttgacatattaattatttaaaataattagaaaaagattttttaatattaaaaaactggatttcaaaaaaattattaaattaattattaaataaatatttttttatgtaataaaacgaaattaattttaatttaaaaaacaaatttatctttaaaattaatttttctatgatttgatttttatctataaaaataatagatttattttttgaattttgtttatagccttatgtaatgtaaataaatatatttattttatattctttttttagcttaacatatttatatcacaaatcacataaaaccagtaaaaaaaagaacccattcatcccaaatccaggacatcgcaaaaagtgtgaccctgtgatattctatgctgttggaatggccgctttttgtttgtatctttattagcaccgctattattaattgcataacatttgataaagcctgtttcttcattgccgatttcatttttttcagaaaaatgagaaagccgcggagattgattagattaattgggttatcaaaatgaactgaccacaacacaaatgtgggacttaatgagatgacaagttttttagtgaaaattatttacagaattctataatttttattaatttcaattaaaaaaaagtatatttcaaattgatttaaaaagaaaattgaacaatttaaatcacaaaaattgtattgatgcaaagattaaaatatttcttttattgctaaacattattaatgaagaaaatgaaatataaaaataataataatgagttcattttattttcttagtttcctcaatcatttatttgtcaaattgaatagcattattcgaatttggttaaaagccaattgtttgacaccatacttgatctctgatcacttaacagatttttgggctaaaaattaattaattattgtttatttaatgaataaaaatcacaaaaaacttttttgcttctatactatgaaataaattaaatgaatttcaatgaaatttacttattgttttaattatataagcttgtaattaaatgatttggtttgcaaaaatttgaaagaatatcgacctatttgtcattatctcttctttttagggcttttgtcacttttgtaactgtttggcgcttttcttcacgatttagttcagttattaaagaaaccagccttattaattcttccattattttatagcctagctctcgactttttcaggaatttctttctaaaaattaatgctacaagaaataaaaaacaaaaaattatttaaaataatttcaaaccaaaagagcaattttattgtaaaatttcgaatttagtcgaattttcttttgcttatttttaacattttttatcctaaccttttccattattttttttccattcatgttgcggacagggcacataataagcagctgatttcatgcctttacccttccatggtttgaatttcttccgcaattttattgttgtttgtggctaaatttttttaaaattttcatttaatatatttgcattttattttactggtgccgcagatgctgaagcaaattgaatgtgatttgtcataaaaatttcattgtcaccttcaaaatgaacactgttgtcatgaagaagatgctacatttaaatgggaattatatattaaataattttaatgtaacatttaaatactaattatggctaaattttaaattattttaatgttttacttctctagttgctttgcagtcagatttattcaaattcattagaaagataatgaaaatactggaagtcgataaaaatttgataattgcataatttttctttagttctaaaaaaaatgaaacattgcagagtggtaaaatcgcgagcagagaatattcatttacctgattaatctttgctaacaataaattttaaatgtcggaaagtgtactttgtattaagatggtcagctcgttctcaaacagagaaaattggatttaaaacattttttaatttcttgttttttactgggaattaaattaattttaatgtcttttactatttgatggattttataactacgaacagcattatgaggttaattttatatttatataattatataaaaaacattttcaaggaaagcacattttttgaaaatttttccagtgaattctgttaaaaacaaaaaatcctaggattcagctcatttttatagtcaatgttattgcatatcccattaatcatctgttaatgggttttgctttttttatttttggctgcaaatgtgcacaacacagtcgcattcatttaagcaaaaaacaactatgttggctcaaagaattgtctgttcaatgaacaggtttccacctaaattgtggtcatatctttttgatatttttgataacaaattagttggaaaatattatttaagcggcattgagtgaaaattgagcaaaattttaaataaaattatatttagaaatgaatattcttgtttatttgtgtaacattttcattttttaaattgtcataattattccatttttggtgtgttctataataatgcattttggaaaaattgctgaaataatttttattaaaacttaatatctaattatcgcaaaggtactttcctgttctggggccccaattcaaattttttaaaaatcagcaaaaagccgcgcaaataacaaaagttctttcccatataaatttaaaaataaacaatttttgtcccgccttttcttccgcataaattacggacaaacgcccaacggatttcgttaatccatatttcatttaaatttcaaatagtaataatttacgaatttttttcttctcaatttaccgtattttctctgattatcccccatgggggattatttttcaatctcctcagaaaggtgggggggggggggtaattggagactgggcgattatttatgcattatgacactattttatcaagaaaatataagatatgtggcaaaatttggtcattttttgaaccattctgtaacctgttaaaaaaaggataatttcaaaaaaaaaaatttggcggcgcctttctgaagcatcattctgaggggggggggggggaagttaagtacgcatccgggtgaggtaagtaattttctttattattttttcgtgtttattaaacatttaaatgtgtttcaattgaaaagtaattatttttattttttaaaaataaatattttttgaaaaaataaaaaattccggaaatatttcgttgccatagtcacaaataaatatgaataaaatcacacaaattatttgcctcaaagtcaatacaaaagtaaaatataataaaatgataaaaaaatttaattaaaaataaataaataaatataactttttaatattttttgttaaggagttcttttgtgctttttgtccatgcgtttcaggctttacaatcggaaacaccgttaaaagaatttttccattagaattaagcaaagttttctagcttttctggaatctgtcttcttttggcaatcacttggatatggaataataaaatatcgttttttcaattaaatgcaatttaaaacagagacaaagggcccatttccagctttgtttactttctattaatttcccaacctttacaattgattgttttaagcttattttcactaaagaaaaagtatcctacattcgtttagtcgaaaaaattattttataaattttttagctttcttatatacaaattatttattttttatttttatgtagtatttgaacccagtgctccgaaaatgcgaatttaaccaactgagccatcaattttgttcattttcctcattttttggtttcttgccattggcctaatatctaattaagaataaaatagtttatttaatctgttcatctttatatattttattttatccagaatcttaagaattcaaacgatcaaagaacttcaaaaatttgtggcttctaaattttctgctttgtcaagacgttaaaacgcacacaaatgattaaatattttatcactagggtcggttttagatttgttttagtttatataaaacattttttaaaaattaaaaaaacttgaatataagaatgttcacatgccttgaatcgaattgaacgtttcattcaaatatggttgacccttatgcaaatcgcagttcatataatcagaatgcattacgcgctgtaaagactggagctcacctgaagtcaatattgtggccgtccgttatgatgacacacaatttggaaaggctgacaaagcattcaacacgttcgacaaccggaaacagaaggaaatggtggcaatcttttatttaagcaaaatttaaataattaacaaaacataaatttgcacagggattggtacgatgaaagttccagccagcctctctcttccctcatggaccgtttgaaagatgatttggaaggatttgccgaccccgacctttatggcaatattgttttgttacgtaattggattttttgatgcctcagcgaccgtagcattcggtaaagtaatacagtaatttttggaccgttcattgctattttcagatgataattattttctttaaaatatttttatttgccccagtact

SEQ ID NO: 5129 - DNA, 2030 bp, Heterodera glycines
aaaaaaatatatttttaaattaaattaaatattttttaaataatttttttttctttttctttttaatgaaagcaaaattacgcaagtatttgggtgtgtgaaaaatattgtgttaaagaattctttttatggaaaaaaataattataaacaggtgatttacctatttgtgcttgtgaatgcaacagaaaattaattaaatggaaaataaaaattaaaaataaaacataataattatttgtttttatttagttggtcctatttggtttcttaaacacgcaaattgataataaaatgaacacattaaatcataagattgcttaaaggtcaaattaaaatttttatggtatcatttattggtctatatttctctaccagagaatatgcaatactcaaaaatttcatcaattttcaaattattttgacaaaaatgcaaaagccaagggttcagaaattcatgaagataaaattttgaaaaaaagcatatagttttttggctgaaaattatgccactattcgtcactattttggcattttccccactatttaattaattgttttgagattttcattactaaaaatcgcatcccttatttataatgcatgtgcacttttgtttatgaaggaagaagacctatttgactttttgttagtgcataattaaaattttctgcccatttgcccttaggcgcaattgcacgaaactcatagtttttaattgggctaaagccaatcgaagtttgttggtttctgcattaataatagaaagttataaattaatgaaaaaaaacaaaaatatttccatttttttatgtttgacattttcttcttgacctctggcaatgcctaagtaaaattgaaaaaaacaaattcattatttaaattttactgatttcttttcattaaatgctgcttttgataattaacaataaaaatagcgtagtgataattataaacaaatatcttaaaataaacagaattcttaatttactttaaatttaataaataaaaaatcattgctattatttggaaaagatatttaaatggttattataaatggaatgcttatttttggatcattttctttatcgcatttccgttttcattcttttgctcttccatcattttcatttctccgcttaaagcaaaatgccatggcgaattgccgtgcagaccaaagccacggcaactaaattaaaattaaatatattttgtttaatttatattgttttttttaccaaaaaccatcacaaagtgatggccaatgccgggcttagtgcttcttccactcccagcagaaggaggcactccaaggggaatttccatatcggaaaagacaatgtctgaaaaaatattaattgatttaaggtagaatcccctactcattaattaatgaccatgaaaaaatagcccaaccacctgatttagctaacccagaaaaaccccgactccgacttttgtcagaccgaattatcggagtcctaccctaaattaattaaaaatataaccaatgccattctgcagttttggcggtactgaaaaataaaaaaaaattagaaaagaaaaaaaaatttcaccaggcacagaagagttctcggggtttggcgggggaggcgctgtaaaataaataaataaataaattaattaatttttttaaaaagttccttaacctaaattgaaatgaaatcggcaaaattaaaatgacacactcaaaaaataatcaaatttttattttttacaaaacaaatttttttgaatttcatttcatatgaatggaatatttacatttaattttgaagaaaaatttccaaatggaactttgtaggtgggtagaccacccctgagttgagagaatttcaaaaaaaatactaatttggaataaaattttgaatattttatatggttttgtgatatttgcacagattaatttccaaaaatcccttgagttgtgtcttcaatctttgaactaaagacattttgtcaaaataattattaaatttttcaaatttggggcagtttcactggcgaaatt

SEQ ID NO: 5130 - DNA, 2617 bp, Heterodera glycines
ggaatgctattttttggataattttgttttcgcatttccgttttcattcttttgctcttccatcattttcatttctccgcttaaagcaaaatgccatggcgaattgccgtgcagaccaaagccacggcaactaaattaaaattaaatatattttgtttaatttatattgtttttttaccaaaaaccatcacaaagtgatggccaatgccgggcttagtgcttcttccactcccagcagaaggaggcactccaaggggaatttccatatcggaaaagacaatgtctgaaaattgttaattaatttgaggtagggttcccgactcattaattaatgaccatgcaaaaatagcccaaccacctgatttagctaacccagaaaaaccccgactccgacttttgtcacaccgaattatcggagtcctaccctaaattaattaaaaatataaccaatgccattctgcagttttggcggtactgaaaaagaaaaaaaaattagaaaagaaaaaaaaatttcaccaggcacagaagagttctcggggtttggcggatgaggcgctgtaaaaataaataaatttatttatttgtttgtttttaaaaagttcattatcctaaattaaaatgaaattggcaaaaaaaaattttaccaacagaagcgttcacaggatttggcggaggcgctgtaaaaagaaaaaaaaattaataatatttttaaaaagttaattaacctaaattataattaaatctactaaaatttaaaaaaacataaaaaatgatcaaattttgcttcaatgaaattaaaatttttacaatgtaaattatatttaattggttttacaaatttatccgattttgtccattgaaaaaatgattaaacagaaaattaaattttaatgctataagaaaacaattttccccaattttttttccaaaagattaattaaaaacaattttttttctactttttggctgatacggcgggaactttgcgttgccattgtcttcattatctttgccaaattggcactgctcgcaccggtaattgccatattttctgataaaattgtccttattcttttttttctcctcttcacaggcttcttctgtgcttccgtttgcttggcactccttctttgccaaaaattcacgaccagcagaattgcaatcggtaatagtggagcatgtgtaaacggtcacatagtgttcggcttgggaaaaaaagtaacaaattgttttatgtaatgtgattaataattacttttttaaatctgtgcgtttttttttgcatattgagaatttcttatatggaagggtttaaaattatttttgcgacggttttatttcgatgaaaaagacaggaacaaaaacattttagcgcccaaaatattgccactatatggtattggtgagaacaaacaacataagcattgtgtacttttcgccaattaataaaatggcatttcttcactatttttgccactttttgctttttgttttttgaaaaaatttaaacaaaaaattcaaaatttacgactattaattaatttctttatttgtattggcatttctgctgttgtgtttgtttatcatattttctacctttgccctctcggaagcagacagctttcgcacaaaattttagctctttcttttcagggcaagcagtcgaaggacttgtgagctctttatcaacaaagggcttatcaacggtgccaataattcccttacggcaactgagaaatgttgctaaaatattaaaaaaaaataatattaagaacatttaaaaatgtactaaaaattaattataattcattattattgtataattaccgctccaaaagcacgcaaacaagacattgagctgaaggatgagcttcatgttaaggttggttcttggattatctaaaaacatatgaaaatttattttatttttaaatcgtttttatttatttttatttattattaaccaaataaattggttgtccaaaatgaaatgaaatgaatggttgggaagggatgtacaattctgttttcgatgcatatctcttgtggttaatgagaatgtaatgcggtttcatcactgatgtgagcaaaaaaaagctgattgacacccaaatcagtaaatttatgcataattattttcctggcaataaatttttctgtgtttggaagatgaatgattcaattattataaaataacaaaaataaaacgaaaaataaattgtatgaaaagggaaaataaattgtacgataaaaaatatcgagttcaatgaatgctttattctgttttagaaattctcgaaaatctatgtatagaaaattactccgaaagattgaattatcgctctggaaatgagagtcatgacaatttgtacataatggaaaccatacaaagtctactcgtacataggcttaggctttattttgtaaaaataatttttgtacgagttgccattaatccctcggaagatataaaaattgctattcgaagtttttctctactcgtcgacattatcaatttgaaaaaaaaaaaaacaaactattggtaatgatatcctaaaaatataatgtcgaattttaggtaataattttaaatgttttaaatttgatgaaaaacaac

SEQ ID NO: 5131 - DNA, 1885 bp, Heterodera glycines
tttgattttcacatcactttttttcggagcgctttttcaaaaacttttgggaaagaaggggtccgacggtgccgataggcgccgccggaggaaattttgaaaatttgagtgtgatttgttaacaaatttcaacaaaaaaaggttggtttttgcgattattaagcttaattggtaggattttcatttaaaaaatgataaaatatgtatcaatttaaaaaaaactatgagtaaacatattttctttataggaaacccacgagtatacaaaaaaaaattgaaaataatctagtttctgtagagggattgaaccaggggaaagaagaagggaaagtcaaggagactagccattaggccatttgcacacttggcagtgttacttttaaagaatatattaattattattttttatttttccctttgactccaattttcttcactaatttttcactcagacccccattcttaccagtgcttgtttttcccggttcccggttgccctaccgggaccgggaccgggacctgagcttttcaaaacccgggaccgggacctcggatgaccgggaattcccggcccggtcccagtcccggtcccgtggcactctatttataaccattacaacaaaatgtgtttttttaattaattgcattcgattttttaagttgagaatgaatccaatcagcgccaaaatattgaatgcccactatgggctaaaacacccgcaaacaaagttgaacatcacccttaacgaggcaattgcacttggactttatgacccagtcacccgacaatttctcaataacaatgagcagatggattattgggattccttagcattccattcgccgaacactgtccacctctacgtcaaatttggggctataaaagtgacaccgatggacttggattatgcactgaagtgtaagtgggcgaaaaagtttctaaatacctaaataggattttcggcccaaaatgcgaatttaactaattttaaaaatggtttcgttttggccaaattttagatttaatgcgaccttaacaatacttggtacttgttaattatcttttcaaaaaaatttttgagaataaacttgttttttagttttttagcgtcggaaaacccgattctggcatctattttggttccgggtttgaatttgggccaaaatagattccagaatcggatttcccgaacctaaaatccctaaaagttttctttaaaaaataaaaaataaatttttttttttgaaaatctgtaaaaaagtacccaataattttcaatgtttcctgggtttcattaaacattccaattttttttatcacctatacaattttgtttaacaatatttcccattaagattttttggaccggtacgtcggagagttccgccttttggaataccaaatttctctgccggaggccctcaaatacggctacattgaaattcgcaagccacaaccgacatttgcattgtcgttgaccgattgcatcgaacagacttggataaacagagaaaccggactgttcattgcccgtcccgaaaaaccgcatggatttggcgaagcaatgcgtttcaatggtgacgggccatcggaaattttgaagtgcgatgtgcgcgagtgtttcgactcggaaaacaacacgcggttgaccattgccgaagcagtgcgccgaggaattttgaatctggcgaccaacacattcgttgacacaaagaatggcacacagctgacccttccacaggcacatcatcgcggattcattcataaaccgttgactctgacggaagcggtgcggatccaccttttggatgagaacgaacagtttcgagatggcaccaaccgtcacacactgcttcaggcaagggcgtatctagggggagggaa

SEQ ID NO: 5132 - DNA, 3375 bp, Heterodera glycines
caatttttgtaacaaattggactcaaactttcaaaattttgcccggcggcgcctatcagcaccgccggacctccatttccactatttttacaagttttgttgagaaggggggcgctgctgtcgtttgccgtactcgaaaaattcggaaatttgaaacaagtaaataatatttgaaaataattaaagacttaaatttttaaaagtttttgtttaataatatcttcgatttaattcgaaacaaatgtttttaaatccaaaatactgcaaatcatttaattcggatggcatttttcctttgactattttcgctacgttttaccggtaatttcatttttactaatataaccaaaacaaatccaatctgatcattccaacaaaaacgaatatttttaggagcaagtcaataattccatcattcaaattgattaatcacttctcacattcgtaaattctaatgcccattcggtccaagtgatgatcaatttgctagccaatcacatcttatttccattccgtgattttgagcaaatttaaaaaaaccaaataagtttttccggccgccagaggaaaaatagaaattttatccatttttaacagattttcactgaaaattggccatttttaagtcaattttgcgctttgaaaatcatcatttcaaaagaacaacaatcatcattgaccctgtgaaaccaccaaaatgatgataaatcattacatctggcaactctgatttaaagcctgatggataaagattttattatggcgtttagaataaacaaacccatgaatttaaatttattgacgaaataacttactgatgaaatctaatgttaccttaattattgtcattttattacttttaattataaatccaaattatatttaatgattttaataaagaaataaatagaattctgccgaatcaaaatcatcactccctgaagtgatcatttttcatttcatgaaaataattaatttaaagtagagtgccacgggaccgggaattttggcttaatcgggaccgggaccttttcgggttgaaaaaccgggaatttttggctgggaaaaccgggaaaaaaccggaactagtcccggtcccggtcaaaaccgggacctcggtactcagttgtccgctaccaggtcccggtcccgtggcactctaatttaaagaaataaaatttctcaaataaatttgtaaaatttaaaaaaccaaattttgcgcaaaccttatattttcttgataaaatagtgacattctgctataaaatttcaaaattttgaatatatttaagaaataagaacaaaataagaacaatagcccgaaatgaggacaaatcttacaaataaggacatttttattttgtaagatttggaccctccaaataaggacaaatcttataaataaggacagatccgagccctggttttaatagccccaaaaaattgtacaacattgatcattttgctaaacatctgctgttaaaaatgatttataaatgcacaaaaatttttctggcgccaaaataaaataattatttcggaagggaaaatttgaagtttagggcctttttaaagacttttatccttttttattagtgaaattgtattgaatgaatttatcgggataaatgtcagtctcaaaatacgaaaaatatttttggttttttttttgcataaaaatgctaattatatgagtgaaatgtttaataattactatcattttaatacttttgttaatcaatccaatttacatttaataactagggctcggaaaaatatggatataaaatcgcaaaatatgtgccgctaaaatttgctcacttttagcgaaaaaccaacccgaaaagcgaaattttcgcattttagcttatttttggcgtaaattaaccaattttatcaaagttcaaatttaatcaatattttcgaaaaattttgttaaaaaataaccttttcggaaattcaaaaaggccaatttaactgatggaggccattataataaaggttttctggaaaaatgccaaatatggacataaaatatggatataaatgccaaaatatggacaaatatggaaatatagacataaatagcgaaatatggaaaaatatggaaaatatggatatagaaatccatcctagaagcttaaaaccaagccaaaacatgtttttcatgcgttccaggccttccacagtcctggaaaaaatatggagatttccatataattccgagccctattaataaatttcacccaacaaagagtcttttggcttttcactgttctccgttggcatttcagctgggctattgagaatgcttatcgtgctgatggtgataataatgatgataccatcatccgttgctgaagatgagtttccaatttatgtgatatgtaagcatttacaaagaacgctacacagttataggcgatgccagggaaaaatttttgggctttaatgaattttgtaaaggaattagctaaataatgtaaattgcatactcttttaaaatattaaatatatttttaagtatgaaatagttttcaggacccggttcgaccctatacccgtaccctggacccggtttaaaaactttggttccggacctgaacccggcttttgtggacccggcaatactcggaccaggtttttgtcaaaattcccggactgaaaatttttcaaattccgcatttggagtaaatctaaatgaaaaaatcaataaaaaaatgtttttttccgcacacactttttccagaaaaaaaacattttggcaatagagggctggtggagccggtaggcggcgccagaaaaaattttaaatgcaatttgttaacaggtttacactaaaaagacgactacgaaaatttttcgaaaaacagtctcgtgtttttgggtctcggttcttgggttttcggtctcgagtctcgtggtcaagtctcggtctcgggaaatttcaggtctcaaacagcattatcaatcacttttaaattgcttaacaacagcttataaacatgtaggtggatttataattttgaaatggaataaagacgtctatacattaagccattaagcataaaaaccacgaaacaggcaaaaataggcattacaaaagtaaaagtcagacaacccaaaccaatttaaaaaatgctttttgcatgcatatttgtgcgtaggaagtgcaattgaacagaaatttaggcatttgcctaaaaaacgaagccctaataattattgtcattttattacttttattgatcaatcaaattacatttaatgactttaataaatataaatatataagtagaattttgccaaattaatttgatcactcaattgccaattcaatattcactataaatatgcaaaattaaaatgatcact

SEQ ID NO: 5133 - DNA, 1819 bp, Heterodera glycines
gagtaaaagttggacaaaatggtagacctggaagggaatcgaaccctcggcctttggtgcggtgatcggcttcccacccaaaccagtgctcttaccgtctgagctaccagaggctatctcccattaacgcttcccttttatggatcttttgactccgctttaagcgttttaaccgtccactagcttaatccttacaggtggatggacgatcgttcaatgagtttggtgagccttatactgtgaaagtggaaaaaacgcactcagtgaaaacattgaaatggaagatcagtcatgagattggcattttgcccaacaggcaaacactgagacataacaaccaatttgccattgtgcttaaggtatcttaacaattcgtacaaaggcaatttgtacaacacagggttggcttaggccgcagctttaggctttggctcaggccaaaatttgaggcttaggcttagacctaagtttgaggcataggctcgcacctaggtttgagggcttaggccaagtttgaggcttaggcttggccaagaattgggcttgcttggcctaggcgtaggctttatttgtaaaaaaattgttttgtacaagttaccattaactcattcttaaggacgagaaaaaaatggaagattatggcattaaaaggggccacaccatttatgtgtcggttgatgaatttaaaatttatgcgaaacgtaagcattacaatatacgctacccagtttgggtgagcagcacggacactgtgacaacattggaggaaaagttcaaggcggtgtatgaacatgctaatggttgtgaatgtttatcatttacgctgaaagaaggtccacgaggcagtaaagtttgggcctccgccaaaatggacgaattaggcattgaagaaggatcatatgttactttggatacccgttattgtgaggatccaccaagagttggtgaattttagggatgctcggcgagttgtcaacacaatttccaagacttgagaatagtgatcccgtaagttgattgagacagactaaaaaaagcccggagaaaattctggactcgagaaatgagaccgagaattgactctcatgagccggttgagacagagactcaaaaaaaacccggataaattttcgattcgcgaatttattcgacttgagaaacgagtctttcgagcatccctactaaatgcacgcagttcccgttgctaacaatgatcagtagggctctaatttttagatttttgcaaatttttcaagagctcccagtgacctgaaacgcacaaaaacccagttttttggcagttgttaagcctcctttcaaattattagtctctattttctaggttttatttttatagcctaaaaactaaaaaaattgaaagaaaaaacttattttgacttatttggtgtttttcccaaaataaatgcaataaaaccgaaaaatacagccctaagaatcgactcgaaaaattcagaaaaatacaccctaggtcggtaaattttctaaaattcatctccaaaattttattaatttatttcttgacaagaattttttggttttaaaaattatttatcttacaatggatttagcttaattttgttatctttttgaataaatttttgtcattttactccctaaatttttggctttttagtgcctattttccatttgtttagtgtctgtttttggcgatttttagaataatctaaaaattggagccctactgatcagtgaaaaaatctactccttttttgattgtccattttcaatggttcatttccattttcatccaactaatttattgcatactatcaattta

SEQ ID NO: 5134 - DNA, 985 bp, Heterodera glycines
  misc_feature (13)..(13): n is a, c, g, or t
tgcaggtcacaanaagagaaaaaaagttcaatttcaaatgaaaagggatcaataaaatttctctttgctttgctcgccctcccctcgcccattattttcctttgccttttcctttggtctgtctgtctcttcgtttgtctgttttctcccttttcccaccctttcctttcgtcgtcgcccttaacagctcacttctatagcacttctgcggttcatacacattcatattcatcatttcttgttgttcatttttattttccttttccattttaaatggtcatttgattaattccaacatttaattaacgtgggatgaaaattgaatagtaaaattgtccattaatgaattatattaaatgcctattttaattcgttaaacattttagtacgattattatcttgcacgaatccaattgtttcctatcttagacacttaaatggcactgaaacgtatacaaaaggtttgatcgattgttgatgcaaaacactgttttttccaggagctgcaggacctcggccgtgacccacccgcccagtgcagtgctggccctgtcggcgatgaccttttccattggcaagccaccattatggggccaccagaatcgccttaccagggcggcgtcttctttctgaccatccacttcccgacagactatccgtttaagccaccgaaggtggcgttcaccactcgtatttatcatccgaacatcaacagcaacgggagcatttgccttgatattctgagatctcaatggtctcctgcactgactatctccaaaggttttctttttggattagccatttaagttggtcttgttgtttctttttattaatagatgcgaatgcttgtagtgataatttaactaaaattcagagcctcaagatttttagcatattcagttctatttttgcccagcgtttaatttttcaatttagtcttgctttcgatttgctctcttctctgtgatccgaatcccgatgatcc

SEQ ID NO: 5135 - DNA, 7026 bp, Heterodera glycines
  misc_feature (7009)..(7009): n is a, c, g, or t
gcgttctgtcaaatcaatacttaaggcttggctatttcttttttgaacactgtatggccatcatttgagtcccattatttttcagggcttaggcaactaccgaaaattcacctttattatttttcaagattagggaactaccgaaaaattatttttgttggcaacttagggctatttcacttaaggcgtccaatcgacttaggcatccgatcagtggacatcctcaatttcttaggccataactttttctttttctcaatgctacatttttggtatcaaacgaaagttagtctcaggagtttacaatatgatttagagaataagaaagaaatatcaatgagaaacacgaaattcactcagtgttttcgagaacaatttattatccaacagcccataaattaagtattaaacaaatggcacggtcatattatattttatgcataaacacataattagtatttcacagttaaaaagtttgaggcaattaaatgggaaatcatcgaaaatgagaagagctgtaatagacattgacaatgagattacaaattaacactgtaaaatcagccacttgtttgggcaaaaaaagcacggggacggaaaccaaaatatgtttaaactgcgcaacaatgcttgagtaagacttaattcattattctaaattcaactccacaatttcgacaatgtgagtgaactttaaattaggtataaacaaatgaaaatatggacaagggatatcggcgctacttaaatgacagaaaatgtaaattaacaaatgcaaaacccgttaagtgagttatcgaaatgcttttgggaaaaactttggattattaactttcctgcgatgaatcaatgttttagatgctaactaatcttggcacaattttgagaagagttcgtttgtcctatttctgagttcgtcgtcatcagattcctctgaaaaataagcgtaattaaagtttcataaaccacaaaaaacaaaaacaaacgctaccagaacaacatggagagaattggattcgattgttgtcgttgctgcaataaaattctggcggactgagagagttctgttgaatttgttctggttcctcaatttgctcgccggttttcccggaaaattctcctctttttaggggtaagtctaaaaaacatttccttcggaaaagacacttttgtgagtcactcacattgacttggttcagtctttggctgtgcgttcgtttcaatcttttcctcattgttcccagttccaaatcgtatttttagccttggcactttcggtggcgcctcttcctgttcttccggtggttttggcttctcctcgtgacttttccttttcctgcttttctttctgtgttccgtcgatttcacctccacgctgctatttcctcctctattcagaatcaagcgcaatttcaaagggtcgccgcctccgttttccggctttatttgacagttttttggtgttgagtgtccatttgtcaaatccacactttctttgttggaatgaaagccatggccgcccaaattcgagctgtactccggcgttacgttgttcgtccctgtccaacaagccaaacgactcagtgaaattttcagcgattgggtaggcattcggtcgtcgttttggaggtgtacggacgatgggcttggctgcggttcgcacttatttaattcctctcgttccttcttcatccgctcctccaactttgcctgtttctttttctcctttttctccgccttccgtcgtttcttttccgattttctcatcatttcttccctttctttcttttctcgtccatcctttttttcttcatttccgttttcatgggcatttctctcctccaccttgttaatattcattttgtccaatttaattttcagttttactggttccttatttacttctcgttgttccttttcctgaaaatttagcaatttgtaaataattattgcattcgttaaatttcttactttcatgaccctttcccgaaactcctcttttgaactctcttgctgatcattcaatttaatttctgcgccattttcatgagtacacaaaagtgacttcgtcatggcattgacaactgaattgttgccgtcattttccaacggtttattgtcgcaatttgacgaggaggacatcgtaacattttggcgtaaaaactcattgagaagaatctctgaggtgagcgacggaaccaatgggtcggacgaaaattctgccgatggtaatgtcgttgtcgtttcaaaagggaaatgctggggtgttgcagagggagcaaatgaatgcacggagacagagacaagctcatccggcgactgttgggtcactttcagttcgtttgatggagaacaaattacatcctaaattaattgttagagtaaatgccgaactattttttggaaaatgttctgggttgatttcatggtccttaaaaattgttcatgttttggaaccgggactgatttcccctccgtccgctttgttcattaccttctcgtcttcttccctgctctcggtgttcatccgctgggactgctccaattcctcgtcgttatgttcactttgtccgtcgtttggcgaatgttgcgcatcgctttgtccattcgtcgtgccgttctccagcgccgcatatttcggcaatgtcagacgaatgttgccaattttggctggtgctgtttcgtactcctcttctacgaatcccctttgtccctccttttggtcggtctctccgtagtcagtcatttcgtcttctgtctcttctacgattttgggcggcgattgcggcggagaaacgaacggagaaatgtccttgtaacgttctctgtcccaactgtcgtcgtattcccagtccaaaaaatcgcttgacgagttaattggaaatggaaaagatgctcctgaaaaaggaagacgagaatggcactttcaaattaaattaccccttgcttcggtggctttttggagtttggccttttcaaattcaacatccaaacggagcaaaaggttcctctgctctttcatttcgcactaaatcccgaaggtttctattcatttctcattatcagcgttttccatttccttaccaatgattctgtgaggaaaatggattggaaacgttctttcaacgaatccatccgttcgcacaaaaattcggaatgcctttgcaattcaccatcaactgaaaagcaattcaattattacgttaaaatgcgtttactcacatttttgtaggaaatcatcggacagttcagtctcggaataaagtccaaaaggaagaagccctaaaatgtaacagttttccatcagactttcaattaaatagaaagatcggcttacgttttacacagtccattttatcggaaaagggcgttttgtagtccaaagtcggaatggatgaacggagagcagaaaatgcgtcggacagtcttcaattagaggggaatttgcttaattttccaaattaccctccccctccaaactttgtcctcctcttctccctctccttctctcttttgaccctttctctttccttttcctgcgctatttgtgcttcgcttttttcttcctttttgatttgctgcttttgtgtccgaacttctctgattgtcgttgctcaaatttgcattgtttttaattattgtttaaaattttgcataaagaatttgtacaaaatgaaaatgagttgtgatggaaaacaattagaaaaaagaaggcaacctttcttttcggttggagtcacatcagcacaaacgggtgaagaaattttgagagaattggcaagaaatggaacaggaaattttggcatggaagttgaggaagaggaagaaggaaaatgattatgggagaaggaagaggcagaaggaagttcagaatggacggtgtactgcttgaacttgttgttgtctgaaaggaaaggggacgacgtattgacagaaaaatggaaattaatcgtatttatacccgggtttaagccaacggcgtttacgggcgatggatggcaaatggcttcctggggtgtcaaaagcatcaccggctgatggcaagttgaaataacggatacgggcccattcgacaatgaaacagttgacggcacgttatgcttagaagaattttgcttttaaatagattagaaatatcccccaacagagacttggcacggatatttgcacctatgccgaaccaaaaattcaactttgccaattcattgtctcaaaaagataaaaaccatattttttgcatttttgaattaattcgcgttttttattcgtgatcatctaattcttccccccccaatgtgccataatcccttgtcaccatttgcgtctgttgtgccattccatctgtcctttgtacattttgctgttccgtcttcggtggtgctttttttctcgctttgctctttttcttggtcgttgttccttgcattactgatgccgttgtgccattcccctgctgtgtcatggcattttgtaccaattcggcaattctcgcttcgcatgcccttagttgctcgcgcacgtcaatcccttgctcttcttgctgaaagatgcgttcgttttaaagaaatggcaatgcaaaagcatgaattgcctctctcagctgttttgtctgttccaacactatgccaaattcgatggtccgttgggggtcgaattggaccgtggccaggttcgagttggagaataacatcgtggcaatctggtccaacttcgtttcactggtcccctgtgcgagttcagtgccggacgatgagttcgtttggttattgttggcagaaggcttcattttggtcggccttttcgttgacttgaactgattttggtggacgagtcgaaattccatggcattttccaccctcagcgaaaattggtgttgctgaatttgtccatctcccaacacaatttgttgttgttgttcagaaaatgacggcacattttggctctaaaaaaataaataatttttgtagctttaaatattccttacattcggaaagttgttgtgaaaagggacattatgatgagactcaatggcacccgaagagcagccgtacgattgtgggggaaaatgatttgccgattggtcatggacaattatcctagccgttggaaatgctaaaaaaaccaaaatatcaaaggtttccggccaccatttaccatttgagccgtttaatttcgccgtctgtgtccctccgtattcgttttgctgttcgaattggtgccgttgtccaatgccattgtttccgcccaattgcgtcgtccacctctgctgctgcggttgttgtgcgtgtctttgcctttgctgctgctgttcgtcccttccgtttagtttttgtaattttactgcgttttgtgtcggtcgaactgttgaaaagtcgctgctcgttgttggtggccaatcggcataaaaacactctctctgcagattttgagttccgtgcccattttgctggactgctgctccattttctccctccaatgttccaatttgcgattgggtgcccaattgatggcactcaatcggcattggattaggatgaacttcttgaacaactttggccttggaagagggacagttgaccatcttctgctgctgctgacaatgactgcccaattcggtcaattgcggcactgtcccttcggcggtggcaaaaaacatttcatcaaccggcacattcagctcgaggaagtccgtttggccatggggtggggccgagtggaagcagctgaagccgttttcgagcggtgtgtgaaatggactcggctggggctgctgctgttcgaccccagccaacggatgtggctttaccacctcatcctcggcagactcttcgaaccagtccctaaaaaagcaacaaaaagtgtttctttttgaaatacgacgattgttttggggaaattaattaaaaagaaaaaacgattttgaaattaaaatgcactcactgatcaacaaaatcgtccatcattgtccgcgtaaattttgacgatgaaagtaacatttgctgcggttacaaaaggcaatggtctggacacttatcattccccgcattcgtttttcatcgcattttaggaacagaaacgaaaatggcaatttttaaaaagtaagcaaagggccgacaaaaagaattggcaaaccctaaattacaactgttatttaaagttaaaatgagaattttttaacaataagcaatgattttacatactctaaaaagtctgatcaattagttctaaactgttgcaatttctttaatctcttaatctgttttgtttgaccaaactatttacctacctaattgtttatttgttaattgattttttaattaggcaattatattaaattcgtgttcgtgccattataaagaaatgcaaaattattaatcgcacttaaggggggcggggggggggggggggaggagggaatcccaatcccctgcccacttcgactctttctgccgttgtcgcttctcttctcacaatttcaactcgttcatccaccccttcccttccctcactttcttcgccctcattagctcatcaatttctaatacgtattattggtaacaataagaaaagaagaaacgagactgaagaacaaaaaagagagggaagaggggaagagacgaacggagcgagaagagaggaagaggagagaagaacagtttcgctgttggtaatggtgaacatgaaagaacaagcacaagcacaaccctcaacaaagaagaaatgagtaaagacggaaggggcgagagaattgaggagacgcggacagagcgagagaaagggccaggcaaaaggagagagtgcagacaaacagagcagccagagaatgtgtgggctgcagacgacgagagcgtggggaatcgagcgcctggcgacctgccagccaactgctgatgaatgcccaaggggaggaatcaattgcggtggggcgggagtcggctagttgaggtgacacgcggcagaaaatggcaacaaatcgcccgagaaaggcgtgagaacggttaatagccanaattaatagccaaccca

SEQ ID NO: 5136 - DNA, 1372 bp, Heterodera glycines
aaagacgaaattaaaaaggtatgtattgtaaaattggctaacttaaaatttaatgaaaaatgccttgattaattaattttatattccgattaaagtgtaattaaattactttttgtcaaataaaaaatttaaataaaaacccatttaaataaatgttaaaattttattaaataaaaaataaaacatttttaaaatccatttattatatatatatatatatatatatatatatatatatatatatatatatattttaaagaaatatatctaataaaaaataataaatggtaattattggtaattaatttccccaattaaataaaaacaaacttaattaaaaataattaggaattaaaaaaaaagcattcatttataataatcaatttttcatagtgatttaaaaagtaaaatttgaataagctaaaaattacaattaaatttaaatttgttttcgtcagatgaaaataaaaattcaaaaatatttaaataatttttaattttattaaataaaagataaagccttttttaaatctatattattttaaatgatttaaagaaataatttaatatttaaataataaatgatattttacttaaccatttaaataaaaaccaaaattagataatataattagataaaattcttttaaaacaaaatgaattattatataaataataaatttttcgtatagttaaaatgtaaaatcaaataaatcaaaaaaataaaataatttaatttaattttagaaattttaaaacgaggatttgaataattaattaaattataataaaatattacataaataataaaaaattatttatttgttgcctgaaagtccacgtcaccgtcaagcgtcaagatgaacgtgttctcggacaacagctctcgccttcgattctcatgcactcgcatggcaagccgatagccgagcaaatagtacaaatacatcacctgtaaaaatttccaaaaaaaatagccaaaaattttctgaaaatttttcttgtgggttcggtttaaaagaatttttcaaattttctaaccagttgaaattttcgaggggctttgaatttttttgtataattttcagaaataattcgaattttccgaaagagaattaaaagggaataaaataagagaaaaatatttttgcttatttcttggacttagaatttttaaatttttttttcccctaaattttaccaattttcgcgtggctttgaatttttttttctcatttttactcacctgactccatcgttttcgttgtcggatcagccatttgtttttcagatgaaccgtcagccgatttttcccaggcaaaatgtagctaagaaatttattaaaaaaattagtttttttaactcaaatttt

SEQ ID NO: 5137 - DNA, 2162 bp, Heterodera glycines
  misc_feature (69)..(69): n is a, c, g, or t
tttaattttttttaccaattaatgcttttaatttaattatactctttttgatttaaaattttcattacntttttcatttctttgtaatataaattagtgtttttaatatcttaatgcctaaaactaaaatttttaagaaaattttcaaaaatttatttcaaattaaaactcaaatattttttaatttaatttttacattgttaattttatattcaataaatttgtattattttttttcttattttccatgcttaaaaaactgaaaagatttcacgaaatttcccgcccccccctaccaacccggcaccggtgaacagcagaggcagccgcgtccatgcaggcgatcagttggcgcacaaatttgttgggccgcggcgtcgcggccggctcagcactgtccagctcgaacgcgtcgtcaaagaaaatgtgcgcctcgaactcgtagtagtccgggtcgaccaccttcaggtagcgctgcgcattccgtcgcgcgcattggtcctttaaattttggaattttcgtttttaagattttttttaaaaatcttttcaggcgcctatttaaaaaacattgagaagtgatcggaaccgtaccaaattttaaggaagtctaaaaggacaaggaaattttattctataatttggcttttgtttttctgattttttgaggcagttataaatgattaaattatgattttaagtctaatattctgtgtatatttctgaaattaattcacatattttttactaataaacaaaatatagattcttaccaaaaaagaattttttataaaaacataaaagtgcatcaggaaaataaaatgaactagacgaaccataaattattcataaaagaacgtggtgagccgaagtgacaaaagtctgaatgtttgtaataattaaatttaattattattttaattaaatttgctaaataattaatcataacttagcttaaactttgtcaaattaatgaaatttagtatttagcgacagctcaaagtaccctctactatttatgtaattttttaaaaattttgcataaatttacaaaaagtgtaaccaaaaaagtacgaaaaattttgacttaacaatttcgaccctaactttattgaagttcaataaaatttttcgaattttaatataatattagagaaatctttgtgctatctaattatataaataaaataaaattggttatttctgaaaaaagttatgaaagaattaatagtgttatatttttatggtcatcaaaaaaatgtaagatcgtttaaatgcatgaaaattgtgccaacatcaattaatcacactgaacttgatatgaaaagatagcccaaagatttctctattattatgttaattttcgaaaaattttattgaacttcaataaagttagggtcaaaattgttaagtcaacatttttcgtacttttttggttacaattttttaaatttttactaatttaaaaaaaaaattacataaatagtagaggttactttgagctgtcgctaaataataaatttcattaatttgactaagtttaagctaagttatgattaattatttagcaaatttaattaaaataataattaaatttaattattacaaacattcagacttttgtcacttcgccacattcagacttttgtcacttcgccacattcagacttttgtcacttcgccacattcagacttttgtcacttcgcccacattcagacttttgtcacttcgccacattcagacttttgtcacttcgccacattcagacttttgtcacttcgccacattcagacttttgtcacttcgccacattcagacttttgtcacttcgcccacattcagacttttgtcacttcgccacattcagacttttgtcacttcgccacattcagacttttgtcacttcgccacattcagacttttgtcacttcgcccacattcagacttttgtcacttcgccacattcagacttttgtcacttcgcccacattcagacttttgttacttcgccacattcagacttttgtcacttcgccacattcagacttttgtcacttcgcccacattcagacttttgtcacttcgccacattcagacttttgtcacttcgcccacattcagacttttgtcacttcgccacattcagacttttgtcacttcg

SEQ ID NO: 5138 - DNA, 1474 bp, Heterodera glycines
aacttgatcggaaaagataggacaaagatttctctattattatgttaattttcgaaaaattttattgaacttcaataaagttagggttaaaattgttaagtcaaaatttttcgtacttttttggttacactttttgtaaatttatgcaaaatttttaaaaaattacataaatagtagagggtactttgagctgtcgctaaatactaaatttcattaatttgactaggtttaagctaagttatgattaattatttagccaatttaattaaaataataattaaatttaattattacaaacatcagacttttgtcacttcgcccacattcagacttttgtcacttcgtcacagcaccataaaagaatagtcatctatactatatatataaccaaatttaagccatccaatattacattccgtgatataaatatatgcatagaaacatatacgaatattcccgagtatatcgcctgggtatacacataatttatagtttataggttttgatttccgtttatatcatcggacccaattttgtattcctatagcttgtatctttggacaggcaatgcatatgcatattcatggatgggatatatagagttcccacggatatgatccccatcagcaaataatattcattcacttcgtcaagacgcagaatggacttcagcatgcacgtcatctccagtgcactttcatgccacattgttgcgcacacataaattttgcaaatggcatcagcggcgctcggctgctccctggcaaaaaaaatatatatatttaaattttgaaaattcataaattgtaaagcgcaattttttgagtcccgagattttgtctcgctcttgagggatagaaattttcaagaaaaaatcttagaaattgcattaaaagaaaaactcgagaaagaaaagggtttttcaaaatttatatatgaattactaagttttttaaaaaaattttcacaataatcactggaaaattttaaaaaatttcttaaattcctaagatttttccagaaaaattcctaggtttcttagtcaattttcttcattttttcataaaattcataaatataaaaagttgcatcgcaaactcagcgctaccgtatcagccccccgcagtcgggcctcccgctgccggcggtcagttggctgctgcacaatgacggcactttacgcgacgccatgccaccaccggcgggcccaccaccgcgctccaccagatagtcagagatggcggtggactcataggtgcgcacactgctctccccgtcatcagtgccatcatccgtctccaactccttgtgggtgagtgaaaaattgggtcagattttggtgaaaaagttggccaaattttgatgaaaaatacgccaacttgtggtgaaaaattggaccaactatggcaataaagggacaaaatgtgccaacaatgggaaaaaatggcaaaaatatgccaattatggtgactaa

SEQ ID NO: 5139 - DNA, 1393 bp, Heterodera glycines
atggagattttttcagcgtttaaaaatttcaaccaaattaaagcgaaaaatatccatttttaatttatttaaaaacaaagggagtttgaatctggcagtggccataaacgctggcaaaacttaaaattttcactaaaatttctaaaaaatcgaaaattttcaaaaattccttacattaatctataaaaaaaaatttgcacatttttctcatatataaactgaccagcattgtgccaaccaccagctgagccaaagcagcatcgcagggtctgtccaaaattgccaatggaaagccctaaattttatggggaaaatgccaacaatttaatttggcgcttttaatggcacttactggtccgggcatttccagaacagctccttacttagccaatcgttcatatagcacgcgttttgtgtatgactgaaattcttattatttttttatttaataataaaaattttaaattattaaaaatttaaatgattaaaaaattattaataataaattaaaattattaaattatgtttttttaattataaaatttgcaaattaataatttttatattttaaattattaaatattattttaataaaaattaaaatttttaaattatttttaaaattatgaaatttataacataataaatttttatattttaaattgttataaatattttaataagaaataacattttcaaaaaatatttatttttaaaatataaattcgcaaaataataaatatttaattaaatacacaacgttctaatttgctgacctttcgcacgcatgcgcgagaagaaacacgctgagcgggccgctgagcatcatcggaaacgccatgccaacgcgttgcatcacaacctgtgccaaaatattttttcaaaaaaaaataataatacttagctaaaaattctcaaaaaccaactgtgccgttatgccttcgtgagaatggcttacttgattacttactttgcatgcaaacttggcgctgaaatggcatagcagtgcgcacgcaacttggaacagtgcaagccacagcgcgtcgtacgccgtggtgaactgattcaactccacgcgatcatcgtaaatctggtggaaaatttttagagatttgaaattaataaacaaaaaaatatatacccaaatttcaaaatttaaattttttgctttaaattaaaatttcgataattttctaaaaattttttgaaaataattttcacattgtatgccgaaatgatctcctcctctcctgcctgctcctgcatttttggtgcacgcttttccacccggcgatatgcctttttgtgtgggccaatgtgccgctgcttggccatggtcggctttgatcggttcatgagcattccctcgccgtcgctgaactgctccacaacg

SEQ ID NO: 5140 - DNA, 4754 bp, Heterodera glycines
gaaaccatgataattttttgatgctccctaatttcttaggagaaaataagaaattttataaagaaaattttctagaattttgcttttccttcaagcaaaaaaatttttttttttttaatttcagcaaataatttttaaagaaaaattttatgtgttttctcataaaatttaaatttccgcagaatttttaaaatattccccaaatttctttaaattttttttaggaatttttcaagtgagggggggggggtggatgacagttttaagaaatcgcatagatggcagttttcaagaaacacactagcgccctgaattttctgttctcgacccttgtgaatttggaatccgttcttgaatccactctcgacggggggagcggtcggagaagagattcgataagagtgccattgaagactcgaaagctctcaattacgaatggcacccaaaactgggagaatgaattccatggcacgggctcaatggctgacattcaagcgccaaattaaacaaaaaatcacctcgtcaaagcggtatccactgagcgcgtccacctccgcaacggccatgtttgagcgggcaccggcacgcgtgtaactgaaaaaatggcaaaaaataaataaaataaaattcctagtgatttaattcttcttattgttaataataataattaattaataattaaattcaaaattaaaagatgaaaaaagttgaaattccaaaaaaaaaaatttccaaatttttttgactatttatttgatcagaattcaaaattttctgatcatttttttaatcaaattcatttactgatctgatccttttttgatcaaaattcaaatttggcagtgccaaaaatgtttttctgttttacgcacttgcagcacagctccaactgcagccggttgccgttgcgcacctcgcgcacttctttggcacaataaaatggcacgtcctcccgaagggtttggcgatggtaggagtattggacctgcacaaatgccatcgatgtgccgaccgcctccagctcgacgggcgcgtccaaatttggcaactaaaaaatggaaaataattaatttaaaaaaaattgcaaaacgccaaaaacagggcaattaagcaccgagattgtaaaatgccaaaaacagccgcaatttcaagcgcgaaattttagaaaattcttagacaaaatacagtcaaaaaactcgatgaatcagagaagaattatttatgaaaaaaacaaattatcgaaataaaaaaaattcactacttttgtcctatgagcttcaaaatcggcggtaaaaaaatgcggaaaattaaagaaaaaaaattgtgtatggtttttgtacaagccataaatatttataaaatctgttagatgctctaaagaactgttttgagactcatagaaatattaaatggcaaatttaaaatcaatcattgattttttagccaaaacccaatgggtaaataaatccaaagagttgaatttaaaaccctggaaaattccagtttaataaaagtaagttagcacttagttttttaaaagtaattactaattagtaattagcatttaccaaaggattaaatctatgattgttggctaatcatagacaaaatcagtgatatttttaagatttgggcaccatttaaaaccaccaccatcaaccaccacacctcgtaactctgcaggacaagtgcgttctgtgcgttgatggtgaacaaatgtgtgtcctgctgtccattctgcactttgatgctcaagttgaaggagggcgagtaggctttttcggcatatgcccccagggattggagtgccatcactgtgtcctggggggggggggaagaaggggtttttttttgaacaaaaaatcataaaatcataaaacaagaaactgattgatcaagattgatcactggttagtccaatcaatggatttgatttgggatcacaaaaaaagcggttatctgacccaaaatcatacggaattaggcttgatcagtcaaaaaaaaagattggtcactgattttggtttgatcaatgcttcttttttaaaccacgtcatggtataaaatccaacgattaagcacatgcttgatcaagccggtttcgagattttgatcttttctatgatctagtggtgctatttgtattcagactcttctgatcaattaccggatcctttttattgcattttagcgccaaatttgaattttgaacaaatttccacctgtgtggatgaaaagccgcccagggaattgcgctgcgcggtcagccaacggacaatgggcagcgcgtgctctttgttgtccagcagcatgtaagtgagcagggcataactgtaaaaaaatgacattttcttttttggcattttttaaatgaaaatttgaaagccgataaattgagtacgagagactctctccctctctctctgtctctctctctctctgtctgtccctctctctctctgtctctctccctctctctctgtctctctctctctgtctctccctctctctctctgtctctctccctctcttcctctccctctatctatatctctctctccctccctcgctctctctcttaaaaaagtcgtccccgaggggactcaaacgtacgcgctcatctcaacgtcggccggctggggttggaagaagtactggttggtgtcccgggccgcaccgccaccatttttagctgctccaccagtgccatctttggcaccgtttgacaccttcgtcgtccaatggaccatgccatctgatcagagaaaaaagggatcaatgaatcaagcgcacatttgtatgatcgaagggagaggatagtgtcagagcacaaaatgctattatatagaacaagatcagcagcagatggaatcaaaacttcggattatgttctacaattatattagctaatcagttaatatccaggggggggataatcccgaactccgaccacaagatttcaaaattctcggaccatgtatcagttacatgcgttgatcaggacatttctagtaactaatcaatcaatatccaggggcggggctaatctccgaacctctgaccataaaatttcaaaaatttcggcccatggatcaattataaatgcgctgatcaatctgctgtgatgtgatcggtaaatttagaaagccaattacatgaaagtgatcagtcagaatcaatctatagtgatcagaatcttccaagtccaagcaagaggaaccaatccgatcagaatcatttgggctgatcaggaggaacccatttcctggcataaaaatgccaattttgtccacctgtggcgccggtgatttgaaggccttccagcatcttcagcacgtcacccttcttcggactgttcgccaaatggagccttaaaagggcgcaaaaattggggaaatgtttgaaaaattgtttttggcaattttttacacgtaagtgcacaacgccaacgcgtacgggtcctccttgaagtcggtgaggtgtgactccaaatagcttcgtgccaattccgtcactctgtgtatacagtaaaagtttaggggttaattattttttttattttaacgaataaatttcaattttttttgggttttggatttttgaatttttccgcacttattctgcacgtggttctccaacagtgcaatcagcacatatgcagtcaatgtgaagccgccctccgatgcgccgccctgcatcaatttgtggtgcacttcgccacgcttaaaatttaacaaaaaatttgaaaaatcacattctctggcggtggttttcggtttcgtaatctatggatgattctcgttttcgagagtctcgagcccaatgctcgatcggtctcaattctcggtaagaaaaaaactaagtttttgattgatcaggcttagttattgactgaaaaggcttatttattgattgatcaagcacaattattatttgatccgacttatttattgattgatcagaatggtgcataaagtgtcagctgagacgtcttaaaattttttattctcattccaaaaatttacctcaacaaaagcgccattgtccagttgttgcgaaatcaggaaggcaatggaatccttgaaattttttaaattattttaatttttttttggcattttgtgccatccatgcctcgagcactcggtcgtccacaaaaatgtacgcctgtgcctgcttgaaggagcggagcacaaacgcggtcagccatgtggagccatgttgatcggactcaccgaaggcggaaaacgaattgtcggaacgcctgggggtgtaaaaaaatttaaaaaattttttgcgaaaaaccaggccccctaattaacccccccccccctcaccggtaagtgagctctcgctggtagcccgactccatgtacttcttggccttgagctccagcgacgggttgacacgttgggtggcacgcaggtaacgcatgacgacaatgttcggcaccaactgtttgggaagggacaggtggagttgggaagggttgaaaattttcataattttagaaaattaataaacaaattaggcgacccaaaattttatataggaggttaaaatttaaaatttttaaaattttcttgatacattttgttgaatcaagagataaatttcaaacacttaaattttgccaagaaattttcaaaacaaattgtgaggcttttttgaggtaaatcccaaagtatctaaaaattttaaaaaatttttgtgcgtaaatttttttttgagttttttttttttgattaaattc

SEQ ID NO: 5141 - DNA, 1231 bp, Heterodera glycines
  misc_feature (140)..(140): n is a, c, g, or t
tttttgtgctcacgatcaacgtccactcgagccttgcgcgatctgaaaaagtcattctgatcaaagtaaatggccaggcgtaggccaaaaaattatttaaatttttttaatttttcaaaaattattttttaaagaaaatntaagaacgaataaaattttttgagcaacatacccaagcacgtgatcagcagggaactgtagatcaaccactttgcggtacggcgctgaagcggctgtggccattccaccgctgccgtttgaggcctgcggttggctgctttccgaagcgtgggttggtgaaggtgtctgtaaatttcatggtgatgaaaatttatcccgatcaatgtccaacatcataatcagacctgttcatacataaaaaaggggggtggttcggaaaaattttttgcgaaggggggtcgggccgtccgatgacattttttttatttttttgcttttcaaaaaccgtttttttcggcgcggtttttccaaaaaattttcgggaacaggggggcggcggtgccgataggcgctgccggggaaaatttctgaagttttgggtgtgctttgttaacagattttcaccaaaaatggccaatttttgcgattttgagccagccaattttttatgaaaaattgggatttttggggtccggcggtgccgctaggcgccgcctgggaaaattttttgatttttaatgaatttgttaagaaaattttcaaaatttgcgacccccctcgctgcgaaacccctccccctcgctggctccgaccccccctaaaaaatgtatgatcctgttcattatcccccgatcaatgtctgacatttaagactccttcgatgaatgttaaacattatgatcaggactatcctgatgttcatcatcgtcaacatcataattagaactattctgtccaatgttcgacaattacgattaaggactactccaattagtgtccaatatcatcatgatcaagattatcccaataaataatccatctgatcatgataaagaaaaaatgactaccgtcgcgccgctgctcaggtccacaatcagtggcacgttgcggtccacgcggtacccttccggctccacgcgcagtgtttgctccaacgcgtcgctggccttttccgcctgccccaccacgctcagccgcagttggccaacatccgtgaacacaactgggaagtaaacggcgcgggacacaccgccgccggtgaccgacaaaa

SEQ ID NO: 5142 - DNA, 3331 bp, Heterodera glycines
aatttgcaaaaaatagcactttttacagggttttgactttttagggggactttgtttggtgcattgtttccgtcacccctccgtgccgtcccctggttttttttttgtataaaatttagctaaattttcgatttttaattttttaaggggagggcaagacgagtggttcccgattttcgtattgaaattttgaaattttcttagtagttaaggctttatagggcaaatttttcgttttttccgcactttttcctaattggcattttttgtatgggtttattcccggaaacttcggcactttttattgacattttctaaacttttcgggaagcaaaagttaccctttcttaatgctggagccgtccttttgcagaaaatcaaagccgggctggtgcttcaatgttacagtgacctgtaatacaagtttggtacggtaattacggtagtaatacagcacaaaagttgaggattaaccctccttatgcccgaaatttctcaccaattattggggaattctatagaaattttagaacaaattttcaaaaaatacaaccccctgctgattttataaaaattttttagagagaaatttgttaaatatggcattgatcagagaagggcagaaattttctgatcatttggttgtcgctttgatctatttccgatcacttttgttttttcctaattcattttgcctacttcctgctcattctccaagtagttgaacacgagcacttgcaatgccatcttttcaccacgtttcaccgcataaggcagctcaagacggacaaagaacggcctgaacaccttcagcttgacggtcgacggtgccaactgaagaggaacgggtgggtggatacggtagtggatagaatattgtgcagtacacaacggtacaccaatgagggatgtacggtaaagaaagatttggaaggcttaatgtgccaaatttgtacggcacgtacattaacatcgtatggaatcgaaatggcttaaaccacacgccatatggtataggttgtacagtataccgcgagagtaagcgtataatgtgaaaaaagcgcagagttgcgcatgtgtgttcccttcccacagggaatatggtaggaaacgggatacggtagacagatttttttgaaaaattttttaccccaagtccggctttgtcgttgatggcaaatgcggatgccacccatgaagtgatcgtgtcgggcgccttcgcatcgtacaccacctcaccgctgtcgctgaaatttgttataggtaattacgcttaatttttttttaaattttcccccaaaattccaaggttaaattaaaaaatgtcccaggaaaaaaaatttaaatgaaattttgacttttcaaccctttattgcgcagcaactcagaagcatcaatcacactttcacaaaaaatacaatataatttgcgtttttttttcaccattcaatgtcctttaatctgttaaaaaacattggcattttccaaagatgccattttgacggaatgtccatgacaattgggcaatttgtccatgttttagttttgcaatttttgcaccgctttttacagtattcaaaactccgccaacaacaacaacaccgtagtctgcgcaaccttttgccatcatcatcagcagcagtgtccaaaccggcccaaatccatgtttccgggaattccgatcgcacttttgtcggtgccgatgccgacgccagcccaaaaatgccactatggagttcaccaagtgttccataattaggatcggtcatgatgcctattgtggtcttgattgattgatcgatcagattggtgatcaacaagcaaatgaataatgatgcatgatcagcagaaacgagaaaagtgctgctgattatgaaaacggtccgaaattcgctatgcataaatttttttttctgaaatgggtctaaaatgatcagaaaaaagatcaatttatgtgtgtgtgtgatcagtgaggctaaaaaaaaagaaagaaaacacctgctgctgatcaattagcaagaggatcaaaataattgttaaggtttgacgtaaataaaaaggtgcgagatcatcacccaatcaattggtgagtgacctaattagtgtcaattaatgtcaataatattgattagtttctgacaaaggatgatcaaagcgacggtggatatgataggtgatagatgatgacacgcaaaaagcacaaaaaatgcaaacgcattatcagacacacacacagtagccgcataagatagcgagaatacacacgagaatactgttcctaccgtatgcccccattactgtagctacagttggggccttttcggcatcaaccaaaaaaagggatccaacccgtttccaattgcttaaccctttcaatgcataaacaaattatctagtttttggagaaatgccaaagtccgttttctaccgtatccaaaattctataccaacaccgtaacccgtgcaaccttttcccatcaccagcagcagtgtccaaatctgtccaaatccaagtttccgggaattccgatcgcactcgcgccggtgccgacttcggtcggtccattttcaatgagcgcaaactggcaccagcgatgggcgggccgccaaagtacgaaatgccgggattatcttccgccagcatgtacgcagttgcaactcctccaactttatttttacatttattgactgatcagtgatagagtgatcaacgagcaacgatcagaaattagtggaggtgattatgagcaattagttgctaattggccggtcccattagcattgggcagcagcaatgatcaaaaagtgttagatatgaaacgagggaagtgatggacaagtgcacagaacaaagtgatcaaaaaaaaccatcgtacacgtaaagcatgccgacaaaaggataatggtacaagggatactgtaaaaacataacccgctacaaaaatggtagaatgatatcccaaatagaacagtatgcactgcgcaaaaacggcatatttctgcccaaatattacaaaaaaccggcgcgaatatggccaacaatgtccagttattacagtattcccgcacaaatacgcgcaaatcattgtccaaatagtgcggtatgtactgcataaaatacggtaattacctaaccatcgtctagtagtattacagtatgcctctgcacaaatacgcaaattaggcactcatcaccttggaccagctgggtccagcaggtcggcccatatccacgcctccggaaagtatttgcgctggcgcggtgctggcaacagttgtggcaccggcgcggtaaagcgtgacaccatcagtggagcgtttgacttggact

SEQ ID NO: 5143 - DNA, 1465 bp, Heterodera glycines
  misc_feature (14)..(14): n is a, c, g, or t
atcaaggtggaganagtctgatcaatcaatcgacaatcaatcaacgtccaacaatgagtgatcagtcaatcaaccaaaaaatcacgcaaaagtgatcaatcaaatacaataattttaatagtggaattgtgctaattgctgcaaaggaacaccagggaagtagtacgatggttgagtgaatggcacgcaaaatgccatcagaaggatatacactatggcttaatagcatacggtcagagccatactgttcgaagcaatacggtaattaatgtacgcgcttctaatatggtaataaacgctgttgctatacagtaatgtgtgcgcggctgctgtcctactgtaacctgttgctgggcgtgacaaccgcatccagatccgcccatatccacgtgtccggaaagtgtttgcgcagatgcggcgccggtgcttcgcgaagcggctgcagcgcctggggggcggctacggcggcggaccgtgccatcgcgaacatcaccactgttgtgtgatcagtgtgtgagggttgtgatcattgacgaacaaattttgatcagtttttaatcatagcaatcagaaagccacagaatgatgagagaagcggataattgaagaggagaggttgttaaaggcgaattcacaaataatatgctgtaagcaccacaacaccacacaggaacagcagagagcacacacaacggtaaagcaacagactaatagagcatgagcacatttggggaattctacggtagcgcgagcattgacatacaaaaagtactgtacaagcgcttttcaagaccgaaaagtgttcaagtgatcgcgagagcaccagaccacacaaaaactgcggaatattttctcgagaccgactctttaaacaccgatcagtcattttgatccaatagagagaagcaagggggatttgatacgatagttggaaggattaatgtaatgggagggctacggtcagctggcgcaagagctaatcggaggccgaaacagtcaaaatgtgttgactcaaccggaaatggcatacggtagtgtacacctacagacgcccgcgtcatggtttggtacggttgaaatggcacacactcgcgagtcaccttggcgtcgtgccgttggcggcggcgtccagatcaacccaaatccacgcctcggggaagtgcttgcgctgggcgtggcggtggtgccaccgacaacaaactggggagaggacttcctgacattggcctgaagcggcatcggcgggcccggcatgccgggctgctccttcagcttgcgctcctcgccgccggcaaaatcggtccgcatgtgcatgtacatgggacggaagcgccagtgccctgtagggttgggcatgggaatccagtcagtccaatagagactttctcgcatcgaacaatttcaggtagtccccaaaatttcgagattcccgagccgataaatgatgtcatcggggtgaagaaag

SEQ ID NO: 5144 - DNA, 2461 bp, Heterodera glycines
ataattaatttggagttcatagggagtcaattaggggggtgattagtaaacttaaacatttactcgtgactgagatttctcgaattttccaattcaaaacaaaaataccagaatttttctcggacttcgacttgaagaagggcaccacaaattcaaagtgtcaatttaaaatcacagatatatccccaattcaaattttaatgttgattaaaaatgccaaaaataaaatgagagatttccactgacaatagcgttgtcccggcttcagcccttcaattagtgcccgatgggtgtatcgtttcgttttctcggtgccaccgtccacaaaatagtctactgtagccggcgttttgcgcgttagctgactgtactggtcgccccatacgaccagcgagtccaatgtgtcgtcaaaggtcagccaagtgacccacaactgttgtaaattaattaattaattagtttaagaaattaattaattaattagttaatttaaaatcttcttaattaatgaaaaatcttggaaaaaatatccatagctatgattatcaaataacaaatttcaaggacataaaattatttcctaggaaaaaatgtttagcttgtgataaattaaaagttttaaatgttacattattaaagaatgtattcgactttttaatgaacaaataatcttgggtgcatttttcaagggtattcattgaaaactgttagcaaaacaaatcacaaaagtggaaaaatgctatttttataataaaataaaaataaacattttacctttgatgggtcactggcataagacaaatggacttgttctggttgtccataaaatggtccttaaaacaaacaaaaacaaacaataaatacgcattaaaagataaattaaattaatttcaaaatattaaactaataatccatctttattaatataaaatgaatgaaagtaattaggctactttaattaaattaattatttttcttaatagttggcaggctactttaattaaattaattaatcacaaattttgttttaacctctattaatattgttctccactttccaatgtggcactctgtttgggcttagcacaattcgattttgctgctgcttttgttgttgttgttgttgttgttgtttttgctgcttttgccgatcagcagtgattaggccaaccgactgaattagcaggaaaatggtggtggtgccgacaatgaatttaaatcccatttttttcttcaaaaccaaaatttcaacaatattttgaatgggttgaaaaattcatttataaaatgatcaaaaatgcagtaatatatttattttttttctccacatgatcgaataatcgattttgtgtattaattaaaactttttaaatttttctgggctaaataaatgaaaaattgggcgaaaacatggaaaattttcaaaatatcaacgaaaaatccaaagacccataaatgatgtgataataaattgtgagggaaaggaaaatgattaaataataataaaaatatatttttgtcatgcgaggagtgcaaaaattttggtgacaaatctacgacggcaaaattcccattttatcaccaccaaacataaccaaccaaccccacgaccattcaccagccagagcccacaattctcaattagatactaatatgtgataattttagttgaaaatagttgacacacaagtgatgaaattgataaaaaaaaattgtgattggaaatttttcctagaaaattttaagagacaaaaaaaaatgaaaattggttttttaaatgtataaagtgaggttatctatctgtcatctgtgctaaattgaaaattaatagtttcatgttttaaaaaagtattgcagtaaggaacaaccccatcttttataataatgaatttgttaaaaaaataaaataaaattttaacaattattaattaataaaacttcaggaaaatgttattttcttttccggacagtgttatgtcgaactattgtagaaaaatagtgtcaatttttttttaatttctgttatatttaaacaaaaaaaacctttatttttcaatattttgactttatcaggggcggccggccatcacattcagtggtgccgattagacaccgctagggaaaattttttttttgttgaatataatgagatttattaaaatattttgatcaataataaactttgagggtttcccccctccccaaaaaagaaaaacaaaatgcctcatttttacaattagtctcatcgtcctctcaaaaaaaaaaaataggccatatagcctcacgtctgaagctctctgctgacaaatgaggggcagttaaaatttaatcaaattgatgcttaaatacacattcttctcaaagttttgttgcatatccaataaaaaataattaaaatttacataatattaaataaaaatcattagccagaatactctaaattttttttaatattttaaaa

SEQ ID NO: 5145 - DNA, 6043 bp, Heterodera glycines
  misc_feature (6030)..(6030): n is a, c, g, or t
taaattttaataatttttttattcgaaatccaacaaaacttttagaagaatgtgtatttaagcatcaatttaactaaattttaacatgttataattaaaaaattaattaaaaaaaagcataggaatttgatttttacacttttctcggaattccgtgccatccctgctgtgtatgaatgatttcgtttaaagtctttttcggttttcattttgcgattatttaaatataatataataaactcaaaaccaaaaaaaaaacattctaccggaagcacttttggctaaacatcaaattcaaatgaatttcgcacaaaacgtgttctacttcaaaatttaaaatgcttttaaatttaaaaaatgctttttaaagcatttccggtgccaaaatagcactttaaaagcattgaaaaattatttgtttacatcgtcatcgttcatcatcacttcatctccctcttcaatttcttcgtctccgccggagggaagaagaactttgctgccttttgtcaataatcaaaattttgaggcttcaatttttttgaaaaatcttttcttctatgtattaaaattcgttttattgaaaatttaaatcatttttgtagaccatgattagtacagttaagtgaagtgtttaatgcgactgatcaatgctttgagaattctgatcaaaatatcagtcacccgttcctcatgaaaaaaaacttttttttttaaatcgtaactagaacattttaaaattagatgaaggagttagctcgcttaattgttgaacttagtatattcgtattaataactgaacatataaaacttcaattcgtttaagaaaatgacagttattctgtttaaaacattaataagccttaagcatagccttatgaaaattctcaaaaacaaattaaaaatttctcataaaattttggcattaaaaaatttctaactactttttttttcaatatcattgtagaactgattgcaattcaagtaagcagtttgatgagtgtgcgttctgatcagaaaacatagcaaaaacttttcaaatccgatcccgtcaaaatttttataataataaaaaaattttctgccaaaaatcacaaaatttctctcaaaattcaattcagtgctgaatgagtggtgaagatggggcttaagcctccttactaatcagtgtgagaactctgatcacagcaaaaaaaaagaaaacatactttttgcccccccccctccccttaaagcgttggttggttggagtgcttcatcatcgcaactccactttaaaaaattgtctccaataagtctcccccaagcccccggccctgggcttcatccctcccattcatttggcccccaatgtttgtccaaaatattttcttgacgacgacgacgacgaacgctgcggcgatggcgggaggacggaatattcagaggattttttggggggaggggggccaatggttgggccttaagtaaaggctaatgtttcaggcctagccaaatccgcttgatcgattaaggccgaattaaggagggcaaaccaaaaacaaagtacaaacaaaacaatttgccaagtctcgcactcagtgctaacatgttttggaattttgattaattaaaaatttgtcaagcgaggcttgtaatttgccgagactcgagactctaattaagttcatgatttaaattttgggcctcgagaaccgtgcttttaatggcatgactaggacagtggatcatgcatctacagtgattattttttgtcgtgcatttttcagtgctaatatgtaagcgcattaaactatgagatttgaaatgttttttaaatcccgaaaatttactccaccaacaggcgagaaatcaaaaaaattttagttataaaataatattttaatgtaatcttttattaatgcaaaattgttattaatttactaatttcttaatccaataattgcttattttaaaaaaaaattaacaaaaaatggaaattgtcaccaattaacatatttttatgcccatttgcaaccgtttaaatttgctctatgtaaatagtgcgggagaccacaccacggccatttcaaaaatcaattcgttccccttttcaaaattgttggcccctgagcgctctttagacttgtgccaacaaaaaattttttccatttttggcacaaaatttgctgccaaaatttgcaaaaaaaaagtcactcaatttgcttgtgatttatttaatggtttggttttttggcatccattaaaatatattaaggttcatcccgggtccattgggagcaaaaattaaattttcttagaattcttggccgatttgtaagaaaattttgcaaacattttgcaaaaatttataatttttaatcatttttaatattttatattgctattaatggaatatttataggaaaattttcggttccctcccaccaatatcttttttttttgatttgcatttaaatggacacacatgctttttccaatacttgtttcttgaaaaatggaaacagaaaagtacaaatcaatttttcctattaaattttgcaaattttttaccgtaaaaatttaaatcctttttttgaaatatttatttaggcttttaaatatttaatttgttattttgaaaggctcactatgcatttttgcccatttctcatgcctttagtcaaattattcacaaaactttgcccaaaagcttagatcaaatttccatggccaataagctgctctgggaaatttcaaacaaaaaaatatttttaaacattatttaaaattgctgttgtttattctttttctgagatttatttgtgagagaagaataaaaggaaaattttaaaatgtaaaaaatatagaaaaggaaattttttgctcaattatatgtaaattaattattttattttatttttgctaaattatatgctttttaaaataaataaaaatgtttaaaaattttaataaaatattagaacatttgcaacatttatgttattttctggggaaatttgatatgcacatatgttgtgagctaatctgttcatttttttaacttttttaaaactttgctctcgatctttcaattgttactaaagaaatattgaaaatttaacaatttgaaaaaaatttaaatattgtagaaccaccgagaaaatttattaaaatttttaaattaattcaaaaaaaagttttactatcttaatttctgagcggagcagggcatgttcagttacaaaagtccaaagttataaagctccaaacttgtcaaatgcacgtcagacgcgaccaccgtgccaaatccgttaatcgcacgatttaaatctcgtttataaaaactactaatcctaactgagataattccttagaacgtctttatttaatgctttaaatttaatttttgcagcattttttgaggcttttaatgcttcaattattaagcatcggaaagacgttccctatctttaaaatttatttccaaagctcttccattcacttgttatgaacattgataaagctaatgacatcatttgtggtaataaattatttcaaaataattttgattttttcgacaaaaataaaggtaattagaggcatatgattttttgccaaattttataaaaaaaagtcattgttgacctaattgctaaatttttattggttgatcatttgaatttcatttctaaaatataataattcaaattaaaataattttaaggatttatttatttcaaaattaaaatattttgttggcggcactgaatgggccacaattttaccatggtggagttgggctggctgtgtaccgcgctggtgtcactgatgcgcaacagttcgcctcccctggtacacactgatcagaatgcgcaacaaatgctcaaactgatcagtgatacaaaatgctcaaatagcaacagtacaacaacaacaattaacggattgtctaccgtaccaactacagtaggaacaacagctacagtacagctgaatgctgcactgcttgaaaaacttataaggccaggcgctgctgatcagcaggtcagcagtaccgattgaaactgggattccaaccataattttttgggatttggaatgaatttgggatttaaaatttgcataaatctttaaaaattaaaaattaagtcccaacaaaataaaatttttgctgacaaccaacgattgcttgactggcttatgacatttgtgtacatgcttatttcaatgtttggcataattggcaatatttttggtatgttgtcgagaaaaaaaaaattaatttgattaatattaattaagtggtaattgttgtacgaactgtgccaggaatggtatgtgttttaatttatttcaataaaatgggtttaaaaatctgaattctttgaaatatttttaataattttagagataacaacctactaaatataatgagacaattagagttttttaatttaaaaattttcgtttgtctaaacatatttaaaaatgccatgtttccgaaacgggaaagcattatccagggtagttttaggcgctaatgaaggatatggagtatgaaaaaaaatcatgctttttcgaaaaaaagccaaaaaaaaaatttgtctatttttaaaaatcaaaaccatcggcatatcggcttaatttagtggagtgtggcataacgaaaaagttaccaatataaaagataaatcttttcaaattaatcaaagatcactccaaccaactgttatttgatgtcattggcaatttccgattgcatttttctgctttctgctgcaccggttgagctcagctttttgcacgttgattggtacgcgtttggctccattggctgcaaagtgctctcatttctcccatttttgggcataaattcgagtaaaaataaaaatttatttaatctttgatttaaatttaaaaatttgttcatcgttcatcttttatttaggttcaatgtcaattacggcatttactgttgagcgattcattggcatttgttatccattgagggcaaggtgaagaaaacaaaaaaaaattgagatattctaaaattattttttcaaaattatgttacatatgaaaaatatttttattttaacttaatatatttcaaaaaaattagaaatatttattaaaaaaattgtctaaatgacaaaaaaaaaaccaataaattaaaatttatataatgcaaatatgaaaaattattttcattttacttaatttgtttcccaaaaaaatggtaattttaatattatttaagttaaaacgaagaatgaacatattaaaaagattataattaaaataatttaaatataaaaatgaaaaaaaaaaaacaatttttttttattcttttccattttcgatacatttgtacggtaaagcgcgcaaaactgatcattttgttcatctggtgcttctgtattctgtacaatagtccttggctttatttggcaacactaattgttgacgaggacactatccaatgcagttttcggcttgaacgggacgattgggcatataaagttggcacaagcaaaacaaaaataaaattaattaaataataaaattatataatttttgaagtattttaattattcttcgcaattatttaatttaattgcttttctaaataaaaatttttaaatggatataattcagtttatgagttcaatcaatgactgacttatcctcggttattaggccataatttttagaaaaaaaaacaggaaattcagcattttttcgagtatagttaacaataaattttttgtcaatgaactattatattattattatcacataacatttttattttaaaaaataataattaaataattaaataaaatataattaaaaaataacgcattaaatgccgattaattttcggccatatgattcatcattttcaggtgatgtttgttgccgatttctcagccttttatcttattccaatgatcatgaacacatacatttatacaaaagttagtccaaaaatactaaataaataaagacaattaattatgtatttattttaaaaaatttatttcaganttatatacacatt

SEQ ID NO: 5146 - DNA, 1356 bp, Heterodera glycines
ccggacgcgatggccgggctgcgcatgacgcgcgctcgcctgcgccaattggaacgcattgcgcgccgccgcattcccaccgcgcggctgcgaccgattgtggggccgaaaacatttttggacatcaattacggggacgacgaagaggaggaaagcacttcagcaaaactgccggggcagcaggacgatgagggagacatggactacaccccggcaaacgacccgaccgcaccaacggaacgaagacgacggaggaggagacggaaaacgaagacggagggggagaagggacaaacggtgagcaacagatggggaaagtcatgggcaagagggacggtgagaaaggcaaagtgcggggacggttttcagcgatgtttttgaaaattagtaattattcataagaaagatttctaatttttttttcttgaaattttctttaaaaaaacaaaacaaaatgcccttaaaattccaaaataatgataaaatttaattgctaaaacaggctgacaaagtttcttattcgcagatttacaataattgttttctcactttatgtttttttagcaaacaaattccgaccgttcggcttctgagtgtgatgatgctgaagacgcgtcatcgtctatgcgctcctccgacacggactttgtctgctcggacatggacgaacaacagcagccggagcagggaacatcacaatcagcaacagttgagactgaacaagtaggagatgaacaacatcagaagcaacaacgatgcacacatgacgaggaagaggaggagggacaaagtgtcgaatatctgacaaaagtgggcaattaatgatcaattaatcaatttaagcaaaggatatcgaaaatgaatgtcttttgtcatattaacagaaaacaattttcatgcaggtggacaatccgatctatccaatcttcatcaaatcgttggccaccgacacggaaattgacccggaagttcgtcagcaactatacgatgacggtacagtttgctgttgtttgttgatcaaggcgagactgaattcatggctatgaaagggggggggggggggcttccccttcggagtttgaattaaaaaatggggatttttaaaataatataccatcttatttagaagacaatgaccccgagtacgtcttcccggactttgacgatttgtgtgatgagcaggaggacgaatacgaattccgacgggaccgagccaccgaaattccgcgtaattttttatgacaggaatttaatttaataaaaatttttatatttgcctttcaggttgggagggtgaggcgcttgagcaggactttgttgaggacggggacgaaccaagtccgttggaagtgccca

SEQ ID NO: 5147 - DNA, 7380 bp, Heterodera glycines
tcatgttctctgctgaatccgtcaccaacaatcgcaccagtggagctggacgcactgaaagtacagcttgaaaaggtgggaagggaatgcgcgcatttttaactttgttctctcctcccatttcaaccttttcagcacgttcagcttctctgccaagccattgtgggcacgtctcaatatgccaacttggtggaaccacacaacaaatctatgttgatgctggtcagtgagtcatgattattaatttttaattgaaaactactaaaatagtgaaaattgtttaaaaaatcgtttcagagcgaattggacggattgtctcgcgagcgtggcgccaaatcggcgtttaacgtgccgacgctggaggcggccatttacagtgcgcacgacatcaaagcgtgccgcgaagtgaatttggcattggcatcaacagcggcagcagaaacgaatggcgatgagctccaacccaaaaacactgtcgaagtcagtcggattgaaatcaaattgttttttggactaatttatttagggtctcattattttttaatccgtcggtaatttctcgtaattaatagaaatgtaattgccataatgtcaccgcgtatactcacacttttttctaccgaaacagctgctccaactcaaggatgagcagcggcctagcaatgagaccatgtgggtgttgtcgcgcagcggtgccgtccgttaccccgacctgttgtgcccgtaccggttcagcagtgccgaagactgtgataaattgcagtcctcaaaaatgggtccaacgcagcgatttttgcattcggaacaggcagaaattactaaattttctgggccgccgaaattttttttcaaaattttcaagaaaaatctctgtgtttcagttactgctcgccatcggtctctaccaattgggtggtgtccagtcacatcggaatggcaaaatgcgcaaccgttaccaacatattcagcagtactttctgcccacaaaacgagtcgaccaaattcgcaatcacattgtcagcaacacaaattagcgattagatctaatgacaatggctaattaattcaaacggcgctttgttttgtgtggcattggcccatttttaattccaaaaaaaaaaaaaaatcaattttacctattttaatattgcagaaaaatgtgcattcgtccccgtcaccgaccatttaccaccagttgatcatgcaggcagaaaagggccattttccggtcacttatcggcccgatttgggcgaaaaagcccagcgaaaaacgccaattgaatggccaacgaatgtgcagccctattggcttaaagtgtgtggggatgcattaagtcacttccgattttttaatcttttaatgcaatttaaattaaatttttccattttttccccattttagtggctttccaacctgctgggcaaatgccaaacccagatgattatggtcgacgatggtgacaacactgacaatgatgcgggtcaacaattgcatggcgttttcgaggcattgaatggcactgatcagccttcttctcctcctgcccctcctcctgctgctttcgcttctgctgatcatctccatcaaccggcatcatctgacacgtctaattccgaagcccaaactgctcaaaatgtcaaagttgagaatgcaaatcgccaacgacacgtaaaggcgggaaaaaagccgaggatattggctactgctcgaaaacgctgcgttcccacagcaacgggagcggcaccatcaacaacttcaacaatggaacagagaaaggatgaccaacagcagttggacacgacgacaaccgtcccgtacaacaacaacgaagcggccaccgaactgcttggagacgttttcattccaggggagcaacaacagccagattttgtggacgtggaggaggaggaccatgtggtgggtgtggagacccggtggcggaaacgtatacgaacagcctcgtcaacaacaacggaagacggggcaagtcgcttgagtggtgttgccgctgctacagatgttgctgaaaagggaggaacaacgccgccgacacaaacagttacagcagcagcaacgatggtaaacaacaacgccagcagcaggaggaattgtagcagtgcagcaaacggcgccggtggcgcagaagccgccacattgtcgacgatggcgcagatgacagcgaaaagcgccggcgttgaaaatattaatggcactaattgtgccgaaagtggtgtcatgcctgccgcaacagctacgtcgcaattggtgcgtttatctatcatttattaaattggaattgtacctgaaccaattcggaagatttatggcaccattctttttcagcaaaagaagtcacggcgacatgaacgggccgagcgcggaatggccgcgctgggcgacgcgcattcgcttgagcaaaccgaacgggcgctggccgccgcaatttacgaggacttcggcaagcgaatgttcatgcatcaggcaaatttgctcacttttttcttgccacttcctcctcgtaaatccacagacgttttgccctctggcaatattcgcaaaatgccattgtcgccatttcaggacaaattgcgtgccgtccagcgcgtgttggccactgctccaccgccgcgttatgatccatcactgtctgctgcttgctcaaccgcacaatctttcgcctctctatggcaactgatgggcctcacccatccccaactgttccatttgttcgccgccattgcgcccgaggcgcagctgccgcacgcactgcgcgtcgacccgcactggcaggcgtgcaaacgcgcgctgcgcatgctgaagaccatccatgtgcgtttttgcttgtagtttggtcggttggcagcccaattcgggaattctcgaacttttcttctcgtcttggtgccaattcctgacacaatttcgattctcgatcagacttctagggccattcaaattgccaatttttcagacttatttggctgcgagtcgaacccttgcccagatgaagcatatgctcaaattcctcaaagagagtgagttaatttctgtttatgtataaaaaaataaacataataatttaatggaactttgtggggtcaaatttatagatttttttgcatttttttgttattttaatttctttcttaatacaaagttttcatctttgctattgctcttccactgtttcttttgttagtttccgtggacatcacttctgagcaacagtttttcgaggctcttcagcgccaatttggggttagggacgagccgttgtggcggctgttgcgacgcgaatggatgggcggaaaatttgttgaaaagtgggtttattgggttagcacaaaaccaatgtttaattttgagttcagaaaactcgtttcaaaactatttaacattagagcaaattggaatcaaagcaattctcaaacaaaaaataattttcagcgtcgaggattgggagtacgaatttgtggacatggacaagcagtaccagcagcaacaacaacacacgagcgaatgcgcaacagtttccactgatggaattggcaacggggacaagcagcaattccagttcgaacatgtccgacttccctaccgacgcgacccgtccgaacgcagtcgccttcgcgtccgacacggccgcgtcacggcggaactgaacggacggttgtgcaacgtgtcaattggtgccaatttcataaggggggggggcactgatttcaattacatttgccattgtttaagcctgtgcttcgtcatcttctggtctctcctcctccgactctttgtcggttgttgaacctcagcagagcaattgtccaacaacaacagcacgtgccagtgtggacaaatccaatgaactgcaaaagaatcgctgctgttggacccgaaaaatggacatggaattaatgttggcctacaagaatgcgggtggcgatcagtaagttttttaattcattctttacggggcaaaaaatgttaaaatgatggaatatttactggactatggactgtatacaaacttttgggtgttttagcaagaaatgtgtgaacgccttcctacaccaacgttccacacaatccaaaattggtgaatcggtcgtagcagaagacgctgaaaaacggttggaccaacttttgaacgtggccaacacattgaggaggaggaggagggagacagaagaaagggacgggaaatgatctcatcattttacccattttattgcaaataaatatcagtcaaattcaaaaattgtctgtcttttcccgccactgaactgctcttcaaaggtcggctttgtattggacacgcgtgtgcaccgtgtgaattgagctggagaaggagcgcagctgcacctgctcggcattgtcaatgtggcactcgctcgagtcggcccagccctgggaaaagcaatttttattggcaaaaaagtagtcattgtttaacgcaaaactgtgacatttctgtttttcgccacggtgttcataccacacgattggttggccctctgctcacctcgggcagttcagtgtccctgaacgtgtagacgagcacgtcgaaggagcagcgctgttcaagcagaggcagaaaggcgacagaagctgtgatttgcctaaatgaaaagaaattggaaaaaacctcttgattgttttttaggctctattccaatttacgcgtccaaaggaagacgacactcacaaagcggcataatttttcaaaattgccatttttcgtttgggggacaatggtctcttcagtccctcctcccccatgtctacgcccatagtaaatacctgagcacgtcactgatttcctgctttattcgcttctcatctttacttccatagccattttcactgcaaaaaaagatggattcaataattggcatttcccgtcccattttcccacttttcctacccctccggcgtcgtttcgatgtcaaattgccatctctccagcgcttctttgctggaaatgtccgtaatgaccagcaccaacttcttcagcatttgtttggtcaacatcgtctaaaacgtaattaaattccattcgctccaaatttgtctgaaacctcaacgtgctgaaggagagggtttaaaaactgctccaacttcgggtctttgttcaccagcagcgtcatcccgtactttttgtcactaaaagaaaaatttaaaaacaatttttgcataattaaatgggtaaccgcgtaaaattgtcggatgggtaaatgccgcgctggtagagaatgctgtgaatgccgtaatggaagaattgctggaccatttgtgcggaacccttcagagtaatcgaatttttggtggctaactccgtcattgtttgtacttttcttgtagaaatatgctcaggttggagtcactggctaaaaaattagtttcgtacaattatgaaccctctaagagttggttcaaaaacctagttactgtttatctagtgaaaaaaggtttttttgaatgggtcttaacaatccgttctaaatttattttctaacaggttatctgtttattttatttaaaattaattcttacgctaaaaaacgtcaagcatgaaacgccaaatataattaacataattttgccgctaattttaaatattgttcaatgcctttttatttactttgattactatcagccataactcgctcgcttcattcccatcgagatttacaattaggaaaaaggtcatttgattatcattttattagggaataacttttgttaaagctttgccgctccttaaaaatgattccgtcgatggtaccattgacttctctcactgagatgaatcgattgaattataaataaaaagttatctaaatcaaggtgtcaattattcttggcttttacctttttttacagctttcctaaacattaaataatcacgctaacatttcacgaatacaacttcagcattaaacagtgttgaattgaaatgacatgccaaaccggaattcgtggtatgtttatttaaaaaaagaaattgtgaaagtttgacaaattttagccgatgaaaaactgttggactttttcgagcagtgcaaacagtgcaaagtgcgctttggcaaaattgtcattaacaacggttcgtctcatttttcaacattttttagtggaaattccgcccattttccctcctttagagcgtctctgtgtgaatcacaatttgaagccctcaaaagattggcgcaaagattggaaaaaatggtgagcaatttttttcgaatttttctaatatttttttttcagtttgcccgactgtgtagatgcctatgagccttgctttttgcttttccgtttcgactcgagccacgattggattctgatcaggcaatcaaaacggatgactctgaccatttttgaatggtttgtctttctttcagtttttccgacgacaaagcgtccacacgcgacaaaatgatgttggccgccaccaaagcgacgtttaaagtgccacaaataaatgtggcattttcatttgttttgcccccttttcagtcagagtttggccaatcgttcgttcgtgccgagtaccaaattagcaaccgaaatgagttggaattggaccaatttgagaagcgccatctccgggacagcgaattgcttttggtgctcattttggaccccttataacaattttggagaggcttttaaattgaatttaaaattctggtcaaattggtaaggtgtcagacgacaaaatcactacaatttgaaaaaacattttttaaatatttttgaaaatttaaaactttgagaaatgatttttggagctttttttattccttttgaataaatacgaaatttctgttcaaaaatttaagtgatgcatttttggcacttttaggagggcgctggtgacggcgacgcggcggcggaggacgcgcgtccgctttcctttgtcgagcgcgagctgagcgcggtggccaaagagcgggcgaacattcccttctcaatgcacgcctcgcaaacactgcgcggtgtccaatttccaattgaccaggcgaggcggacgagggggggggggggaaggcaattattgacggaaaacttttccaaaaaaaaaaaaaatgaattttcgattttttaacttttaaaagcagaattattgggagggggaatagcgcataaaattttaaaatgaaattaggccaattttggtgacaaaatctgctacttcacctcacaggtcacacattttcatgaaattcttcacaaaaaggcaatacccgtaataaaaaataactcgggaatttgtttttcgcttcgttttactaataaaactcggtatttttcttagaattttagttcatttattaatttattggctcaaaaaatgacaaattttgggcatattgggt

SEQ ID NO: 5148 - DNA, 1764 bp, Heterodera glycines
aaactttttggccctgtttaaaagaggaattaaaaaattttaaaaaatttttattcatcttcctttttgatagaaaaagcatcagagagccttatttaacatgtaaatagaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgaaaaatgagtaaattaattttcactaaaaagttaagcctaaactttttggcctgtttaaagaggaattaaaaattttttaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactctgattttcgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaataattatgaattaattttgcaaaaaattggaaaagtacgcaaaattgcaatgtctaaaatttttaaagaaacattatgggacagttaaataattatatgaataagcattattctcagctgttaccctgcaaaacctggtgcgcttctgagcactactcgaaaaatgagtaaattaattttcactaaaaagttaagcctaaactttttggcctgtttaaaaaggaattaaaaatttttaaaaatttattcatctccctttttgatagaaaaagcatcagagagccttatttaacatgtaaatagaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgaaaaatgagtgattgaattttcactaaaaagttaagcctaaattttttggcctgttttttcttgcaaccaaggtactgactcggccgcttcgcggcctcgtggggggccttcggcccccccccctaaaatagcttggaaataaaatttggggcggttcaaagcactttctgaaaaaataattatgaattaattttgcaaaaaataataaataattaaataaaaaccaaagactctgattttcgaaaaaatttttaaacccagctagctcggcgctcatttcagtgttagtaagacctttaccggggagtttccctgcaaagtttggtgcgcttctgatcagtttctgaaagaaaaagttaagactaaactttttggcctgtttaaaaaggaattaaaaatttttaaaaatttattcatctccctttttgatagaaaaaagcatcaaagtgcctaaa

SEQ ID NO: 5149 - DNA, 1593 bp, Heterodera glycines
aaatagaatttgggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgaaaaatgagtaaattaattttcactaaaaagttaagcctaaactttttggcctgtttaaagaggaattaaaaattttttaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactctgattttcgaaaaaatttttaaacccagctagctcggcgctcatttcagtgtaagttagtcctttaccggggagtttccctgcaaagtttggtgcgcttctgatcagtttctgaaaaaaaaagttaagactaaactttttggcctgtttaaaaaggaattaaaaatttttaaaaatttattcatctccctttttgatagaaaaagcatcagcgtgcctaaaatagcttgtaaataaaatttggtgcgtttcagagcactttctgaaaaaataattatgaattaattttgcaaaaaataataaataattaaataaaaacgaaagactttgatttttgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaaataattatgaattaattttgcaaaaaattggaaaagtacgcaaaattgcaatgtctaaaatttttaaagaaacattatgggacagttaaataattatatgaataagcattattctcagctgttaccctgcaaaacctggtgcgcttctgagcactactcgaaaaatgagtaaattaattttcactaaaaagttaagcctaaactttttggcctgtttaaagaggaattaaaaattttaaaaaattttattcatcttcctttttgatagaaaaagcatcagagagccttatttaacatgtaaatagaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctgatgcacttctgatcactactcgaaaaatgagtaaattaaaaacgactaaaaagttaagcctaaactttttggcctgtttaa

SEQ ID NO: 5150 - DNA, 1289 bp, Heterodera glycines
ccccccccccccttcagagcacgacatatatttcaacaaaaaatttgaaaaattgactagagaaatcgtacgctaacggatgacctaatggaaaaaaatccccgaaggagagaatttaattaaatccattccttcgggggtccgtgccgggtgccgcggggtaagcagtgctggtttcgtttcatcacggcccccatccttttgactagtcagccagcgttgcttaacttgtcagatcggacgggtacgcatgtttccacttttccaagcaccccaccgaaagttgaacgaaataaccaaaatataaggaaaaatttaaaaaattttttattctttagccttattcataatataagcctaagaggaccttgttaacatgtaaataaaattaggtgcgtttaagagcactttctgaaaaaaataattatgaattaattttgcaaaaaattggaaaagtacgcaaaattgcaatgtctaaaatttttaaagaaacattatgggacagttaaataattatatgaataagcattcttctcagctgttaccctgcaaaacctggtgcgcttctgagcactactcgaaaaatgagtaaattaattttcactaaaaagttaagcctaaactttttggcctgtttaaagaggaattaaaaattttaaaaaattttattcatcttcctttttgatagaaaaagcatcagagagccttatttaacatgtaaatagaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgaaaaatgagtaaattaattttcactaaaaagttaagcctaaactttttggcctgtttaaagaggaattaaaaattttttaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactctgattttcgaaaaaatttttaaacccagctagctcggcgctcatttcagtgtaagttagtcctttaccggggagtttccctgcaaagtttgtgcgcttctgatcagtttctgaaaaaaaagttaaacctaaact

SEQ ID NO: 5151 - DNA, 4672 bp, Heterodera glycines
tcctgcctgataggaacatgccggacaatcacctccccgagtgcttggtcccgaattgccgtgacgtgcaaaaacgacggtttcgtacaaatagcaatttacgatttcaactgttctccagaaaaggccgattggccaggttctccacccgggctctaacgaattttgtgtggccctcaatgtcccattaatttgaaccattttccccgcagatgattcatcaaaatccttcatttttcggcacattgccgtaggcatttcaacgttttctgttgataattcctcgtattttcccccaaaaaatccaatccttctggatatttttgtcttgatgcatttacatgcagttgcctttgttttgtactttaccgtatttactctgtatacgttcaatttcattgccacaggcaattccgttggtgtccaacttggacaaatcgggtcaattgggattgaccataaagttgcgggagaatcgggatggcaaatcattgggctctccaccgaatttgtcgcaaaatttgcaccaaacaatgagagaataaccattaatgctagaaaaattgggctagcaatccttgcggctcctattctttggccaccaaatcgaactcgcctccccggcgactgagttcgttcattttcatattcccttccttcataagaaattggtgaccgatgattatttctgccgtggctcggcctgttgtggggtgagaagtgccgttgtcggtgttccccctcatttcctccatagttcggcctgtcgtggggtgaaaaatgcctatgccggtgttctctttcatttctctcataattccattttctttccccatagaacggtcggtccctttgaccaccatgtcctctcctttcttcgtcccttttcttgtctctacaatcctttacaacatggcctggacgccgacaatagtaacagacgcgccgttctattcctcttttaggtacagaatgttggcggatggccaatgcttcaactttatgcgacaattcagcgactgaatccgccaccgacacttggttagtccgcttagtggcgagaagaagctcaaaatgttgagcaatttcataagcgtttgaatagctcgttggcctccccgccttgacctcaaattgtaattcgggggttaatttttcaagaaattcctcaagaagtcttcttcttattgtctcttcattttctcctgatagagcagttctgactgcctcatttaatcggtttgcaaactcataaacacgttcgcccggtgcttgtctgcaacttgccattgcctgcctggcaattgaccgagtattttcgttttcaaattttctttttaaatggtttagagcatcagaaagagagacaggtgagggttcaattgagtcaaactcggctcgggcttgtccactgagcaaaattctcaatctactcaatttttgcacttcagaatactgtgggtatagtgttagcatatcctcgaaacgtgcaacccaccgtgagaatgatacacttgggtttccatcataaccctcgaggggggtaattccccctaaaaatggatctgcaaccataatttcgcaacttccgtccccaattgggatgttgtcttccccttccgttgcccctttgtcatcaggcaatcgattatgttcttgggattgtccgtcatcaaaccattccccaaatccctctggattatcttgttcaaattccaacagttgtactcggccttttagaacatccaaattttcggtaattttccgaacctcatccttcattttttcaacaattttcccaaatcgaacctttgtgaacgtctcataacgttccatatgattacttacctttccaatttcttcctccacttcaataaacttttctttggtctcaaatgtgtccatttctgtaaagttctcgagttcctttatcgaactttccaattctcttactcggtcagcggtgtcctgaatctgaatttgactcgagatttgtgaaaatgcgttctcgattgttcgaaattggcgacaaactgccagttcaaatgctcgcattcgaccaagtaaatttgcccatttctcattttcttcgggcgtgaaatgaacgggatcaaagtccgatccgttgttaggtgaaatgttgatttcactttccattttcaaattcaattcttctttttttcacgtgttaagcacccagctcgactggaaagtacacacttttgaccagcctttttcacttcttttttttaaacggcacaacagcccggctggaagcacacagctttgaccagctcaaatgttccttgcttttttttcccggcacaaagcctgagatgccccttaaaatactcttttaggggtcccgggtcgtggcaccaaaatgtgttgtgtccgtacccaaactctggacttttcccggttacttttcagcaaggcttcttttaagacaatttattaaaatggaaatcaaaagtggaaatgcaaagttaaataaagaatgatcgctttttaaatagtaagaaaacaaagccaattgttaagtgagttgtatcgctttaggcagggaacctgagtcaacgaatgggtgagtaaaatcctgaggataagagaataagcaaagacttaaataccaatgacaaatgggaggggccaaacagatggaattacacaaaattgtttggaagaatattttccgatggattggacgaaggggtcacttttatgagtgagtgaggagcagaagggccagggaaattacaacataggaaatgtcaaagaaacgaagaaaaaaagagaaacaaataaataatggaaaaaatgaattaagccaaaaatgcagatccaacagttgttgtccgaatttccgtcgtttccccatttaatcgccgccttttcactaattgggcaccgtttcaacagccaataataagcgttctcctttattagtgtcaacttttctttggtccattcgttcaccaattcaaatggctcctcaattgatgatggaggcgagaaaactccaaaacgaattttgtaactgacagaagaagtgcgggcacaaataaatttctaaacaaatgaaaataaaaaaaattgaaaagcaaactaaatatgtaggtatttattttaaaatgggtgcacttcatttcccctcccccccacgtcaaaatttttcgggggggggggggggggggggaacgatctactccctttaaaaatagctcaaaatcggaaatttagccatttttagacgaaatcggttgacaaatcgcattaaaaactatttttaaaaaatttcccgacggcgcctaacggcaccgccggtcccattagtataccgatttttttttaatttttttttagaaaaaagcgtgccacaaaaaagggatgtgaaaacgtaaaaatggtggtcgtcaatgggttcaaaatgccaaaaatctgccttttttgatcaaaatttgtttttttttaaataatttcttggcatattattgagcagaacccgaaaaccattttcgtgatcagcacattaattcagcctagaaaaatttcaagggggtgacaaaacctacaagcaccgttttttttttgttggaaaaagcgccgcaaaaaaagttaagttgccgccggagaaaaacctttgtatgaaaaatcggtcccgagacacccaaatatgatgagaatctgagcacaacaacaacaacaacacctctttgaaactggtgatccattggaagtttgttcttatgctattttcgcaaaacaatcgcttcggttggccatttggtgtcggcgtgtgcacccatttggacaacgcttggtcagcagttgcatttggcccatcatcacaaagcccatcatcagcagggcacacaaaatcggaatcgattgaatgcaactgattgagatcagtgagaattgtgggtgaaatgagacgccgcaaattgtccaaatgatcagcattggaaagggtcaaatggcgaatggttgtcacaaaaattggccaaatttcacggaccaaaacatcccaaatgtgctgaacatcagcagcagcgttatggtgtgaagaaggcatccacagacgcaactttgtgccccatcggtcccaaatgtgcttgttggcatggagaaatttgatcacgaaatggtcaatgtaactgaaaaaagggaaaggaaggactacgaaacatttactcattaattagatggatgcatttcatttcccgttaaaatcttttttttttaatttgcaaacttagaaattcttcaaaaaaaaagaacagagttagggatccgagactgaagtgtccaaatcccacggggactcaattgtccaatgtcttttgagtctctctctctctctctgtataaaatttgatttaattactcaatccgaaggaaatgaaaacgaattttgttgtgcagcggacggtacggcaacgaaaaatccactgagtggaaattagacagtatcagcacagatagtttcgggtttggtccctcttcaattgaaatggtattccgaagcgtcaattccggtttgccatcgaaatgcgtgtccaccagcgcatcgaaacgataagaaagcaatgccattttgagtccaagttggggacggtcaaacgatggaagaatgtccatccaaacatcgttacaaatccagctgaaa

SEQ ID NO: 5152 - DNA, 1056 bp, Heterodera glycines
agagattaaccatcagaaaaatgaagtactcgttcaatgtccgcgaaattcaatccctcctcaacgggttcatgtgcattttcaagccccgtgatgtgtccatttcggccattgaaaagttgctgatgcgccgcatttgtgagcaggcgaactgcttggacccgtgccgtcctttgcccaccattgaaatgccaattgttgaagcccacccgaagagtggtgcattggttgtggttggaagaaaaaaacaaattgactacaggtcggtaaaattcgatttatatttgtcctgtttttttcggaaatttaaaaaaaaattttttcgtaaacatccaactaatttgatggttgttttccattttttgaatattctcacaaaattcaaaaatttcagcaaacatccgttgatggtaggccagatgttcaggcccgaagacatgcgcattgaagcgctcaattatttggagccttcctgctcgggcgtatgcggtaaattcaatggatattttctttttttattatgacaaattgtttggtctacattttaaaattttttcggaatggaattttagacatttctatggagaatttattgaaaataaaaagggggactttttggatttacaaaaaaatgacacaaaagatgggatccaggccaggattgagtgaggcccaaatcatttttcggtaacctggatttttttgggttttgtccaggaaatctccaggtgtacaacattgaatccaagtctagttttaggcttattttcaaatgtcgaactctattattgagttcttactctttagaaatgccccctccccttttgtcagtgtttggtctgaacgacggatgcgatcagttggagaaggtgcgggacagagcatggctaaatgaatacattttggagggcgaattgggccgagaaactgtggagcaccaaatccggggcaaagttgtgtcacgcgaaaaatttggtaaaaaaaatttttttttttttgcgtatgaaaaattatattttttagaccatgtctctttgcacaaaatgaattgcgtgc

SEQ ID NO: 5153 - DNA, 1686 bp, Heterodera glycines
  misc_feature (57)..(58): n is a, c, g, or t
  misc_feature (88)..(88): n is a, c, g, or t
  misc_feature (149)..(149): n is a, c, g, or t
  misc_feature (1548)..(1548): n is a, c, g, or t
tttatgagtttacataaggacaaagtcaagacaaagcacaaagatgattaacactgnnatcagatattcaagcggagcaaatattttncgtggaaaaaaaaagattttatcactaaactttattttttctccgttttttatattcaatntagactcatgtttgtattttgtccggcgacgcaaatttattttaattttgtagattaattattcattattatttttttatttctataattcttgttcagataaactgctcgagtgttatcagatgtggcattattataaatataaaagaatatgattttttatatttattgtactaattatatttagttttgtggttttgtttatgttactttaaaaataactctctttatcatgctgttatagctgttatatctgagtttatatttgcaaacctaataaaataatatttccttaaaattttatattaaatattcttttgtcatcatgaatttcatgttcataataaatgaaaattcgtaaaataaacgcagaaatttgggttttcaacaccaatctcaaggaatgattggaaaattatgtttttttatgaatataattttatgttttattcctatattattgaccaattttctttcacacttttatatattattatgttcttattacattaaatgtttaaagttttgttgtctttataattttaaaatgaattttaactattaaaatattcacgttttaatatcacataattgctacggcaggagttaaaggaaagaaccagacttaaaataaatttatttaaattaatcaattattattgtgtaatatattactatattgattttatattcttattaaaaattatttccacttttattaaaatactcagatttaatattgttaatttattttataatttaagatttaatctaatattttatttttaaatttcttggcattgcacacataaatgttgcgaaaatttgatgttggcctttcttgtttcatttttctttttatactttgggatatttatgcaaaaatgaataaggtttgttaatttgtttaaattattttttaattatgattatctttttataaattttaaaatttagataatatttttaattttttacagtaaataataaatattcattaattacttttgccttttgattaacaatttcatgaaaatttattattaattttttaaagttatttttcttaaatataacacaaaccttttcattaattcccaatttagcctttaattcaggggtgtgatcaaaaaattttcaaaataagaacatcaaggccaaaaaataagatttttgggtccaaaataaggacattttgcaaaattgcttcaaatcagttatttctacaattattcgatcaataatgtatcaaatattatatttttgtctcccattaacgattttaacaattttggggaggaaattagcaaatcataaaattttagtgcattcgggataaaaaaataacaattttttgcggcgcatttttccaaaaaacttttgggaagtgcgagggagngggggtccggcggtgccgataggcgccgacgaaaaaattttttgtaatttaattctcgatttgtgaacagattttcaccaaaaaaggccaatctttatgcgattttgagccaatctcttttataaaaataaggatttg

SEQ ID NO: 5154 - DNA, 929 bp, Heterodera glycines
ccgccgttggtgtcgtcatcgcgcggcgaggcgttgtcccccccctgtgctgcaaccgttggctggtgccgttcgccaccggtgacgtgcgtgccgtccttgctgctgctaggttcgtcgctgtacaccgactgccgacgtttgctcgccttggtaggcggaggcgatcgcggctcgtgccgttcgtcaccagtgatcacagcatcatcatcattatgattattgttctgatcagctaatgccgatgctgccacttttgatgatgccgcctttgatggtgccgctgttgatgataagcttgacgtcataccacaactgtctgacgcccattcgtcgtcctcacattctgctgccttctctgctgcaatcatcagcaccagttgaggtggctgctgatcagtgttgtcatccgtcttttgatcactggtggtgccattctcttcctcctcctcctcttcctcaaacgtgctcacattctctcgcttcgcttcttcggcacggagcagcattggcggctgatcgtgatcatcgcaagcacccccaatggcactctctcgcacaccgtacgcactctctcgctgcaccgctgcggcatccgcagccaatgatggcatttgatcagtgcggcggcatctttgatcgacgctcaacggcacactgatcagtgtggctttcggcccagttttccaatcaatttgttcattgactgtagacatgccatgccctttgtctgctgccatggtggatgtacgtgatggagaagtgttcatcaccagttgagcttttggcggtgccaataacatcgaaacaattgcacttgttgttgatgttatcgtcgttcccgttggctttgttatactgcttgaatcccatgtcgttgctgctgccgctttcgtcatccttggtgttgctgcactacttgaacttgc

SEQ ID NO: 5155 - DNA, 1612 bp, Heterodera glycines
ttctgaggatctgaaaaaatttatttttttgaaaaaaaatcaaattttgtgccgagaattgatgataagagaggacgaactcgaacttgaactagagaatcgggagttgagccgaattctcgagaccacaaaaaagagagtgatcaaaagtttcaggattattttgaacaaatttctaataaaattctttaaaatttcaaaaaaaatttcccctacggcacctatcggctccgccgggcttcactgtattattattattttttgaaaaagcgcgccgcaaaaaagcggtttgaaaggcaaaaaagaaaaccgtcgattaacatgtccccggacccttcccaaaaattcggtaggccttccccaccctttttcttgtataattaaaccagtgattagtccattgtctaaagctatccaaaacaaaatatgaggatgctgagatcaatgccgtccttgccttaccaattgtttctgctgctgttgttgttgctgtggcactttttttggtcccatcagttcactgaaatcggttggcatcggcattggcagccgctgtttgttggcagcagtgggggccattgttgttgcacatcggcggcaccggcacaccatgattttgatgataaagccgctgttgttgatcttgatgatgataaagcggctgcttcgtcaacaaaatggcgctggcggtcggcactgtggcggcagccgcgccgcacagtgaggaggacgagttggagtcgggcgagtcggaactgccggccggcgacggcaagctgtccagcgaggccaacgacgagccgcaacaggacggactttggtgatgttgctgttgttgggtggtggtggtggcgtcgaacatattctgaatatttttccaaaaatcatgactaagcaagccaacacttctgtataggtagaatgagtgtttaagagttgatctgatcaaaaaataatgacagtgatcagcagcagcaacaacaacaacaaagtccaatcaaattattatttctttttttatacgcgtaattggccctctctctctctgatcaaaaatggtttgatcgcgagaccggaaagagataaaaaactttaaaaaagcaacatcagcccctaaaggactcgaacccacagacgctttttcgtccaaagcacaaaccactagacaaagaattgacagtgatcacgtctgatcatttgttttttgatgggactgatcacgtctgatcactttttaggagactgatcacgtcagattcacttgcttcaggtgactgattactctgatcatggcctattatttatttgatcatttattctacctgaaatgtgttgcttctgatcgtgctggtgacgttgttgttgtatgctgaaaatgcactcgttgaacttctgttggcggagtttttgctgaacatttggtgcaccagcggagtcagcggaggcaaatcggcggcattggcaaactgatcaaagcttgtcgcttcatgagtggtgacgacaaaatgctgctgtaaaattttgttttggaaagaatattactcattattaattagataaatgattcccgggggagaaatttttatttcaaagcgacacatttataaattaa

SEQ ID NO: 5156 - DNA, 3758 bp, Heterodera glycines
  misc_feature (3719)..(3719): n is a, c, g, or t
tcaaaaaaaacttatcaaaattaggggggggggggggggtgatggggaggaactccgatcagcagcagtcgatcgatgaccatgaactattttggagtaaaatttgatcaccgcagcctaatttggttgagaaaaacaattctctgatcaccacggccttcaataaaaaaaccccatggaaaaggcggttctttggggtatcaaattttcaaaaatatggtaaaatggagctgaaatagtgcctataggtgccgccggggaaaatttttggaaattttaattaaatttgttaagaaaattgtgaaaattgggagggggtgaggcacacccatggcataatttgcttaaaagtgacaagattttacattcttgggattgttcgattgcctagggtttttttctaataggctgtaaaatttcaaaaaaaatttttggtcaactttcgaaaaattgtattaaaatgaatactatttcgaccataatttatatattttatttggaattttatattttgcaggataatgtagagacaggatttttatgtgctaaaaatttgcacaaatcgcgaaacagaattttctaactcagctcattgttttcagaggagtttgaaattttgcatgaaaatacttttacataaggccagacactctgccaaatttcagaattttttatgcactcagattttataagaaaatccttctttttccagcctctgaacgccaacttggtggtcaagatttaaaaacaggcgattttttgtaaaaaagttttaccaaaatgaaaattctgaaattttgcaggtgttatgactcatgtcaaggaattttcatgcaaaatttcaggctattctgatactctgaatcgaatttaaaaaatcaacttgagcaaaattcaagtttttagcacattaaattcgtcccctgaccatgacaattcaaatagcagtcagtaatgatcatacgaattaattaggttgggaaagaacagagatcactccgatcaacgaagaaactgatcagctctcaaatcaagaagtttatgtatgtgtacatcttttggatgggaaaggaagaattaaacaattagctagtgatcactcacttctccaaccaccagcagatcaatgaaaccgcaattttggatggggaaaaaaggaggggggggggggggggggaccaattgttgcgcgtcaacaaaaaaccattctgatttggatcactgattacgaaaactacacaatctctccagtatctgatcacactgatcaatttttcagttggtggtgatcaagtccaatttttttcctttgggggtacaaagcctcgaaattttaaaaaatttaggcacctttgcctactccccctcctcgaaatgaaataattttaaggaaaaaaggcattgataaaaagtctccggcatatgactactaatcattcttcatcttcagattttgatttgctaagacattcccaagaatttttggctttgccccaagttaacgcggcgagagaaaattcgatcgatcatattttcgggtgttgagatattgattgataactacgatcagatcagcagtccgtacctgatccggcaccgacgaaaacgatgccatcggtttggcggcacagaacggcgcggcggcgaatggtccggcagtacccggggcggtgccaaattggagcggtgccattgttggaaatggagacgatgtggtggcggtagcggcagaagccggcggaagcactgccggttgatgctgaagggcatggaacagtgggaagggcgagggcgccagaggaagcagcggggcatggaattgctgaacaaaatggcattggtaagtaacctatccaagacctccctcaccaaattttttcaaaaaatttcgctaaatttttccaaaagtccggaaaatatgaaagtgattgaaaatggcatgggaaaggggcataattaataaaaataaattaattgtttaattaatttttgacaaattgtttttagagaacgggaaaggagtcattataaaaaaggttaaaattatttttattataaggaggcactaattaggggggggctattaaataagtttattgaaataagaatttttttataattatttggagggggggggggaaaaagatggcacacatttggaaatttcctccaccagagaaaggagttttaattgtcgaaaagcacaaatgggtatttaattttctgaaatgctcctaaatttttccgaaaattttcgcttttaggggtcgaacaaaaataaatttttaatattttcgtgccattctcacagtttgttgttgctgctgttgttgttgaagcatgtattcgcgttggagtttctgttgcatcagcagctccttcatgtacagctcgaccatgttcagactcatgacgaaaataatttaaaaacaaacaaacaaaaataaattaaattgaattgcccctgtaatgaaaaaaaattattaattaattatttgatcacaaatcatatttttggcgtggtaaaaatatgtcgggatcgagtacggtaagttgctgagattttgtactgtgtaagattaatcagcgaagggataatttgagttgtataaggtaaaatattatttgtctaggatacagtaaatctctgtcgggacttgcacggtataattttcaaaagatcgaatacagtagtttgccataacgccaaaatttggcatggtaaaatatatgtctcagttcaagtatctgtaaatttgacgtcgggatttagtactgtgtaaaatttatcagcgatgggagatctgattgaatactgtaaaattgtcaagatatttagtacagtaatttgtccatgacgtcgtaatgtttggtacggtaaaataatttggccaaaatttgagcaggaagattaacttactcattttctgaaagcagcaagcacaaagaatggaaatgaaaatgccattcgtagccaaatggaacacgccttctattacggtcgacagcacttaaaatggcacggcatttacaaaccaaaaaaaaaacagatttttgtatttgacactctgttggcaggttgttcccatgccattttggcattttctcatggcatttcattaaagtttagtagaccacaccatcatactaattagctgttggtgtcagtgctaatgagggggcgtgaattttgagtatattatgatacggcaattaaatgcgctaatgtgacaattatttttggcattttaaattgtcggcatttcctcccctctcaaattttcggtttttcatttgggaaaatttattttagtgattttttttttgcaataaatatgaattttaaaatgccatggcgcgcttttctcacattcattcttctctcatttgatgtggtgggaaattttataaatttggcaattttaattagaaaatgaaatggtttgggaaataaatgaacggttgccttggcattgtgccaacaatgaaattcaccgggtattttaaattttttggcattcaaaaatttcttaaatgaacaaagaatttgatcatgaatgtgtctgattattagtggaattttctgtcagcgtgattttgggacagaaaattcaggaaatttgatcggagcctgactgatcactcggcgtatttgtttgaagtgatcaatggctctctattcatgatttgatcggatctacaaccagaagtctgggccnaatggttttggcttagtagccgaagccaaacctcggcat

SEQ ID NO: 5157 - DNA, 935 bp, Heterodera glycines
agtagccgagccaaacctcggcatggagccaaattttcgtggcacgatttttcgaaaattttggaatttccaagctgatgatctcgagtgttcagatttcatataaatatttaattaaatggaccaatggttgggaaagttattttaatcgatttgaataaaattagttcggaattatatagaaatataattttaatttatttgaattgacattaattcaaaaacagaaattatttgatgataattttatttaaatataagtaattaaaattttatttattttaatttattttaggtaacatgaattaaaattggttgattctttcccgtcgattaattgctaattaggcaatgaaattaattaacccaattagccaaaagggcaaatggatgggaaattgtatccaaattggacagtgtattttgttcattatgtttttctgatttggcaaagtgtaccaacgccaaaaacaaaaaaatgcgccttaaaataattatttttgtaagctcgattaaccccgatctgaaaagaagcttttgcccaaataagccataagcaaaaaacatgttttgcagcgattggcaaattttggtatttaaaaaaaaacacggaaataattgccatttttgtacagaaaaaataaggccaaaaccctaacccatcacatccgatttagggagcagctcaattaaaaaatatatgaaataaaatatttcaatggcaaatgaataagttttaaataaaatttttaatataaaaaattttaatatttgaaaaatggaaggaattggcattttgttaagcaaatcatatgaccgcaacccaatccagaacatccgattttgaggtcagctcaaataaaaaatatcaaataaagttttgttgcaaaatgataaaattttttaaaattatatttgcaattaattaatttgca

SEQ ID NO: 5158 - DNA, 940 bp, Heterodera glycines
aaaaaatggaaaacaaaatgccaaacaaaaaaaatcaaattagccaccagacgattaactgtggaaagtattacctaacatatgctaacaaaaaaaatttcatgtttacacaaacacatgtatggcacataaaaaaattttttgatttttggcgccaaaagaaaataaaaatattattggaaaggaacttttaaaaaaacttggaaaatttaaaagccgaaaaacaaaagaacgaattgaatttgttaaaaggtttaacgaagattgtaaaggataagaatttaaatgttgtgttaagcctataaatgattttaagattaatttccaattggcaatgccagcggattgtcgcaattaattaaaaccctttatttaatattttgaaattttaacaaatcgaagagagaaaattgaaataattatgattttttaggtgtaaaagtgttcaaaacaattttaatgggaaaattaaatttaaatgggtgggttttaatgacataattgtaaaaagaaactggctaatttttattattttaaaaattaaatttccaaaaatattgctcagtcactgatttttaatgctgctgaaaaaagaaactaaataattttattgcgcagaaattggccacgaaaggttggcccaattggcggcaattcgcagaattgaaaagccgtgaaaacatttcgccaaattagcggttaattaaatttcgaatgaacagatgtttaacgtcaagtgtttatgtgcaaacaaaaaaagcaaacgcattggctcatttgtggaaaaataaccttattaattaactaaatagtttcattttttattttttaaaatccaaaaaacatccaacaaataaaatttttattaaaccaatggcataaaattatgtcaaaaagactgtcagaggtttaaagctcgtcggggagaggggggggggga

SEQ ID NO: 5159 - DNA, 941 bp, Heterodera glycines
accaccatcgccacacagtgaatttagtgaatgagccatcagcagccatcgacggcttttgacgcggcgccaacggattatcccttcccccagccgcccctaatcagctgatgtgttatggcgctaatgccaaaaaacattacttactcttcttggggggggggggggcgaaaaggcacaccacgtagcagcagcatttttggtcgatgaaacatgtgccgcgggttacggtatggagaaaaaagagaaaagtgcaaaaaacataaactggaaaaaatagatcgaggtttcatactgtaattaggggataagcgattacggtgggaacgagagtggaaaaacagagcccagaatttgaaatgaccgggaacaggagattgaaaatcgactgggacgggatttcccgggttcacgtttttcctgaacttctgctggtccggtgtttggcccagaaacccggacgggagtccggaaaattcacggcggaccctcggtcccgtctgggctctactggcaaataattttgtgaggctcggaaagcgagaccgagaatttatgaatttacagtcgagaccaacacccaaaaactcgagaattatattcgtgtcgatactctcgaagtcaaacattggataaatgtctataaatttatgaaggagactaattctaagcagatggtgattatgttaaccttgtatgtgtgtgaaaagaatttggcgataccgtagtatagaaatgcattctttaaggatacgataattttatggattgtagcggaacaataatttatttaaagttacaaaaaatgtatgataaataatattattccggaataagatgcacaaaccataaactacatattacagtacctcccccccccgaggtgaaaagcttaacgataataatgaaaataatgactagccgagattcaaaaaatatat

SEQ ID NO: 5160 - DNA, 1629 bp, Heterodera glycines
  misc_feature (1617)..(1617): n is a, c, g, or t
aaaagatgcatcacaatttttctaacatgaacattaaactgtgcacttatttgttggtccacccaaatcaaaaaaaaaaatttttggaagtgtgccagtaaattgaaaaattcgcaaaccctcgtcgtgctcgtccgtatcgctctccttggccttctgcgctgtcttcttcggtgggcgtccgcgcttgcccgtgcctccgcccgccggtgcggccgccttcttcttcgctgctgccgatgtgccggtgccctttgggcggccacggccgcgtccagtcgctgctgccggcttgacggcgttctttgcggcgggcgagccctttgcctaaacaaattttggatgaaaacatgttttggtggtggacatgcgtaattgatggtccggcattaaaatttgaaatcccaaaaattaaaccggctgcggtggtgaactcggaggcgatttggctggtgacttggacggcgacttgggcgccgcttttgtggtcgctggtggtttcttggcaattgttttcgctacgccgcccgccttcggtggtcggccacgcttcttcgctggagcggacggatccattcaaatatgatttgatattattgctcaaaaagttgtttaacaaattgctgaacaaaagttttaaaagaaaaaatggaagtagtgattaatttgaaaaaaaaaattggaaaaaatagcaatgcttggatttggtccaagacatacatgcttaaacaaattatgaaatctaggtcagattttttagaaaaaatgtccagccttatagaaaattgaaattttaagtaaaatttttcccattaagcaaatattaaacaaaaattatgaaggaaaatttttctcaaaaaaaaaattattattcttttttcttcttttagcaaaattttttataattttatttttaataacatatgcttctatgaaatataaaacataataaaacatatatcaaaaagatatcaaaaaaaaattcaataatttggacggaccattttatgcgaaaattagagaaatatgaatgaatgcaaattgtcaacaagcgatttaaaaagagtgaatgggagagtgactcttttcatgcaaattaataatgccaattatttttcaaacttaattttagtgcaaaatttagcggaaatttaaatttttctctcaaattttttctcactcgatcagcaataaaaaaggagtacaaagtccattatttaatgggaacacccccagcactttcactcactcatcttcacagacgaacccaaccaaccaccacgactctcattcatttttcattatcttaacttcatttactaaagatttacccagggctgccatcgtccatgctccgttttcaaggacgggttgccgatttgcaaggacataatgggaaaaattcatgaaacccaaggacatttaaaattttttattatatacaatgaaaaatagttaatatttatttaatggcttgtatttgtcatcggaatggatttttccaacctttttttgtttcggctgatcattttcctcatttgcgacgacttttttctgctttaaaaacgcatttttttgcgccgcgcttttgcaaaaaattttgtgggacaggggggngggggggggggt

SEQ ID NO: 5161 - DNA, 6100 bp, Heterodera glycines
aaaataaataatatatatttagtccctttttcatagtaatcaaagttgtaaataactgcctaataaaatatagtaaatcttattgtaaaatgctgttaaggtatttatttgctatagaattcgtaattaatgattatttaaattatgccagaaaaatctgtcaaaatttcgaaaactcttaagtatgtttcttcattctataattttaccttaaaaaggcgaaaagcattgattgctaatactaacaagcaccgaaataatacacactcagttactaacttataattagtccgtattttagagtgataagaaccacaagattagctgaaaaatttcagaatgcaatttctgtgctaattaatataaagacctacctgttaatagcgggtaattgcatgagaaaatatattttaaattatttcgataaatacgaattacagaaggaaatttttttacagtttcagcttttgcattccaatcagggctggctgtgattgaatttccaatcacggaaatccgtgagccgtgatcacggggcttttaaaaaaatccgtgacccgtgaaccgtgatcacggcaccccaaaatccccgtgatttccgtgatccgtgagccgtgatccgtgattataaaaaaaatttttctaatgattttttatttaaatttatttaaaaaacggaatttaatcgcgggaaaaattcccaaaaaatgttttaaagaaacaaaacatataaaccgctttttttgcggcgaccatttccaaacaatgactaagtttacgatttttggcaattttttgaagaaaattagagctttttgtagaaatctccaaggaaaaatttttatttttaactaatttattaagaaaatttttcaaatttttcttaaatttaaccaaaaatctatttatgtagagaaaaaaaaatttcctctaatttgtaagctaacttttgatgctgaaaaaaatcttttggaccaacatgctcagtccttcatgacgatctgaacaccccaaaagatactgaaagtcgggaaaattttagaaaaaattcttagagggttgggaaaattttctgaaaattttgattaggcctgtcgttttaaatttaagcgacggagagaaaaaatagggttttagcagtttatatgccaaaaatggtaatttttctgccattttggggtcaaaatttcaaaaatacggtaaaatgggggtccgtctgccggtggtgccgacaggcgccgccgggaaaaattttgaaattttgagtgaatttgttgacagattttgtccaaaatatgtccaatcattggttaatttattggtctaaggacgttttaaaaaataaagaaaaataattttcaatgttatgaaatttcttgttaattaaatttcaattaaaattatcaaaacaaaatatataaattgtcctatcccaatggggaattgaacccaagggacagacaacgaaagaaagaaggcttaaccaccagactacatatatatgtttactttataatttgtaagcagcggccggaaaaaaaattgtaatttttaatgcgatttgtttacagatatttgtcaaaaaatgaccaaaatttaaaattgtgactttatgtcataaaatttcaaaaattctcaaccatgagaaaaaaattacattttcattgacataatgccataagtaattaaatattgttgaaaattacaaaaatttgtcaaatttctttgaattttttaaaacttttccaaatgcttatttccaaggacgtccttggcatccaaggacattttttattttcaagaaagagggtccaatttcaaggacgtccttgccattcaaggacggatggaagccctggatttacctattggttttatggttttttatacatttatattaaaaggaaatgaacaataatataattttgggattagagggggccagagactcgttaaaatttaggtaacatgtacttgagaattacggttccaacaatcaaacgttttatgtcttgaccatacttacctagtttcttatgccacaactttgttttctaacttagtcaaatcttacattcttgtttcttgagcacaaaatttagataatcaaaaacttatagactttaagctttcgattgataccaagaatgttgtggtcttgatcaagtatgaaaaaaagttatggcctaagaaatatgtgtggtcattaattggacgcataaactgcagtagagcccttttttctgttatagccacccctccattaaagccacccccatacgctttctttggccacaaaaataagttgcgcatttacaatgccttttcaattcaggagaatctcagcatacaaatacatattttttgtccaaattcccgtccattgttgtaaatacacaataataaacaaacgatgagtgacacaaatgtggtgaccaatttcatcgctggcggcgtcggcggctcatgcgccgtcatcaccggccatccgttcgacacggtcaaagtgcgactgcagacaatgccaaagccggcgcccggacagccgccactgttcaccggtgcgctcgactgtgtgcgccaaaccgtggcacgggagggattttttgtgaggttttttcaaaattaaaaaaaaaaaaatttgattttcgtccgcttcgagcgtaaatggacagtgattcggagtgggattttctctaaaacccacccaacccctaaatcatcgactgtttaatttgaaatacgtagatagacgcaatttggtcggaaaagcccacttttcaaagagtcacgagatttctataacctgaaaagttgcataaattcgggtgtggtgagaattttctgaaaaatcatggaaaagcaatgttttaatgggttttgggtccgaaatcacgaattttacacccattttccgcagtttctattaccaaacgccaattcatggacctatatcatataaagaatttccttttttttttggcatttcattaacgggattgacacatctaatttgccaaaaatttatccaaatttcaaaatcatgtcccttttctcaggcactttacaaaggcatggccgccccgctcgtcggcgtttcaccactctttgccgttttctttggcggcactgcactgggcaaatggctgctgcagaacgagccgggccagcagttggacttcaagcagaatttcacggccggtgccattgccggcgtgttcaccaccgctgtgatggtgccaggttgatcacttttttaagggctttttacttcttccgcttaaaagttaccgtatttgctaaaataaagccctgcggaccttaattttccaaccccccggcactaattttaggggatggcactattttccaattgatgccaattcatcatttttaggcgagcgaatcaaatgcattctccaagtgcagtccatggacggcagtgccggcacaacgcccaaatacaccgggccggtggatgtggtgcgcaagctgtacagagagggtggcattcgcagcatttaccggggcacggccgccacactgctcaggggttggtggattggggtacacggagtaaaattcacacccaaaatgggtcgattcaattttttaagtttttttttttctgggacgggcattgatttagggtccgtaaattttcgccaattttcaactcatttgcagacattccggccagcggcgcctacattgctgtgtacgaattgctcaaagacaaattttcgggcggagaacgaaacgagctgacgcccatggcaacgttagtccgggaaattgtagggggggggggggttataattgaggtttaaatttcaatttattacccctagtcattttttgtaaattcaaatcataaataaaacggagcagctcgcccctctctcgaaattttttggaaaagtttggggcgcccggtcaggtaaatcgagattttttttggttttaatgcgtttttacggcgcgttcaaaaactttggggaacgagtgctccgactgtgtcgatccatatccaaatttgttgctcttttcagtctgctggcgggcggttttgccggcatcgccaattggtccgtgtgcattccggccgacgtgatgaagtccaggctgcagacggcgcccgagggcaaatatccgagcaagttttttttggcacggtgtctaagtttttcatttttgttttttttaaatttcaacgagttgtcactattaacgcccgccagggcaaaaaactgtgggacacggagaagttcttgtcgcaaaatgcccgccgcgagaggattcctcccacagttgtccctggccgggctttcaaaagtgcaacaaagaaaataaaaaaatttgggaccctcagggcttgccattctgtccccccttcaaatttttttttgaaaattgtcccccacttctatccgttgtaagatggcatccgtgatgtgttccgcgaaattttgcgagaggagggaccgcgtgcgctgttccgcggcttcgtgcccgtgatgctgcgcgcgtttcccgccaacgcggcctgcttctccgggcttgagctggcgctgtgggcgtttcgccaagcgggcgtttgaaaaaaacaaacaatctctgtgtttactgtatttttcgatattaatttcattgttttgtcgctgggtgtgtctgtctctcctcccttcgtccgtctctctctctctcccattttatttgccttaccacacaacaacaataaatcaataattaaatgtaattaacttgcgaaaatgtatttctgattaaaagcagtgattaaaatgtgtaaatttttgatttttgcatttgacaagtaagtcacaatgaaactgaacaaatttgacggcggagcccaatcgattcagtgcgatcaatcaaaaataactaaaacgtggcgaatttatttgacctcggcattttaaattaacaaatttttatgaaatttcattttttcaaaatctaaattggccaatttgaaaaaagtgtgcggaaattgtcagactgaaccgaccgcggccgcttcatgtggcattttatttctagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaattttaaaaaacttattttcacctattttggcattttgcccaaaatttgttaacaaaaatgaaataaaaaggaaaaacagacccctaagaatcgaccgaaaatttttttcaaaaaatatacccctaagaatcgactcgaaaattttcaaaaatatacctttatttctgtgtctttttggcattttgtttgcgtattttgtaatttaattttcccccctctctcaacagaaggcatccgtgatgtgttccgcgaaatgttgcgcgaggaggggcaccgtgcgctgttccgcggcttcgtgcccgtcatgttgtgcgcattccacgccaacgcggcctgcttctccgggcttgagctggcgctgtgggcatttcgccaagcgggcatttgaaaaaaccatttttgctttaattcaaattcagtgctaatttaatcttattgtatttactgtattatgtcgaaaaattaaaaatcttttgctcataaatctcttatgtttcaatttttgagtttgactttggcaattctataggtactttttcgtttagggcgcccaaatttgaattgtggcatttatgcttccaaaataatttttacgccttttttttgcaattcttgcgttcttacttgaattttcaaaaaattcaaatccgggctccaaaacagaaaagtagccaattaattttatctgtgaaaagggggattagtcagtgatcaccaatctctcgttactctctgacagtctgtccgctcttatttgcccacactctctcatcatatctctctttctctttaactcagcgcaaaaaagtggccaattttcgattatgacacaactaagagaatcaaatgtacaataaatactattgtacaggttca

SEQ ID NO: 5162 - DNA, 3280 bp, Heterodera glycines
  misc_feature (3234)..(3234): n is a, c, g, or t
  misc_feature (3249)..(3249): n is a, c, g, or t
  misc_feature (3268)..(3268): n is a, c, g, or t
gaaaagtccgggagccatttaaagaaattttggcaaaaattatccctaaattaaaaaatagttttttcatgttttgcaatttttggtcatatttatgcgcttgtttttgattgtatgtccatataattccatactctatctcttcaccaccagccaaccactgccacattttccatgatttaaaaatttaaattaaatacctaactggatgtgaccactttttgggttgcgttccgcactttttttagacccattcaatatatggaaattttttccccttgggggttccggcgggcgaagagggtcagttccgtcccgccagttcgtcccagcaagtttagagcatcagatatcatttaaaagctcttaacaagttctatcggcttcacaaaaatcacagcgatatacgtacaagtaaaaaaagttataaataaaataaaatattcatgttgcaactttttataacttgttcaatcgcttagaaatagcttgtcaatagcttctaaacatataaagctttcgaatgttgccaaatttataaatttggccaactgagaaaaaagttatgatgttttttaaacatgcctgggacggaattggcgccttggacgggagggagcgatgcatgtatatccctccggcgcaccacccactggaatagtctctgatcccatccatttgacgaaaagccattacctcactcaacggagcacacacatatttctggatctgtttaagatccatctcctggctaatcgctatcgctgcaaagttgcggaattggacctgaaatgctgtctccaggcactttttgcgcgcctcgagatcaaatgacgcgtcaatcatcaacaaattgagcaatttggtgacttcatcttcgagcttaaagttcgtcttcgcttgatcatacaaaaagtgatctgaaaatgataattaggattataaatcatatggactaaaaaaaccccaaaaatttactaaaatatggactaaaatgccaaacacatggacgaaaaagctcaaaaatggccaaatatggaccaaaatatggataaaaactgtcaaattttaagttttaaaccctcaaaaattcccattcgagagcccttcaaaggttcggtaatatcgccgtttgtactccagcagttgagccggtgaattttaaacagtaagcataatagttatgtgtgaaattttaaaaatgaaaggttcctctttgtttttttcagcggagcccaaaaaactaaaaaagtgccataaattgttttcatcattccatactaatggcatatgtcatgccatttatttccagctgctgttcgtcctccccagccgtttgccttcccttccggcgtctgttcctctccttccgtccctggacggagttgaccccaccgcgatgggcactgcggtaggaaacattggaattttgaccctttttaagagattttcacagaaaatggtaatttttgggtcaaattttgaagttttaggggttttttcctagacgaaaaaccctagaccgagaccgagaagcgaaaaacccgagaaatttcccgagacgagaaccgagactctcgcacatccctaaggtctctgtcactttggcaccactctgttaagcggccaacgacgaaatgtttttagaaaatccaaaacgggaaaacagaaggcacaggactcaatccttattttccaaacagaacactaaatgcattttggtagaatggaatggtgccgggtcgttactcaaaaaccatcaaaataaaaaatgttggcagaaaattattcataacttcgcccaaaatgaatcaaattttagaatctagatattattcgatagccctaagtgttttctattatcctgctaaatttcaaaaaaattcatgaagtttcgaaactaaagcaagttttcttgaacatttttggtcataactttctttaaactttctcaaaatttttgaaattttgtaggataatagaaaacactttgggctatcgaataacattaataattaaaatttaatttacttttgagcaaagttatatcaaaaaaattttttattttgatggtttttgagtaacgtcatagcccaattgaatgcttaaaactaaaaagacacttattttccaagtcataaaattctttaaaaatttattttatttatttatttatttatttttttgctatttttgtccataagaaatcaattttttgtctttattttcattggcatcctcacttgtcgaatgcttctgcacccataatttcatttggttacggtcatactgatacggtatttctttttcccaatctttcaacaattcgtgcaacccatgcttattgttgctcaaattattaagacgaatgacaaatgaaaactgtttgttctttttggccaaatcgaccagctcatcgatgcttctttaaaattgtaaataaaatagcgggcacaatgattttaaaagtttcctttttttaattattgtgcacatatcagttaattaacaaatttataatggtttttttaatgatgctaatttaattggaaaaatagctaatttaaaaaaaaaaattgcaaatccctgaatttttttttctagggttttatccggggttttcaacaaaattttggcacattaatatttgataaaatatgggatgttatttttatttgataatttaaaaagtaaaatttattagataattattacgcttttgtttcccgctttgtgtcccttaatttgttcacttttttctccgcttttattataattgcattctgatgttcagtgttctggttaagctttttaagtttgctctttgcattgtttgcttcttttaattcttctctcgctttatgcagttttttctatttaaaaaaaattatctttttaaaaaaaaatttattttagtaagaaatttctctttttaattaagcatttattaaaaatattagtgaattttaattaaatctctcatatctattcctcattttatttagaaatatttttaaaaagccacaagtttatacttaatttgactcgttttttaattattaatcaattactctgagctcaaccagcacgtgttgataataaagggcaagttttagcacctccttctgtttttttatttgttcaggattttcggaatgtaacacttcaagtgcaaggcgaacaatctgctcatttagctattgaaaagaaaattaaattaattttaatgacaanattagaggtaattanattgaaaataaataattanatgtaacgagac

SEQ ID NO: 5163 - DNA, 4457 bp, Heterodera glycines
ttaaaaataaagaagaaaataatttaattaaatagtcgaaaatagattaatacttaaataataaaacaatttaattataataataaattaaatcaaaaaataaaagaaaataatttaaatttaaatttcgaaaataaattaaatattttaaaaataaaactttataaaattaaatataaaaattaaattcatttaaaaataaacaagaaaataattcaaattaaatactcgaaaaaataattaaaaatttaataccaaaaaaatgaaatgtaatagtaaatagtaataaaatttaaaagaaattaaaaaaataataataataaaaacatttttaaaaagtttacaacaaaattttctgtttatgaccatcattttcgcgtgatggccacgttggaattgaggggattattgaggtttaaaagctcctctcaggactttttgacctcatcgacgggaaaatgggcggggggaggtgcaaaattacaacaaccgacggctgttcaacaatattggaaatttgagaccagcagtaaaatttgaaacttggcaagaacattttttttttaaattaaagtaaccaaaaaagagtaacctaaaaaagattaaaatattttaaatttacgaaaaaatggatataaaaacgatttaaaaaataaaaatcaaaaaatgggtaattaaatttctgaaaacgttttaaactttcaaataataattgtcaaaaaagattaaataattattatatatatatatatttaaaattgatgtcaaaatatctcgtcaccattcataattaaaaaaataataataattaaagaaaaataaatggaataatttagaattaattgcttgagaaaatgtatttttttaaatatttaataataaataaaaatattcaacaataaattctttaccaataagaatgcgtccatcttcctgaattgtaatggttggcctcctgagcacaattgtacgcactgagcttccggtgtgttgaggaaaaatcttttagtttactaataatttataaatgttaattaaaaattattttttaaattttttataaaagattttttgtaaatttcaaatataatttaatttatattttggacaggctcattggtactgaaattggcatttttctctagcgacaacaataattagagttgtacgggaccgggactggtactgaaaaaaaacgtacaactgagtacctagtcccggttttgaccgggaccgggactagtcccgattttttcccggttttcccagccaaaaattccctgtttttcaacccgaaaattcccggtttttgtcaaaattcccggtgccgtgcaactctaatattaacacctcatgactgtaccttcttaaaaatccccatccgcccttttttgccaccggcttttccattatttcagtgacaaaacgttggcccgacggtgagtttagcaaacttttcttcaccgatttgctgctgctaaggcttggcaattgttttttcttcttgtcatcatcaccaccacggcgccatcgacgacgagtgccatgctttttgtttgaaaaaatgccagaaaatcaaatcatttggcgccgtgccaagaaaactggggcagccaaaattccaaggatttgatggtttgggaaaagcacatgggcaagaaagagccatcaattcgttggaaatgtgccaaaataaatgctaggtagagggtattccggtaccaattcataaaaaccgccaaaatgtgcgtttcataaaatacgccaatacataaaaaaataatttcatttattaaacatattttataataaaatatttaaataaaataagaatcagagtttttagatatttattggtgtcagtgtatgtcatcagtagggatacgatttttagttttttaactatttttttcctgagctccctatggcctgaaacgcataaaaacatgttttttcgattgttgttaagctagttttcgataattaacctgaattttttttaaaaatatatctttaagaatcgaccctaaaaattttaaaaatattcccctaagaaatgagaaattttctaaaaaaattcatctccaaaaatttgtttattatcttgaaagatttttgattataaaaattatgtgtgtctcattaatgaattggcatatttttgttgctttttgaagaaaattttgattttgcaactattttcttcagacatttaaatatccatttgataaatcaaatcaaatgagatcaaatttatttatttatttgtctccccaattggcagatttcatgaaacgacctagcacctaaattgaccaacccatgaaaaacttggcctaaatatggcttagggagtatgagaaaaatgccaggatgaattaaacaatgccataatttgtattattttcgaaatggctgtgccttgatcgtttgtgtgtcaaatctatgtcaccaaatatcagtatatggaaaaaggcgaatgcttgagaaaaatgcatatgcctctacatacaatgtttggcgttatgatgagagcagttgccggactattgccaccgatgatgccatgttcgggagaaatggtaccattttcttgagtgaagatttaaatgtttaattcaataaaaccatttttaccgttttttgcagtttcagtttgttgtttggtttccaatgtcaccgatatggccaaatttgtcgccaaaaatggcacaagcattaataaagttagaaaattgaatttgttcattttctattaaaataaataatacatttctttaattattttaaaacaattaaaatattttagaaaatattttttctattttttactttccaccgtccgcgattaagataattttttagcaggaatatcgcaattttcgggggaattcttaaaatttttttttcaggtttttgtgtcttttatttttcttaatgttaatctggacggtatgcttgattaaaaaaaattcagttttacaaatctatttgaatacaaaaaacacatataataaaatattaaataatagaatattgtttattaaaataaaaatgatttctgatggctgaaataaaatatattccccaaatagctattacaacaaaaagctaaatgctattaatggggagtgggcatgccaatatttgcatgtcacatttcacagagaaatatatgaatagagatattgatttgattattcataagatttgcataagcataagaaataactaatttataaaaaaaatggtttcgtaaaaacgtaaagtaacataattaatggtggctggacatttcgacaattaccgtttcgccaatgaccgtttcgacgataccttttcgacaatgaccatttacaaccatatcatatcgccaaaatttaaataataaattaatacaaaaataaaaaattactttttaaaaatatagaaaaatataaataaattataaaattagttgttaaatttaatataattgattaaatttaaaatacctagttccaaaaacatgttgttataaataggtatgttaaaaattctctcggacattttgaattaatttatgcataatgaatgcattattatctatcgattcgagagtttattgaatttgtcgaggttaagtcaaaaagaggcgcttcattgttcttgagggacggatagattcgaatacgcttttgaaagactcggcaatactcgaaaacgccgaatattacctatgcctcataaacgcaaaattcgaaaactaaagccattctcataatgctattttgaacaaaaactaaaaaaaaactattttatattgatcccaaatcacatcacctcgtttcatttagcagaaatttgaattttattcaaaataattatttgattttattgtcgaaacggtcattggcgaaacagtcattgtcgaaatgtccggaagcccaattaacttttaaaaatgttttcgtaaaaacgttaagtaacacaattaattttttaaaaatggttcgtaaaaacgtaaagaccagggctcggatttatctttaaaaaaaattcctaaatattaatacggtttaattggcgaatatgaaagaaaagatcataaaaagtatttaatcttttcaaattcagggtaacaaggttgcttgatgtaaaattcaaaagcctattttatggcgaaaaaacctcatttagaaggttaaaactcttatttttaaaagctttattccaaatttaaaaaaagaaaaatcaaagattgtatttttaattttccatttaaccgcggaatggtcttaattagacttacttttagaatctgttatttcaaggagcaaaacctataaaattgcattattgtaaatggcgtagaaataaatttgtgaggaattttaatattatttgtgttggataagaaaaagattgacgcatagcgagcggatttatacgcgaagaaaagctctagagatccccgg

SEQ ID NO: 5164 - DNA, 7862 bp, Heterodera glycines
  misc_feature (46)..(46): n is a, c, g, or t
ctttcttcacatacattttcaaacccatgacctcaaaatgttattntgggtgcacctacgactggtgaaattagcacaaagtcgttgtcgttgggcaaaatttcaatgtccaattcacaaaaattgatcagatacaacggctgattgaacaggtcggtgtcaatttttgcaatgaattgagctacgttgctacccgcaaataaatcgcgtcgcgctgtgcatccgcctcccatctccaatgtatcgcccgtgtcccggaagtacccagctgcattcagatgggagtcttttgcggtcgttgaataggagagttcatgtgagaaatatgatttgtaggccatcagggcgtttgcattaaaaatttcgcgcccattgatgctcattttgatgttacggatgaaggtttgtccgatcatttgaattggcgcaatatttatgtcatcaatgcctaggttaacgagttgaccattaacgttttccttacggattcgaaactcggtgagcaaatagcatttggagaggtcaatgtaattttgactggagtgaagtttgaagtggtagggtgtgtcggtaagcggattgctgggcagaagctcgaatacctttgaagatgagacgctcacatttgtagggggtatacggaaaaagtccaatgcattggtgattgagttcactgagtcgttgtcgattttgtgaaatgtcatttatttagtaaagtccaaaggcgtccgatcgaatacgcttttttgcctgttttacaataggtcgaccaattagtgtctgatgaccatgtacatatgttctctttctttttatactccgttttccgcttccaaactgttttggtagtcctcctttgtcaagtacggtatcaattcctcgctttccctcactgacaagcgcctctttaaatggcaccccctcattcccgactcgctccagcacgcgttgcccagtgcttagcgcctccgaccctaccgtggtgccaacgcggcgaagaatgggtaggaaaaagcgccacagtccacgaaacacatctccaacgcccgcccctcgttgaataccgtaccccctctgaaaggggcttgaccccctgaagtagtcaaaatcgtccttttctaatccgctaccgtactgcacatactcgtcgtactgcgcaatgcttgggtcaaacacaatatgaaccatttttattaacgtatgacaaataaaacataaaatgaatgaaatcaaaaatttatcactttcttaaatatcaacacggccatcgttgtcccataggcgaatggcacgagacgacctttgtccattgtgcgcagttcaatctcaatctcgttgatctcacgtggcaacactcgcgcaaatattggcgagtcgtaaatcttctcattatactccccggggatagcaccgctgatagacacaacccggagcaaggagctcaatgaattgccaattatcatattttcagttagtccttttgagtagactgcaaaacttgatatgccacctcgtagatcaaacccgtatttggcaacttcatttgacaccacatgctgagggttttcaaagccaagcacatacccgagctgtggtgagaaggacaaatggctgatgatctcctcattgaacaccagcttgaaacgttccatattggtttcatacagaataaacactgaattgggcacatatgtcagagggttttgattagctggaggagttctaaaaaatatttttggtgggtcgagcgtgtgaatcaaacgcgatgggtctatttgagctgctgatgttggtggtggtggtggctgttgatgttctgtttcttcaaaacggggtggagagcctgacggcggagcttgaggcttagaaggctgttgaggtttgagttgagatgctgtcggactttttagttgcgctggaggcgccgtaattatcggtttggcagaaggttttacaggcgttgctgtctttacagttaatttgtccttatcttcttcttcatcataatgtggtggagattccgccttaggagacggcggcgtttgaggcctagtgcccactttagcggaaaccgacgctggaagtggcggcttaacagtagaaattggggtttttgattttggagacagtgccgagctttttagttgcgccggcggtaccggaatcgtcggcttaacagatgggctaggaactgcacttattgctggcgtacttgttgttgttgtctttggcggtgcaggcaccgttgttattggcttttctgttgatggagggccggttgatggctttgtgattggtggagggacggttgtggtaggtggagggccggttgatggctttgtgattgctggagggacggttgtggtaggtggagggctggttgttgactttgtggttggagtaggtgtggttgtggtaggaggaggggtcggtgttattggttttgtggttggagaagggacggttactggcggctttgcagttgtgggaggcgctggtgttgttacagatggagtagctggtgtttttactgtcgttggtttcgcagggcttgtgacaggtgctggtaccggcacttttggtgtgacaggagctgttactgtatcattttgctcttcattgtaatgcggcggagactcctcaatcggcccttcatcatcttcttcttcatgatgaggtggtgactcttcaatcggcccttcatcatcttcttcatgatgaggtggtgactcctcaataatttcttcatcgtcatcattttcattatgcaatggaggaggggcaatctgttttctactcacgtcaaacaccgtatctcttttctgtcttttcaaaggcggtggcgagccgagaggctttgttgttgtacgattccgattctcttccacctcacgagggagaggttgtagttttgcaccgctatgattactcaaagtgacagacaaaaattctctcaactgctcaacccgactatgcgatgccttaggcaccggcactctgatcactcgctgtctgtcctcatcggtcgctctgcggtcggtgaagtgaatgtcaatccattgctcatccaatgtgccaatggttgaccatgagtaggggtaactgatactgtgcagtccgcacacccacgagccgttaaaatgtaaaggttttggaagccgaacacggaatttattcggctgattgtcagggtaatcactcacattactaggtaaaaacacaaagaaactgttcgacatgattgtttatctgcataaatgttgaaaaatgtgaacgcttttatacaagttgggactcatgaacccactcccgattgggatagccaataaatttcacaagcatctctgtggtcccgtccgttcttttcctcttcctgtacaccttctcgatacggtagcttgtatccgcgtcctttcttacgcgcgccaactcctgctcatagaagctgcccttgaatttctcaccatgttcatcccgcaatttgtatcgaattgggcgcaccgctttcaacacctcatcaatctcgagaatttcgtctccataatttggtaaatatcccttctcaaattgtcccttctctctgctcattcgcacaaattcatctttacggaagcggggcgtttttttgaaaaatgataggggacggtacattcgtttccacaccttctgagcatttgaaaaatcaacatcaataggtcgcataccgtgaacacgagagtgtgaactattaattccatccacaattttctgtactgcatccacccagttcagcgtctccttctccgcgaaataccggtacagtcgctgcttcacattacgaatggctcgttctgcaaccgacgcttttacggatgaatggacaggctcatgcttctcaatctcccgctcctcgaagaattccttcatcaatcgatttttgaactcggtgcctttgtcggagaaaatacggtggggcaccatgggcatttggtcgatgagttgcttgaatgcctccagcatctcctcggctcgcttatttttcagcggtacaacaaacaggcgtttggagaggacatcaaccgcaacaagtaggtagcggtgaccccgattgtggcgcgaaagagattgaaaatccgccaaatccacttggacatctgtcatgaatcccgctgcaacagttttggcccttggaaagcgcaccctgcgagggcgcatcagagtgtaggtgcggtgaccatccaaataatgctgtacgtcctttttccgtaaatgtttaatcttctttcgcgcctctttccacagcgctgtaacacctgcgaatgccgctggggatgatggatcattgtacattttgtcaagagtggtgttgatcagctccattttttcgggcgaaattccttcttgattgcccgttccgtccgggtggttttgctctgtgacggtctctttggtggggccgtccatgaatacaaaattgggtccttcctaagccgctcttccaataggttcgctcctggtggtttaatggtggggcggcccgctctccggtctattatatacttgatggccattcgcaaattgctatgcgccaacggcttgccgtttgcggtattaattgtatttccccgaacgcccatacgatccgcataatggttgcatttgatgtatagccgttcaatccgctgagtcatggtcagctgatttgacggaatggcaaacagttcacgttgttgccgttgttgttcataagcttgtgctgatgttgaagggcctggctctggcgaatactgtactcttacccttctcggttgcctcacccgttttcttatgtgcacctcaccattctcatcatttacggggtgggggcgtttggtccccctcctaggcggaggaacatagggtatttcttcgacgacagcagtaggatgaggaggttgttgttgctgtaatggtttttctctgatttttggctctctttccgggatacggtatggtacgggcctctttgttggtgcatgttttggttctattttggttgtcgggggagggaagtacccggcttgcctagacgtggatggccgcgggtccagcttaagttctggctctcttttcgcccgaggcgctggagtagggtgttgggttttcttccaattcagctttacctgttgtttttctctcttggcggtaggacgcggtggaggtggtcttggttcaatttttgttttcaaacgaggcggggatgggagccgtggaggtgaacggtgataaaccaaaaatcttttgcgtcgtaaatcatcatcatcattatcatttgcctcatccttttgtaattttcttctggtggcactcctgtgctgagcagtgtccatctcctcaatttcgttcgcgttgtcgggcagcacaggcaaatcgccataatattgtgacggcgctggcaacgcgaatccactctccaacatgtactcatcatcatcatcgtcactttcgggcaatggcgcagcagctgcttctgcaagaaggtcccgcaccaccggctgccgttgctgtatattgtatcgacttttccgccatttctccagacgaccacctctccgagaagctctacttggtctttgggggcgttcaggacggggcggaggacttccgggtggggagggacgaggagtagttggtccagagggagggcgtctcccagtcggtggaggagggggtccacgcggaggacgtctccctggcggtggaggtggtggtggtggagcagggggtcggcgtggagtgtccacaacctcaccatcttcatcttcaccacctctcctcatcagtacactgattcctttggtgagctcaactttggctggtctgtccgcaagatccctcctcattttcaaatagcgccttagctgttggttgtagtggacattttttgttgagggatttgttcgctcacccctggctcggttcaaatcgtgtcgaacagcatccagattgaggtcgcccgtgtcatacacggaggtgagaccacgataaatttcttgaggaacgagtaaaaatttattcgccatttatcgccaatgaatgaatgatggaagcatacaaaataacaatgtcgatgggtatttatgcatttttgttcatgatagactttgccaattcaattagaacgggggttaatacggcagcaaacaatcctccaaatcctgcgcctttctggacaagcacacgccgggcgccccgctcacttctcgctctgctcattcggcgtacagtatccacatggggcatcagtcgctttttctgacgagttgagagtcggaagcgtgaagcgacaaggttcagacaaatttccaccagtgcgagcagctgttcggagtttgctttccctatcagtttcttacattttttagcggatttcgtcctggccaaggcacagagccaatcgcaattgttttttatcagctctccaatatttacttgttgttgttgttgtttatgttgctccatttttggggatgaacacaattgttccttcatcttcctcctgttcatctttaaatatgtttgttcgaagccgtaacgatgggtccgatgaagcatgcatatcgatcaacaaatagccatagggacgggcagtcgctttgcggtaagcatcaaggaaaaaatcaagttgtcgtggaaagagttgaacgccaatgttgcgaatggacaactgggaattcggtgcccgcatcagtaccagatactgagcggacatgcgggccaccttgatcttccgctcaaacaaattttgagtgacgaacaccaccgcaaattggtgatggtgtgactttttggtgaacaaatcggacaaatacttctcatcaatggatagcatcaggtcgtcgagaatgagcaaaagaggcttagggaaacgcttgaccaattcctcggatggaactcccgcatacacatcgactcccgccttttggagagccggcaccgccgaattcatttcaccaaaacaatagagcatggagatgggtttagggattatcaattggtccgattcagcaataaattttaataaaaattcagttttccccgatgaagagggacccgaaatgattagaccaaacggcagtttgaagcaaatatctttattggtgaatgattgggtgttaagcatttttagggacaaaatgaattacaagtttgaggtggatgctttaatactgttgaagaactcatcaagtgttttgtcaatgtctccaatgtcctccttgttttcctctttttctttgggctcttcctgcaccttttcttcctccacagggctattggtcaccttttttgtccagagattccgctaaaaggagatttccgagtacattgattgccgttttggccttgttccaacgcgcgccatcctgcatggcatcggccattaacccagcttccactaagtcaagagctaccttcgcctttctcttcaagtcctgtttatcctcatcggtgtgcgtcccttgggttggcgtggtggtgggggtagtagtgcaagtgtcggagggcaggtcaccgtagggtacattgaatacgcgggccttgtttttcacacggaagaagcagtggcctggtagatcgtagacaacatcaaatgggacgaattggactttgctgatccggctgcaccacatagtgatcccctccttagtcaccattatgtcgacctcaacttcagtagctttacaagcgcggcagcgaccgcactcatcgaatggtataaaacggggagtggacagacgaggaccgctcaatgttatgccgcttgttgtcacggttatgtcagattgggcaagaatttgattgacaagcgatcttttgtcgcacatgttaattgccatttttat

SEQ ID NO: 5165 - DNA, 1240 bp, Heterodera glycines
cctcatcatcttcatctccagcacctgtcgtcatcagtacaatgattgttaaggtgagctcaactttggatggtctgtccgcaagatccctcatcattttcaaataccgccttagctgttggttgtagtggacattttttgttgagggattggttcgctcacccctggctcggttcaaatcgtgtcgaacagcatccagattaagatcacccgtgtccgacattgaggtcagaccccgataaatttcttggggaacaagtaaaaatttattcgccatattttgtcaaatgaatgaatgatggaagcatacaaaataacaatgtcgatgggtatttatgcattcttggtcataacagactttgccaattcaattagaacgggggttaatacggcagcaaacaatcctccaaatcctgcgcctttctggacaagcacacgccgggcgccccgctcacttctcgctctgctcattcggcgtacagtatccacatggggcatcagtcgctttttctgacgagttgagagtcggaagcgtgaagcgacaaggttcagacaaatttccaccaatgcaagcagctgttcggagtttgctttccctatcagtttcttacattttttagcggatttcgtcctggccaaggcacagagccaatcgcaattgtcttttatcagctctccaatatttacttgttgttgttgttgttgttgtttatgccgctccatttttggggatgaacacaactgttccttcttcttcctcctgttcgttcttaaatatgttggttcgcagccgtaacgatgggtccgatgaagcatgcatatcgatcaacaaatagccatagggacgggcagtcgctttgcggtaagcatcaaggaaaaaatcaagttgtcgtggaaagagttgaacgccaatgttgcgaatggacaactgggaattcggtgcccgcatcagtaccatgtactgagcggacatgcgggccaccttgatcttccgctcaaacaaattttgagtgacgaacaccaccgcaaattggtgatggtgtgactttttggtgaacaaatcggacaaatacttctcatcaatggatagcatcaggtcgtcgagaatgagcaaaagaggcttagggaaacgcttgaccaattcctcggatggaactcccgcatacacatcgactcccgccttttggagagccggcaccgccgaattcatttcaccaaaacaatagagcatggagatggg

SEQ ID NO: 5166 - DNA, 1601 bp, Heterodera glycines
aatattagcaaaatgtgtaacccaaaaaaccaacaaactttgtctcaaaattccagaggtacaggtccgagtcgatggacatccatgcacgcattatggagggcaacaaaccggtggcaaaattgctttgcatatctgaaaaatgcgtgtgaaaattatgccaaacttcataaagtgagaaaataattgtaaaattaagtcgggagtaatttaaattttttgcttatttcgcacagaaaacaactaaaagctgattgatttgaactataaaaggagtcgttgttcgtttttgaaagtccaaaacaaaagcaatttaaacttaattggttgggtaattgacactaatgactgaaaacaaagcaaacgtttgaattggtcgagcaactcctgcgggaacgagtgatgccaactctggtagaataacggcacgccaaacggctcgtgccgcgcgtagtccgcgtcggaaagaccggagaaggccgtttttcctgcaaaaacgagacatttgttaggtcaattttttggtggacttttatcggcattttttgtgccagcccatagccactggaaattttaaataaaactcgaaccctattacagtttggacaaaaagaatacgagtaaaaggcgttgcgagaaacagaaaatgccgtaatttgggttaggtatagggatgctttttgtctaacaataagaatttcaggggttggcataagatgtgatacctcttttgaaaaaatgtgtcccaatttgtaaagatttcaatgaatgccagacaaacccaagaaattaaaatgtgtatttttgaagacacaaaaatcccgggcataaattttgaacaattgaatggagcgctaacccttgccaatgtacgggtcgtccatcttgagcttgttgtagagatcaacattttgctgatcagcgcgcaaatagcgcccaatttgttgagcagtgtccataaaattttgcaacaataaaagtaaagtgcgaaggacgacggacgattcagcgacagatattataacacaaaaaagcggtggcaattcgaaaatcgaaaatacccctcaaaataatacgcaaaatttgtgatgaaaagacggcaaatctttgaaaaaggcaaataaattttaaaaaaagaaatgacgaatatgtagaaacaatgaaaatgaaaaatgacgcactttttgataaatgtttatgatggaaatgagaaaagaaaagctgtgcaaacgaaaaattggaattcctttataaagaagtgattgttaattaagtaatagtaggagaggcgaaattcccgaaaatgaaaaattaaaacaggcctaattttgggtaatttcaaggtgttttaatcgagaaaagaaagccttcaattaagccattctctagaggattttcctgactaaaactttcttgaaaatttaatgccgaaaaaacacagatttattggttttagttttgcatcttctaattgcctgtttggggcgtcataagcaattaacaaattaacaatttgtgctcgagaaatcatgacaaaggcaaggcataaaacaaacagttaagaaaatcaatttcggcgggaaacggaaataaattaattc

SEQ ID NO: 5167 - DNA, 2742 bp, Heterodera glycines
  misc_feature (2640)..(2640): n is a, c, g, or t
  misc_feature (2671)..(2671): n is a, c, g, or t
gggggaaaattgctgaattagacgaatcgaaagattattccccgcatggggcaccacccaccttaaggatgtaagactccaccattgtctggaagcaccaccaatcgaatttgacggtgaccactttgtaggcgcacatcaccggctcgcagttggtctgccactgctgctccaacggaccacggcctgtgtttacggagcggaacgtcgacggtcgggtgttgttcggtccgaggggtcaaggaacacgatcaataatgtttattgacgaacaataaaataaaaatggaggacaatttggtcggaggaaaaataacaaaatcaaatgaatgagaggaaaagaccaggagggagggaatgaccgtctatttaagggcgagtgacaacaacaaaattgcggggatttgaatagacagatcgccaatataattcaaataggctcatccgaacacctccccttttgagcggctcacggcgagtacctttgtggggcacgtctgttccgttgcgggtatcggcatggctgaacttgctgatctgcttcttcggccactgattcgtcgttgtctgactgactcagatcattctcgagtccctgctcttggacagtttggttttgctcatcccgagcttccaaatcattgacattttgtcgatcggcgggttttccgatgtcaaatgcgtcgagaaagatttgcaattggtcggcttcgtcgggagtgtgtcgaggacggagttggttggcatggaatcttcctgacgacccgtcacggaagcccacgtcataaatgactcctctctttttggacacttcaccaaatttccaattttgtgaaattcaacaattttgatgacaaaatttttttgattttgtcaaatgcatttttgcatttatcgctccaattccattcggtgtcctttttcagcaaatcatcaagcggcttttgatgaattgttggtaatggtttaccattcccaaatatgaccgaagtgaagagacatccgtcggttctggcatctcattgatggcggtgattttgctggggtcgggtctgcgtccgtttttgtcgattatttgcccgagatatttaatttcatcttggaaaacgaacatttttcccgtttgacgcgaaatccccattcttgaaatcgcgagaacatctttttcaaatgttcagaatgttctttttggtccttgctgacgatgatgagaaagtgattgttaattaagtaatagtaggagaggcgaaattcccgaaaatgaaaaaaacaggcctaattttgggtaatttcaaggtgttttaatcgagaaaagaaagccttcaattaagccattctctagaggattttcctgactaaaactttcttgaaaatttaatgccgaaaaaaacacagatttattggttttagttttgcatcttctaattgcctgtttgggcgtcataagcaattaacaaattaacaatttgtgctcgagaattcatgacaaaggcaaggcataaacaaacagttaagaaaatcaaattcggcgggaagcggaattaattaattcgaatgaaaattaatcatcataatgccaatttttttgctaaaaatttttatttgagcccggaaatttcaaattggattttcgaaggcggccaagggttggtgagagataggcctaacaggatcaaccgggtgtttttttttgaaatgaggcttttaaaaattcaactgcaaggccctgtatggcctatattatctaacaaatacattctaaaatctcgaacatttattttctgtcaacataagcacaataatacatacatatcaatcaggaggaaattgggagtgtgttcagtaaacaataagtgccgaaatgaatgcgtggaggtgaaaggacaaatggtgtgacaaatattatatacaatatgacgagcaaatagatgagcgtcatcggcacgatataatatgatgagcaaacagatcagcgtcatcggcacgtcactcgcggttcatcatagcgttcagccggacattccacgcggcctgccggtcatctgagcaaaatggacaacgattacgtaaagcggtggaattggatggacggtggcagagtagaagcccacctcatccaatgccttctttgtctcctcttcgatcagacgaatttgcgccagcgtcagcccgtaccaacggtccatccagcagaacacctcgcgattgaacttgcacaaaaggcgggcgtactgctaaaagggggaaaattgctgaaattagacgaatcgaaagattattccccgcatgggcaccacccaccttaaggatgtaagactccaccattgtctggaagcaccaccaatcgaatttgacggtgaccactttgtaggcgcacatcaccggctcgcagttggtctgccactgctgctccaacggaccacggcctgtgtttacggagcggaacgtcgacggtcgggtgttgttcggtccgaggggtcaaggaacacgatcaataatgtttattgacgaacaataaaataaaaatggaggacaatttggtcggaggaaaaataacaaaatcaaatgaatgagaggaaaagaccaggagggagggaatgaccgtctatttaagggcgagtgacaacaacaaaatgcggngatttgaatagacagatcgccaatataattncaataggctcatccgaacacctcccctttttgagcgctcacggcgagtacctttgtggggcacgtctgttc

SEQ ID NO: 5168 - DNA, 2304 bp, Heterodera glycines
  misc_feature (23)..(23): n is a, c, g, or t
  misc_feature (57)..(57): n is a, c, g, or t
agagataggcctacagggatcanccggggtgtttttttttgaaatgaggctttaaanaattcactgcaaaggccctgtatggcctatattatctaacaaatacattctaaaatctcgaacatttattttctgtcaacataagcacaataatacatacacacacatcaatcaggaggaaattgggagtgtgttcagtatacaataagtgccgaaaggaatgcgtgggggtgaaaggacaaatggtgtgacaaatattatatacaatatacgagcaaatagatcagcgtcctcgcggcacgtcattcggttcatcagcgccgttcagttatcggtcatccccttcgggttgccagtcgcgcgcatctgagcaaaatggacaacgattacgtaaagcggtggaattggatggacggtggcagagtagaagcccacctcatccaatgccttctttgtctcctcttcgatcagacgaatttgcgccagcgtcagtccgtaccagcggtccatccagcagaacacctcgcgattgaacttgcagaaaaggcgtgggaatgactaaaagggggagggaacaaattggaggtggtgtttggaaacaggacgaatgaatgaatctgccaccttttgcattgaagactccaccattgtttggaagccgaaccatttgaaattgacggtgaccactttgtacgcgcacatcaccggctcgcagttggtctgccactgctgctccaacggaccacggcctgtgttcacggaacggaatgtcgacggtcgggtgttgtcaaggatgtcggctgctttcagaaactcgttgtcgttggcgatgtcaatgcgcaccactttgcgttcgttcagctcatccttcgacagaccgagtgcctgaaaaacggaaaattaaattgtggcataattaacaattaattagtgatgatgatgatcattccatccatacattttttgtggtgccgcggtcgctcaagtgcattgtttcaatccggatcagaaagttgtccttcatatagtccgggttggtcacctccgttttgcagtacgggaaggcgttccacgaccgttcatgcagcgtcgtcgaacctcttggcataatcgccctcagaagagcaggcacttttctggagaaaaaaagacgaccaattagcattaattacatttccgcgcctccctctaaaactcacgtatctaagtggatgattttgtgcgtgaactgtccggacgtgaagcggccattgaacagactttggccttcgaagggctcgttgcgcaccatttgaacgccttcgccaccgccggtctcctgtaaaaggaagaaaaagcagataaaacgccgctcactccacgggatttgcgcaagttcctccaacctgtcgcgatgcctcggtcacagaaaacaattggccaatttgatactcctcaatggcgaacggcatgacgatgcgactgaaaaaaggaaagcgtaattaattaacgtaattaaggaggtgtcagaagaatgatgatgatgaaaagcaactcactattctctgatgagcattgttgctgaagtgcagtcaaaaggggaacaaaatgaagaaggagacagacgcttattatgtcagtaaaggacaaatgaagaatgattgtttctacccttaaatcgccccttttatacaaatattttcctacccctcaatttccgtgtaaaaattctctataaaaagggatgaaattcgcgagatccactcattcttcgcatcggcgactttcactctctgctgtacattttcttctctcgacgacactttgcgcattcaatccgagcacacttcttcacccatcggctggtcctatgtctcttcaatacgtcggcatcgctgcgttaatcctcggaagtaagccgggacgagctgttaatccatgttaatttgctgctaattaatccccatttttcagctgccatcgctctgttccaaactgtgtcgctcagcaccagacgacaaatcgccgcacaaaatggccgaagcagcagcagcggcagcaaacgccaaagcaagtcgccgtcgtccgcgaaaaccttggcacacaaaatcgcagcgacggtcatcgctgagaagagcctgagctccatcccggacaacgaaatcgtgcagctgatggacaccggctttcaactgctcgacgaggtgggctcagcctggatccgggatgacctgccagtgcctctgataattcgtgccaccattgttttcaggagccggcgcgtgttgatgtgcatgccccttgctacgttttcggtgacatccatgg

SEQ ID NO: 5169 - DNA, 884 bp, Heterodera glycines
ggtgacgacttccatgtgagttttcgtgttccctgtctaaacctttgccaattccaattttcctcacacatttttcagaaagccaaaaatcgatgaggaaatcgacgaaaacaacacattctgtgacctgctttgggccgaccccactaacaatgcgcaggagcttcgtctttgcaaggattacgagccggacaaagggttcctcggcgagtacggcaactatcgctttaatacggtggattggtcccgaattttgtcaaccgttttttaatacttttacaatcttttcaggaccgcgaaacttcaattcagttcaacgaccgctttgcgcaggagttcttcaatcgcttcccccacatccgcggcatcttccgggcgcacgaaaaccaaccgaaagggcacagcatcaacgaggcgcgtacaatttgcacggtgttcagctcgcctcgctacacggaagacacggactgtggatctgtgctgcgggtgggtgctgtttttgccatggcatcttttatttcaattttcaaaattcttttttcccctcagctttctgccgacttgaaacacattcacttcgtcacgctgaaaccgaaggctactggagagaaattgagccgggaagaatgacagacgagcggcggaaagaaagaagccccgacgacgtaaatgaagtgccgcatattcaattcgatcacctcccatttaatgatgttgaccattctcctgctgttgcccgagtaggtgtgatatgcaattgctccgttttatgctgtcccgatacatatttgaccacgtatatgttattgttgtattatatgtatattgtatatatatgtatgtattgtttttgtatatgtatttgttacaaaacgataaaaaga

SEQ ID NO: 5170 - DNA, 7259 bp, Heterodera glycines
taagtttatttacttaataattatattatcgactattctcccagtgtaattaaattccttacttcaaaatatctcatccttttattcaacaaatttatataaaaaattgtaatttgttgaaagttagaaatttattaaaatccactgttaagtcacaaaacaataataataattaataatttctgaataaaatatcacccactttttcatattaaattcattaaaattaaatgctttaccgatcctctcactcaagattctcataaattgacaataattttaaaaattcttaaatattccgtaaaattctataaaattgatcgatgagtcacaaactttgtatccaaaaataattttgggtgaataactttttaattgttttagtcattcgatctccgccgtttttttcgccccaaatttctcaacattatttcattaacatttgccactgtttcgttcacttttcaaattggcgttctctccccctctttttttcaccttttttatatttgtttttcccactaaaaatttatgggccaaaaatttcgcgcggataaaacgaaaaatgaaaaacgaatgaatcattcgcccactcaaaggggggggggaagaagtgatcgacggacgcgcaaagtgatcaaaccaaacgatgaataaacatttcttatttatttaagtgtttgtcaaccacaaatcctttaattgttttatttttgtttttaaaaatgtcatcactttttttaattttcgccatttttggcacaattttttgagtcgatgtcgttttttcggggcttagtttaattggcgtgccattaatttcatagccaatcaattaaatttcagtccaattttgaaaaatacgggtcggacttgatacaggtttttactgacccgtagccagtaacccgtacttatccgtacattccaaaaattcgatctccagttcgaattaactccatttttttcaacttcaaaaggaatggctaattaatgctaatggctaataattactcttaattggtccctttctttttcactggtcttttctgatcatagtttctctgtcgtttcgagcttactaatttgtcatgttcaaaaggaatggtttgattaaatggaattagagcctccgctgaattatgaccgcccccctgaaataaagcccccctttcgataaaataatttcaaataaatatttattttcgtttttaaaatatatttccatttttaattttaattttggttgaccaaaacttttcctgtaaacaatcatcccaatgttttcttctgttccgatcacttcttccattttctaattttcctttactaatcgaatttcgcgcttcgttccctccaaatttcaacttttgtttttcgtctgtcaccaaaatcagcgcccttttcttctctttttcgtgcgttgttttaacccactaaatttttacacttttttttgtcgcacgtcgaaacgccaaaaggcgacacaaattgcccccaggggcctggcgatggatgacccccgggggcatcaaatggaatcgaaaagtgaaattgaatgggtaattgctgatggggtgcgcacgggaggcaacaaaaacaacaaacgaattccaaccgcgaaaaaatgggcccccggggggacaaaatgtacaaaatgaaaagttattttccatttatgacaaaactatttattgtaaataaatgttgggtgacaaaaaaaacccatttaacacaattataggttaaacgaaaaaaataaatttaaaataggcacaaaaattggtttaatgcttttaatgacccccatcagcagaggtcttaaagtttgaggtttaattttagaaattaaaatgcattttaggagtaatcaaaataaggcgaaagaaacatggcaattagtcgctaattgctcggattttctcgacgcacgaccctcccattttcagggattttactcccgtgtccaacccatcggcaaaagtgccgtttagtcacgaattgactggcccaattcccgattgaatttgtcccgccattcattttaaaagtctctgtctctaattaattttaattttcaaaattcctttgtcaattccttttttaattgctcacttttgcgcgtcattgaatgtgttcacaattgccccttttacccttcacaattatccccaaaattcgccttttctcggtgaccttcaacaacactttttttctgtcaccaatttttcctcttttattcgccaattaattcaaaaaataatttttgtggaagattaattgagtaattaattgaaaataaatgttctttctcagatattttctgtcaccttttcaattgacgtcattttgtcttgcatttttctttcagtgttttttccctattttttgtcatttccaaaaatataagatttaaagttcaacaaaatttttgttcatttttaaattattttgtcaacaattttttggaattttgtggggattttttgatatatttttttaattttttatatccgccatcatttatggcattttatcgccatcatttttgtccgccaccatttgtgccatttgtccgctcacaatatttaatgccattagtccgccactatttatgccatttgtccgtgcccttttgtcccttttcaatttttctctgtgtcttccatttgtctcatccccctacttcatcattcatttcgtcaccactttttcgcccatttgtccctttttcttccatttgtcccttttattcctttttttgcccttctcgattgactaaatgctctgctgtccatcatcatttattttatgatttattttcattgccatcactttttttgctccgttctccgcgccattgccccataaaaaacgccgtcgactttttgtccgtccgtcggtccgtcgcccggggggaggacaaaattttgtttgattgatcgccgctgttcaaaaggctcaacttgcgcactaaaattttcaaattgttttcgcgaattctgcgggaaataattttatatatttcttttaaatttaatttatgaaaaatttttaaattaaaaaatatcatttttaaataaatttctctcattatttattttataatttaattttaagtaaatttcttaaaatttcgattataaattactcaaattattgtttccacttaattacctattcatttaattatttttcatttaattatctctttccctttcgttcgatgcattttcacaaattgtttttgcttttgcctattttgcttctccatctccaacaatcccaagcttgcttttcacgtggcaacagtggcgaaccgtcggatggcaatcccgaggcccaggggctaaaagtgccaaaaattttgaattttaaaattaaaaaattctcaaattttcagtcggaaaacgatgttcggactgttcagttgaagaaggaaaaacaaacggatgaaacggaagaggagaaagacgaggaaagttcggcagaacaaaaattgccatctgaattggacccggaatttgtgaaagtgagagaaattggaaaatttctttttaattaataaatatttaaaaaattaaaattttcttttttaacattatttgatattgtctttatttttgagggttttgaaaaactatttaatatttttatcaatttttaaaaaaatttttgcttggaaatttttgaaaaatcttatttatttgggaacaaaatatttgaatttaaaaatgaatatttctttgaaaaaatattttattgaaaatttaataattttttgaaatttatccaagtttttctattcaaatgattctttttaagacttatctgcgagaatttggtcatctgaagcacaatgagaatggcctttcccatggcgttaagtgcgtttaaataaaatttcaaaaagaaatattttaaaaatcacaaatattttaggcatttccaacgctttttgggctaccggcagacgggcaatgtcgacttgggaacccttcaaaaaatgtcgtggaaacgctgtgccaactctgacgagggctacacagcacaaggtgggggcggatcgatgaattatggcatttgccaggattattttggagtaaagaaaaatgccggaaatttggccctaaaaatcgaaagtcaaactaatttcctggcaaagttaccaaccgagaatggcacttgcattacagggttgttccgggtcgagaaaaatatcgggtcgggtttcgggtcgggtcggccgaaaaatcatcgggtcgggtttcgggtcgagaaaaaggccgggtttcgggtatcgggtttcgggtaacccggaacaaccctggtgcatgggtgcggatggcactgcaatatttgcagcgaattgcgccatttataggacgatggaaataaaaccaaatggaatcaggtttttcagccatttgctttgcttaaattcaagaaattcatacaaaatatctttagaaaaaggataataatgaacaaaaacaaatacaaaattttcgattccattgaacacaatcgtttaaaaaaaattctcaatttccttatctaattttcacccagacccccttcttaccagtgcttatttcgacccgaaacccgacccaaaatcatcgggtcgggtttcgggtttcgggtcgagaaaaaggccgggtttcgggtttcgggtatcgggtttcgggtaacccggaacaaccctgttgcattacacaaagtgtttaatgcaatggcactggctgtgttttaaataaataataatcattattttttaattagtccgataattaattaattacttaattattcgcatttgtttttttcgctttagacccatcgcaactttgggaacgttcgacattgttctggaacctgaacgcgtcgcaccccaagcagttcactcatggcgaaacgaagtcagccaaaatttggcacaatttgccaatttgaattagcactcattaaacatgttttattacatgcttttgcataattaacttaattgcgcttaattttgcagggaattaattgcgcaagcattccgcgcatgggaaattgtgatcaaaatcgactttctggagacgaacaatgcggacaatgcgcagatcattttcacatttgaaagcgacggagcaaaaaaggagaaaagcaaaaatggggaggaggagaaggaaaaggagggcaaaacaggcaaatcactttctgatttgataagcaccgatcggttggtcaaaaagacagagaaggaaattctgatcattttggcaaaaaacaaaatttgatcactttagaatttgttaaaaatttttcaaagtcggaatattcaattcgaaaaacgaatttataaaagtatttgctgaacatcaatttattatttccccatattctgagtaaattaggcgactttttttaatggctcaatgtttaagtttttaattttttactttttaaagagcaattaaattttgatattttaatcaattttattaattaagaaattaacaaaaaacatgaattcatcacataactcattaacttaattaattttttgtgatttttaaatgctttttgctttttgttaaggcctcgccattgccaaggcgtcgtcgccgcccgttgcgcgaattgttttgaatgccgacgagaattggtccacttttcaaacacaagaagaggtgaaagttaaatattgctaatttaacaatttattttttcagggaaaaatcgacatttttgtggtaaactaaatatattttttcgaaaatttttggcattttttgccaattttgaggttttactccacgaaattggccatgcgcttggccttcgccattcgggagacgaacattcagtgatgttcccaatgtttgagcgttctgttggcgaacatgtaaaattaaattaattaatttaaaaattaaaaaaatatttaaataaaattctctaatttatttcagttgccagtcatttcaaatgatgatgtcgagcatttgagagcactttacggtgattaactgctaacaattcattaattattttcttaacatttgtgtgtgtttgaagtgctaattaaaaaatggaaaattctaacattattaattaattttactctttgacaatttattatttatgatatttaaattattacatttttaattttttttaaattttttaaacccttctcttatgtcaatttgctaagccttttttttcttcgtttcggcttcatttgtttccgtatgctttttgttttgtttttttgccatcactttttgcttaaaatatttttcaccatggcatttcccattgctttttccatttttggcattttttcagtgcttttcggtaataaaaatgatgggcccaaactgcgcgtgaagcgcagtagcagcgtcgccagcagcgcaagtgccgccggtgccatcgctggcggtgccaatgccaattcgaatgccaacaatgcgtttgcatcattttatgccgatgatgacaataccgttttgtgttgtgtgtgccctgcgccgatgacattaggcgatttgaagaaaagttcgtcgaaaaaaaataatgaaaaattattttgaaagctttgcggcttttcactatttaaaattttcaaaaatccatttttaaatggcttaaaatagaaaatttgactccaaaaagtgcctgttttgcttttttgctttcttttttcgtttttcgatttttagagcctggtcttcccgagaggccaaaaaatgagacaaaaacctctccacggaggccccaacccaaaccacacactccgaaaagtatgccattacaaaaaaatccattttgtacctggacaaatcgaagaaaaaattccaaaaatgccaaatgcctggcttttgaaaattttgtgcttcacaagatttaaattaattttcaggcttaatattccaaaataattttttttaaaacattcactttttgacgtgtgtttttcactttgctttttcttttgccgtgtgttttcactttattttaaattattttttaaattaatttttaattaaatttattaccattttattttctgatcactttcagagggcgacctcaccgatcggccaacacttgcggccgatctgcgcccaacgaggcccgtgcccgtccagggcggcacgcacagcacagagttacatttagaaaaataaaataaaataagtaaaaaataataacatataaacaataatggctaagctcatacggaggagaaggagctacga

SEQ ID NO: 5171 - DNA, 1820 bp, Heterodera glycines
  misc_feature (12)..(13): n is a, c, g, or t
  misc_feature (37)..(37): n is a, c, g, or t
  misc_feature (43)..(43): n is a, c, g, or t
  misc_feature (53)..(53): n is a, c, g, or t
  misc_feature (156)..(156): n is a, c, g, or t
  misc_feature (1778)..(1778): n is a, c, g, or t
aaaaaaggagannaagcaaaatgggggaggaggaganggaaanggagggcaanaacaggcaaatcactttctgatttgataagcaccgatcggttggtcaaaaagacagagaaggaaattctgatcattctggcaaaaaacaaaatttgatcactntagaatttgttaaaaatttttcaaagtcggaatattcaattcgaaaaacgaatttataaaagtatttgctgaacatcaatttattatttccccatattctgagtaaattaggcgactttttttaatggctcaatgtttacgtttttaattttttactttttaaagagcaattaaattttgatattttaatcaattttattaattaagaaattaacaaaaaacatgaattcatcacataactcattaacttaattaagtgtttaatttgtattatttatgttttttgtgatttttaaatgctttttgctttttgttaaggcctcgccattgccaaggcgtcgtcgccgcccgttgcgcgaattgttttgaatgccgacgagaattggtccacttttcaaacacaagaagaggtgaaagttaaatattgctaatttaacaatttattttttcagggaaaaatcgacatttttgtggtaaactaaatatatttttcgaaaatttttggcattttttgccaattttgaggttttactccacgaaattggccatgcgcttggccttcgccattcgggagacgaacattcagtgatgttcccaatgtttgagcgttctgttggcgaacatgtaaaattaaattaattaatttaaaaattaaaaaaatatttaaataaaattctctaatttatttcagttgccagtcatttcaaatgatgatgtcgagcatttgagagcactttacggtgattaactgctaacaattcattaattattttcttaacatttgtgtgtgtttgaagtgctaattaaaaaattctaacattattaattaattttactctttgacaatttattatttatgatatttaaattattacatttttaattttttttaaattttttaaacccttctcttatgtcaatttgctaatcctttttttcttcgtttcggcttcatttgtttccgtatgctttttgttttgtttttttgccatcactttttgctttaaatatttttcaccatggcatttccctttgctttttccatttttggcattttttcagtgcttttcggtaataaaaatgatgggcccaaactgcgcgtgaagcgcagtagcagcgtcgccagcagcgcaagtgccgccggtgccatcgctggcggtgccaatgccaattcgaatgccaacaatgcgtttgcatcattttatgccgatgatgacaataccgttttgtgttgtgtgtgccctgcgccgatgacattaggcgatttgaagaaaagttcgtcgaaaaaaaataatgaaaatttattttgaaagctttgcggcttttcactatttagaattttcaaaaatccatttttaaatggcttaaaatagaaaatttgactccaaaaagtgcctgttttgctttttctgctttcttttttcgtttttcgatttttagagcctggtcttcccgggaggccaaaaaatgagacaaaaacctctccacggaggccccaacccaaaccacacactccgaaaagtatgccattacaaaaaaattccattttgtacctggacaaatcgaagaaaaaattccaaaaatgccaaatgcctggcttttgaaaattttgtgcttcacanagatataaattaattttcaggcttaatattccaaaataattt

SEQ ID NO: 5172 - DNA, 1093 bp, Heterodera glycines
tgcaggtatatttgctcatcttaatttattctgggggcttttacgtttaaaaaagtcaaaaataaattcctgaaatttttccccggactacacgatcttttatcaccataatgacaaaatggcgccagaatgcaggtatatttgctcatcttaatttattctgggggcttttacgtttaaaaaagtcaaaaattaattcctgaaatttctccccggactacacgatcttttatcaccataatgacaaaatggcgccagaatgcaggtatatttgatcatcttaatttattctgggggcttttacgtttaaaaaaatcaaaaattaattcctgaaatttttccccggactacacgatcttttattaccataatgacaaaatggcgccagaatgcaggtatatttgatcatcttaatttattctgggggcttttacgtttaaaaaaatcaaaaataaattcctgaaatttttccccggactacacgatcttttatcaccataatgacaaaatggcgccagaatgcaggtatatttgctcatcttaatttattctgggggcttttacgtttaaaaaagtcaaaaataaattcctgaaatttttccccggactacacgatcttttatcaccataatgacaaaatggcgccagaatgcaggtatatttgctcatcttaatttattctgggggcttttacgtttaaaaaagtcaaaaattaattcctgaaatttttccccggactacacgatcttttattaccataatgacaaaatggcgccagaatgcaggtatatttgctcatcttaatttattctgggggcttttacgtttaaaaaaatcaaaaattaattcctgaaatttttccccggactacacgatcttttatcaccataatgacaaaatggcgccagaatgcaggtatatttgctcatcttaatttattctgggggcttttacgtttaaaaaaatcaaaaataaattcctgaaatttttccccggactacacgatcttttatcaccataatgacaaatgggggcagaatggcaggatatttgctcatcttaatttatttctgggggtttttacatttaaaaa

SEQ ID NO: 5173 - DNA, 1120 bp, Heterodera glycines
  misc_feature (15)..(15): n is a, c, g, or t
tcctgaaatttttcnccggactacacgatctttatctaccataatgacaaaatggcaccagaatgcaggtatatttgctcatcttaatttattctgggggcttttacgtttaaaaaagtcaaaaattaattcctgaaatttttccccggactacacgatcttttattaccataatgacaaaatggcaccagaatgcaggtatatttgctcatcttaatttattctgggggcttttacgtttaaaaaagtcaaaaattaattcctgaaatttttccccggactacacgatcttttattaccataatgacaaaatggcgccagaatgcaggtatatttgctcatcttaatttattctgggggcttttacgtttaaaaaaatcaaaaattaattcctgaaatttttccccggactacacgatcttttatcaccataatgacaaaatggcgccagaatgcaggtatatttgctcatcttaatttattctgggggcttttacgtttaaaaaaatcaaaaattaattcctgaaatttttccccggactacacgatcttttatcaccataatgacaaaatggcgccagaatgcaggtatatttgctcatcttaatttattctgggggcttttacgtttaaaaaagtcaaaaattaattcctgaaatttttccccggactacacgatcttttatcaccataatgacaaaatggcgccagaatgcaggtatatttgctcatcttattttattctgggggcttttacgtttaaaaaagtcaaaaataaattcctgaaatttttccccggactacacgatcttttatcaccataatgacaaaatggcgccagaatgcaggtatatttgctcatcttattttattctgggggcttttacgtttaaaaaaatcaaaaattaattcctgaaatttttccccggactacacgatcttttatcaccataatgacaaaatggcaccagaatgcaggtatatttgctcatcttaatttattctgggggcttttacgtttaaaaaaatcaaaaataattccctgaaatttttccccggactacacgatcttttattcaccataatgacaaaatggcaccagaatgcaggtatatttgct

SEQ ID NO: 5174 - DNA, 375 bp, Heterodera glycines
attagaaaaatgataaaaatcacaaaatttgatcattttttagtgaaaatctgtcaacaaattttaatcaaattttcaaaaattttcccggcggcgcctgccccctattcccaaaaagtttttttggaaaaagcgctcctcaaaaaagcgttttattgatttttaaatttggaataaaatttaaaaaaatgatttttgctttatgattttaactattcaattttgtagaaaaaatttcgctttcgcatttcgcctttcgcattttcgcatattttagcttttcgcatttcgcttttttttaatttcgcatttttcagtttcgcaaatttcgcttttcgcatttcgctttttatttttcaatttggcccatccctg

SEQ ID NO: 5175 - DNA, 3292 bp, Heterodera glycines
  misc_feature (3154)..(3154): n is a, c, g, or t
  misc_feature (3235)..(3235): n is a, c, g, or t
tgtcgggaatgaggatggccaattgtcaaagtgggccaaatatttattaagaaattaattgggaaatcggcggaagaaaatggagagacgatataaaaatagaagagaactgcagcaggaagattaaaatataaaaacaactgaacttgcatgagaaaagaatgacaaaaagagggatggattttgggactgaattgggaaaatgacaaaataaatgatagcggtaatgcaaaattatttaaaattggatcggttgtccgttggtatgacgtcaccgcgcaccgaccagctgagctcctgcgaagcgtttaggcgtttgtcctccctccgccacgaaccatggaggcctcctggccgacgttgttgttggacagcggcggcattgctgtgacatcaaactgttactgaaatggaaattttgggagacgggatgggaatggcgggcaaattcgggaatggtccaattataattatcggacatattcgagacggggagagtttggggaatgtgggttcgtattgagaggaggcttggtggacgcaattgttgagcaaatgcctttttctcaatcttggcttttttgaattttgaattcaaaaaagttcgaggctggatcggctgcaattttggactgaattgtgctggatccgaatggaaaattttcgttgggaaatgcgaaaattgttttaagtggttttgatttgtgaattcagtttttgacttgtccattctttggaaattcagtggaaacggacacgaatttcgattttgtctccacatttttgatgatgattgtccgacttttttgtattgacggagttgtggtttaggcggtgccgaaaacttgggagatgtttgcaaattttgaggatttgcgtggccgtgatttgcttggtcttcgtctctcttcaaattctccaacaattttagcagatttccacttaaaatgaagtcatattccagtgggattttggtaaccatacaccatgtttctaattctgaatcgcctatatcaattgggacattgaccaatccgtaaacaggaattttttgtcctttgtaggtagcaaattcataaggcaatcctgtcagatcacattttggctgaaaactccattttagaaaatcggttttgtcactcacagacattttgaagagaaattcggggtttatgaaatttatttcggaattcgggtcgataattgacttggccttccaattttggactttcatttcaatggtttgacactttgagggcttcgggattggtttggcttcaactattctttggacaaggccattaaaaaatttttcatagacaaacggactcctttttttcatatccgaatttatttcgttcgaaatcgtgctgattggtgaccggcgttggttcaccatctcttcattcaacactctttcaaattggggccgcgaattcgggttcaattgggacgaaataacatcctttcctgcattttcctgcgtcgttgttgctctgtatagatccaccaattgcttttcttcctcacaaaaatgaatttggttcggtggaaaattttggaaaaattcgattgacttttcggtggaaaaagtttgtgaaggactgattggcgatctattgaaaacacttttctgaattcggtgccgatcctcagaattttctcttccaaaatttttaggaaaatggactcggttctgaacaagatcccgatccttaaaaccatcataaaacaaacctccattctcaacgttttttgaaaaactttcattttcctccctttcatatgcctcaactaataaggaagggtcaattggagaattgttgttgtcttgtcgccgctcttcattggaaatagaggggtgggacgcactgttgaaaggaaaagggaaatattgattattttggaggtggtcattgataaagcgttgttggcactgcgtatgacgaagtgcttgtggaattttgtaaaaattgggatttgtcgaatgaatttcaaaaaacatttttaaaaaatggggatgcttcttgtgcacaatcggtaagcgacggtttgctgtccgaaaggttggatttacgacgtttcggcaggagcgccaagtactgcgaaaatgggttgggggtctacgggaatacgaaatatgtggaatattgtcgggaattgaggatgggccaattgtcaaagttgggccaaatatttattaagaaataaattgggaaatcggcggaagaaaatggagagacgatataaaattagaagagaactgcagcaggagattaaaatataaaaacaactgaactgcatgagaaaagaatgacaaaaagagggatggattttgggactgaattgggaaaatgacaaaataaatgatagcggtaatgcaaaattatttaaaattggatcggttgtccgttggtatgacatcactttattaaaatatctaatgcgaatttaggcgtttgttataaaaataaaaagaaattttataaattttattagttcgagaaaatgagataataaataatcaagaagtaaatctattaataattattatgaaatatgagtagaataatttcttcttacttaaagcaatattttcgctctattttcactttatttttaaaaagcaatgaatacgtaattctttcaaccagtagacccgcagttgaattctgattgatatcatttgtccatgtatattaattaatgttcccaaattaaatttatgttatttgaatatataaatttatataagggaattatcaggattattttttaacttttttgtgaatatttaatcacatgagaagctcaaaaataacatttcttacatttatattttcaatcaaagctaatttttttttttgcaaataaaaaatatttaggcttttggcagataaaaaaaatagtttgggaattttagcaaaattttggcgatttttataaaaaaaaaaataaaatattgaaaaattttcttttaatatttttttacccttttcatgactttttcattttcaaagtaaaaggatttgatttacatgcttgcaaaatggtaaaaaatgaattatttgagaaattcacttatgtttgggcagttttatttcaattcgtaccaaatattttgccttttttggtttataacaaatatattgangggtttttggcaaaatattcacataattgggggtttttagtaaatataaatccgttccctgatatttatttatcagactanatgttttccaatcaaaaaaatcatgttttataattatctaaacgatttttattcatt

SEQ ID NO: 5176 - DNA, 1657 bp, Heterodera glycines
catggttttccggtcactaccatattcgtgctcccgacagaatgttctcgacagtgaacagcccgggggtgcgatgtttgactttggttttctgctgaccatttttaacacaatcatttttcagaataatgaacttcatattttgcatttctacgagtccaatgtttacccattcgccgttgaaatccatggagactttgctcggcttggtcgtattatttctggaaatgccgtcggtttggtgttaggtggtggcggagcacggtattcataaatattcaaatattttataatattttcatttaagaggtgctgctcacgttggcgttattaagtgagtgtcacaattttttctgtttttttaaattttcatcaattttagagctttacgtcagaatggcattcccattgacatgatcggtggcacttccattggctctttggttgggggagtgttggcgagtgacccatatgaccaagacggacttgagcaaaagacacacttctggtttacggtatgatagttctaacattaaacaatttcgttaattttgttcatttcagggaatgggttcggtttggaaggttcttatggttcgttgctcatttttgtttgtttccattaaaccttttgtcaggacttcacttatgggtacgtggcgcgtttcaccggttcccatttcaacagtttgttgatgggactgttcgatgaaaaacacatcgaggacctttggctgccttatttttgcgtgaccactgatattacgtgagtgattgaaaggaatataactgataaataattcattattccatttttatttagtgattctgaaatgcgtgttcatcgcactggttgtctctttctcactttttaaatcattttatcttttaccgatttctgcttcaattaggtcccctctggcgttatgttcgtgcgtcaatgtctttagccgtttggctgccaccgatctgtgattccgaagacggtcagtggtcggaccaaaacactttgaatggtgtttaatttaaggtcattatttgcttgacgggggctatgttaacaatctcccggcggatgttatgaggtcttgttgaattctcctgtgttatctcctttccctgattttcaggtcatttggtgcacgaactgtcattgcggtggatgtcagttcggctgatgaaaaagattttcacaattacggggattccattagcggtttctgggcacaattgagagcgctaaatccgtggtcaacgaaattgcgcattcttacgggccaggaaattcaggtgtttcgaattcccaaagaaaattccaacttgttttttgaggatcgtttggcttatgtgtccagtgtccgtcaattagaaatggtgaagaaagcgccatattgcaattatcttcgtccgccaattgcttcttttttgaccatggattttgctaaattcgaatctatcagggtgactttgtgaatttcgttgttgttgaagtgtcattcacaatatgtttttgcctttttagcgttcgggttatcgttacgcggcagaaattgttccaaatttggtcatgactaacgcccatctgaagacgcttattagtcatgaaaagatgcatgagcggttgctccgttgcggcattatttatcggcctgattcc

SEQ ID NO: 5177 - DNA, 1590 bp, Heterodera glycines
ccgataaaagagggttcctgtaatcaatatcacatgaagcattcacaattttcagacagaagtaagtttattcgtcgtctactatttggagaccgtttcccgttgaaggcgaattgtccattctgtcttcctctctgcaattgccactctgtcggtccgttgtccgtgtttggtttggtcgtactgtactcgctgaatgactcgcggtttgtcgatgctcttggtcattattggcttggccaaaccattctagtttttgctgctgctgttgaggcaaataattgtggttctgctgttgatggaagaactccccggtagttggttgtactgcttgccaaccaacgctgccgctgagctgctgttgggcagggaaatgctgcaacaacggagggaaaggatgctgctgattgtgaccagaccctccatcgcgagagtgctgttggaattggacagtgaaacgatggccagcggtggatgaagaggacgttggccgcctgtaaagcaaaattgaacggaaaataaaaggatgggttcgttcgtgtcaattacgtcgtcgagggtgctgctccgtgctgttttctcggctgttccgaattccctcccccgtgtcgtcctccaccgcccgcttgcgactgtttcggtgctctttgtcggctgtacgcgttgtgtggttggaatgatgagctcccaccacctcctcccgcatatttgtcgttgtattggtaatgtgtgtgttggtgtccagctcctttcgattgttttgctcctccccccgggcgacgttgctcgaaatgatccgaagatttgaatgggccgaatttgctgcgcgaacccttctcattggaagatgatgctaaactcgattgactgctttgttgctgaagttcggtggttcctcctttgtttggaacgaaatgcggggcactgctcgtagaaggaggagggtcagcattttcgatcacttttggtatctaaaagaaatactctttcataatacaacccaagtctgtcaccttgaaattcttgagatttggaaatgggaccgtgatttgacttatcacatttggcagtgccgactctttctttgccgtggtactgttcgccccactttttgccgtcgtattgccttccttcacccattttgtggtggtagtgttgctcgtactgctcgaagtcgtagaaggacggtgttgctgaactggcgaaggagaagacggtcgcccttccatttcagacgacttccgttgttttttcttcgttggctgcgctgtcactgtttcgtcttttcccattggtctcttcgtctgttgccgctgctgtttgtatttcgaaggtggtgccgcgctgcttgacaaacgcgcgacgggttcattgagctgctgctgcggtgttggcacagccaatgccggaggggcggcagtggacgacgaagttgaagatggggaagaggaggaggaagagtgctttgtggacgctgccgaggaggcaccgccctcctttttgatcttcagaaccaacgcgggtcgtttcgcagccaaagagtcgacactctctttcttcacaaacgattctttggacgttcgatcgggg

SEQ ID NO: 5178 - DNA, 2135 bp, Heterodera glycines
atagcctttgcgacggtattttcgacatttgttgttttgggttcgtgtccatctcggtcttgacgatcatggccattggcgttcggtagtcgccttgttcgcttaattgggaaaaagccggcgacgaagaagcggatgatgtcgtagttggaatgagtttgatgtcctgcaaaaatggcacactttgaggagggtcggcaacggccgtctgatcgccgccgctcgactgagaggaagaaacgctgcactttgccaacggcggaccacctttcttcgccgcatttccactgttttcaacagttccagccgccctttcgtctatttcgggaggcgttttttgatcagtagtcgaactttcggattggttatgagccatgagttcttttggcggaggaggtgggtccttaaaacgaaggcactattctgatgccaaacgatgggccaaaccatttcctcgtcatcggtcgaagactcgcaaatgcccatttcataaactgacatcattttggaacggaaatcttcctcaatttgggctgaaacaaaaaggggtaaaaagaaaagcaaaaaatttatatttacgcgaaatataattggacggagtagtgggaagaggcggaattttgcctattgtcggatggctttctgagtgttggaacggcgaccgtggaattccttctcgttgttcaaagctcacattggctggcttacgcggctttctcggtctgcgttgacccgaattccctaaaaccaaaaagcagttgattttagttataaagaaattgaaaatttaagtgagatttgataataatttttttaccaatcccacgcgtttttctgagcgtcccaaaatcggacggcgactctggcgtcccttcgtgttcgattgaggaggaagtggacgggtgtcggtccccaaaattccccgctcttcgccctcggccacgacgacgcactaccccagtcggcaattggtacggagtcgttgaaatattgccaaaatttggagtgtcctcaaatgaatggtccggcacgaaattgaacacgtcagaactggaagaatggcgaaggccaggttggctgtcctgaaaatgaacatcgttggcatttcacaaagtgtgaggatgccattattagtctgccggtggtcggatttatccctcccatcggtgcaattggctgcttcggctgttgctgtctgtacaccacgttcatcccaaatctttggcgctgttgttccactgacatttgtgccaaatgggaagagtcggtgtttccgcccgccacatttttctgctctattggcctcactctttggtcggaagttgtagaaaatgcgttttgttgtgtcaaagaggaaagactattgcccggatttggtgaacatcgtccggtcagtttggaagacggacgagtcaccgtttcgcactgctgcgactccgcgtcgtcggtaccggcgcccatttcggcgattgcctcctattcgtataacagactcaaactcaaaaacagcacacacacacacaataaaaatgctcaccaaatcagagaatgcattcaatgccatcgtcgtttccgtattttgtcgaaattgtcgtggcgctgccgcacctaaaaatgaggaggtcatacactctttggactttcatcaaaaccaattgattctgtgctctgcattcgtgcattgagtcggcattgaacggatcgaaaaccagtggaaagacatggcggtgggatcagttctctgtactcgggcacaacaaccttcatgaaccggagcaaagaatttccgtcattttcacgttccactacgaaggtgtgaggcgaagaataagtggcaaaaacgcgctttgattttgcggagttttgttgccccctcaattggagttgccgccacgaacacccaactttgctttccatagttaaccaaaagaaaaattgtaaatattttgaataagtgatgaaaaaataataattaataattattagcggaatttacgtgtgaaaatgttggagtaacaaatcgtgggcgtgggattgattcgagacgatttacaaccttttcgattattagaccacccgggtcttttattgttcaacccctgcaaaaggggtctttaggtaattgaacggggttc

SEQ ID NO: 5179 - DNA, 1223 bp, Heterodera glycines
atgtttttttattttagaaggtggtcttaaagaaagtgaacgtctctgaggattatgtacattattttaataagtttgggaagttgggacagaattatttcatcggaatcaatgaaaatgacgaggcgacgaaatcatatctcccgtacataaactgtcaggtgctttgatttgccaaactgaacaagaccctttcaatccaaattctgtttaacagaaatataataaaaatgactgcgacaagggaagaagtgatgggtgtatgaaaacggtcaaatgcgttgtgactgacccaatccgcggctcacagcaattggtgggtttaatatgaatttgctcacaaacactgaccaaagttcaaagggcactcatttgaccattgtaccgtttaggcttgcatggctaattattacctacgcgacgcatcgccaaacaaaagcttttctgagggcgacatcattgagccctctctgatggactgctggcagcacgaggagaggcaattggcggagtgtaagcagcaggacaaatgtgtggcggacgtgcgcaagacgggccaagccaatcagtcgtcactcttctgctgttgccgtactcacaattgcaatcgacagatggtctacgcggaggagaaatacattggaccatcgaccacgagtaacaaatcggtcatttcatttcccacccaatccttttttgccttaagcgtcctcttcaattgtcgactttccattgtccgttgggtttaacctacttcaattggccatcatcttctttaccgtccttttcatcgccattttcgtcgtcttcatcctttccatgccaaaattacgaaaaaaaatatgcaaacggagcggaactgcgaagttctttttgccgttttacagaaacacaaatgacggaaaggaccagcggaaagaattactcgccacggaatacgacgggcaaatcactttaccagatggagaaaaagtgcacaaagagaaaatcactctgcacgaggttctaacggtcaaaaggctgatttggtcgattttcttttcgagagagtgtccgttggtcgctttggccaagtgtacgaagcgtttgtaagcggccctgactgttgggctgcggttaaaatagtgccgggccgaaaaatcggcggttggcagaacgaaatggtgccgttacgtttattttggttaccattccctccccttgtgccgctttaggaaatgtat

SEQ ID NO: 5180 - DNA, 1068 bp, Heterodera glycines
ggtaatactttggtttgtcccccccccccccttttgagaaaataattttttttaaagttgtataaaatactttattatgggcttttcggggtcgctgatcacggatatgacattcatttcgaacaattccgaaacccgtaaccgaattcgaaccaaattcgtaaaattctcaaaaaaaggggggggggcaaaccaaagtattaccaaaaagtctatattaagtttaaattggtcattaatttttatttgctacaaaaataattaaaccgttttagattcacagagacatcaaaaggtgagtgttttgttgctgcgtttgtatttttgcgttttcagtaagaatattttggtcactgctgggatgggcgtccgaatcgccgacttaggacatgcgatgaaatgcgaaacgcgtgttttgcttcttgagaaaatccaaggctatgtaagcgacgatgggttgtgcatttgaatggggaaaccattcgatattttaacccgaagttgaaggcaaatgccatcaaacgttgcatttcttttttccttttgccaattttcaaatgtgccttaggttggcaccattcgttacatgtgtcccgaagtgcttggaaatgccaccggaacgaccaatttctacttccagcaaatggacgtttactcggctgccctcgtcatttgggaagttctttcgcgcaccgaaacagcggaaacaaaaagcggtaggcttttgtacagagacgggcaaaataaaacgaaaggccccacatttaagacatggagccgtatgctttgccttatgacaaggaactcggccacaaaaacccttccatttatgatatgcgaaacattgttctgacgaagagaattcgaccgacgacgagggcatctctgagtcggaataaggtgaaacaccgatcagagaatgcgtccccctcccacgaaaatataaaatttttctagtattttttagaaaaagttaggaaattttttaatttcggggtaacgacacaggggaaacgctgtggggggagatgaattgcattcacattcacttggcacgagcaatctttt

SEQ ID NO: 5181 - DNA, 3737 bp, Heterodera glycines
  misc_feature (2952)..(2952): n is a, c, g, or t
tcaatggacaatccgtcactgatcaattgatcagtggacaatccgtcactgatcaattgatcagtggacaatccgtctaaaaacttaatttgactcaaaaaatgcattcattgtgaattcgtaattttattttctgagcttttgctcttaccgtcagcagtgaccggttgcatcggatgagcttcaacaaacacctcgtcctcctgattcgacgactcgtcgagctgtaaattgtttaaaaatgagataaattaaatttaataaaataattaaattaaatttctgaattaattttaataaaaaaaattacaaaaattttaattgagcctgcgacatttgtaaaaattcatttaataattaaacaattaattaaatttaaaaataattttgaaatgctgatttttaagccaaaatcaaaatgctgatcttgaaaattcaaccctgatttactcaccgtattttttttgccacgtgcccgcgtaaatttctggacaacgtcaattgggccttgggaattgcgtggaatgcctccgggtaatattggggcaccttaaaagaatgcaagattagaaacataaaaaattttttaacgaatttcgttatattttaccaaaatttccctcccggtgtgcctatcggcaccgctgcccaaaatttttttttaaataaagacccaaaaattatcaaattggtcattcagataactgccattttcgcctacacctccctataattttaaaaattgagaatccgtcactgatcaattgatcagtggacaatacgtcactgatcaattgatcagtggacaatccgtcaatttttaaaacatattttattttattatgaaaataaaataatttctaatttgataaaaacttaatgtgactcaaaaaatttaacttttaattgtgaattcgtaattttaattagagaccggacaagagggtcggtcgaacggtttcggttaaaaaccgaaaaaaaaccgaaaccgaaaaaaaccgaaaaactcaaaaaattctcggtcgaacggtttcggttaaaaaaccgaaaaaaaccgaaattgaaaaaaccgaagaaaaattttcggtataccgtttcggtttcggtttttttgaatttttttatcttttcccaaaaaaacaataaaccatttttatcaatagaaaaagcgaaagatcacctctgagtaacagcaaaatttagttttttggttagtttttacgtgttttgctccctaaaaatcattaataaaaaaatttaaatgccttttttcatgccttttcgggatttttgtgccttttttcagtgccattttgcgctttttggtgccttaattgtgagctctagccataactttagggccggcggtgctgataagcgccgccaggaaatttttttttgtaattttaatgctatttgtgagcagattttgtctaaaaataccaaattttgagattttgggctaattttttaagaaaagatagctttttggggggtcggcggtgccgataggcgccgccggaggaaaattttaagaatttttaatgaattttgttaaaaaaatggccaactgatttgtcaaaaaagtcggtcgattgtttcggttttttaattatttcggtcgaacggtttcggttaaaaaaccgaaaaaaaaccgaaaccgaaaaaacccgaaaaactcataaatttctcggtcggtttttttcggttaaaaaccgaaacctaaaaatgaaaataccgaaaaaaccgcaaataaccgaccggttcgatctctacttatgacagtactcagaatcatttgactctctattcttaaaagattatttcgcttttatttgctacctttttaattgtttatgatgcaggtaaattcaatttgcagattaatttaaatctaattaatataattatgtaaccgaaaattatcatttaaatttccgattaaattataccaaaaaccaaaaattttaaaatttccttgtgtatttttgcagtttttcggcgttttccccaacaaccaattgcccttcgctttccttttgaccgttggcattcgctgggccatcggttcgcttggctttctgctcaacttttccctcgtttttgtcacttggaggacaaagtccgctttttctcaattttaaatataatttaatttaattattttaaaattatttccctttatttgtgccatttaaaaggacatttcgtcagttgtgcaactgtttgatcgccgccaatgccctcttttccggcctttttggcctttcgctgtccatcggttgggtatttgccctcagcggacacccttttatgtttgaaggtcccaacaaattttcgaaattttttctatttttcaatatttttaggcccttgtgccgtcgtccaaaccgttcctttgttatgccgaaatgttggcctaagttcgcttttttggattggctttgatcgccttgtcaatgcgttgttcgccaattcgtttatgtacacatttttaaaaatgttaaaatgatttttaattttattcagacatcgccaccaagcgttctacgcttttctgatcattttcagcacttcgcttcattcgggatttattatcatttcggtcttttcgatggccattgattatccggatcagtgagtaaaatactcggcaattaattggctaccgatgattagcgtcactctgtgcttaactcacgacgacacttactttggcccaatggcactgcctttgcttctcgtcaacgttttactgagtgcgctgatctttctgctttacgttctcttggcgtttgtggtcagactcaagaaggacatttcaggcaattcattaattgatgacccatccaattgataattattattaattactcttaattaatcacccattcactttgaattctcatggcagattatgcgtcccattattttatgttataaaaaccttanttaaaatgtcggttcgatttgatttaacagaattgttttgtaataaattatttatgtgtctggcccttaaacctcaattagtttttgtctgagccttctaatttatttaccatttaattactgaacacaccagggatttaattgcattggcctgtggagggctctaaagcaaagccagaaacacctggcgtgggtaatatttgtgtctgacgcatttcgccgattatcattcaaacacaaaaatatttgaaaaatattttgaagtaaatgcgctgtcctattaaaaatgaaatcttctattagcttcttgtttttttataaaaaaataaataaatcgttttgatgtgtaaaatttcacgggactctaaaataattatgggacgcataactcaccaaaacccctttttatcctttcgttcagtgaatgccgaaatcactcggcgccttctccgttctctgatggccattatgattgtgatggtgaccggcttcaccctgaacaattttgtcaatgttttgttcgatttgatggtcataaaagccactgatattgccaaagtgattttttaaaatggaaattttggcaaatatttgccaattttaagaattggcaatttaggtttatgtgtccatggctttgtcctgtcttatggccatcgcttacgcgagcaatgcgccgttgcttatcattttcaggtgctaaccaaatgcttaacaatttaaaacaacaattaaaaatacaattaggaagtggcgaatatcaaaatgcgtatttgcgcattttt

SEQ ID NO: 5182 - DNA, 4997 bp, Heterodera glycines
  misc_feature (4810)..(4810): n is a, c, g, or t
ggaggaaaattttaagaatttttaatgaattttgttaaaaaaatggccaactgatttgtcaaaaaagtcggtcgattgtttcggttttttaattatttcggtcgaacggtttcggttaaaaaaccgaaaaaaaccgaaaccgaaaaataccgaaaaactcaaaaatttctcggtcggtttttttcggttaaaaaccgaaaccgaaaatcgaaaaataccgaaaaaaaccgaaaaaaaaccgaccggtccgatctctaattttaatttcgcattaagcttttggtcttaccgtcagcagcgacaggttgcaccggatgagcttcagcaaaaacctcttccgtacccgactcatcgagctgtaaattgtttaaaaaatgaaaacaaataaaatttaagaaaataattaaattaaatttttgaatgaatttaattttaataaaaaaaagaattataattgggcccgtgacatttgtaaaaaattaatttaataattaaacaattatttaaatttcaaaattgtaaaaataactttgttttttttggacctatttttttttttttaaaaagcgcgccgcaaaaacatttttgttgatttttaattatttgggataaattatgaaaatgctgaatattaacccaaacttaaattttggatgcaattaattaataaatttaaaatttttaatgggtgtttttaaattaattttttattttggactaaaaaactaataaaaagcaatcgataaattaaaaaatgaattatataaaaattaattaaaaaataaaccatttttgaaaatcaaatttcatttttttcccacccaaaacttacattggccgcgatccgacgagacctccttggtgcatccgatgttgaaggcagcaatgcatcagtgccattgtccgtcaatgtttgcaagtgatcgggtgggatcacatcggccaatgttgtcccatttgacacacggcgagtaattgagcctaattaaagcaaaagctctttttagtttgggacaacaatcaaataaatacatttttttgagagtttaatattataaaaatataaatcaaatgagtcagacgaaattattgtaaaatttggaatgcacgattagagaaataatttaaaattttttttgacaaatttcgtataattggccaaaattgccctcctgatgtgcctatcggcaccactgctctaaatttttgttgtttttaataaggacacaaaaattaacaaaattggtcgtttctgttggataaaaaaatatttaataattgccattttcgtccacacttcccctataatattgcctcggaaaatcccatccctactttgagcgtgcgctttgtcggcactttgaccagcggaagcggcattgttgacagccgcgagccgacgagacttccgttggacagtggcgctgcgcgtccgttgcgcctttggcgtgtctgaaaaagaattaaaaaaatttaaaatcaatttaaaaaaaattaaaaatcaatttttaaatgtaaatttattttgataaaatgaacaactaaaacccagtcctaaacataatccatttttatatttcatttcagaagactctaggaaaatccgtcactgatcaattaatcagtggaaatccatcactgatcagtggacaatcgtcactgatcaattaatcagtggaaatctatcactgatcaattgatcagtggacaatccgtcactgatcaattggtcagtggacaatccgtcactgatcaattgatcagtggacaatccgtcatgaccaattgatcagtggacaatccatcactggtcaattgatcagtggacaatccgtcaacaaaaattaatttttcaaatttaaaactggcttcaactgttaaaaatatcgatttctcaaatcaattcaaaaataaataaaaaatatttaataattgccattttcgtccacacttcccctataatattgcctcggaaaatcccatccctactttgagcgtgcgctttgtcggcactttgaccagcggaagcggcattgttgacaggtgcgagccgacgcgacttccccggagcagtgccgcttcgcgtccgttgcccctttggcgtgtctgaaatcatccaaaaataaacaaacaatttttttatttaaaattttattaaaatataataaatttgataaaaacttaaaataataattatacccgtccttggaaagtccttaaccctaagttgaggcaaggttaatgaattaacaatttctaatgaaaatctgttaaaaaaactttttgttggttaataaaaaatttttcaaaattttactggcaaataaacaatattgaacacgtaaggctaaactaatcaaatccaccaaaaatatttaattttggttggttgttactggaaaatagtgattcattatttcaaactgatttggcgctattgtcctccgccccgtccaaaacataccctccacagtgaaaaatgaattggtcggaactccgttcgcttcgcatttgtacttgccgctgtcatccgggtccgggttgttgatgatcagcgtgatggactgcttgtcgatcagaattttgtacttgagaccgtccgagaacagctccttgcggcccttataccagcgcactgaaaagaaatattttggcattaaatttaagaaatttttaaaatttattttttttaaaattaatatatttttattatcctaaaaatagatttgaagatatccttaattttatcatttattttttggtgttttattgaaattgaaaaaagtaattgattatgattttatcagtcgtttaaataatgaaaaatgatcaatttttcaaatttaattttaataatcacctttggcattggcgcgcgagtatttgcatttgagctcggcaaatttgttctcctgctgctgaaattgcaacttttctggcaatgggtccacccatcgttcttgaggcacttcggtgggcggctcggctgctttgggctgaaaaagtgtaaaatatttttttgttttttactaaaaattgcattttttttttgttgtaaagcataaaaaagactctaattcttaaattttgactccaagataagaccgccaactatcccaaggagggagaggggggggggggggagccatagctaaatgattgagccatttttaaaaaattgataaaattaaaattttattttttggacttatttgcaaaacttttttgagcaaacatttaatcaatttttttctaacaagggaatatttctgacagtaaattcaaatcacttttaaaccacttttattttgtggagataattctatcataaattctcgacctttttttgaccctcaccaacaaactgatcagaaaaatgtgatcaaagtttcaaaaaaagaattaattaaaaaatcaaaataaaaatcacatttttaaaatatttgatcaatttttcggattaatttgagtcaagacaatatatttttatacggcatcatgacccacctcttctggttcaggtgatgccgccgtaaagtcaatggtggtgcgaatcgatggccggcggacgggggaatgtgttgcaccactattcgaaataaattattattttttaaattaaaattaaaaatttatattatttaaaattgatttaatgctgatctacctatgcactcgttgcatatgggtagaaagtccacgaggcgtataaaaaggctcgtgactacattttgtgcatctccattcctggaattaatttggttaagtcacgatttttacattgatcgaaaaatcgttgggcaaaatgcatgacttgatcatcaaattattcttaaaagttttggaacgtttttgaaaaaagcttatatctaaaactttctaacaaataagtacaaaaaagaccgcttgtcttcatgacatttctttactaacatatggtccaaaagttactgtatttcatcgagaaagtggacccaaatcgatcagctcaatttttgtgacgcaaaaataatcacaaaaaatgaacaaacgccaaaaacccaattttagggagagaaaaatcatgaaggtttctggaaatctaatatggtgctgataagttttttaattgctcaaaataactttttttaaataatgaaattatgcagtgaaattagaaaataattagggctagcaagatcacttaatttgttggttcaaagaaagttttaaaatcagaatttttgatgatcaaacttgttttatttgtaattaaaatttcaaaaaggtatgaaatgttgttacatatttcgcacattaaaaaccaaaaattataattgacccaccagaggttttggtggggcctccggccttttgtcacgtcgggcggacaacgagcgggacctttgcgcgtctatttcattgtgccattctaccaacgtgttgtcctcggacttaaattcgggaaaattaatttaatatttatttcaaaatgaaattttttaacattttgccttttttggcattttgccgttttggtgccttttttggcgtttttacaaaaaaatccattaaaaaatcatttaaatgactcaaaattaagttatttggttacgttttcggtgttttgctccctaaaaaaaattcatcaagtaatttgttaaatcctcataaaatttattaattctttaaaaaaagttacctcccagaaaaggtggcccgtacttctgtgtgcatattcttttctccactttgcccgttgttggtcaggctagcatgaagaaaaaaatttaaaaaaattttaaataaattaaaaaagcaattaaattanaatttaattattatacccacagtaagtgttttgttgtccattgaaggaagcaaatattgtagaacaaatcaaagctaaaaaataaattttaatataaattttattcctaatcgattcactaataggggaagggaaggaaaaggaaaggaaaggaaaagggagaataaaatttagttgtgcataaatt

SEQ ID NO: 5183 - DNA, 5518 bp, Heterodera glycines
  misc_feature (5512)..(5512): n is a, c, g, or t
aattaatttaagcctgttgaacggattttgaaatgcaatagttgttttccatacatgtttaattttaccaaaaattggcggtattttgaggcaattttgtgaataattttctacggtaaaaccgggtaaacggtaaataccggtttttacagtaacccaaaaattctataatacatcaattaaagaacagaacaaatgccatttcgcacctcaacaccacaggctttatcagcagcaaatcctgctttgagaagccatctttgtgcaaaatcctgaaaatttatttttaatttttttttcaataaatcgttttttcccgtttttgggcacctcatctgcttcaaaattgtgcttttgccgctttcgccagcgcctaaattaatttaaaaatttcttagtgaatttttaatgcattttcggcatgacaaaaaatgtcatgccgaaaaaagtttgaaaaattggtttatttattcgtttaattaattaaataaaaatacattttaattaattattatatttttacatttattaaattaattaattcaaataaattttaaataataattattatattttattcgcggaataacggacctaacagaagcaatttgatgatgcgcaaattcatcgattgctaaaataattggaaattaattaattaatttgtttccacaccatggcacctaattatatcatcacactgacattaatactgagtgccatcccaattgataaatggtacggtatttgtacggtatgcccacaggaggtcttttatgtcccattacggtgcgcgtgctctatcattacggtcagtgttcctccgggtacagtatgccattcaataatccctgctgcagcacagcgctacagttaacaaatcccaaccaacagtacagtatattttccggtctctccggaaatatacggtacaaattggcgtctcccatcactcttctgtctgacctccttgcgcaactgttcctcaatgcgccggttgtgccttttctggtccttctggtccttggaagcgcaatggcccattgttgtggcattcaaaaagggctgtaatttatggaggtattttcattgggagggctgagacaaaacgacaaacaattttggcacgaaaaaaccgggcaaaatgtcaaaaaaaattgtcatgaaaattctctggacaaaatatcaactagagatcgacattttgaaaaaagcctggacctggacctggattccatgttggacctggatttcctggacaaaaatccaggaaaatccaggtccaggaaaaatccaggttgccaaaaaatgacctggacctggatccaggaaaaatccaggcctggatccaggtccaggtcgatctctaatatcaacaaatttaatacaaaggactcatcctttcgaacaagatagcgaaaatttgattcaaaagccgtgaaggataataaagtcaacaattttgatattggaccaaataccgactaaatttgccaaaattggacaaaatatcgaaagttccgagacattttaacagatttgccgagccggaatggtcaactggaccaaaatttaatgtaaagttttttgaataaaaattgattattgtctcgactttttgacgaaatgtccgttatttttttggttcggttgacactttgtctcggattgaatttaaatttaaaacattaaaattaatttgataaccagtaattaatcacattgacataagctgttgtggagaaacacctgcaaacaaatgcgctgcttccgtcacctccggcgacgttttgccaattttaggagacagacggaaatgccgctttttttatggtgcgcgaaagaggggcggacggataaagaaataattaataataattgtttaataataggacgtcattttttaatttttttttcgtccgtccgtccaacaaacaagccaaaaaattcttaacaaaacacaatttaatcaggatattagcgccgtagccaaagtgatgtatttattgtatattatggtgtgataaaaatgatagcgccgcgggacggcactaattaacactaattagtgcctgaaaatttaatttgtttttgtgccgaccgccgtcgccgccaatttgatggacttttgattggattgcacttgtttcttctcgtcataattagggatgccagaggcatccgtgcccacgccacacacgagattgtgccattccgggatgggggtgggcacaggcaacaattgccaggggtcgccgaaagatacgcaagaaaatgccaaaaatgtgcccctaaggggagaatggagagaaatattgccaaacattgaggggtggtaataatgggatggaaaatgggcaaaattaacagagtgatttggcaatacatccaaaatggacaaaagtaggaacaaccaagaaaagaggtggccaaatgtgacgattaattttgattgggaagaatggccaaattatattaaaaaaatgccaaaagaaatggaaaattagcaaaggaatgtgccccaaaaatgccaaaattttcaaaatcgcaatttaaaatatttaacggcatttataaattatttaatttttattttaatccattttttatgtggcggtgtcttaataaattgctgctgctgctgctgcttggaacacacaccagcaggaagcagcagcccatgcagaaaatgggcacaaaaatgaaacaaaaaagtttttccattaagaaaatggcaaaaattgccgcatgatggatggcattagccgaaaaagcaaaaagcagggggggggggaaagcggacggacgggcgatgggctggacgacgacaaaacaacaacaatttttgtggccctttaaacattgtgccaacggcaggcacacatggcacggcacggcgggcggaagagcggcgatgatgatgggactggggagaggggggggggaacatttcggcacggccatttcggcgccagaaacttttaaaatgtttttgccgcttttttgctggtcagtaaatttaagacattcccggttatcaattatgctagaatcaaaatcatctctgttcaatggcagcgaaaaaaatgccagaaaaagtcaattttttgagtgttccgggaccttggtactcagttgtccgctaccaggtcccggtcccgtggcactctacttttttttaccgaaatggaattttttgaaattttgaggcgtaaaagaattggcagcctctttccattggcaccaattttataaaatttggtgaccaaatacaaaagattcagcgaataatggtgccgaaacgtcactgtacgaaggagggggggggggatggcatggcacccaggggagagggggaggagggacagcggcggccgctcttttatcccatgctaatgccattttctctgtctctcgcccccccccctttttcccgcccgtttttcgctctctctctctctctgtgtccatttatggcgcgtgggcgggacccgcgctccgggggacacagggacggcacttgtgccgtgcctgcccaacccccagccaatcgacccaccaaacggtgtcccccccccctgagaggataatcaattgagtttgtgttgtttttgttgcctccttacaccaacggcgctgctggcactcaacagagcaacccaccagccgcagacaatgtgccattcccgtccctccccattcatccatcgcttcgttctcctcgagagtgataacaacagggagggagggcgacggcaaaactgtcgagaatgggaagggcgagcaaaaattttggggtgggaaagagctttgtggcttttccacttatggcacatgccgtaaaaagggaggggggagcatcattaagcgttaaaggctttgtcaaatacatgatgatgcaggacactgaaagttcgaaatttgggagccgaaattcaaaatgggcgataaaaaatgttgaaaattccaaacaaaatgagcattaggatgaagatgattgagcgtatatatctctatattgaccttattgtcactacacagtgtaaaaaataaaaggtaacccgcccggtgggactcgaacccacggcacttccaatccgccgctgaggaatgccctccctacccaacccaactgaactacgggcacatctttcaccccttcctgggccgcaaaaaaatctaatacatacaacgcaacgaaaaatgagtgtatttagcgaaaaaatggtttttaagaacaattttcgaattaatttttggaatattttttctcggcgacattttgtctcggcgatgttttgtcccggcgacgctttgtctcggcgacgttttgtctcggtggcgttctgtcccggcgacgttttgtctcggcgacattttgtccggccatgtctcggcgacgacgtttcggcggcgatctgtcgtcagcgacggtttttcctgctccgaaaagcatcgcaccttaaaattttaaaaacacattaaaaaaggtctcattattcgaaaattgcacatatttcaagcaaaatcaaattaaaattacacaaaaattcgtcaaaaattagtttcatgcccgtgtccagacagagatttgagccccggatatttgtgcctttgtccaaatttggaatacgaattcggattcagacttgaattttttttaaagccttggtagcataattacgaaaacacgatcttttgattcattagaagcattaattctgttgtttgaaagattcattatttttttttcaaaaatttgctgactatcaaattatcgcatacaatcatatttatttaaagctgtttaggctttcagggattgaaaaaacttaagtttgaacttgatttttgacataggcgaaaaattagcattttccttgcatttcacttgaagacccctcacaaaaaaaaacaaaaattccgtccgtccgtgtccccaataccaatttgctgggccgcacttttgcgctgcagaatctgttccttgatgtctcgcatttcgaccattgtcttctccttgcgcgccttctccggctcaacaaccgctttttggtacaactgctccaaatggtccgaaacccatttcaaatttggtgcctgaaacaaattgaaaaaaatttgacaatttttagtgtcataaaaatgatcaattttggtgcacctttttgcgcgtgtacagctcccaaatggtctgtgaaatggcgcgcacatcgcggtcactggcatcgaacagttcaaacctggaaaaaagcacatttgacagcaaataaaagaattcggagggtggaacccaaacttttttttgttcttcgggtcaagaaaattttctccattgttatttttcaaaaaatttaaacgccaaagcgaaaaagcaggaatttgtagtggttatgcgacaaatcgacaattttgtcattttagggtcaaattttcgaataatatggggcgccgacgggaaaattttttcctgcaatgaaaatttcaatcaaaccccactcccccaaagatnaaacag

SEQ ID NO: 5184 - DNA, 1430 bp, Heterodera glycines
gaatttcgcttgcactgtactttttttgatcatttatcagctggtcaaggatgtgcagatagatgtagatgagtttgtgcgggtggtgaacctgtcagcaatttaagaatttcaaaatttttcaacggcatcattcattggcaccgccatggctcatgtccccattttttaaaataattttactcgaaaaggatgactttttgagggcaaaatcagcgtgtcattatctaaatatattgttccttatattgaaccaagtgccaggaacgaccaaatttaaaaaacccgaaaaaattttttcatccctctcctccaagccccgaagattccaaatcgtgggaccgtcgcaactccttcccctttcaaaaaatttttttttctatccgtcccccaacttacgtgcacaacaaatccgagcacattaagcagtcgacgttccgctttgatcacaatgttcttcaactcttggtaccttttgctgcacaactccaagtgctcaaacctgaacaatggacaaggggacggggcaattattcaaatggaatttaaatggcaaaaaaaaaaaattgtcagaggcgatttgggaggagttaaattagggtttgtcaggggtactgttgttaccatcacctctcctaatcataatgccatgagcagctccactctctctctctatctgattcctcaaagaaattttggggattaaaaaattacgcgaacggacaaattagtcgtcgtagaaaacaccattttttccctttacaaatgtgtgaaaggaacagcagcaaatgaacacacacaccaaccaaccaacaactgaccttgttcgtcttcttctccaccacttttatcttgtgtcaaccaaaaaaaaaaaaccgcacgaaaacccagcggcagcagcgcaaaatgtggggggggggggatttctttcgaaaattcgaattgaatgctaatgaaaaacagagaccggatcttttttataggaaaaatgccaaaaaattgttttaacggagaagggcggtgtccattagcagttttgttaaattttcaaagatttacgggcatttgcgctgcagaacaaaaatactttcttctcactttccaccctcccattgtttgctgtgctgcggccggggaattcgtgcggactgtcaattacagaaaatgattgaaatggcgcgaacattctctgaaatggtgacaaaaaaagagcagaataacggagacagaaaaatgcccttggggaggggtgcacctgagaaagaaacaaaagtggcggagtcgaaacgaacattcattctttggtccattgggcgggctacggttggtttgtgccaaacaacttgctgctgttgctttgctgtcggggtgttttgacaattcatacaaatgggcaattttcgaataaattttttgaacaattttttttt

SEQ ID NO: 5185 - DNA, 1386 bp, Heterodera glycines
  misc_feature (1366)..(1366): n is a, c, g, or t
atcatccatccattcatttagtcattcatttgtggaggggggaaaattgggagggaatagctaaaaataaatatgaaaacaaatcagtggttataatgtgccaaacaaatgacaaaaaattggcgcttgagaattcaatcatttgcccattttgggcagaaaaagtgccgtaaatgaagagaatttaagattttttgaaaaatctaaatcactaccattttagaaccaacaaacaacacatcaatcacgatcatcatgagtgagagagagaggaaggagctgtggcattttacaatcattttttaaaagtttacctagagaaattttgaccaaaattttttaagtggctgttcaacggccaacaaatgcatgaatagttcaaaaaactgtcaattatccaaaaaaatttttgggtgtttcctctgaacaacaaattttcgcgcaaatccatgcctaattaagggaaaaaaattgtttactttttgctcagcttttgcaaatcttcgggttgttgtgatgcgaccgcatttctccgatgatggatttgcttaaggcgattgtacacattgagcacgtcacgctgaacgcgataattaaaggggaaaatgggaattataattggaagaaaaaaaaacgaaaatttgattccccccccccatttaaggttcatttgttaggaccaaatgggctggagtggtttcagaacctaaaaaaattcaggaacacagaattttgggcgctatatggaaagtcaccgattttgaaaaattttttcacttttttttaatcaaaatttttttttgtttaaaaagtcctgaaaccaagtacccgggggttttaaaggtcgctgatcacgactataacaattatttgggcctgttaagcaaatttggcgctagttataaagtgatagattttgtactttatcaaaaaccataggggggacccttttgttttgtaaaaaaatttttggataaaaatcgtgaaaatactttttattcaccataattgtgctattaatactcaattttcatcattatgtgtaaaaaaacaaaaaaaaaattttgaccaaaaaaaaaagtgaaaaaaattttcaaaatcggtgactttccatatagcgccgtttttttattccgatcaattaataaataaaaaaagcattcggaatttttgtcgaccatcaaaatcacagcaaaattttgtcatcgctcatcattttctgaaacactccaacacagtttgtttctgactggggtaagtgattgttgtgaacgggttggggcgcaaggagtcgcagcgacgagttgggcatctgctgggcttccgattgtattgcgagaaatgacaaggaagtctttgatggaanaaagtatatttattttattt

SEQ ID NO: 5186 - DNA, 4857 bp, Heterodera glycines
accgtttcttctccagaacgtgttccgcgcacttctgctccaatcgtttcttctccagaacgtgttccgcgcacttctgctccagacgtttcttctccagaacgtgttccgcgcacttctgctccaaccgtttcttctccagaacgtgttccgcgcacttctgctccaaccgtttcttctccagaacgtgttccgcgcacttctgctccaatcgtttcttctccagaacgtgttccgcacacttctgctccagacgtttcttctccagaacgtgttccgcacacttctgctccagccgtttcttctccagaacgtgttccgcacacttctgctccagacgtttcttctccagaacgtgttccgcgcacagctgctccaaccgtttcttctccagaacgtgttccgcgcacttctgctccagacgtttcttctccagaacgtgttccgcgcacttctgctccagccgtttcttctccagaacgtgttccgcgcacagctgctccaaccgtttcttctccagaacgtgttccgcgcacttctgctccagacgtttcttctccagaacgtgttccgcgcacagctgctccaaccgtttcttctccagaacgtgttccgcacacttctgctccagacgtttcttctccagaacgtgttccgcgcacttctgctccaaccgtttgggaattagtcataatggactggggagcacaattggaaggggaaaatagggctaaaaaaagaaaacggaaaatgcggaggaattggaaggggataggcaaaagagaagaaatttgtagaaatgaagtgatgcctaaaatttgtctatttatatattgctgaaatcacatttttgatgaagttggtttgatattcaatttgcatttgcatctctcaaaagctataaaaggttgaatattctacagtttccaacattcaaaattggtgaatataagcagcaatcgttggatttgcgaatgaaatttaatgattaaatttttttcggttttcagatgggtttgcaacgacctttggattggaaggacattttcccattttttggtcgtcctcaactcggcctcaaattgttcgacccgtttcaattattttgtccgtgaaatttgtcccattatttgtttaggcatttctgcgtgccaccatttctccttcctctgtcagttacaatattaaattcgttcgtttttcgtcttccaacagtgattggctgtgaagcgatgcccaattggagagacggcggcggcggttcagcggaaacccaaaaattcggcggacgatttgaacaaatgtcatcttttatttgtgtgatgccaataattaattgacttggcggtaatactgccgatggtgccccccttttttgaaaaaaaattttcaaaaatttttcagagataaaattgtctttagggtttttagggccgtagaattcgaatctgacatccgttttgacccatttcgaacctcgaacccggattcgaacaaaaattcgaaaatacaatttcctaataattcacatttattcactaaaatcggttcaattgcattaaaatagttgttttgcattgatttgtgtgttattagcatttaatataatatggctgcgttggaagaccttagaaattttacattgaaaaaactgcacgataattggcgttgaatgacattgagtttgatgcttggcttgaagatattggtctccttcacgcacgtcgtacgtgtccacgatgtggtggagacacatcgattaaggcaaaagaaggccgccgttatggaaactggcgatgcaaaacaaagaattgccgaaaagaaactggctatttggtcgggacatttttcgaaggttctcttgctattttgtacacagttagtggtgttctagggtcaaaattatcaaccaagcaaacttttgaattgacttatttttaggcgcgtaaatatgaaaccattgattacattcagcaggaaactttgtcgattggtttaacttttgccgtgacgtttgtgccgaattctttgtaagacgacccattgccatcggtggttaaggtcctagccaatttttttctggggatttttttgtgtgtaggaagattagtcgaaatagacaaaactctgatccagcaatacgtacttcctggtaaaacgattgtcagtgacgaatggcgatcgtaccgcggaattccgaatctcccgcagaactatgcccatttgaccgtgaatcattcagaaaactgtgaatcccggaaaccgtcttacacacacgcaaatatcgaatcattatggaagaaattgaaaaggaattttaaacaacagttcgggaacaaaactgaaacatatgatacgtattttcccgaatttatctgacgtcggcgttttggtgatcgtgatactgttttttataatttttggttgcatgtatctgagttttatccgtgccaataactgttgcaaggctcactaacacaattgaaccgattttattgaataaatgtgaatttttaggaaactgtattttcgaatttttgttcaagtccgggttcgaggttcgaaatgggtcgaaacggatgtcagattcgaattctacggcctaaaaaccctaaagacaattttatctctgaaaaaatttttgaaattttttttcaaaaaaggggggcaccatcggcagtattaccgacttggctaatgtgtcaaaaaattgcaacttaattaagcccattctcgtcaccagcagcagcagcagcagagaaaagccaaagcaaagaaaatccgactgatcatttcgttggaaaagaattatatttgagaaatggtcgatcagaaatgctctctcacattttcatttgttgattctttcgttttttttggtgttttacctttcacttcttaggtatttcagccgcagcgttatgccttgaccatttacgcacaagatttaccatttgaaatcgtaagtttgaggggggattggattgtaatgctaattggtcatcattttcagcaaagtgccgtctttctgagcatgaactatcgtggaacgccttctcgtactgcaaaacggagctgaccaacccggactacaggaaggacgactttctgattcggattgaaacaatgcacttgagtgaccgcggcaccaccaaaaacgtgactcatcatcatcactaattgattgttaattatgctacaattttcagttccgtctttcaggcactcggtctttcgaagggagtgctgaacgaacgcaaagtggtgtgcattgacatcgccaacgacaaaataagtgaatgccgagaaaagtgcccgccggtgattttcggcggttgccaatcacgaaattttgacatcatttgtctactaatttaacattactgaatttccctcgaccgctggtacggactgacgctggcgcaaattcgtctgatcgaagaggagacgcagcgggcattggatgagggatgaccgcctctgaacgctgatgatgaaacgcgagtgccgtggcgatgaagctgacctatttgcttgttaatgtatataattcactgcttgtcctttcatccccacgcatttttcgccacttattgtatactaaacacaccccaatttcctcttaatttaattggtttgtgttgtgcttatgtggcagcaaataaatgttcgattttaagatttaagcacagttaaagattgaaaaatgccggactcggagaaggacccgaatttgaaattcaaattgtgacttaaaaactgatgaaagtcacgaaaatgtcagaaaagtgcaaaaatgtcttacataaaatcccaaaagtaaaaaaacaaataaaactgcaaaatagagacttcaacttatgcagatgaacatatgttttatttacacaatacaagtacaggttatgcgagaaattaatacagacggattataagttaaatatggaacataaatgagggtgttagcacaggatataattacaggtagggattatggacagaacagcagtatatgatcaatgggcagcaaaagaacagatgatcaaagggacggcgccagagcactcatcggtggcacatcagtcggagcggcgcgaacggagaaattctcggagctcatcagttcgaagaaaagttggtgtgccgctggtccctggagcattgaaagaagccaattcccaaagcgttgaggtagcgaaacctgcaaaagtgaacaatcaaacttcacttttttaatgtcacgtctgttacctgctgggaccgtttcttctccagaacgagttccgcacacttctgctccaaccgtttcttctccagaacgtgttccgcgcacttctgctcgaaccgtttcttctccagaacgtgttccgcacacttctgctccagacgtttcttctccagaacgtgttccgcacacttctgctccagacgtttcttctccagaacgtgttccgcgcacagctgctccaaccgtttcttctccagaacgtgttccgcacacttctgctccagacgtttcttctccagaacgtgttccgcgcacagctgctccaaccgtttcttctccagaacgtgttccgcgcacttctgctccaaccgtttcttctccagaacgtgttccgcgcacagctgctccaaccgtttcttctccagaacgtgttccgcacacttctgctccagacgtttcttctccagaacgtgttccgcgcacagctgctccaaccgtttcttctccagaacgtgttccgcgcacagctgctccaaccgtttcttctccagaacgtgttccgcgcacttctgctccaaccgtttcttctccagaacgtgttccgcgcacagctgctccaaccgtttctt

SEQ ID NO: 5187 - DNA, 1557 bp, Heterodera glycines
ctgccgatgtgcccccctttttgaaaaaaaattttcaaaaattttcagagataaaattgtctttagggttttaggccgtagaattcgaatctgacatccgttttgacccatttcgaacctcgaacccggaatcgaacaaaaattcgaaaatacaatttcctaataattcacatttattcactaaaatcggttcaattgcattaaaatagttgttttgcattgatttgtgtgttattagcatttaatataatatggctgcgttggaagaccttagaaattttacattgaaaaaactgcacgataattggcgttgaatgacattgagtttgatgcttggcttgaagatattggtctccttcacgcacgtcgtacgtgtccacgatgtggtggagacacatcgattaaggcaaaagaaggccgccgttatggaaactggcgatgcaaaacaaagaattgccgaaaagaaactggctatttggtcgggacatttttcgaaggttctcttgctattttgtacacagttagtggtgttctagggtcaaaattatcaaccaagcaaacttttgaattgacttatttttaggcgcgtaaatatgaaaccattgattacattcagcaggaaactttgtcgatttgtaagacgacccattgccatcggtggttaaggtcctagccaatttttttctggggatttttttgtgtgtaggaagattagtcgaaatagacaaaactctgatccagcaatacgtacttcctggtaaaacgattgtcagtgacgaatggcgatcgtaccgcagaattccgaatctcccgcagaactatgcccatttgaccgtgaatcattcagaaaactgtgaatcccggaaaccgtcttacacacacgcaaaatatcgaatcattatggaagaaattgaaaaggaattttaaacaacagttcgggaacaaaactgaaacatatgatacgtattttcccgaatttatttgacgtcggcgttttggtgatcgtgatactgttttttataatttttggttgcatgtatctgagttttatccgtgccaataactgttgcaaggctcattaacacaattgaaccgattttattgaataaatgtgaatttttaggaaattgtattttcgaatttttgttcaagtccgggttcgaggttcgaaatgggtcgaaacggatgtcagattagtcggtcattaatttgaagctccaaatcccccacacgctatgccatgctcttcaatggattctacacattgtcaaacgcggagtccttctgcctatgattgatagggttctctttgtacctcataaaaatagtcgttcataaatttgaagctccaaatcccccacacgctatgccatgctcatcaatggattccacacattgtcaaacgcggagtccttctgcctttgattgctagggttctctttgtacctcataaaaatagtcggtcataaatttgaagctccaaatcccccacacgctatgccttgctcttcaatggattccacacattgtcaaacgcggagtccttctgcctatgat

SEQ ID NO: 5188 - DNA, 2222 bp, Heterodera glycines
  misc_feature (89)..(90): n is a, c, g, or t
  misc_feature (92)..(92): n is a, c, g, or t
  misc_feature (95)..(95): n is a, c, g, or t
  misc_feature (101)..(101): n is a, c, g, or t
  misc_feature (105)..(105): n is a, c, g, or t
  misc_feature (107)..(109): n is a, c, g, or t
  misc_feature (111)..(112): n is a, c, g, or t
  misc_feature (115)..(116): n is a, c, g, or t
  misc_feature (120)..(120): n is a, c, g, or t
  misc_feature (128)..(130): n is a, c, g, or t
  misc_feature (132)..(134): n is a, c, g, or t
  misc_feature (137)..(142): n is a, c, g, or t
  misc_feature (147)..(147): n is a, c, g, or t
  misc_feature (164)..(166): n is a, c, g, or t
  misc_feature (168)..(171): n is a, c, g, or t
  misc_feature (173)..(173): n is a, c, g, or t
  misc_feature (202)..(202): n is a, c, g, or t
  misc_feature (205)..(205): n is a, c, g, or t
  misc_feature (212)..(212): n is a, c, g, or t
  misc_feature (217)..(217): n is a, c, g, or t
  misc_feature (222)..(222): n is a, c, g, or t
  misc_feature (228)..(228): n is a, c, g, or t
  misc_feature (235)..(235): n is a, c, g, or t
  misc_feature (238)..(238): n is a, c, g, or t
  misc_feature (260)..(260): n is a, c, g, or t
  misc_feature (265)..(265): n is a, c, g, or t
  misc_feature (271)..(271): n is a, c, g, or t
  misc_feature (281)..(281): n is a, c, g, or t
  misc_feature (296)..(296): n is a, c, g, or t
  misc_feature (303)..(303): n is a, c, g, or t
ataaagaagcacatgcgaatgaattattatattttcctatatagttcgaaaaggaatttgacaattcgttgttttctctctaaagggcnngnaanttgggngganannnannaannaaanaggagaannnannngannnnnnaaaantactccatagggaaaannngnnnngnttttttgttgaattttgaggtttttcttntgngaaatgnaaggnattanaaaatntacattnaanatttaaattttgtaaagtaaanatttntatgtnagtaaaattnattggttttttaaanaaatatncaatcgaaaaacggttgtctgtttgcccgtattgatgtaactgatcaatttcacgcacttcattaaggtcaatcatatccatgtttatatcttccaagtcaatcaaatccaaattaataacattttcttgttcagtgtcttgcaattttctttttttattcaaatgttcgttttcaaaagtttttaaccgctttttttctccggagctttgaaccggttcatccgcttttttgaacgggagctttgaacccgtttgatcatttgagggtcgtgaatcattatcatgcaatgatgatgaagaacactgatcctcggaaggaaaagattgcttaattcgtaccattataaatctaaataaagatacaaaataaaacaaaaaatttacactcaaaaaacaatatcaataaaataggacgattattatgtaagagaaatttctaatatggacaaaaaatggttcaatttcactttgtgcgtcgaatcatttttatgcgtccgatcggaattttttcgctgatcaatgattacgaatataacgatttattgatccaaatccattcaaaccaaattaaattttctatttatttttttcagcttagtttccaataataacgaagttaagtcagatttagcaacaaacggcatttattcgtgatcagcgacctgaaatcccattcgatatgttttatttgattgtttaaaaattaataaattaacgtaattaggtgcataagaaaatgatctggactctaaagtaaaactgaaaccaaaaaacatcaaaatacggacctaaaattcacaattagaacttaaaattttttgaatacccaaaaaggaaaaccaaaaaaaagagaaaagaatgcataaggaaaaaatatcgatatttttcggaaagaaactaatgaaaaagtatgtaaacaacggaggaccaaaatgatgaaacaaactaatctttgatgtgtaagagagacacaatcacaattttgctgaaaacaacccaccgacacaatctttcttgttttttgtttctttttcctattatgtacaacaaagcaccatttacccgctaattcaaaaaaagaggcggagcttcggctgacttagtatatagttaagggattgagttggtagcttggtagggcgtgggtaccacgggggaacccacgtcatgtgggagcagtgaggacgtgttggacaaagcgagtaagggagcggagaacaacaaaagcagtgcaggcaatcgctgtgttctgatggttagtggataaaattaaaggcgaaaaaagaaaaaatcatgggtttatcacgagggtcattggggcccaatcactccaatttcaaattgccaaaatgcttaagaatcaattcaaattaattaaaacaaccaagcacgggcagccttttcttcttgttttatgttaaattgttcagctgctgaataacattcatttcactttacgaacgagctgaaatagctgcatacggcagcggttagtgccaaaaatagaatttgtggctttaaaatgccttaggctatgattaaaacagacacaatcactataaattataaatattttggcgctatactaaaagtgggcctttttgaaacaaaaggggggacccttttgttttgcaaaatttttttaagataaaaaaccatgataattttttatccggggttttaaaggtcgctaatcacgaatctgacatgtattttgactaatttctaatccctaacccaaactcgaataaaaatcggaattttgaatttttcaaattatgattttttgttcaaatttagattaggaaatccgaattgatcaaaataattgaaggattcgtgatcggggaccccaaaaaccccagagaataaatttttatgactatcacaaaaaaaattttgcaaaacaaaagggtcc

SEQ ID NO: 5189 - DNA, 4061 bp, Heterodera glycines
  misc_feature (3894)..(3894): n is a, c, g, or t
  misc_feature (3969)..(3969): n is a, c, g, or t
  misc_feature (4009)..(4009): n is a, c, g, or t
agctgaaatagctgcatacggcagcggttagtgccaaacatagaatttgtggctttaaaatgtcttaggctatgattaaaacagacacaatcactataagttataaatatttttaatgtgtgtaattgctttgtcgtattttcaggtgctttaccattactcgcagttgaaagactttataaaccaaacggaaccggcagaaggaggcccgtcaatttcaatattcaaagggacgcggatgaattgaaaatttggattttggaaaagttccaaacggcactggttagttgccaaaaatggaattagcttgaaaatttcgagttcggaattttgtaaatagggaacggggactgaactgattttggacagtgagaagaaacccagttttaccgggggccccgccgaaatcggggatttacaataatcaataacatggtcaaaattgaaccagcgttttttaagtgattgagaaaaacgaggaaataatacgatggtttttcttttttccgaaattaagttttttcaattggattttcaactttacaaagaataatttctcaggtagagttctttcgtcctttcgcgatccgaccaatttgcaagcgaatacccaaagcatgacgcatttggtgccgaagttaaggtcggaaactgccgaggattttgaacaaattcttctgttcctctgtcaggtgcgcttgaccattacgcagttcaaagattgcgatgacaagaagggaccgagtcgagcaggcctatctatttcagtacttcaaaagagatgccgaagagttggaaatttggattttggaaaagctacatacagcggttagtagccaaaaaataaaaattttagcttaaatctttcgcgaatttgttgcaaaagttcaggtcgaaaactgccgaggattttaatttttgtgttgaaattttcaagaaaatcttatgtaaaaatactttaaaaaactttcatttaaagatttctagtatttgaaaatcagctcgaaaattattttcttatcttggagaattttttattatttaaagttttctcattttaaatgaaagttccataaattttttaatttataaaaataatgttaacattttgcaggccgagaaatttttaaaagttcccctgcaaaaaattgcttccttggcattttgtccacctgctctttcaggcccacagctggacaagtcaggcaatgacatgattcagccaggtatgaaaaaagtttaaataattcaaaaatatgtaaatcaaaaagtcattttgaacagcgacattgctggccaccaacgacttttggcgcgatttgaacactgcactgacgcagcgaaagcataaggggcccgagcgcgatttggccgcattggagtcgaaggtggcacggcaaggggaaatttagcagtaaattattcagacacaaaatgtcctgctttcaaacaatcccttcacaaacaagatcatggctctgctcgataaagctctgccattgagtagttttcgtgtgacaagcacatagcttaattccgaccatagaattgttagtgctgttcgagagacgagaccgagaaaattggattatgaaagagagattgataaaaaatatgaaaaattttcaatatctctctttctgaactggtggttaaatgtaaaagtaagaacagaaccaagaccagttagatgagagctaaaaccacaaaaaagtcagacttttcgcatattttatttataacttttttacatgtcgatttatatttgtgatttttgggatgccaatagagattgtaaagctttcgaatgataccaagtttgttgaatttatgttatgggctaagttcattttttatttaaatataccttagttcgattaaagccacttaaatttaaatgaaaaatctgttaactgaaaatcttatatatttacgttcccctcccccaaggtggacaaactcggcacagagacgaaccaattcgtacaaacggcaccgcttcatgagcgacaaacacgacttggtcgagtgaccatgagcattcaggtgaatgagcacaagacaataaacaggcattgtaccgtgccaaaattgtactttagttttattataccgtaatatttggcatctaactagccattttatttagttaaaatgaacttaacccgcaacatagaaaaattaaattttttccaacttaagaaatcatacaataggatttattcgttaatgtgcacagatacaccacaaccaaaattagctaatcatgaccttgacattttttgctagatgattagtttttccaaacgctgattaatcatcccaaacagatgattcatgccttccgtcaattccatttgttttaaaatgtttgtgacttatacgacaagctacacatcgggaaaattgagcagccaataattgcggcagtcaaaaattttttaaatattaaaaaaaaaattgtttacattttttaaattaatctttttgttttttaaattctcctagtaaattttttgttggtggtcccgtatggcttgtcggaacagatctcggtccgcgttttaacgggatcccgaaacatgcattcgatgggagtaaattcaagacattatactttttctttgttgattaaaaatataattttgatataattcgaaagcacatatagacttctatggccaaatttatcaatgtatagaaattctgacttttttcacttttattcaactatggttcctccccatcctcaaaaatacagtaagtattattgtttgggagatttggctttgtgatataccaaagaaacgaggcaattaaaactaatgttcacatggattaattaaatatttcaatattttcattcttaacagataaagtctgcacccactcattcaatacactgtgccgaaaaagtcaacgattgttggacgaagagattaaaaagtcggtacgaaattttcagtgcattcagatgtggttattagctttgtttttaaaatcttaggatcattccataacactattataatttttgattacctaaattattttttataagcatcattattttaatcgatgaaataatttaaaaatttttaatgttgattcggtgtcgaattttaatttgtaagctttcccataatgtggggtttttaatgtttgaaaaataatttgagtcaatttaatgcgaaatattttcatgcatttctcacttttcgattttgtaagaaaagcgccaacacatcagatgacaaaaaaaaacttttttctaaatttcagtcaacgaaacaatttcccatttctgccacccatttcattttttggatttgcgaaattattccccataggaaagactcagatagttcaaggtcatggattccacccatccactgccatcaagtacataattgttaatgttgcaactgactatttttgctaaaaaactccattcagtttgaaaatctttgtcccagttttacaactgtaatcgtaggtcaatcgcacaatcagtcattgtgttttggcaccccattttcgtcatttttccttccaaattttcactcttcagtttttcatccattgcctataacaatttgttcacataaaaataaacttttcttttaaaacccgccatatttttcagtcatcatttgtcattacaaggcggaaagcgtggcccctctgctcacatttggctctcagtttggcattgtgttggctgttctctccgcctattttctcatttggaaaccctccgccgtttgctcactcgtcaaaaggtagtgagtgaccaactttatttataaattacctttcctatataaaattcaaaaacattttgtttagatatgaaaattttctatttatattaatttaattgcgttagcccanaagatggataatgaatagggattccttttttcgtaagaaaaatcgcgaaataagtacaaaaaagctcgaaatcgntattaaataggtacaaaatcccgaaataggtaaatttaantgaattcctttaaactaaaaatttcgaggtttaacccttttgttgcttacca

SEQ ID NO: 5190 - DNA, 2536 bp, Heterodera glycines
  misc_feature (2376)..(2376): n is a, c, g, or t
tcaatttaagaagcttcaaattggataaaggaaagaataaaatccgctttaaaatgttttttttttgataatatacgttttaaataaaaaaaaaattactttttaaaataaaaaaagctttttggcttttttagttttgtagaatttgacaaaaatcttcagcagttattgcgtcccagtaatggatgttccaataatatatttcaattttattttttaaatcaaccaaaaaagcaaaatattttaaaattatatattaatttgagctaacaagggggctgaataagctaataaccaaaacaaatgtactacgtctattttatttagttgggaacggattttcagttgctaaaccccaaaataactaaaataattgcgaaaaatagaatagaaaatgcaaaaagttcaaactaaacatttttctctaaaaaagtactaaaatatgcttcaaaattattctcattataaatagatttgctaaatttttatatggaaaatcatttgaccttatcttaacatcttttacagaaaaaaaaaccgtattttgccccatttatgctctacataatttcaataatttcgataaatttcgataagattcataaaagttatgtccagaagaattcaaatatctcaaattttacaactttttttggctcgaactttttttgaacttgtcgagattttttggaattttgcaggctaatagagcatctaaagagctttcgaatgataccaacaatgttggatttggttggcaaagaaaaaagttatagtccaaaaacatgtgttcgtacgataacggcctgacccctttaattttactttattatgcttatgttcctaatttcaaattaaaaaactaatgatttttttgtaaaatgatgccaataattttatttcaatgaagtacaaattaaaataatgactaaaattttttgtatttagtacaaaaaacaattaataaactcttgtacttagtcaatggggagtattgatgcacctgaacacacctctccgtggactgttcttcttatcttcaccactcaatgtccaaccggagaaaaactacaagaccgctgcacgggctttatcgtctcacatgatctaatcctaaccgcgtcacattgcgcgttcatgagttacaatgaaatcgaattgagatgcagatacgaagcagaaactcataaacaatggtgagttctaactaagattgaaacttctcattatgcatgacaaaaattttaatgaatattttaattgttatgccggccgagggcaaacaataatattcaaatttatttgaagacaaaataagttaagaaatagcaaaaaaggggagggatatcattgtgaggaagcacaaatgaaaaatgaaaatacaaatgacagaatgggtaaaatggtagttctaaactcgctagcagtgactgaagtggagtctgtaaattatctgcaagaaaataaacagaaacacgaatactcggtgttcaattcgattcagttgactttctccgtcgaaaaaatttattcggagacaaaataaataacaaggagcaaaatcggagtgtcgattgggaggaagaaccgataaatgaaattaatacaactgatagaatgggtcaaagggcggactatttatgtggaggataatggagagagagagataacagatgagagacaaatacaaatgaatatgggagcggtcatattagtcccaaacctaacatttttgatatatactagggtcagacgggtccaggtaccagaccgggtccaggcctggataccctgctttttcaagacccgtacccggacccagttttttgaaaatccaatacccggtacccgacccggcaggtccgtttccaaccgggtccaaaaacacactgtaacaatcggggtcagagtcaaaatattagcaaagttgaagggaaaaaaaagtaaaaagaataatttaatttattgtaaaatagcaattaatttctcctgtggcctagtggttattctgtttgattcatttctttctttgctcaggttcaattccttcttatatcagttgggtttaacattttttttttaaatttttgtttaaaactgccattttatcattaagtgaataaagctcaaaatttttaaataaaataactatcttgttttaatagaatttacaaaaaaattcttaatttttacaatatcccataagaaattttgaaaattttatccctatatttcttgaaaatttgaacattttttgtgctaaaaccacaaagtttggtcattttattcactaaaatctgttaacaaatcaaagtaaattttcaaaatttttcccgacggcacctatcggcaccgccggacccacccctgttcgtngaaagtttttcggaaaaggctcgccgcaaaaatggtttgaatagcaaataaattggaaaaataaaagcatttatttgtaaaatattatattttcatgcttttttaatataagcttttattatgaaaaaatttaggaaaaatttggatttttatatttttc

SEQ ID NO: 5191 - DNA, 1382 bp, Heterodera glycines
aaatcggagtgtcgatgggaggaagaacgataaaatgaaattaatacaactgatagaatgggtcaaagggcggactatttatgtggaggataatggagagagagagataacagatgagagacaaatacaaatgaatatgggagcggtcatattagtcccaaacctaacatttttgatatatactagggtcagacgggtccaggtaccagaccgggtccaggcctggataccctgctttttcaagacccgtacccggacccagttttttgaaaatccagtacccgacccggcaggtccgtttccaaccgggtccaaaaacacactgtaacaatcggggtcagagtcaaaatattggcaaagttgaagggaaaaaaaagtaaaaagaataatttaatttattgtaaaatagcaattaatttctcctgtggcctagtggttattctgtttgattcatttctttctttgctcaggttcaattccttcttatatcagttgggtttaacatttttttttttttaatttttgtttaaaactgccattttatcattaagtgaataaagctcaaaatttttaaataaaataactatcttgttttaatagaatttacaaaaaaattcttaatttttacaatatcccataagaaattttgaaatttttatccctatatttcttgaaaatttgaacattttttgtgctaaaaccacaaagtttggtcattttattcactaaaatctgttaacaaatcaaagtaaattttcaaaatttttcccgacggcacctatcggcaccgccggacccacccctgttcgtgaaaagtttttcggaaaaggctcgccgcaaaaatggtttgaatagcaataaaattggaaaaattaaagcatttatttgtaaaatattatattttcatgcttttttaatataagcttttattatgaaaaaatttaggaaaatttgatttttatatttttcaggacccggttggacccagtaaccggatccagtttaaaaacttggacccggactctgtttttctggacccggaaatacccggacccggtttttacctaaatacctaagacttaccgcaaaatgaaatccttcaggttacaacacacaccagaagagttagccatttacataggatatttggacatcaacaatcccagcgaaaacgcacaactactacaaggagaagacatcaacaatatatttattccaattgaattttcgcctcaccaattgaaggatggcctcgcccttaaatttgactatgcggtaattaaggtatttatttgttgctttcattaaactgaaaattattgtcttttatctatttaaaaaaagtttacaaataaattgaaataaactttaatatgcttcgt

SEQ ID NO: 5192 - DNA, 5166 bp, Heterodera glycines
ttacggttccgtgagaatgttcaggccctgatgcgatcagatatgtgctagagcggggggacaggtctgatcagagaggatgataaggaaattgatcggagaatggaagagaaagaatattagctgatctgagaaataagacatgattggtcacccccaggcactgatcagagtagtagcaagggaattgattaccgcctcggataactccgatagttctccatgtttggctcattctatttgatcagcagcgtatgatcaatgtatgaaatccctgctcattttagctgcttcactgagtacatcggtcgcaatggcggcttccaggacattatcatcggctcggaatgtgccgaggtttcttgttggtgccaatggcaaaatttaatggttggcacttcctctgaccatgtaggaatatgtggtggcacacgaaacggggcacgccctgggctattggcacacgcagtgagttgatcagtgccgtaaaaaaccaaaatgataattgcttgtttggcacaattcagtcaacggcccgaccgggagaagtacattagcatcaattggaggttggcccggtggaaaagtagagaacggaagagagcggacattttgccaatattttatgaaatttttaatccgatttaagttttacaaggctttcttttttgaatttacccgaatcgaaattgcatttatcaatttataagtccactttggtttatcagcagtgcccgttatattttttaaaatatatttttcgaatattttaccgaatgaaaagcacaaaaaaagcttttaccagtttttcttttcaacagagcgagtttttatcacattaaaaaaatacaaattatatttttggatttttgaggtttttagcaaatatttggggtttttggcaaattacacatttagatatttggcatttttagcaaatataaaccgggccctgtttatcagatagtttaatcaaaactgtgttgtattcattaggctttacttgaccaacaatgccaccaccacaaaactaacctgagggcctttttggcattttttggaatgtcaaaatgtttaaaaattcaaatttcggcatttcgttttgtccgctctctgagaaaggggacggggaattctgtgggggcatgtacaacaacagcttatcaattaacacactctgctgaaggaatgtgctggaagaagcgaccgctgtaagtttttaagtttctccattttatgaattataaaaaataataaataaattgttgaaaacattaaaaaatatattcaatttttgatattgaattccaatttgataataaacatatgagattttgatcaaatattaacacaatttccattcagtccttcatgcccttccggtcaatgcttcaagtaaatatttattattttaaaatatttttcttttataaattaaaataattaaatcaattttgaaattgcattttcatttcaattcattttttgattttttgaattgttttatgatgcaaaatcaattcacaaataactgactcggaaatacatattccaattagctaagaccttatagtaaaataaaatgcttttcccgcatttgcaatttccctctcattagtatgattaattgcgtaattagcaacgctccgccccattcccccaattatcgctaattaattgccctcttccctttcccaggcgttcggcatcaaacaggtgggtggtgttggtgagtgacgcaactgattgtgttatgtgtacgtcctgcccatgcttcgcccattttttccatcatccgaaggtgtccactcgtcgagcaccgtcagtgcctaatgttttttccctttctcccgcggaggggtgcatattctaattaggctaattagtttgatcgcccccgaattttttttcagaattttaacacattttttacatttttccattgttcataacttttttgcattgttaaaattatttgatgttttttggaaaaccaagcttgtccagatgaacatttaaatgttaaattggtgtcatgacaactcgtacaattgcttaggttaagcctatgatttaggcttaggtctaagctttaggctatacctaggctcgtttggacctaggcttaggcttaagcttgggctttattttggaaaatacgaattgccttttgtacgaattgtcattgacccgcaaatgcttaaatgctacggattgcctttccgatcggttcacctgctttttgatcagatacgactacggttcgctgatgcactatcacgcggttgcacatgcgcgccaagtgtccgacttcaccattgtgcccaaggagctcaaatatgtgaccacaatgggcaccgaacggatggcatttttggacgccaaagtgatcaacggttgtttgtacaaacgaatgatgtgccctgggcatacggtaaccgtattttcctcccctttcagacatttactgtccaagtcagtctctcccgatgggatcgctacaaatgaaattatgtaatggcacttccccatcccattccccactgatcagatgcctgctccggtttgggcgagttgggaagacccgtaagtgacgtgggggaaaattgggaggaagattagtgggttttacgggaatttttcgagagtcgagactaaggcacaaagaaaatggcgagaatgatctccgatgacgtatgacaatttttggaacatttggttttaaaaaccgaaccaaatttactgagatttttcatacgaatagaacaatccgagagctaacgtatgatatcaagactgttttatttggctgtgtttgtgaaaatttatcatgagtttttcttgaaaaatctgtaaaattgagagtttttttatgaaacactctgacatcgactcataccaagcccaaaaaacattcttgactttggaatccgaagagttgggaacccaagcagtggacagagttggacatgcttatgctctgatattgatctcatttcgtgttgaaaatggggaacccctcaattttcctaattctccacccctccgttcagttgcgctgccaatcaggcggttacccggacccgaacaattgcaatgtgtgccgatgccctgaaggattgggcggcaccgaatgcgaacggcttcagccctcaagtgggtaattagggggacaaaaagccgggggaagggggggagggataaagccaatggaaaaggaggaaaagccgtggccaaaaagggggaagggaaaatggggacaaaaggaagtgcaaggaaactagggaattgtgttatgccatctcagactgtggtgccgaactgcaggcctccgaccaatggcaaacattgcgaagtccgaacggcaaagacattcagtgctattggaggattacggtgagtgggcactttcattttggtccagacattgtttgccaaatattagtgattctcgagatcgaaaatttcccaagactcgagaccggggcttttttcaaaaaatattcttatgcacttaaaaatcgaaacaaagtctagaacacaatccatttgactaaatatgtggtaatgtatgtatataatccatgaaaaaggttaccaaattatgtatttttttaatgaaataattttttaagtttgaaaagccaaattaagggtgtttgtctggtctcgagatcgagactatcgggcttcactaataattatgccaatttcagtccgaagaaggaagccgagtccgtttccgcctaagcgacggcgaagtgagtctcggcaattagtcgacccttgtaaaaatgctttttttagtttccatgctcctacggctgtcaggtaaaatgacgcttttccgaccactccttaattagcacaccgtttgccccacttttccctccttttcagtcctatgtcgagataaagcacaaattggacgttcggctgaccggctttcggaggtcggtttatatattggccaatctttccgacacacatttcgcagttgttgctatcggcccaaggaggacaccgtgtcggatgggaaccaaatttttgtgatttttcggcccaacgggcgcaccgcgcgcttctcattgcgcttcatccgtcaggcgccctgagacggcggcgacggcaccgccgacggtgtgcgcatgccaattccatacgcgaccaaaaccgttgttttgtgtgttgtgatccggtaacaaaaaagtgctgccaaaagatctctccctagcccactcttttttttgctctgcttcttttcttcctttcaaggtcggtctcgggggcgaaggcccaccacgaggccgcgaagaggccagagtgagtaccttcggtgcaggaaaattattaaattttaaaattttttaattgctttttaaatatgccaaaaaatgtaggcttaacttttctagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaagaaagtcacggtgcgaaaaatggggtttgaaaagtttatt

SEQ ID NO: 5193 - DNA, 1999 bp, Heterodera glycines
catccaccatccccatcaaatcttctacacataatttgagacgggtgccccccccctccttgcctctccctcaaaaaattccaattcattccttcccatcaaaatgttggaaaaaatttatgaaagaataaattttgtatttccagcagaaaaatatgtatttcgaatcatgaaaagacaattattaataagcatttgttagagtaagagctgcgggcctcccagcagcaaacatgggagacaattaatgtgacatggtaacagaaaagcgaccattttaaccagttcatgtgtcaaaaaaaacacatcaaaacattttttgcagcattttttacgctttttttctaaaaaaaggggggaggtgaccagcagctcccggacaattcaccaaaaaaaaaatccgtcagtaaattttcttttataaatctcaagatttaaaataattaatttaaatgaaaaagaataatttgttaaaattagctgacggattgtccggacctcgagggaggttatcggcggtggaattggctggaaatttttggtttttttaatgaaagcacccatccatgtctgctgttgtgtgtaatttgcacaatatccaaataatatcaatgtaatgaaaaaaacgacaaaaaagcactgggaaaggggtgaaaaaagcgacacaacaaaaaacaacgatttgaatacactaaaccaaatatgaggacggcaaaaaatgctgaagagtttgaagtgaaatgttgacaaataaagctaaatttggcgaagagagagagacaatgggaaaggcgcgcatttaaattatagggtaaagaatatcggacaaatgagatcctccaaaagcattggaaaagctcgttctttaatttatgtggcagattggcggcttctcctccgggtctttttgcaggtcggcaagaagtcgtccacctcggagtccgactcagaaatgtcaatccgtttcagtcccgacgcgaacagccggtcaccgtctgacaaaagaatgtggcaatttcttttttccatgttcattatcattagcgcgcgagttgcgttctctctctctctctctgttttttcacattatctcatttgtcaacaactttctctctctcacactcttatatctgtttctctttttctctactcttttcatcctcccccctctttctttaatcgttctatcaacttctttctctctctccccttttggtgtcatattatcacattatctctctctctctgtttctcttcttcctctccccactatgggtcaactccactgtgcagagaaaagcctgtactatctcgtcgtttttctttttctttgtaatttctctcactttggcgtagtatctcttccattttatgatgtaaaaaacaacattcacttcgctctatagaacttttttatcgccttatagattttctttaaattctgcatatcgatagagaaaaaaattctgcatcggttaataggtcaagttaatattaaaataggtcgaattagaaagttatggagtgattaaaatttttgcattactttttctctctttttggcgtactattttcacatctctaacacacaaaaaacatcaaattcgtaaatgctaacaattttggttataaggataaaaaatcactttggacatttagaatcaatagagaaattaatagttttagcatttttgctgaaaacagcagtttaggacttgagttataacgtgataaaaatttgaaagtatcacaacttttttctgggatgtcaaattgcttagcattcgcttagaaaaagattctccttttcaaaaactttttgttgataccaaatttgttcagtttagttgggaatgaagcgagttatggcagatcaaaataaaaaatacaaaaaaggcattttcagtgtaaattttgaaatagcgggcaaaaatttacgccaaatgcgctatttggcgttatgagcaattttgtctgacactgggcttgacccatagtg

SEQ ID NO: 5194 - DNA, 1144 bp, Heterodera glycines
tttgtagcgccggtagcaaatggcaaacagagggtggatgaccaagtggaaaagccagacggacaactgttcaacgcggtcggcgcagatgatgagcagcgggcagagcacatgctcgtagaggagggcggccgacgcgtaggaagcgcggccgaacatacgcaaagcgaactgggcaaagttgaggcaggccctgggcatggagaaaaggggtgatacagtgataaacaaatggttggtcaatgttttgcatgaatcaattatttttgggataaaaccgggatattttttggggcttattttcgagactgaaaaatacttgtgacctttttaggagctcaggagagcttagcgttttctgactcttcaccaggggaactttgcaacgcacttttttgtataaaaattggatcccaaaagggaaaaaatactcaaaaaagttctttggatattacttaatgatgaagcctttgcgaaaaatacgcgaaaagtaatcgctttagctgtgagaatcctttaggcacttcagcccaacaaatggacagaggtgaaaaattgacaattgatggcttagtggacagccgggagaagagcagcaaaaggaacacaaacagaaggaaaggacaaatcgccggaggggacaacaaatggcgaatattggggaaaatgacaaagatcaaagggaaaggggaaaggccgcgggggacgacaccgaacagaaagggaaagtcaaaaggaaaatgtacgaaatttgaaaaggatggacgcaaaattcaggacaaaaaaaggagaaagaaatgatttcaaatgatgctggtgggttgtttaattgttaatatctttttatagcagctaattgtaaatgctctctattagcctttaaaattttaaaatttttttgttcattttcaaaaaagtttgtcctgaggactcgaaaagcaggttttcgtgcatttttggccatatttttgtcgaaacttatcgaaaatttttgaaattttacaggtgcttagaaaatgtgtaggaatatcgaatgatagcaaaacttaaacatttgtttactcctgagcaaagtatgggcagcgtagttttgagtaacgaacgaaatgacataatgaaacgaaatgaaatggaaggggaattt

SEQ ID NO: 5195 - DNA, 1531 bp, Heterodera glycines
  misc_feature (9)..(11): n is a, c, g, or t
  misc_feature (20)..(21): n is a, c, g, or t
ttgcatgcnnnctgcaggtnnccgaatttgaaaatatacaaaataatggggcaaaaagaacttcccatcataggaaaatagggaaaagagagaaatatttcggtagaaaacccaaaagatttttggtaaagccccaaaagaatggcaaaaattgaaactgtgccttatttggagggtccgaatttaaaaaaattcaagcgtaggacaaactcggaaatttttaacagcactatcagacctcaaaaaggacagaaattgacaccattccggtttttgggacatacctaacttatttcactgttttatcaatcaaaccaatttgttatcattcgatagcccaaagagttcccattcttttgagaaaattaaaaaaactattaccataaatatttagaaaaaaaaattttttttgtgttgttttttggctaaagattgaaattttgcggggcaatagaaaaatgtttgcgctatcgaataattatcaaaaattcattcattcaattcattccgggctagcacccatttgctcgtagccgaacggacactaacccctaaaaaagttaagatttttgatgaaaaaacggggcgaaaaaaatcgtagccggaaaaaacgcatagcttttgtgcaatcataaaaaaagatgggaatgaacctgcaaaaagtgagccaaaaaaggccctcctctcgcggccctcgtgcaattcgttgacggaaaaggcgcacaaagcgaccgcaaaagactgaaaaaggggcaacaaattggtaaattgcattgtaaatttttggatttttaaatttattcaatcaaaaatgaaacaaacattgagaaagtcggcgaacacccagcggaccaaacccaacaaaaggttgcagctgcgatggtcgaccagcaaaaaatcgacgacaatgacaaaagcgatcagtgcgcacagcgcacggagttgcacttcccgggaagtgtgaagggcgacaaaactgacaaaaggggggggggtgaaagtatggacggagaattggtgaacaacattcgatttttaaggcgtattctgttcattggaacggcctaagttcagaaacccaccgggcctggatttttgtgcaaatgacaaaaaaaaatttttacaaacgccgcctattggcatcctttgacagcaaaaaataaagtctaatggcagtatttgcttacattcccgagattttaagttttgtttgatagcatgaaggccttgattggatataaattgtatgagttatcattttagatggttttttcctttgttgaaactgaccaaaaaatggaattgatggccatcaaataggggatggacaacgggtgccgaagacggaccaaatcgagcgcaaaagaacggagcgaactccgccaacggcgaagcatttccatgcgtttgtctgtcttctgcctgttctgttcgttcgtaattcttccgttcgttcctctgaaaagaaaatgcgaaaatttgaaaggaaacgaaagaaaaaatcaaaaaatgagaagggcaaaggaaaaac

SEQ ID NO: 5196 - DNA, 4566 bp, Heterodera glycines
aattcgtcagtgccatgatcggtggcatttcactgcctctcaaagctcctcagaatttccattccttcccaaatgttggcactttttccccgctcatttttcggcaattccgctgatgacgacggatcggatgggtccccattgttttgggaattagcagaagcgaagctgccacactgttggtcctggcggatgtcgaacagatcgaagccccgtcggatagcatttgaaattgtgctaattgtccgttgttcgtattcctcttggctgacctacattttaattggctaatagttacgtatttctgtaaattccgacgaacatgattaaaatcatgtgccctaaattacaatagttatataagtagaggaagaacacaggtggccgaaaaggggcggtattttctgttttagggcccggatgaaaaaccaacaaatggcgcaaaggactgcagataacttttgtttcatttaaaatgtataaattaacgaatgggcagaaatcttagcacaaattatgacatttatgtcaataaaataattttagcgtgtatttttaagtcaatgccgtaccaagtcttcaaacaagcagaaaatattttcgaatcctaatttcttggactttttcaaaataaattcatttggattcttaaagccaaatttaaaaagtaaaataaatcaagtaaaaaactgtaaaatttcgaaaaaacattaagagcaaaaacgaaatttacccacctctttcgttaaattttctctattcgctttcttgggccgtccgcgtaacaaatccactgggatttcgtcaacctgcttaaaatataaaaagcagctaatttaattgaatttgacatttttattgaaaaaacctctttcacgagacgttccatttttaaacacccaattcgattgtgaatattttcaaagcggcactcaaataattccatttccgactccaaagcattcgctgccgtttcaaaattccgaattgtgtctaacaacccggaaactgtgtcttgcaaagcatcttttagctgaaagtcgaaaattgaccaaaaataacgcaaaaggacattttaaaacaaaatataagacaaatacctctttgtcttgtttaagcgtccaacatttggcgtaattcgcaaattccctgaatttatcgctttttttctgccgaagttgaactcgacccatccataaaggaacagctaaaaatttagttggtcacgcgaagctaaaagaaaagcaacattattttttaagtgatttaaaatattttttgtcattttggttgcccgatttttaaattttgaatttgattttttaagatttgttttcttttgtgaaatttttattatcaaattaactaatctttcgttgtctccgcctcatttaccatctaaaatgatagggataacaaacagtttaataacaacaactttagataatcgttattaaataatcattactagagttttgaaaaatggaatctctgaatatggatgcaggcctcagtcttaatagctccggtttggcactcacttcagtgcattcaatttatgttttgtttttaggtcactcgactttcgcattagctgagaaggaaaaccaaattgaacagatgcgacgcaaattgcgtgttttggaaagcgacaacgccgaacttcgcaccactttgcctcgactcaaagacgcgcagggcaaagactgcactggcgaggtttgtgctgctttctcaatcctggaatcagttttgtgaattttattcctcattatcagatgatcaaaatgaataaggaattgctttcggcaaaggaacagtgcgagcgatggcgaaccgattacatggagttgaccaagaagtacgacatgtttgagaagtcgaccatcacgcagcttgaccagaaagacaaacagatgacacagcttcgacaccaagccatggaaatggaagaggaaaacggaaaggtacgaattccgtccattcattttgatgagccctcaaaaggatgcaataattcaaatttagttgcgcgaaaagcttgaaaatgagaagtctcgagtgtggcatttgcagcgcggagagtttgaagaccaattggccacgccaaaggccgttcagaacgaaggggcagacgatcagttgtcaacaccaaaggtattctcattattttttcaaatttgccatttctcttttttttaatttaattctgtttttaggctcacaatcagatgctggccaacattatgtcgaaaataccacaaaatgttgacgttgtcgaagacacttacctgtgcaatgtcgatgatgccgaacagctcgctgcacatctgctgatgatcctcgagactttggacaagaatttccataatgcaaacgaacttcaaaatgacatattcacttttctggcatcgcacagcatttgctccaacaatcctgaaaagtttgccttgctcaactcggtttacaagaaagtggtcagtgttttttttgaaactttcaatcacttaatttaaatttcattttttcaaaatgttttagactgacaatcgtttggcgcaaattcgtgccggaaatgagcagtttcgttccaacatgtcggtgggcgacaaagacttcgatgcctgcatgaaacacttggcggtccatgactccatcaccctttcgtccataccttcgtttgccggcttctccaaggaaattgcatttcaacttgaagtggagttgcacttttagaatcaacgcctctctttcattttttagacatcaaccccggaaatggacaacgaccagaatttgacttctggctcatttttcgccggcaatgtgacttgtcgcacctcaactcttctcgaggtgtgcgttcggatgttcgagaaactgcgcgggaccgtcgagtttttccaaaaccttctcaaaattcttggagtgagcgccgaagagttgggcgaggacattgccaagaagttggaagcaatgaagctggatttggacgtttccgtcggagaggcccagtcgatgctttctgaaggaggaggcctggctgcgattgaggattcatttgcacaatgccgagtcgagagggagcagcaggtgaaaagtcggattcatgggaggacaagaacgggaatcccatgataagcaaatcagctttttgtattcaagataaatgacatgaaggtcgagattgagaccatgcgcaaaagtcaacaggacgtggagcagaagcagttcaaacttgagcaatcgttggcggaggaacgcgatcgaatgctgaaagtgacggcggaacgagacgctttcgcgcgcgaattgcgcgatcgggagacggaagttgagcggttgaacagcgaaatgaaggaattgcagaagcagacggaggagttggaccgaatgaagcaaatgctgcagtcggaggtggagaaaatggtgggtcattgccaaaactcaagccaaaagcatattcataattgcacattttttaaagaccaactcggaactgaaggagaaagtgctggtgcacagtcgggaggagttggccaaaattttcgacacgatgtcagtgtgttaaatgcttactaatataaatggaggcattttaattttgaactttgacatttctttttttatacaatcaccgttaagggaatacaccaagtcaagttgcaactctgtggtttcgtcgctccgcaaaaagaagccaaatattgggaagaagcagccgacgcaggacactcaaaaacagtgagccgacgatagccatttgtgatccattttatagaaagacgtgccgatgcctggcgataatctcctgacacatcatttaatttaatcgttttgctgactttaattctttatatttcttccattgttttccttgcactgtgcctactctgatttgtccctcgcttcaatgctttcatttgactcaaaattattgtgcggtaaatttggtgctgactaacttgcgatgggtttcgtttgatctctctgtttacctcgccttcgtttacccttttctctctctctccgttttctttcaactttctctcctcttcatcccattgatctgatcaatagagcaatgcagaaattgcctcaagcaaacttccgctaataatgccaaaaagcagtcactttcccccacaatccttgacggctgtcaatttggtgtcaattatttgctgcagctgtaattgatgctttaattaaataaattttgcagcattattttgtttattataaataaattgaaaagttagaaagaaacagttatagttgttccatcgttttatacaacagaaaagcttcgcccaaaattgtcgaattgaaaaaaacaaacaaattgtttttccatgtaaccaatatgagccggcattccgcacgactctcgattaattcgggagtagctagcagtgacaacttccccctccccttggaattttagcaattggtccttcccattaaaatgcctctgaggttgggctccagcttcgaattggcattccgtcgtgcaatcttctccattgtgctgctgctgcttttccttctgttcaatgccctcct

SEQ ID NO: 5197 - DNA, 2712 bp, Heterodera glycines
  misc_feature (1879)..(1879): n is a, c, g, or t
tcccttctgctgctgctgcttttccttctgttcatgccctccttttgtctttgcttggccaattcgaatgggcccagcggacggcgcgcgtcggccgccagtcgcacgcgttgaagcgcagccgtcgcatggattttgagcggcacgaactgatcagcacactttgggccgagtcggtggccgcccgatcgggtacggtaatagctgggggatgaggtacggtactactgttcattaccgtaatggaagttgcggtggcatatccatttttatgtaactctgtttgtcaagagtccgattggtcactcgcggccaatgccaaattggacgcgtacgagcgaatgttggcatccgaagcggcacactttgatggcacgcatgccgcggcggttgtgtccccttctccgtcgtataatccgtggacatttgtcgagacggtgcgcactttgctcacggccgtcaccacaatgggcaaattttacgattcatctaattattttatttatgtgcgccataattttgtaaaattttttatcaatttaaaaacagcaataaaaattaatttgtcaattttaaaataattttaaggaatgaatttaatttggcgtcttttattaatgtttcccctcaggcggcggcgctttgtccgaaattggcccttctcttctcggccccgccaccaaattgctgtccgcccttttccttctgttcggcatccctctgactttgattcacatcggccattgtgtgaagacggccaatgcgctgatcgaagcaaattttgggcaaattttagccaacaaattctttaatttggcaatttgttctcttaaaatggcagaaagtcgtctaatttgggcctttttgtggtcgccggcggcacccttttgatcgctgcgattgtcgtggacatcgcaaccgttgggacggaggaggtggaaagagaggtgatcggagcaaaaaggcagcacaaaagggggacaaccaaaacaaatatggaaattgataaacaattaaaatttgtaatttaatttttgtcgaaaattttccaatattttggtgatttcattttggcattcttcgataattcttctctcctccgcctttagacctctttcttcgactctctcttctccgtttttctcgcttttggcacaatttcttctccccattccctgcggcacttttcccctttccttctcctccccttttcaattgttctgctcactgtcgctggccttgtctttggcgctttacaacggtaaaattttcaaactttttgttgttgttgttttttgtttttttttgcaatatttgccacagttccatcgaactttgggttgcgccgcatgagttcgcttttgccaatggaatttgtggccaaattggccgagcagtcagtgccgttcggctaaatgtggaggaggacgaggaggaggagggcgacgagttggagacgaagcagcaccaccagcagacgcacacccaacagggggcaagcgaaacggacaattgtcaaatgcatgtccaaaatgtttgattcagctgctgtttcggactgcacagttcgaattcggcgactgttcacaggcgaatgatccgtcgacgacgacgccattcggcacggggaggagaagcattgtgggacaaaccatccacgaggatgacgaagagcagcagcagcagcactcgccagccaactttaggggcgaaagagtaaattctaatgattggaaatgagtggcggcgatcagttccatcacagtgatcagtcggaggggggggggctgacaaatgatcaaaaatgccaatgattcgatttctcttttctcagcaatggccgccatttcattttatttgtttgtttttgtttacattnttcgattagaatctgccattttctgcttccttttctcatataaattttctttgtgattctctctttttttgcgacatttgaaaacaaaaacaaaaggtcagcgaatcctttcactttttgtcgcaatttcctcaaattttatagccgattaatttgctgacagacaaagaaatgccaaaaaaattggatcgttttaaacaatttccattttcggcattttatgccatcctttcgactaagccacaaatatagagacacgcaaaattaacggtctcgatgccaacatttgctaatgagatcagatcatttatcacggttcctctctctctctctctctctctctctctctctgcctccatctgtttcttgctcgctctctcacttctcccattctctcaccacatttgccaccctggccgcagtgcgttcaaacgcattgtccgtcgcgtgccgccaccgccaccccgtggcacgtcgtcactttgtggcatttcgtcctcaatggtcccccgccgaggtgccactgacgaccgcttgcccagcgattggccggccaacgagtcgaagtaacgcttggccggactcagcggcggacggacgaacgccgcgggacgaaaggagcgaacggtgccagcggaagagagcaattggtcggcgaggagcgcatcgggcagaaagaagcgctaaatgaattttaaactgctaattgagtgccaacgaacggttgggtcggcgtaaatgtcgcgcaattgtccggcggggagagaatttgccgaggagaaaaatgaaaggtagacagcaaattggagcagcacaaagacagcggtcgaaga

SEQ ID NO: 5198 - DNA, 2447 bp, Heterodera glycines
tattccaaatcctattattttttaataattaaccaatttgatgtacattctgatttggacatttttcagaaatggctaaccaattgcaaccaaaaaacaaaaagtaaaattgtcttacgaacgccacctttacaccttcgctaaaatgagttctgatgggatgacaaaattttggagatgcgagttcaaaaaatcaatttcacattattttggagtttctccggggaatttctcgcaactatcgaatgaacccgtgattttttgtttattttacatttttatgctgaaattttaaaagttgtttttactgtgtgttttttcatttttctgtgcttggggcccaaaaactggggcccaaacgcccccgactcccatttggggcagaataattgaaattttaaaatatatgtgaaattttgccaacattttttaaaaattatttctcagtcacgaaatgatcagtgacgaaacgatcagtgacaaaatgataggtagccgttaacaactgttgcattggcatcgaaacgtggcgctaacaaatggtttttagatgttggcattgtatcagtgtatcaactttcaaaatttaggacctgatttttttgaaaaggatgagaaaaaatttgttaagcaaaggctcctgaagaattgcaaacccgtctaaagtgctcatttacactcgtattctaccagatcaaatgtgtggtaaattttgaatggactgaggtgagaaaaaattactatatatgcgcaaataagaaaagccaatcaaatattcaacaaagaaacaatttgggcggtcgatgtagaaaatctgtgccgtcaaaacttaaaaatacgcatccctgaatgcttcaggcaattcgatggtttgcgcgccaacaagaagttgacgagcaagcggcagttcctgccgtttgcatcctcgaagggatgaatttttgcctaaaaaggggtctcaaaattaattttggattttctaattcatgggatttgatacgatttaacaacgtatagaggtgtagttttaacctctgatgctttaccaggtggtggtgtgcctcggcgacgaactgccgcaagtcccgaatcatcggatgccttcccatccatttccattctgatcttgcaaattgtatcattaggtgttttgggcttataattagaaaggaaaccaatatggatcattccacaattgaaatctttaaggaaaaaataatatttttgaaaaatgcaccgcaaacgatgtgaacagcaaaaaaaggtctcgtttcccaagggcggtgtccctatcccagccgaaatcctttaaccgtcccctaattacaccaatcgaaagcactcattgatgaaagatcatagatttagcaacctttagttcagttcttgcttttctcttatttttcattacatcacaaacttgacaaatgtacctgctccgttattttcttacaataagtgaattgtgcgttgtccaatattgcaagataaattttgtcgtttttgaaaagcggcattgacgcgatccggtcccgaatcattgcgcgtcctttttggtttggcttgcacggcacgcattttagccgcgtgcatgtgctctcctggtgtgtcaaatacgtcgggcggcggcagtggtgtgtccgtttcggcgttttcttcggattggtcagccggtcgggaatttccatcatgtcagacaaagttagaggtcttgctggacctattcacagaattttatattgcatattagtcggaaccaggattttgaaaagctggaaaccgttcttcccgatattttttcgaaaatgaggggtaccatcaatagtattaccctcacctcttttcttttcattaaagtaaacaaaaatagtaaaatgtcatgccttttcgtaaatggtttctcgcttcttcgtttggagtgcgtttaagccatgcttctgcagagtccttcttgaaggcaatttgcaactgaatgcacaaaaataacaaatttggagaattgcttcccgcttgcactgacttcgttgtattcggatgagttttcctccgccattccctttccttcctctgtgtcgctgaaatcactgccgttctcctcggcctgttccataaaaaccaaagcatctaacggatgggaccaaagttttgtttttattacgaaagtaccgggaccagagcgtttgggcccccgtttttgggcccccgcgtttgggcccccgtttttgggccccggggtcgtttgggcccccgtttttgggccccggggtcgcttgggccccaacccaaaaatcgaaaaatgtgcttttttaaaaattaagattctaaaaactaagcctgagggatccctcgtcacttgtcataagttaggttcaattaacattcgctcatgttttacaattctacttattccaaatcctattattttttaatagttaaccaatttgatg

SEQ ID NO: 5199 - DNA, 3425 bp, Heterodera glycines
aaaacaaaaagtaaaattgtcttacgaacgccacctttacaccttcgctggaagcttgcttcggtgacgggaccttttcattggcgccgccacttttttatcaaatttatacaattttggctaggttagttagtttttagaaatttttaatctctctttttatagtatttaagaaaggtaacgtagaaaaacctacatttcgtgttggattttgcaatgtttagacgaggcaaatggatcataccagtgtgccattttctgctcacatcgaagtcgcaggcgtcatacattcgtatgtttgagctcctacatcaggcatggccaacatttgctcctacatcattcagattgatttcaaattggccgtgagcaatgcggtcacaactgtatttggagggtgtcaaatcaatttttgtttcttccattttgtgcgaaatttgcaaaagaaattgaaggaacaaaatttgtggcaggttttaataatttttttttaaattattgcggcgccgaagtgcccccgacccgtttcagcgctactgcaccgattctgtgtttgccgagaacgctcgaatgatcacgtctgttgcgttcgtgcccttgtgtgacattagaatggcggtagcggcacttgatacggagttcggaaatttggcggttttccaaccgctgattgactggtgtgtgaactttttttaaatttaaaccccactgaaattacaggctattaatcaattacgttggacagcccaggcccaatggcacatggtctcaaccaacttttcgccctgaacaatggaacgtctacacacgcacgcttaatgccgatgcacggaccaacaaccactccgaggcggagcatcatcgtctacagggcgccttcaattgccgacacccgtcgatttttcacttcattgacgtgctacgtcgtgagcagaagacaacagacgtcaaatacgcgtcattcattgccggagaggagccaccaccaaaaaagcgaaagtttttggcgacagatgaacgaattcttaatttggtgcgcctttacgtcccgatgaatgcaggcaacatcaaccatgatcacaattaccacaatcgcaatcaatttcacattattttggagtttctccggggaatttctcgcaactatcgaatgaacccgtgaatttctgttaatttttacattttttattgttaaaattattgttgaatttatttttaaactgtttattttacatttttatgctgaaatttaaaaagttgtttttactgtgatttttcatttttctgtacttggggcccaaacgaccctggggcccaaaaacgagggcccaaaaacgggggcccaaacgcgggggcccaaaaactggggcccaaacgcccccgactcgaaagtaccgtataacagattttatctattttttattaaaaatctctagagcaaataaattaactaattaagtgttttgtacataacaattcagcgattgtgaccataagtggaaaatgtccgggtctctaaattactcccctcaaaaaattaaaatatactgtatggaaaaaatcggtctctgtgtgtgtcaaataactttttccattgtcaaccaaatccaacattttggcacacttcgaaagctcttcacgtgcccccgactctgaatgaattccaaatatttccggttcccgcaggaaagactgatcccgacaattaccatcgccttcacttcgatgaaaattccattgcccaatcgtacttttttggactttgatcatttcgcaattgtgtgactttccatttttaaagacacacaaaacgcaatttgtgtactttttgcattggaaaattccgctcatatttttcaaggggtgtgacttgtgagtaaaacataacttattgttaggtatgtataaatacatatgcaaaagtgccaaaaatagttaaaataaatgttagtgaaaaacccccaaaagtaaaaagaatttaatctctattattttaatttaaattaatttgaaacaaatattaaaataaataaataataacaaaaaataaaatattttggtttaatttatttaaagtttaatagagctttaattaatattgtaattcgtttatatttattttcctaaaatggctttttctcccgttgactttgcttcacaacaaatgaatgagtacaaaagcacaaaaaaggtgccgtttctcattttgttttccgctcttaagcctttcctttcctccgttagaaaatggaagtgctaacgatgtccaacggctcacccattccattcacaataaaaatgccgttttgtccgttggtccccatggtccgatgctaatgcaagacgtcggtgtgttccgtccttttattaatacgttttttaattgtccctattaaattgagtttcattgtttgcatgggattttgggaaatttattttcgaatgattaattagcttcaaaaaaagataaactcaaattgccatcggttcagaatgcattcaattaggccttttgaaaggagggatgttttatttctataattagtaagggaaatgaccgaaagggcaaggcaaaatgaaaagcgaatcctttgccaaagtttccatgagcgggatttgtttccaaagtttatttggacgaaattgcgcacttcgatcgcgagcgcattccggaacgcgttccggaacgcgttgttcatgccaaaggcgccagagcacacggctacttcgaggtgacaagcaaagacatggccgagcactgcaaggccgccatgttcagcgagatctgaaaacggacgccgcttttcatccgtttttcgcgtgtcggtcggtgctttcgttctccttttttaattggtttgacaattatttcaggtggagataaaggtttgttgtgcatgttgtttgtgaattccaccaattcactgctggaaagtcgttttcttttttaaaagacatttttttgtttttggcataatgtaaaatggtggcattcgagtggggggggggtcttacaaagcaaaggcaaatgctgaccgaactctcgaacataaaaggtggagaatcggggagcgcggacaccgcgcgcgacccacgcggttttgccatcaaattttacacggaggagggcaattgggaatttggttgcaaacaacacaccggcaagtcaaattccgtaccaagcaaatgacacccaaaacaatgccttggtattttgtagattttcttcatccgcgacccttttctctttccaaatttcattcattcgcaaaagcggaaccccgccacccatctcaaagacccggaaatggtcagttggaataaccagtggagcaagtggcagagaagggcataatggggatgggttatatgttatggcaagaacccccaaaggaaggactacgacggagtgggcatgagggggg

SEQ ID NO: 5200 - DNA, 1775 bp, Heterodera glycines
  misc_feature (27)..(27): n is a, c, g, or t
cgaacgatggaatgccttccattcggnaaacaattctccgggcttcctatttagcttatgactctcgaagaagcgtcccatttccgttggaatccgttcgatgtgaccaaagtttggccccaccgtctcttccctttgcttcccggttcgttcgttctccgtttctttcttcattcttcttcgctgtttgtttcagttggtcgaattgtgctcaaccgaaaccctcaaaattattttgccgaagttgaacagtcggcgtttgccccttcgcgaattgcattgacttttcgtccgataaaatgttgttaggtgtgccgtccgttgcgttgcctttgcattaattgccttttcttgcgccgcagggcgtctcttctcctaccccgacactcagttccatcggctgggcccaaatttcatgaaacttcccattaactgcccgttcagaagccgagtgagcaacacacaaatagatggtttggcatgcccagacgacaacggaggtggcacttttcaatttaagtcatttttgctctttttttccgatggtgcccccgtttatcacccaaattcctacggaaggccgaaggaattggccactgctaatgaaagtgcgttttctgtctccggcgatgtcgcccgattcaattcgggggacgaggacaattattcacagcccaaaatgttctgggagaaagtgagaggggtgaggaagaggggaccaattctcgagatggcttaaggttctcgacgaagatcatcgcaaacggcttgttgccaatatcagtgcctcgttgaaatcgacttctcggccggtccaagaacgcgcggtagcgaattcggcaaagtcagtgccgactttggcagtgccctacaggcggagttggagaaagggtgtcagtcaaggctgacagcacaattaatgaggaacaatgagagagtgatgaggagacgaattgtgaattaaaaataattaattggcataaatgacatcatgcaatcaaaccacccgaaccaattaaataaaattaattgcctatgcaaattacgcatgactgtcaaataaaaaattgtaactgaatttgatggtttatttcttgatttattatcttttaaaagatttaaattataaaattctcaaaatatttgagatcacaattatgtcaattcaaaaatgaataaaaatttgtgctgtctgaggtaataaatattttgaattcgaaaatgaattaaaatataaatgtgtctggtcatcttttctgctcctcacaatcagtgctttgtttattcatgcaaatactccaaaaaccatttccttgaagaaaaaaaaagaaattattaagccaaacaaattgttttacaaactttgcaaggcgtacaacttcttccattgtgccaggctcttcgaaaagatgggctaaatgagtttgaagctgacaatgagtaaaatatattgtctcttaattaattatgtttgctatctgagagaatgaaaaatttaaattaagaaatgatttagggtcatcagaagcaaatgcaattgtacgagccagggatgggagccaacgctctcaaaaaaattcggcgattggaaatcggaattccgacggctaaaaaaaatttcggcaatcaaaattcaagcataaaaatgtcggaaaccaaaaatttttaaattgacaattagagctcggcattaaaaataaagccgaaatttgcatattacttaacaaatgtgtacaagtgttaacaagaatgttttctacatttctcaataagct

SEQ ID NO: 5201 - DNA, 2328 bp, Heterodera glycines
ctaaattgaccaaaaaactaatttagtcacaaaccattgcaccagtaaaaaaatggttattttatacaggtacgaacataaaagtgaattttcgacttttgttcgaattcaggtccgggattcgaaataatgtcaaaatgggtgtcagattcgggatcagcgatcctgaaaacccccgtaaacatatttccacaacgttttagaacaaaaaaatgttcttttaaaaaaagggggagggcaccatcgatagtattaccatttttcaatcaaagaggctataaacagcattaaagttaagaaaaaacggtcttttatctgggattgaacaaattggacgaaggcgcaaatatccgaggcgcaaatgtcacttaaccatttggacaatgagacgggtaaattttttgaatgaaattccgcggaagggaatttgtccgaaatataaagacccaaaaggaacactcacatgctctatcactgtgtccacttcaaaacggtgctgttgccggtctccaaactttttgtcgaaaaacagtgcccctaatggcgttttgaaggcaaggaaaggcgtcttcgcaatgggttggttaatcgcaacttgatataagagccatctaaaaaagcgtccactaactcacaattaacagattgactcgcctgtcaggaatcctactgtcaaagcgtcgctccaagtgatgacactccgccgaatttgactggccaattcgtccgtcccgtcttccctttgttcccatctctttccccgacatttctccccttttatctccatttttcgctgacttttcttgccttggtccacttaaataaaattttgaattttaatgaacacattcatccaaaatatcatggggagttggctttaaataagacagaccctagctgattgttcgccctgttttttcgctccaccaatttttcggccactgtgacgcgcttcctccgcttctgtgcttttattggagagtcctttctggcttctaattttttaggctgctcttccattctaaccgaaatttatatatatatatatatatgcatttataaataaaacgtaaagaaccaaaaaaagtatgtgtccaatccgtaaatgaaaatataagtgataaaataatttgtagagagtaataaataagtttataaataaaaaataattcaacgcacaaaaaagatcttttagaccagagaaataaccattgtttttgcagccaaatcataaatagcacgattatgattgaacagataaaaggcggtactgagagggaacaaaaaagtggtcagcatgtttttgatcacagcgcgagttagtgagctaaaaaaaaaattaaacaacagaaaaaaacgttttgcgatccaattgtttaaaattttggtgagtctttggacacgaacggcaggttaaacaaaatgagaatcggagccaaagaaaaagtggagggatttttgtaggaacagaccaaacaaaagcccaccttctgaaaccaacactcggcatgcaggtgaccatcacacgatccgaagagccaactattggttgaacatcaagacatgaaatcacacgaagccccaacaaatattttccaggggtacagccaataggaaacccggagagaccaaaggttataaaaatggcctaaaaataaaccttgttaaaatttttaacaaaataacaaataaatagtaacctcaatcaacgcagaaaagagtttgcacaccaattcaatgtaaaacaattcctgtgtgatatcgataagagtctgaacatccgattcacttgaaagaattcgttcaaattgatccaattcgctggaattggaaaaaatgttaagagatcccttcttttggactaacattaattcgaactcaacaagcaaataaacgatgatcaacttgaaaaggaagagaatgcatgagtcaatagcctaaaaatggaaagagtgaagaaaaagtcgtgaaagtgcaaccaacttctgcaacaatacgtcgcataaaagaaggaattgtgtgctgttgaacaataattgtttgagggtcgccgttggcggcggaacgaaacaatcgattcaaatttagacgaatcgttacaccgtttcgttgttgttgaaactgtcctgtctgagcttataaagaaattaaatgaatagttcaaatacaattgaacattgtgctgttgtgtggccataattgccgaagaatactgctgttgtgcatgaaatgcccacgaggcagcggcacactgttggtacgccttaatttatcagttgaggactatcagaaaagggcaccgaaccatccagcagcggacagattgag

SEQ ID NO: 5202 - DNA, 4594 bp, Heterodera glycines
aaggtcctaatttttttaattatttttcaattattagttggataattttaatattttatttaaatttagagtattaattggtttatgtcaaaaaaaagtttttttatcattatgatatttattttgaacttatgtatttctattacttcatcgttttatttcagatatttgttcaatctaatttagcccggataaagaaaagaaaaaaataaaaaataaatagactttaattcaaataaatttacttattctgatcagctaaatttatcattatttttatgtaatttttaaaaatactttttgttaacatggtatattgataatttgattattcgcattcgtatttatactcaactatcagataatactctcaaaaaatctgttaatgcatccatcgccgggaaaaaattttgaaaatttgattaaaatttgttgacagattttcactaaaaaatgatcaaattttgtgatttttatcatttttctaatgagaaataagagttttggcgcgccgctgagaacagtttttcatcaaattaccaaattttgcgattttgggccattttctaagaaaaaataggagttttgggggcgcggcggtgccgataggcgccgccggcgaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaacgccaaaaaatgcaaaggcgaaatgcgaaaagcgaaacctcggcccatccctgctatgtgtttagattgattgaaataaattattttttaacaagcgtaaaatcaatacggaaacatttcataaccaaaatttggtctttttatacgaattcgaaataaatgcgaattttaaaagacttattgacattttattcgaaatcgagtttgatccggagttcaaaattggcctaaatgatgaaacgccatcgcttttttccaagaacgcgggcttcttcacgccaagcgcacgtgtacaaatggtcacccaatgaaattatagttgggacaaagtgaattttcgtggaaaaatggattttaatttttttgttcgaatccgggttcggggttcgaattgggtcaaaacagatgccagaatcggttttcccgactgcctttttttcaattttggtgcctattttagtgcctttttcgcgattttttggtgcctttttttgcgagctctattcattacatttaactttttttcctgacgttaaattgcataccgatagagaaaatatacctatgtgtaatgagtgtatacaggcatttattaacctaattaacatgcaatacttttaaggaatctcacccaatataatttgtaaacacttaaaactatcattctcctgagttagtatgcattatttattgccatcaaaagaacagtacatatttacaatacacgaaaattggttgtgagaaagcagtaaatgaacaattgcaaatgggaatctgtacatggacattaaattggaagtgagtcatacatatatatgccaagggatcatcaatatatggacatgggcgagaacgagggcacaaatgggaatctgagcatcaaattgcatcgcgtcctcaatttggcgggaagaatgtgacgtcgtggctcaggtcctccgcgattgttagtgctgctccggtgttcatttgattgtggtagcgcggcaccgagaacacagtgacaagacgttcgtcggcaaaatattcaatgccctcatgcaccagctgaaaaaatgggaaacttttgaagaaaataaatctgtccaccctgcctacctcatgcgcccgaattatgtagttgaggttgagcagctcgcagatccggaagaccacgtcctcgccaaagacgacgccggccccgcgcgggctcggctccacaccgcggatgtcgagcattggatcggcccacagaagatccatctccaacgacgggctcggcagggtgagcagcgggcggcgtaattcgttgagctgctgcaagctggtgatcctgtcagaaatgccgccatgcatgcctgaaatgaagagaaaaattaatttgagcaaaatgaaacaacaagtcgatctcacacagaatcctgtccccgatcaggcccacgtacggcatccaggcaaaagtttggttgaacatgtcgaagagccgtcgagtgtccgcttggtggtagcgctgctcgatctccgagtagaagccatatctaaaacaaggttgaattagtgccatccgttgccaattaaacgttgctcgactcacactctgttgatgttactgcactcgtggttcccgcgcaacagcgtcacactctccggatatttgaccttaaaaaatgagattactgccccgtaattcttttgcctttccaaattcaccttataacagaagaggagcaccaccgtttccagcgattgggggcctctgtccacgtagtcaccgaggaagaggtattttttctccggcggggggcccagcgtcgagaagatccgcagcaggtccgtgaattggccatggatgtcgccgcagacgttgacgggcggttgaatcctgacgagtgtctgctgctgccggaagacgtccatcgtggcatcgcaaagctggcgtaagtcgtgctccgtcacctgtaaaaagggaagggaagaataatgacgattttgaaaagcaaaaaacaattacatctaagggaaattgcccgtaagtggagtttctgactctgtagataaggccgtccacttgaaggctgaagggcactgccatcgcgcgttgctagcagccgtccgtccgttatgaaatgtgtccttaacgttgaaaagaccgccttatatactcaattttcggcttattattttctattttttcggtcgcataaatttcgttataaatagcagcaaaaaacaaactcacagagccatttttgcaactttgccatttcatcagcccttccgtcgcttcccttatcttcgacactgctcatcgacatacgcaattgctcaatgtccctgctcaaaaaaacaccgttgttctgcgtagccgaatgcgcaatattcctggacatgttacgacatcagaagtcacgcgaatcgcaggtgcacttcgccagtgtttcttccttttttttcaatcctccaaccttttacatatagccgcttcacgggtgaactttagtgaacgccccgtgaaaaaaaagggcaaatgatataccgatcgattcgtctcaaggagctaagcattgaaaaatatgtctcgagttgcggaaatgccaaaaaaccggtttttgaaccggttcaaaactcgaaaaattgagagatttcgcactctacctttttttaaaccatcgaatccccacaaatttggtatcatttgaaagctcttgacgagcttaatctaaaaatcaggaaatgaagtcgaaccagtatgtatgtatttattgtgtatagtgttgcgcatattccatattgtccatttaatcatttatgtatacctatgtgtttagattgattgaaataaattattttttaacaagcgtaaaatcaatacggaaacatttcataaccaaaatttggtctttttatacgaattcgaaataatgcgaattttaaaagacttattgacattttattcgaaatcgagtttgatccggagttcaaaattggcctaaatgatgaaacgccatcgtttttttccaagaacgcgggcttcttcacgccaagcgcacgtgtacaaatggtcacccaatgaagtatacaggcatttattaacctaattaacatgcaatacttttaaggaatctcacccaatataatttgtaaacacttaaaactatcattctcctgagttagtatgtattatttattgccatcaaaagaacagtacatatttacaatacacgaaaattggttgtgagaaagcagtaaatgaacaattgcaaatgggaatctgtacatggacattaaattggaagtgagtcatacatatatatgccaagggatcatcaatatatggacatgggcgagaacgagggcacaaatgggaatctgagcatcaaattgcatcgcgtcctcaatttggcgggaagaatgtgacgtcgtggctcaggtcctccgcgattgttagtgctgctccggtgttcatttgattgtggtagcgcggcaccgagaacacagtgacaagacgttcgtcggcgaaatattcaatgccctcatgcaccagctgaaaaaatgggaaacttttgaagaaaataaatctgtccaccctgcctacctcatgcgcccgaattatgtagttgaggttgagcagctcgcagatccggaagaccacgtcctcgccaaagacgacgccggccccgcgcgggctcggctccacaccgcggatgtcgaaatttaaacgtaggaaaaaagttaattgtaatgatagagctcgcaaaaaaggcacaaaaaatcgcgaaaaggcactaaataggcaccaaattgaaaaaggcacgaaaatcccgaaaaggcatgaaaa

SEQ ID NO: 5203 - DNA, 1271 bp, Heterodera glycines
  misc_feature (1269)..(1269): n is a, c, g, or t
taattacaaataattctgggcttcaaatattttccattatacccaaattttgtttgttatttttctaactatctgtatgcaaaatttggtgtagatttaacatagggaacaaaagctacacatagaaaagtaaatgttgttctttacattattaagaatgaagagacagtacataaaactgagagaaataaagataaaaagtaaaggtgacagaacgccaaattttttttataattgtccataaaatttatttatcgccgttttttttcttttttaccatccatgaagtttattaaaaaaaaattttttttgaaatctgtacacagataatacataagtaccaaaaattttaaatgccttttttcatgcctttttcgggattttcgtgcctttttttcaattttggtgcctattttagtgcctttttcgcgattttttggtgcctttttttgcgagctctattcattacatttaactttttttcctaacgttaaatttcgacatccgcggtgtggagccgagcccgcgcggggccggcgtcgtctttggcgaggacgtggtcttccggatctgcgagctgctcaacctcaactacataattcgggcgcatgaggtaggcagggtggacagatttattttcttcaaaagtttcccattttttcagctggtgcatgagggcattgaatatttcgccgacgaacgtcttgtcactgtgttctcggtgccgcgctaccacaatcaaatgaacaccggagcagcactaacaatcgcggaggacctgagccacgacgtcacattcttcccgccaaattgaggacgcgatgcaatttgatgctcagattcccatttgtgccctcgttctcgcccatgtccatatattgatgatcccttggcatatatatgtatgactcacttccaatttaatgtccatgtacagattcccatttgcaattgttcatttactgctttctcacaaccaattttcgtgtattgtaaatatgtactgttcttttgatggcaataaataatacatactaactcaggagaatgatagttttaagtgtttacaaattatattgggtgagattccttaaaagtattgcatgttaattaggttaataaatgcctgtatacactcattacacataggtatattttctctatcggtatgcaatttaacgttaggaaaaaaagttaacgtttaatcatttagagctcgcaaaaaaaggctccaaaaaatcgcgaaaaaggcactaaaataggcaccanaa

SEQ ID NO: 5204 - DNA, 1163 bp, Heterodera glycines
  misc_feature (15)..(15): n is a, c, g, or t
  misc_feature (29)..(30): n is a, c, g, or t
taaaaaatgtctttnttcggaaattggtnnttcggtctctaccgggtcaaaaaggccaatttacctgatagggtcgttcttctaatagggttattttgaaaaaatgcccaaatatgcacataaaatatgcacgaaatgccaaaatatgcacaaatattcatataaatcgcgaaatatgcataaatatgtgaagcatatggaagtacggcctagaagcttcaaaccaagctaagtggatttcaagcctcccacattccaggaaaaaatatgcatatgcatataattaattctatgccctagttatctctttcatttgattttttacctcctaatatttttctgtcctcttctcgcagaagatcgatttcaattgttttctcagggcattcgacgtgctttaaatgtttagttttttagtaaattgaaagaatacactcgtaatattagtcaaaataaaacaaaagattaatagatatgaagctcgatttatttatttattttttaaataaagttaaaaaatccagatccaggcacggatccggtccttgacattgggtttttcctgaacctggatttcctgggttttgtccagaaaatccaggtcccacataaaaatcccgacttaggtccagctgtaggcttttttgcaaaatatcgaaccctactacatatatataaggattttttgttggtcgttggtatttgaatttaccaaacgttgaatttgtcaaacgcccaatacgactcgaaacccccggttttttgacccacgaataatcggggatgagaatccaactttcaataattacccaataattttgttgctcattttcaaatctattgaaaatgttttttatgtcgtgttgcaggtcacttattttgattgaagaagccgtttgatccgctttttcgcttgaatattccgcctttgcctttccctcgtcttctttccctttttcttcctctccctcttcttcctttccctttcctttctcttctattcctctcactcctcctttttgtcttccctcctcctcttcttcttcgtccgccttcttctcctctcctcttttttgccatttttcaccatttgcattttttgattgcttctcttttaggagatgtccctcccattgctctatattttccaccatgtgcacttt

SEQ ID NO: 5205 - DNA, 2627 bp, Heterodera glycines
catgatcgatctactcggcaccgttccctcatcctctcttcatctctttctctgttcgtccgtgtacttctttcctcctcctctttcatcatgccaaactctccgtattcgtcactgttctctaattgccatttaatatcaaatgaattacggatgtcaccagttgcctcactaatatttttgaaatcgaattcctcaaaaactgattccacagcattcgtatcaaataaattcaacagtttttgtcgtatattcgccgtgcctttactttgcaggactaaaataattcaaatgtcttctgattaatcctcaaccttttcatttttataatgttattaatagagaccgacttttgaggcatatgccttttttctgcgaagtagtttcgatatattaagcataaataacacattttccacgtggtttgagccttctccgttgacttttattttgccttttttggcttttttaacttttcatacttttttggcgttttgtcgttttggtgccttttggcatttttttccgaaaaattccatcaaaaatgcaataaatcggaaaaacacacccctaagaaatgacccgaaaaaaaatccagaaaatacactactaagaattgaaatttttttttcaaaatatatcggcaaaatttcattttttttaaaattttaaatgccttttttcatgcttttttcgggattttcgtgccttttcatgccttttttcaatttttttggtgcctattttagtgcctttttcgcgattttttggtgcctttttagtcggtctctagttattaagtaaaaaattttttcttcgatttcaatttatcgagcggttaattatagttatatgaaatgccttattagttattttgactcactatttttcagtgtcttccaattattatttcgtcttatcagctgggtaaactttgcccgatgcaattggccaatccattcccctatttttttcatttctttcccattttccgttcctttttttgctacttttttcacaattacttcccattttttgaattggattgatgcctttacattgtcatctttgctaattttttccaccattttctttgtctccaaaaacattttctccctcaaaaatttttcaatttcgtttagttcatcttcgtcgctatcaaaaattggatcataaatttggtcggaaatataatcgctgatcagccgaaaaagttttctcatgtgccttccggcattaaatgtttggccaagaaagtgcataaataccaccaagtcggcgccaattttgtggctttgcagttcaattttgttattagttagcatgacaaataaataatgagtccaaaggagttcgtcatttttgggctctaaataaattgttaacttatttcaaaaacaaattatccccaccattttccgcaaatttttgtgtcaaaccaattttgttgtctaattcttcaattcgttccctcgaaccaaccaaccgcagaagccgggtttttgtgccgggaaagctaaaaagccgtctgaacttagttaagtcggcactggctatttcggcgattatcacagtgatctttgcgcctagttctgcggccatctcctttttcaatatttgcgcctgcactattccgttttcacattcgtctgttcgcaattttttcaccattttttccgttatcgcatcaatagaattattgtgcttaggtgcataagcgaagttggcaatttttatcaacacacaaagttggaatggcgaaccaaagttgcgcaaagcgtctgctgcggctgtattcgctttagcgatcagcaacttaaagccacgcggcgattggagacgagcggataaacccgcttcatccgccgcctggccttttctctcgctgatttggctttgcaagttgtccggcaacattcgcatttccatgagcatttgaacagtcataaagcgcaacaactcttttttgtgccgttcggtgccgcttctatgcgccatcagtcgcttaatgcgcattaggccagtggtgttcatgagcacatctgtacagtgttaatatagtaggagggcgataaagggcgaagaaggagggatgcaaatgtgccaatgtattgtagttcaatggtaaagctgtccactgtttaaaaagagacttcggttcaatttccacccgggcaaaacatttgaaaagagaacaactaatgaatatcgttaggggctagtttttattggtttcatttttttggtttttggttttttggcacataaaaaacatatcgcacgtgtttgggctattttggaatttttagcacatattttggtatttttgagaaaatttataaaaaaatacatgaaaattaaaaaatatacccccctaaaaaaatcattttttttacaatactcttaaatttttttttcgaaaatgaaagatgctaaatcgaaatttttcattaattcgtcgttccaaaacattcactattatgcgggcgaaaaaaataaagaaacatttttcttgggttttatgcataaacacacttgatttttccaattttgagaacataatttctcacatattttggcatttttttttgtttttaacagatattttaaaattttcagcacatatt

SEQ ID NO: 5206 - DNA, 5418 bp, Heterodera glycines
ctagaacatcttttcactttttgttagattaacagatagattcgctttttagttaagaaaaatctcgaaatagttaactaaaatagaaggaaaaatgccaaaatagggataaaaggacgaattagtgacgaatagtgccataattttcagcctttatgcacttagcaaatgaggtacatttccaaatttagaggaaaatctcatccgatcagaatcaaaaattcatgtcaaaaaaataaataatattttgaagataatttttttgaaacaaaaaaattcatttcttagggtgtatatttaaaaatttggctgtagtattgaattgggctcgctaaaaaaccggctaaaacgagtaccaatcaatctcatttctctcactgagaggaaccgattgatatataattcacatgcaaaatcaaagttggcaagtatttttcacagttctcttttttattaataattaaggcattattaaacactaacttttataaattcaattttcaacgaaatgttttttgcgcttttttaaattttaatggttttaatatttttcttaaattgatcccgcttgtgagaaaagtttttgtccatgtttttgattgtttgtccataaaaacccggtccataaatataataattgctaaacaaactctctcacctgcgcgcataatctccggaaattcgtcgtccaaaagtgtcaaatatttcctaccgatcatttcgcccagcactattttaatttccgcataatttgcaattttattgcacatgcacataaaatggcgaagctctgcgctattttccaacaactcgtaaaaattttgcccaattatatgccattgtaatggctcgttaagcaaacacatgctaattcgcgcattaatttcagtgtcagcgcagtcaactggatcaattatcttaattggctatgcgattgcaatattttaaaatttatcatttattattctatatagactattttttaacatatagtttttatataatattattaagacgtgccgagaaatgtcagcaaattagtttaaatttggtaatttttaagccctccgtgttacgattgtttgtttaccatgtttttggcttgtaagactcggcctacctcaatgatgtccaacactctgtgtttgtccaaatattccttccatttctcacgtattccctcatcattttcaatatatgttaacatcattttgagaatttgggcaccgttttggtaaattaaacaaagcattttgttgttttcttcctcgcctttctcttccaattccgtaatttcgtcccaatcgctttttagcctttctatttcatccaaaagcccatttttattcagttttgtgcccaattccgtgagaaatgccaacattccctcaatttttcgcgccaaattccatttggccgaatttatttgaaatttttgatgggtttccagcggagcttcaaccatttgcagaatgtaagatttgaaaaagttgatcagttcagtcgctttatcatcttaaaacactttaacttttatttatttttgtctttcttttatacctaaattttctgccattgcattctgaggcgaattttcgtccattttttccttttttgggcattgatgcgttaattttgccgcattttcaatgctttggcttcgctcttttgccactattttttgttttgttattttttcaggttgcttcaccttatcgttgctcactttatttacccttttgtttttcccacaaaaaacgaaatttgaagaaattaaaacaattaaaaataaaagaaaaaatagagagaggctttttcgttttgcttctttcattgtcatttgtcagaaaatgataataaaaataataataataaagatgtaaaataaatgtatcgtttgcacaattattttgctggcaaaacaataattacacgttgccaataattaatattgttttatgttttgcaaaaaatatttttaaaaaagaatattaatgtgtgtgcagtataatttcctgttttctgtgcaaatgtataaatttcattagttattttgcaacatttttcgtttgataaatttatttaagtatcaaattaaaaaaaatattttacaaatcgaaaaacaaatgggaaaaactcataactgtgagatgtaattaagaactataattaattgtctatcgagtgataccacaaatgttaacaccaattgaattttgataatttgtgattttaattcctttgcacttacaattctgagaatggggaaaatgtttgaaaaattcataggtggtaggggcgggaaaacctaccgaatagcctttgaaaagtgggcctacaatcagggcttcgatcgaaaatttttcaaaatcagaaaatcgggctcaaaaaatcagattttgggttgcgaataaaatcagataaatattgacattatgccataaaatttcaaaattagacattttttaaaattcatctcaagcaataattaaccaaaattaacagcaagaaagaaattataatgccaaaattgaaaaaattttgcttaaacatagtacgccaatccaaatttaggaagaaatttgaaaaatttttcggagaatcgataaatcagaacaaattgggtcacaacctccaacaaatcaggacattcattcctgaccaattaggacattttcattttatcagatttggacccttcgaatcagaacatttgtgataattcaggacagatcgcacccctgccgataatacgctttattactgaaaaattggcaaaatttgaataaatgctttaatataatatttgctcatctcttcttcatttcaaatctgtcttttccctttggcgtctgtttttgaaccaattggcaatctgtgaaaagaaaatattttttcccagcattttcggttgtttgttattaaaaagaaaattcggtttttatgtgtgaattttagacttttgtgcttatttttcgattttttgtgcttaattatcttttcttgcttagaaatccgtccctgctcatcagtagggctcggatttgtagttttttcactattttttcctgagctccccgtagcctgaaatgcacgaaaaacatgtttttttcggctgtttttaagctacttttcgagttattagcaactattttctagttttttatttttagcaactaaaaaactataaaatttttgaaaaaaaactattttcaactattttggcgttttgccaaaatttgttaacaaaaatgcaatacaaacgaaaaatacacccttaagaatcaacttaaaatttttttcaaaaaatacaccactaagaatcgacccggaaatttcaaaaatacacccctgattttgttacctttttgaagaaaattttcgattttaccgcccctaaattcggaactttttagcaactatttacccatttttagcaactattttgggggttttttagaaactaaaaattaattattttggcactttttagcaactataaatcgtatccctaatcatgactagggtttgtaattatatggatataaaatctcgaaatatggccataaaatatggaccaaaaatcgcgaaatatggacataaaatggcaaaaatatggacataaattttccgaatttatgggtaaattttcaaaaaaattttcaaattcattaaattctagtaaaatacatctaaaatggctaaatacggtataagaactcgtttttagaagaaaacaagcaatttctagagaaaaacgaccaaaaaagcgaaattttgctttttcggttatttttgacataaatttattaatttttaagaaaatttaaatttattcaatattctcgagaaaattttgcaaaaattgttttttttgaaaattttttcggtttttggggtcaaacaggccaatttatctgttcgggccgttctaatagaggttttttggaaaaatgccaaaatatggacacaaaatatggacttaaatgccaaaatatggaaaaatatggacataaatcgcgaaatatggaaaaatatggaaaatatggatatagaactctttcctagaggcttcaaaccaagctaaaaacatgtttttaatgcgtttcaggcctccaacagtccagaaaaaatatggatttccatataattacaaaccctaatcatgactttttctagaattacccaaattaaatattcttggtatcattcgatagccaaatagaagacaccgccgtaaagtttattatttgaagcgattaggcaattacactttatgcgaaaccaatacatacatacatcatataaaacgagagaaagggaagttggtgtgggcccgaaaaataggaatacgaaaattgcctcatctcgtcgggagtggtggggagggatcgggtggtgataaggactatggcatcagattcttgagcctggaaggaatcaactgtcaagaccgtgacatttaagggggtaagggatctaatagcttttgcctgtgccgagtacagacagagacaagtaattgatgcagatggaggtaaaatgagagagagaagggagagaattgaatgggcaatgtggttttgggccgaatttaatcgtgaaaaggaggttaattctctataatcaggatttgggagatcaacaagaagaagaggggcagtttgattgggtagcggaaagttggaagaggtaatcatggagcgttgttcggccgttacaccggcaacaatatctccatgataaagagaatcagcaagacattgggtgagaattgggtgtcctcggtaggaaattgtgagttttgtgttgggaatgttaggaataaaaattaaatgagaaagaaatgaattaaatccatattggagcaattcctcaggaagttcagaagagcgaacttgtagctgttttgggtcaccagcagcaaggattttttccaaatttggggccagagagagaatatgaataatttgattggtaggtgcctgacctgcctcgtcaatgaatatgatatttacaagctttaaaatagagggaatatcttctaacatactaagggtgacaaagatgatggggatttcagtcccaacgtctctgataaagatttccgcagaagaacgttcatctgctttctgggggtttttcagagcattgattttatatttattaatgattttggcttcttttcgtgttaatttttgcacattaagtcagctaaagttttgattagaagatttttcatgaaaggttcaaaaagggaaaaatatttttcttttgcggaggcagagagaatgagaagggctttggagttttggtctaaattaggaagaatatcagaggctaaacgacaaagagccacattactgtgggtggtgataaggatatttttttctaattctaagaatttttggatggaca

SEQ ID NO: 5207 - DNA, 1900 bp, Heterodera glycines
  misc_feature (1344)..(1345): n is a, c, g, or t
  misc_feature (1357)..(1357): n is a, c, g, or t
aagatgaagcggacggattgaaatttgaaaagaatgccatcgacaaaatgaaaatgatttagaatcctagaatcgaagttttaaaaagcataagttttcaatataattatggtactttttgtgtagatatgtttttgaagttaaaaataaagtttactttatttcttacgtgaaaagtaaagactgtacaattgctggggtagaaagaatcgcaagattttggaaaaacgaccagcaggaggattcccgagtcgggttcgcgtccaactcttgaccccgataaatcccgaggctttttttcgggatcacggaggattatcgggattagctaaaactcaatttttttttttttttgcaaagatttattcaaacgcatttattatttataattgatcaactcgattgagaaataatagcatttcaacctttaacttttttttgcggcgcgctttttcgaaaaatttccgggggaaaggagaggtcaagtggtgccgttaagatctgccagggtaattttgaaaatttagttgggatttgtttaaagaattttaaaaaaatggccaacttttgggtaaatttgaaaatttttgtggtggggaagttatttaaaaaatagtaaataataaatgatttttttaactttaattttttgtgtttaattgttgcaagtcctttatacgaaaatggaaattattcgaaaaagttattgggattccaatcccgcaggatctcgcgggatggcgaaatagtcgggaaggattcccgatgaaatcctgatccagctcaatcgcgataaaatgctcagaatggatccttatgtcgggctcctgaatttaatcccgcgggatcccaatcctgtccgttctcaagtggaaagtaactttaatctttacttatttttatataactgcttttttaattcttctttccggacgcttttaaggcaataaatatctgacaaaaaaattaatgaaatttttatcaacttttagaattttccaaaaattacaaaaatgcaatcaaactagcaaatgatattttataaaaatatatcgcccaaaaatgggaaaatttaaaatttcttatcaaaacataagcacgaatttcaaaatttccaaataaaacacatgcaaaaattattttatatgtttacctcctctgcagagaatgtttcacagatatatccagatgatgaagtggccaaatgaggcgcattaattgtcgtcgattgatcgcccattaattaattgattcgcttttttcataagaaaaattattaattattattaatatttagttgttaaaagttataacaaaaacaaaatgttataatatgactccatnnttcttcaaattngcatattttggatgcacattcatccaaatgcgccttcttccgcctcgttgggcggatttgcgcaccccacccaaaataaagaattgaagaaaatgtgtggtggcaaaaaaaaagagagaggaatggatgaaagaatgaataaattcttggaaatgaatacggtagccaaaaaggaatggtaacggtatttatttgaaaatacaacagtatgattcgttcctttaagcacagtttgaaggtgtagtcaatgctgaattcaaaggtagaagaaccgaaaatcaaattttataaactcaaccaatttggatatgtttttggtgattatcgaattttcaaagatttttgaaatttgaataaatttcaatgaaattaggtcttaaatgtgtcccccttttttcattgaaaataagtgcggtctcaattttcactaaatccaatttttatttttattttaccacacttaaacaaaaaaataaaaaatatagcttttatgtatataattataataaaaatagacgtgaattgcgaatttcaaatttctct

SEQ ID NO: 5208 - DNA, 1327 bp, Heterodera glycines
tgcaacgagggtattgcccctcttttccgtctcttttctttcatgagaaactggtcggacagaaaatcgctgctgcactttatctcactcttaaattctttatctacacaaaaatcccaagaaattcctttcattttgaatattttatgcattttgctgcatataaatcagttaagttttcagcgattttacatttttggcacaagcgcaaattggcaacagattcagcagcataaataaaagatgagctgtaggttttgctgttcgtttgtgtccaattgtcatttgctaaatcttttccgccattgggcgttaattaatttccttaattatttgcttgtctaatttggattctctctcctctcaatctcgtgaccagaaaattcaattgagatacaaatttttgaaagagagatatggaatatgatcatttgaaacgttaattggtacggagaaaaaatacagaatcccattacagtatatttacattttacaaatttcgataaattttcagatttttattaaaatttttgaaactcgaaaaaactctctcttatttcagaacagcttcctatacatattttgatttattatattacaaaatataattatattgaatattattttaagaggattgtactgtaacactgatggatttctaatgattcattttccgggtccacggcacctccccattctccaaaaattcaccaaaaaaataaatttaaaaaaactgaataatattttcatggcaatcgaaaatatttttgaaaaaaaccagataaactaataatcacgcaaatgatggacaaagaaagtcccgacgtggttaagcaaacaaatgggggggggggaataagcttaactggggaggaaaaagtgaaactaaaatagacacgtcgggggctaattttggcaatttggggaacaaatcggagagagtaaacagataaaagggatggggggagagaggatagagaggggggggggggggtaatgcaagcaaacgaaaaactggacaaacaagggcctattacaggattaattcccattcgggcacttattatggcctccacagaaacttgttgtcttcaatagcgaaaaatcagtgacggaagacgaagtttcggtgtcctcaccagcagcacgagaatgggcaacatggagagggctggcaccgtgacgaatgatcacaaattcgcgaaaaaccgagggcaactgtaaaggccaactaaaacaggtcaaaagagcaaacttaatttccattaagcgaatcaaaaaatggtcgcctttacttttgtatgcacagcagccaaaaaagtgggga

SEQ ID NO: 5209 - DNA, 2251 bp, Heterodera glycines
tttactttttgaaaaagaattaagttttaaatgtgtaatactttttgataaagatttgtttaaaatttggcaaatttcaaattctctgtcgcgtgttttctttgttcggaaaacgcgaaaacaaaacaattgtagaaaattggcgcgtccaattcccatcaaatctcacatcggcttgtcacttctgtgcccaacagcgcttttggccaatccaatggaatcgcatccaatgctttgggggcgtcggcgtcggcttcttcgtttctgttgcgcaactccaaagcgaactgtttcctttgtgaccttccgcgaatgccgtgggcaattgttcttgattatgcggaacccgtgtgcagaggctgtgtgaactatgaaggagcagagaagtgattttgccgattatgcaggccgatcggatcagaaacacccccccccccccgcaggatcgaagcggtgatcgaaagcgcacgtcggatgaagcaggtccatgcgactctctccgccggcatttgtccgtccgtcatttccaattccgtgccaatgggccctttggaccttctgaacggcacttcttcacagttgaggtcgcatctgttttccgctcagcctgcacaacaaatctctgtgaacggaaatggcattggcttggccaatgccgcggcgtccgctcatcaccccgcgactccgtccgttcccaacaatcgcttcagcccgcgttcgacagcagcgaacggtattaactgtccaccgtcatcgtctgccataaatgggacaactgtgaacggatcaccgctgaatttggccactcaaataggaaatcagacggtcggccttgtggagagcatccaccagcagcaacaaagggcgatggccgcagcactgaacagtcgcggagggacagtgaacggaagcggaaacaatgcgctggacgaattaaatcagttgaaccaattgcgcgccatgctgccctttttcaacccgcaccaactgctgccgatgggctcgctcaatgggttggctgcttcgttaatcgggccacaagcactgatcaatgcggtgggcgccaacgccggagggaatgtcgcgggaatgaatggtggaggaagcgggcggaagagggaattggagggaggcggcagcggggacacgagggagtcattgaacaacaaagtgcagagaggtgggggagagaagtgccgaagaaaggcggcggcgaaacgcagcggctaatctgttcgtttaaggggacgcccagacgacgtccacgtcgcccacctccaccaacagccctgaccagtccctgcagcacaacggcttccaccacccgtcctcccatccgccgcctcatcacagctccgaccgtcgtcggtcgctattcctttccaacgccaattccgtgccaacgccttcctcaacggtcgcttcaacaacggcattcgcaatggccgcggctgcccaacacgcggcagcagtggcagcccaacagcgagaaaacaacggcgaacggacgctgaagtgcacggggtgtcaggaacggctggaggatacgcattttgtgcagtgcccttccgtcagcggacacaaattctgcttcccatgttcacgaaaatcgatcctaaaacagtggaaatcgcatgtgagaatcgagaggagaataataagagcataatgccacccacaacaattaaacagatcattagaaaacttaaaggattaattaatcaattaaggaagtgcactgtccctccggggaaaaatgtccattgatcaattccagccaaccgtggacattcatgccgcaggagattcagactgtaagaacaaatttaggagaagagagcgaaaaagtaacaaaagggagagactgagaaaagagagaaaaggggaaagaagagagagagggagagaaagaaagaaggagaaagaggatgagagaagagaaagagggaggaaaggaaaaggagagagaaagagggacaaggataaagaggatgagagatacaaagaaaggaaaagagaaagaggatgagagagaaagaaaagggaaaatatccatcttatgtcccagattcaaaattgcatacagttttataagttttcttaggtgctgaaaacgcctaaaccatcaaaaagactgcgcggcaaagcatttaaaccggtttaaatcgcgaaaaattgcctcaaaaattagccaaaaactcattttaaataaaactttttgagcaaatttggtatcattcgagagctctta

SEQ ID NO: 5210 - DNA, 2634 bp, Heterodera glycines
  misc_feature (17)..(17): n is a, c, g, or t
tcttcgcatgctccttntttgcgaaaatttacttatcaaattattctgttcatccattatttctttggtacttaagtgtacattttcactaggactcagtagtcaaagtgctcaaatgacgtcggttcgacttcattccctgatttttagacttagctcgtcacgagctttcgaatgataccaaattttctcaaaacgttttatttaaatgatgtttttggctaatttttgaggcactttttcgtgatttaaaccggttcaaaacccagtttaaacgctttgccgcgcagtctttttgatggtttaggcgttttcagcacctaagaaaacctatgtgtttttatgcaattttgagtctgggacataagatggatatttaccaagaaaagaacgagagaggaaaagaaaaagcaacagtttgtgagacaatgctaaattttaataagaaaatcgtggataattaattcgggatgagtaatttacgttttaagattttgggtgtggacgacttcgagcagtttcagcgtgatcgggagcgaatcggcttgtttctgtctaacagtttggtcggaccgaacccaacggcagtggtgagggagaaaaaacccataagacaacaatttgtcactttagccaaacggagcaatgaatgggcggggaaggaccccaacaaatggggagacgaacggcggcgcaccgatcggaagcgaaacggcggtgagtcacttcaaccaaacagaagggcacaacggatgccaataccaaactgttcattgtcagatgtgcactcttttgaacagcacaaaatgtgtcaaggaatcgttggaccaccccaacagatctcccggaaccgtaagcggcgactcatccggcggagaaaacgctgtggcactgaacggacaatcgccgtaacaaaactgcgaaacggacctttattacagacttttcctctttccatacacctccattttcgtatctctaatttctgctgtttgactcggctaaattttaaaatgacaaatttacgccatttgcatttaatttcaaaaagtcaaaatttttgttgccattgcgagcaaacattgatgatgcatttaccctcttatttaatatatggatagggatcggatttttaagggcgaaaaaaacgcgaattaaagccgaaaataaattcgctttttgaatatatttttccaaaataaaaaaatttcaaaaatcaaaatttgatcaagaaaaaaaacatttatttgttaatggaaaaatttttgaacaagtcgccaaaaaatgtgatcgcgtcaaaaaaatatatttcttttttgttaaagaatttgtgaatttcacatgaaaaaatttaaaaatcgcgaaataaagacaaaagtaaaattgtagaatactagtacctcaccaaattcgacgaatgatataccattcgacgcctctcggtctgtaatgcacgaatccgaaagaatttggcggaaaccactttgggcaaagttatggaccagggactgacgtaaaatcactaaggttctgaactacacaaaaaggagcatgcgaagacggagcaagccgccgtagtcgagtgtgcgctggtttttagcgcaataggcgaaattcaatttttaaatttgacggttttaccatttttctgactcaacattttaaataacgtttttgaggaccagaactctaagtaaaaacttaaaaatccgatccctatatatgaaactataaaattagttctcttgttcaaacaatcaatgttttatggctttcacgaaggcaatgtcctccaaaagttcggattcatttgtaatttcctctggaagttgttaaaccaatccgtaatcgattttgctggcacatattccgccatttccgttgcagttgatgccatcatttgaccagactttggaagagagacggaaaatgattgaacataattgacgaaattgcgcaacattttttgggagaaatcgttaattgcagcaatcttaacaaaaccaaaatgcgtcaaccaccaggaaaagcggtaacagcagcgcacacccgtcccgaataagatgtttttctccatggatgaatgctgccgacaaatatatattcaaaaaaactcactttttgattttgaaccggttgaaaaactggttttttgtttccgaacttcgcgaaggttttggatgatttttaacggcccaattctattttttttcgtgcttttgtggtggaattcaattggctgtactcaaacaacttctgatctatttcactaccctaagatcaattttatcatcctatgtttttgttttatttgttgacgtgattcatccacggtagaaaaaacattgagtcgttacccccccccccccaccgctttttttacctgtccattttccgcggaaaattgatcattggtttgacctttgttttgtatttgacttaaaggctcaagcaaaattccttaagctttcgttaagaaataaagaaattacttttgtggaaaatcaaaaatttcgttttcaaattcttaccaattaaggcatttttggtcccttcggtgtttaagaattgagagccagtgaaaatattatgcgtctggagagaatttatatacttaaaaggaatgttgtgaaa

SEQ ID NO: 5211 - DNA, 1816 bp, Heterodera glycines
attatttattaatttatttcgccgattggttttaaatgaattagcaaggtaaaaaaaacactgaaaagagcaaaaggcaaacaatcagaattaaattttatacgttctctgtaaagtccaaattatgaatgttcgatttcgttaggattaaggaggtaattacttaattaaaattgactaattcgttatccaatgacccggaatgctcaatacgaaaagaaaaagatgagttattaatctaaaggattacctgcccaactcggaaaattgcgcttggcttttcattgctaatgaatcccaaattactccattccatcgaacccattcccttttccatcgaaggccaactgataaatactttaaaaatgattagattgacaatgcgttttccgataggtcacttgatgcgccaatgtccggtggtaatggttgaagaccggtcagaaaaacaacgatgtgatttatgctgaaaaatacatttacagaccaaaagccagtcatttttaataataagtaattcgacgtgcattacaacctcccaacacatttagaagtttatttttctttcaataaatattagattcaaatctttttaatgaaaataaatcgtctgtattttgctagtaaaaaacaataactgtcacgtcaaaatcttccaaaaaattatagtaatagaccaaataaaaccaattccatttgatgaatgacaaatattctatttacccataattctataaaacccacttggcaatatcaaaaagctctgttgtatattcgccttctttatgtgttgtgaaatcagtcttgaccattcgtcctgcaactatgacgccgaaaatattcattgtttgaattgatattgaaacaaatattagctaaaagattggagaatatggacacctcgaattttgtatatagagaccggattttgaaacaaacggactggaacttgacgatggatgggaccaatgggactaaaactaccatttttccggttagatatttcatttgaggaccggaaatgggctatcattagcagggctgcaaaaaatatgcaaatgcatatttttttcttggcttctccaagctctaaatagtaggaaaaacactttcttttttgtgtttgcgtataaaaatcgggacttatttgcatattttgagtttttctttatatttaatgcatattttaccattttctatacatattttcagattttttttgcatattttgccatttttcgtcaaatttttcagatttgattgaaaatgcctaaaattaaatccaaatctgaattgatgcgcaagtgggtcaacagtgagtttcactgctgaaaaccttgagaaacttttgatttacaattacaaaaacatccgatataatttatgagttgggctataaattatatgcttttgcatattttttctgcgcatactatgaagaaggggctcaaaaatagcatttatacgttaaaattttttgatatgattaaagttttagtgcatataaaagcatatttttggagttttcgagaataaatgcatattttgccattttttgcgtttttacagcatatttcggtcatttttggcaaatttctataagaaaaatgcaataataacaaaaaaatacacccctaaggatcgactttttgggaattaaaaaaatatacgcttggaaatcgaaaaattttgaactttttgcaagaaattttgaaaaaaatttttgatactaaagatataaaaaagggattttgtttgagtataaaataaaaattcacaatgtgagagggtaaattttgaaattcaacaatttttt

SEQ ID NO: 5212 - DNA, 3116 bp, Heterodera glycines
tcagtggcctccccaactttttcataagcgtgtttcatctgagaggaaagaattgaaatgttcatatattttaagcaaattgctcaaagacttcgttgtaatccacggaagagtcgttgcacagtgaacaaatggtggctaattctgtcaatgctttgtgttggtcggttgcacagtttatttggactccgttgtacatgatttgcccagtcggctcataggtggagccagagattgtgaattcgctgaaatgaaaaaaacaaataaaaaccaaccgttttaaagggaattgcaaaatgtatattatcattacccgaaagtgatttggtcgccgtgcgcatgttcaacaacaaacattttggacacagacatttgattggtggttaatgttcctaaatgtaatttaattgagcattaaagatttccacattttgtggtggggccattggaattgattcaccagtcttgtccgaacaaatcaccgaagtgcagcccaatgtctcaacggaaggcaacgagcggacaatggcattctttttggccatccgacgggtgcccaatgccaaacaagtggtgatcacggccggcaaaccctcgggaatggctgccacggcaagggcaaccgcaattttgaagtagtaaatggcaccctttagccacgagccgccatgggccgggtcgttgaagtggcctggggtcaaataaggggtgaaaaggcactaatattaattaatcgaaatttgaaatcctaccgatgttgatggcccacaccgcgacacaaattatggaaatgactttggacaactgctcgctgaactcgtccaacttctgttgcagcggcgttttgtccgactcggtttccgccatttccgtgcggattttgccaatttccgtacttagtccggtgccaaaaacaattccccgggctttgcctgacgcaacatttgtgccctaaggccaaagggaagggaaaataaaaaaaaaataaaggaaacacacagagaaaaggcagttcttcttgtcctggttgaccgccctcgggtcgggcaccacgtccaaattcttaatgaccgacacagactctcccgtcagaatggattggtcaatgcgaatggtcgtcgaataaattttgacaagtcgcaaatcggccggaattttatctccaactgaacggaatttaaatgtacgaaatctcttgagaaaatctgtatatcttcaaattattgtatcataacaattaatcagaaaattgaaatttggcacaatttgcttctctttccaaatgcccacccgaaacttcgacgagatcgcccgggacgagttcctttgcacggatcatctgaatgccgtgtttgcccgctcggatgacttttgccatttccggttcgtattccttcagcgcttcaattgcactttccgcatttctctcctttaattgcaaattccctttttctattcgtatattaaacaaatgataaaaaagtgatgacctgccaaactccgaccgtggcattcgcaatgagaattaggagaataacaaaaggttccacaaacgcagtgactgcactcgtctggtcatcgtgctcctcaaacaaggcaaggacctgagagggaagtgaagcgaagccaaaatatacaaataaaaaaaggaaaaacttacaaaagaaattattgcggctaggagtaaaatttttacaaggagatcatcgaactgctcgagaatcaattcccacagctttttcccctcctccgcgggcatttcttaattaaatatgtaataattttaacaattacctaaattgtccccaattcataccattatagccatatttatcccgcaattcgtctgcttgttcctctgtcagtccgtctggccctgtgccgaaaaaccgaaacaattcgtcttcacttttcgtatgagcgttctccatctcgctgtttgtgcgagtatgaacaacctgaagaacatggaaggaaagggaaaattaaataaaaggcgaggaaaacaaaaaggaatatgacatttggttcaatatttctatcaaatttccaaaggatgtacaaaagaaaaatgaaaatgacgtaaaaaaaacgtcggaatttgtctgtggccaatttaggaattatatgcatcataacgaattgcacagcgcttatcattatcaacgaattacgattaattaactcatgttgattgtgagataggcaccggcaattaaggaggccaaatggaagtttcagggaaaaccaaaaaatcacattttcgagggtctgccaatcaattggcaaagacaattaaacaatgccaaaggcaagagaaagaaagaagcagaaagtcgtttcaaaaataagaaggacaaaatgacacgtcaatgtaaaaatacaaaagcaaaaaacaaatcaaattgaacgttatgattatgaattgaggaaaggaaatgggacggacattgtcactatgacatgacttggcctggtttaatgttaatggattggatttgatttatgatgattaaaaatgagttgattatcattaaataaaataaaagggaatttatttaattatttcacattaaaattatttatatgtatacctatttaaaattaaattattaaaaactcatttcttcaatttgttataatttccaaatcatcggtttgagaatttatttctgcacaaattcttttttaaataagttttcccgcacttaaaattgacttgaaaattcttgaaataaactgaagacttgtcgagaaactgaattattgtgtaggaggaggagaaggaaaaatgaaaaccaaaggaactgagaaaagaaagaaacccaaacggaaatgacgcaaaggataaacacagaaaagagaagggaagggaagggaaggaggacaaaagtaattatgattaattaattaataattacaaaattttaaaaaaagaatattaattgaagcaatttgtacaaatgtgaattggacaaaaattaggtaacgaaacgaaaaggcatttaaagaaaaagcgattgaacaaagtgcaattttcgattggctagaattttttgcacaaagcgactgttggctttgggctttgtttccctttggcttcggggggggggggg

SEQ ID NO: 5213 - DNA, 3251 bp, Heterodera glycines
cccgggtcgcttcttcttcagacaaatgggtcgacggatcagcaaaaggggcagcggacggcggagagtgaaaatcgccgcgtcgtccgtccggcgccgttccttccgccgtcaaatgtttggcccttccgccaaacactcattgcccaaccgaaagctgctctttcccctcattgacgcatgtattaccattcgataatgatgatgggtttaagcagtttgaagaggcattttccacccgtcctcaagtgggcccaaacggagggcgccctttccctttcgcccgtcaaaaacccatcccttccccccccccccaccctccgcaagaaattccgctgtttcgcacgggaacatcaaagcgaagacggagaaagaaaagggatatgtatttgaacgatgagaatgaatgggaaaaggtgaagaaaattgagaaaaaaggcatgattgggcagaggaaaaagacggcaccgaccgaaagagacaaaggaaaagccgaagggagtgggggggggggggggaacatgacgatgaccggtgaaagtgcaaaagataatttatatatatttatcagccatcactttttgacaatcatttaaattataataatattgcagtatttaaaaatggaaatattgggaaacaataaaattgactgactatgtcagttaagtgccaatgcttttttggttttccttgcttaatccaaccacttcattaaagagaagtgattcaaattaagattatatgactaaagctttgtttttctctttatgggttttggactgaatcgttggctcaaccgacccgcgtacccataaataataatataataaaaataagtaaataaagtatgaaaatcattgcgcaattaggcatgtgctgccttcttcagcaatgtgtccgtgattttcttcacttcctcccaattggcagaagatggcgccagtcggcatttgatgctctgtaacatttgcaagtcttccctttcaactgccaatgtcgctgcctttttcacttctctgaattgtgttggcgatgtgtcgtaaaaagggcaaatttcaaaaactgacccgaggatgagataagccttcacttgctcctcgtacgcattcagtcggtccatgaggcgaaaagccaaatttttgttgccgtaagtgacacaaagttggatgacagactaaaagccaaaaatgaaaatttaaacaaaccgtaacgttttgccaatcactcaccaaatagcccgtggggctcttcttcgactttgcgtattgttcgaattgttgccattttccgccgcgtgcaaagccttcggctgtccataggaaaacccttcagaaaaagatgaaacaatgaagttgccaaaaacccactgtttctcgttgagtctgtgctgctttcgcaactgttccatcagtgccatttcctcccgtgccgccgcccaaataaacgattcgcggacggtcaaatgagccatcggcgtattgtactgaaagagaagaacatatggaaggggtctaatccaatgtcttgacagatccgtaatgagaataaaaggtccttttaccgtgacaaaaaaaacgttggagtagcgggagttatgtgataaaatcgggaccaaacccagcaaaagtgccgtgccttttcctcccgttttgtgttgtccacgatcatttgtgcacattcggccactaattgtgcgctcgtcggctcccgcatttgccgcaatgctttctccgcccttcccaattgttccgccactttcgacgtgtcgaaaaagtcctccgcttggttttgctccgctctgcccaagtggaaaatcgcctgccgcacaaagtcgtcgttttgctcgtaaagtgccaacaatcgttcgggcgcttcgtcacggatttcactctgtgaaattgccaatgttgaaatttacaaccaaattaaaaggggaacttggtaaatgctcagcgcttgtggcactttgcgcagtaacaattccatgtcgcggttggtcaaagagttgcgcaagtggcgaatcaccaaaagaactgatcaaaaatggaactaaaatggtcaccgttcgttcgacttacgcaagtcgggccgctgactctgtgcggctttgtgcagcgctttgtccaactgttgcagcttaagcatcgccgtcacctgccgggccgtgtccgtctccaactcgagcaaaatgccggccaaggagggcaactgcttgcgagaggccatctcggcaatatcttagatgtttctgactgtgaggctaacaaatccacaaaaaaacagtggcaacctgcgtagctaatggccgggtactcggccaacttggccaccatccgttgtgccaatccttcctccgtcggtttatccgtgtgccgttgttcgtcctccgcttctttttgcctttccttgtgccgttccatcattgctaaacaccagtggccgagcaccttgaaaacgccgttctttggtgccaaatccaaaaagttgcagaatttaatggccaaaggccaatggttgagagaggtgagacgatcgataactgaaaaaggcatttgaaacaattgggcaaaatcagaatgtaagtgactcgaaggaagggaaagttcgttcaactgttggtgggtcaaagggatgcccatcggtcggagggcattcagcgcacggaggacacggcaaatttggacgaaacggtcggagtcataaggccgatcacaacggcgaatgccaatggaagcggactaaatgaaaagatttataaaaaggaaagaaaggacggcactcgaaggagtcgcttttgcatttgggggtcgaaatggtcggcggccgcctccaaacattggtcaacagcctcaggcatttgcaaagcactaatcgagcgaacatacctaatgggaaaaggaatattcaatggcacgggagaatgaaaatgaaacaattgggccatttttaattaaaccaaagtcggaaattttgaggggggggggattgccaaataaaaagttttattcgatgtttcattgccaatccgttaactactcgtaagcttggtgcgacttttgctccattttgcgctccgcaccgaaaagcaaagagcccggctcattgctggtcagccccaaaacggcgttggtggaggcggacacgggcagcaaaaggtgggcggagaagcgggaaaagacgcggacgcaatcggactcagcggaagaaaaaacgggcgaattagacgaagcggaaaaggaaaaactgaa

SEQ ID NO: 5214 - DNA, 1480 bp, Heterodera glycines
atcaatattttgtttcacaaaatgaaaaagaaacgaccattttaaattttaaaaccgaaaaaacgaattgaaattttttttgacgaacaaaaccaacatactaaattgaaaaataaaatttttttcttacagccatgaccgatttcctggcatagctaagtttttttttgaaatgttttattaactaaattatattttcatattcattttctagaattttatcatgtaatattgattctatcaccggattaataaatatttctaaaaatcaatgagaatttaatgttccacataatattaatgtaaaaaatatacaattgtatacatataagatattacatatatttcttataaaatgctgctgttaaaatatattatttttgtggtatttttgtttgcgttttgtaactgtgtcataaaaaggaagcccatttcacgaagggtaattaaattaaaattaatttttaaatctgtgtcatcattaaaaggaagtccgttttacgaggagaattaaaaatagttttaatttttgaacttcagtttaatttttaaattttaattatttctagttgaatccgcctcgtcaaccaaacgagcaaatgtcgactggaaacagcccaaatgctgaacccatcggaacaggaactaaacggttagcaaaaaatagttttaagcaaatattttttggatttattaattttgtccctcaatatttaaaaggaacatagttcgctctccacagatgaaaggtgttcaaattaacgaaccaattcattcggctaatgatgaacttgatgagccaattaaaaagtgggccaaaacaaagaaattaagcaaaccaaagtggaaaatgccggtaattactagtaatgagaaattacaaattgtgctaaaagattttataataactgtagcacagataagaatggggcttattgtcaatgtgaaaaattattataaaatacttacggaatcaaattaatcaaattttttttattatttttagattgaaactatggctaatcatgatgatgaagcttatgccgacctttatgtttataatgcaggaaactatactaatgcaggcgaagaatgtcaaaattgtttgaatttctcaaaaattgatggcttaattggccaattaacggaatctttgaacgcaaccgaaacaatcattaatgagctagtcaaaaaatttaaacttgtgccaattgatctcgatagcccaatgtcaagtgtcacaatgcttgaccaaagcacaaacagtgaaagaattcatttggcagggaatgtgattaacagcgcaattattggtaattagggtcagacgaattgtttatttgatacccaatggaaccaattttcattttgaattttaatttaataattagtcccagtttcgcgcagaattttaaccactataattattgtgtttaccaggcctttatctatcatttttgccgatgtctaaatgaaatga

SEQ ID NO: 5215 - DNA, 2600 bp, Heterodera glycines
  misc_feature (1501)..(1501): n is a, c, g, or t
  misc_feature (2162)..(2162): n is a, c, g, or t
  misc_feature (2170)..(2170): n is a, c, g, or t
  misc_feature (2183)..(2183): n is a, c, g, or t
  misc_feature (2185)..(2185): n is a, c, g, or t
  misc_feature (2192)..(2192): n is a, c, g, or t
  misc_feature (2198)..(2198): n is a, c, g, or t
  misc_feature (2215)..(2215): n is a, c, g, or t
  misc_feature (2235)..(2235): n is a, c, g, or t
  misc_feature (2247)..(2247): n is a, c, g, or t
  misc_feature (2256)..(2256): n is a, c, g, or t
  misc_feature (2263)..(2263): n is a, c, g, or t
  misc_feature (2271)..(2271): n is a, c, g, or t
  misc_feature (2279)..(2279): n is a, c, g, or t
  misc_feature (2285)..(2285): n is a, c, g, or t
  misc_feature (2289)..(2289): n is a, c, g, or t
  misc_feature (2299)..(2299): n is a, c, g, or t
  misc_feature (2309)..(2310): n is a, c, g, or t
  misc_feature (2318)..(2318): n is a, c, g, or t
  misc_feature (2334)..(2334): n is a, c, g, or t
  misc_feature (2347)..(2347): n is a, c, g, or t
  misc_feature (2354)..(2354): n is a, c, g, or t
  misc_feature (2360)..(2360): n is a, c, g, or t
  misc_feature (2367)..(2367): n is a, c, g, or t
  misc_feature (2369)..(2369): n is a, c, g, or t
  misc_feature (2394)..(2394): n is a, c, g, or t
  misc_feature (2402)..(2402): n is a, c, g, or t
  misc_feature (2407)..(2407): n is a, c, g, or t
  misc_feature (2436)..(2437): n is a, c, g, or t
  misc_feature (2455)..(2455): n is a, c, g, or t
  misc_feature (2460)..(2460): n is a, c, g, or t
  misc_feature (2462)..(2462): n is a, c, g, or t
  misc_feature (2473)..(2473): n is a, c, g, or t
  misc_feature (2493)..(2493): n is a, c, g, or t
  misc_feature (2507)..(2507): n is a, c, g, or t
  misc_feature (2527)..(2527): n is a, c, g, or t
atttttggacaaattaattggttgccaaaaatgaaattttatccaaaaatatgaaaaatttaaccgatttgccatcatcctcaaaaagagggttaacacatcaaagcagttttgtgatcatggagatcagtgacaatgtcaaaatggatgaacaacattcagatgataaaaatggacaagaaaaaaaggaggccaaaaatttggaaaatgccgaaaaagcgatgaaagaatttaacattcggaaaaagaatgtgaagtgccaaaagtgtaatgagcgtgccaaaatcctcagaatggtccagcaaatccagaaaaacaacaaagaacaaataatcaaacttgtgcaaaattgtaaacattcgaatgaacaagaagagtttacagaacccaacataattggcacaacaatttacggtgaacaaaaataaataaaattaatatttaataaatttctaacaaacatgcccattcgctaaaaagcgaaaatgttaaattaaattaaaaaaataattatccggacaacaattcccaaagaaaatatttaaaaaactgacaaaaaattatactaattttttttttgtcaaccaaatccaacaatcttagtatcatttgaaagctctaagctcttttacatactctattagccttacaaaaccgaaaggattttaagcctggaaacaatttattaaaaaaacatcaaaaatatcgattttcaagtttacaggtaataatttatttgataattgtctaattgccaagcaatagcttagaaaaaacttctcaacatattaggcttgctatgaaaatcgtttgatttggttggcaataaaaaattatagtcaaaaaattggttggggccgaactgatcgagtccgtccgggccacaagcccaaaagaaaataaaaaaaaactgacaaaaattatagctagatgagatttttctagtaaaattatgcaaagatgttttgaataaatatattttacacatttaaaatcatagctttttgaattcgaaaaactacccattcgttaaaagcaaaaatattattgttgctttttctatactttttttttgaaaaatggcactttaggtatgcaattggcatttaccataatctctactcggactgaattcaacgagaattcgaaattagaagtaacattggctaatgcagatagaattggcaaagctttgcttggcatttctgaaccaattgagcacaaatttttagaatatttaaaaatttcaaaaatatttttgttggccgattcattgggtgctgatgaaacgacattgatcgaagctgaatgcaaaaatttggaggttttgcagttgatattagtaatgtggctgagaattttttaattctttttcaacaattgacctttttgcgcaaaattttaaacaaaaaaacgcacaaaatttcaaaaattttcataaaggctttacgaacataagcgctcataaagaccgacacatttagctttcttgcttagggtntatgaagcgcaatgttctttttatatatatttattaaactaataaataaatttttgagaatattattattttttgatgaccttttacgtcaaaattttaagcataaaaaacgaacaaaatttcagaaattttctgttgggaggctcataaaaattcttttggcaaaaaatgaccgaaagaaaaatctaacaaatttttcttgcttggtattatttattcataatgctctttttaaattttgactgcaaatagagaacattaattcaagcaaatgttttttaatatatttttttaaaaacttgtaaataattttttttttttttgtgggttgcttagattaaattaattaggtttttatttaaatttaagaaattcattaccaattttggtgcaactcgtgcaccatcagccgaagaaaccaataaaattggcaaaaacaatttggaattttacatccatcttttcaaagaaatgcaacagttactggacagcattaagcgcacaatcaaaattgaaataagagaagtgtggaaagacctaattgcatttgtagaaaagtttgaggaaaaattggaaacatttgccaaattaacggaaaattgaaaaagaaaaaagttacgacgcgattgtttgtatttgacaatgatgaaacaatgggagnccttttanaaaaaaaaatttnanttttctnattttnaacattttaccactttntaaaacaatatttctctatnctaacacttttncaattatantaaattnataaaacnttctatcnatttanaaancataatttcnttattaattnnttttactntaaattttaaattatnaaaattttaattnttttttnttttanttttttntncctaaaattcccatccctattaatntaactttnatttnctctataaataaattacaaattctttttnntaatttacacatattttnattantnttttaattctncaatttatagaataaatttncattttttatttcntaacatttttataagttatntttttcctaattatttcacaaatccttccctgggggaccatggaatgctcaattaaccagaattaatctgtca

SEQ ID NO: 5216 - DNA, 3996 bp, Heterodera glycines
ctgattgtgtgtgaatccaattgacaacaaatgtttctaccctggatgtggtcattgttttaagaaaactaatgagcaaatttttaaaattattgataatgtaatttacaagaaaataaaaaataaataatcaaaaattcatttatttaatatttaaatattttaaattgaaagaaatattcataaataaaaactaaaaattaatttattttttattttaaaaatacacctaaatgattttttaaaggttccaaaaatttaacaaatttaagatttaaaatcgaagatttattttcgtattgttttttcccattccaaaattttttattttttttattttgcaaaaaatttttaatttttttaaattaaataattcattattttcagatgacatcgaaagccttgacaaatgccaaaaacaaacatatcgtggcatcaaaatttgcatttggaaatattggaatccaaaatgtgcgttggatttttgttcgggcggaggcggtggattatgtattcgacgaatgcatgttttacgatatgtttaaaattttcatactgtatttatgataataaaattatcataatattttttttcaaatatatgctttcatcattttgcgacttctttccgatatcccatgtgaaggctatgttggaaatcgtaaaccggcactttgattatatctttgttcattatattcatttttctgaattttttttttgacaaatataatattcaaaaagaaaatttttagaacttgagaattattgagtttctctaattaatttttaaaattattttccgtattggaaaatgaggaagatatgctttgagtcacagcaacctttattgaaaatgaactgaaaaatgtaattacaaaaattcttgaaacaaatggtcggcaggcactaaaaagatcaatttggtttttttggctagttttaaaaaggaaagaaatattctaattttttattattttgggtggtaggaaaggttacaagtaattactgttaattcacaaaaataaataatttattctaagaaatattttataaaaaataaataatgaataatatgtacattttattcatttttgaatcggaatttttgtgttgaatttatctttggtaaaaaatttttttttttaaacttcggcttcggctttgaaaaacttcgagcttcggcttcgaataaaaataggatttcgacttcggcttcgccttcgagtgctaagccgagcttggcccagccctgttctgaaggattttcgcaatccgaggcttgtacaacaacttcgtacgaaacggccatacgaaaatgaccctgacccgccaaaatttttttattttattttttttttgttgaaaattcataaacagggctgcaaaaaatatgcaaatgcatatttatttgctctaaactgacaaaaaattatgcattgcatacacaaaaaatcctttcatatacattttattttcctgccttatatttgacattttatttctttctcacttttgatagtcttttcaattgctatatattttctaatacattctagttgtcaaattgtattacatttcggtgcctataactttcattttttctttgtttctttctctattttttgtatggtaatacattattttgatatagtcaaagaaagtatacacatacccttattagtccgattattcatgggcatattaatctatgcatacattaatagtaggaaagaatatctttttttcttttctgtgtactatttcactcagctcgcccactcaagttggcagaaatttccaaatgtcataaattttatagaacactaattttagttcgtctgatagtccaagtatttcggtcagcatattttgaaagtttaatcaaagatgtaactctaaaggtccctccctcattaattattattttatttttcggtcaaaataaaattctttcaaagggcctcggagtggaacgccatgcaaatagagatcttgcaatgagggagcatgcatgtttctgttcaaactgcagtgaacaaactacccccattgcgcaaaaggcagcgctcaaagctccctgtgatgccaaaaggaagttaaattgaacaacatttcattagaggtctgtctgtgcagctcatccacatgcaactcatcaataatcacttcgtctataaggaaactcacgcacaggtaacttcatccccgtttttttctcaggaaaagttccgccgagtttatacaccggagaagatgctgtagggtaacatttcgcctattccaattaatgagcaaacaatggacgtctgcctggacttccaatccattcttttcaagtaatcccaaaaatacgccgtgacggggattgtgaatgaataataaactccgctgagacagagggagtcgaacttgaaattcccgtctttccattcccatcccgtacaaggaagcagattagattcagcactctccccacgtggtcaagcacaggctactcccgaacaaaattccgtggagcgcgagatcagtatgccgagagcacctaaaaaggtccgattcgccgacgaatagcagcatcatgaacagccagccgaagaagtgcaaattcgagagacaccgaatttgaggcgttcgacccgtattagaaaagcccaagagcgtttgggtctttaaaatggggagatgttgggtaatgtgtgaccaaagtccatttacatttccatttctcttattcactctctacccttcattattgatttaatgagtggactacatcccagtaacaaccacaactgaagtgtcaaattcgccaaagcacaggaaggggctaacatgtttataagggttcaaaccttgaatataaatacaggcttcaacagttgactatttttataacaacaagtttatccacaaaataacaaaagtaaagtgaataaaatgcgcatttgaaactttgctatcaccgtatctgatctaccataatcattaactgtttgccaatttcactcaatttctctctccatcagatgctacacaatgcgatgaaaaacacctgtgccaccagattttgttttggcattttgttcattaaaaatcattttcctaaagaattgcttttttgcttacatcttctttttacatgttaagaataatctatttaaaatgcattcttctcacccattttcgataaaattttagagtttgctataatgtaataaaaagttttaaattttcccaccacaggatttttttgaaaatttcaaaatttttaatggatttcagtggttttcagtttagtctgaaggactgatcaaaacttaattactcattcatatccataattttttttattattaataatacttgggttgtgccgtcagttttcactgatttttttgctttggtttttaccgtgaaatctttacaaaaaattttccatttcttaatctcagttccaatatcgttctcaattgggtttttcattgtgtcatatcccaaaaattcacaaatgtttttcagcacagcggaaatatgtatgcataaaattttgagttgaaattgcttggcattccgatcttaaatttgctatcatttgtttggacagaagaaaaattcacaaaacatttgcttaaattttctaaattaattccttccttatatttaaatagtgataaatataaatccatcgatgttctttgcttcaaagtgtgactaaatgtatcaatctgaaaatataaaaaatttaaaaaatctgtaaaactgatcttttgtaataatttcaaatggatgtatgaaaataaaaataattggtctatttaaatatatattttttccctttaacgaaaatcgaaaagaaagtttaaaaatttaaaaaacgtaaaatgaaacaaatttattgaaagacgaaaacataaaaacgaaacgaaaaagctaatattgaatattttttcacctttttatctacaaaataaatatatcgcaacattctttttt

SEQ ID NO: 5217 - DNA, 2614 bp, Heterodera glycines
ttttgtcgcttcgagcacactcatacttttgtcactttcgataatccacgcggaaataggggactgataagatccatataagaaagggcggatgtgcctcggtagattaatagtaaacctgccctcggaaagggtacttgaatggattccattcccacccgaggcttatcatttcatccatttcgtactgtagtgataaatagggatgtcaacaataagtacaaaaattggtcaaaatagattcataaaaacgtaaaaaagaatatccacatatgtataaaatcacaaaatatgtccgacaatatgctaaatacaatttttcaaaatggttattatatgaaaaaaaaatcttcgaaatcctgaaaatatgtaaaaaatacaacatatgtaccaaatatatataaactctaataaatacgtaaatataaatacataaaagtatcaacatacgggggaagagtgattcgctcgtcagaagtggattgtgtgtattacgtacaggtttagttactctgagatctcatagatatgcgctagagcactgtacaaaagaagctccacacgcaggggtacgacggtcaaagtaggctcaaaaaatgaactcccataaatattcacaaggggtccccatatggaaatgctaaaattaaattgattttatatttttcaattatataatatatttttattacaaattatatttttacgatttcgaaatgaaagaaaaaataattaactaattttttcagtaaccgagaaagagtttgaaaaagaattaatagtaattgtccatgaaagtgtgatgtttaatggacaatgctctttttttgattagagacaaatgccgtggatttggcattggaaaggcggagtgccaatctaaataaaatttaaaaatggctcaaattaaatttttacgttttgtaaatattttttgtaatttcttgtcaaatatttcctattttacatttaagacttcaacatcagcagcagaattttgatattatcagaatattttacgtcaatatctttttttcaaattatttttccttcaatcgcacggactcaattttaacgtttttcaaattttttcttggctttatgtctttttgtggtaatgcaggaatttttttgttcaaccaatttttcttttttaatttacgtataatgactcaaatttaaagttagtaattttatgattaaaaatacttaattcggtatattctaaattaattgcttcctttataaaatagttttaaatctttttgaaactccataacattttcatggtttattttcactttttaacgtctatcaagatgccgtcattgtatcatattttcttccaagaccccaaacggggagcagaagtaaattcataaaatagaaaaaaaattacccctaattttactgtatgcattgtcaaaaagcgcttgcgttttatttatgtatttaaatgtatttagctgttttgagccttcagcaagcttgtaaaaacaattttttatttcttaaggattaaaattatttaagtttttttgcttctttaaaatcctgctaaataatttaggtaaaaatttaacaaaaataaaataaaatttttataaaccgtactaatgcggcgcggtctctttgtttaaattgcacttttctcgaagtgcacatttttgcatttttcgcgaaatgacctagcacccatttttcgcgccagcccgagtttttgggttctgacttttttcattgtcgatcgaccaaatctaacaattttgtatcaaagtcaaaatttttgaaaatttttaacttttttacaggccagaaaatgtttttgttttctataaggttaatagagcatttgaagggctttcgaatgataccaagatgttagatttgactaacaaagaaaaaagttagagtccaaaaactcggactggcgcgaaaacgacctgcgcgaaaaagacttggtccgtttttataaatggcttagttgccaaatgttcatctttgcatttttgcatgactcactatatatttatattattaaaagaggttttttgaatttgtcagtataattataataattacaaattcataaaatttcaatttatgctttttgaacgaattgacattttttgtcgaaaaatgacaaagaagtatgattttgagaaaagccccacagaacgcttttaatcaatggaaagttttgactgaattttgaattggttgattatgattaatggattaaaattgaaattttagattaatcccagccctaagcataacataaactgctcactgcccaaacgtgtaatttgaatcgtaccgtaatttgactcgtttagtggtggagcttaattatttctatgagaaaaattgtgaaaaaaaatattagtattttaataaacgacagtgaaatctcatccatattgtcaatgcctgctgaggttgttaatatttacatgcataaacaattttgactctattttgaaatttgttcgagttcgggttctgtattcgaaataggtcggaatgtgtgttcggcacacatccgaccaatttcagtcctaaacaggcaccactactcacgcgtaaacgtaccccacgcgaaaatggccac

SEQ ID NO: 5218 - DNA, 5140 bp, Heterodera glycines
  misc_feature (92)..(92): n is a, c, g, or t
  misc_feature (128)..(128): n is a, c, g, or t
  misc_feature (143)..(143): n is a, c, g, or t
  misc_feature (149)..(149): n is a, c, g, or t
tgcatgcattgttttccattatgcctccctccctcttcccatcatacaatggcccggggggtaagcgccgaataataatggtggcacacaantatgtataaattaattatttttttatgttttgtaanaatggcggtttgttnaaccantagtgataaaatgggaatgggaagaacactcagcagcagcgccaaaaaagaaaaaaaaagtaattggaatgaaaagaatcggaaatgaatgaattaattggaatcaattaattaattaattgggggcaattagtgatggcgcaaaaataaaggccgccaattgtttgtccgacccgagagttgtgtttgctgcaatgaaatggagagaaatttggcgaattttttgaagaaaaaaaaatattacaccgcaaaaatgggaggaaaaaaatattggcacaaacaaaaaaattgcagaaattttattgggacgacgacacttttgttgacacaaaataaaatgaaaaacaaagatggggatgagatatgaatattatgaattaaaataataataaatattattattttcaatatacaataataataaaatgatgtgcgtcaccaccgagactttttcgggggcgtaatgtctggaggttatgcccgaaaaaggctgaaaaaaacaatgatgaattgattttatgtaaaaaaattttttttggcaatttttaaacggccgaggctatctgataatgagagaaaattttataagatttatattgttatagtgaaatgcaaatgaaaagaattttcaaaaaatagcaaaaattttccattcccaacctcattcgaaacagtatgccaaaaattcaaaatccttttttttgccacctctgaagcggcaaactgaatcggaatccgacctttgaaatcttcaaaacgtggcacattctcactcaatattaattccaaaatagtaggaattagagaaccggacgggatcgggatcccacgggattaatttccaaatcccgcgacctcgagacctgccctgagttttttaattcttcagaattggttgggatcgggatttaatcaggatcacgaatcgggatccctccgagcccagttgtctgagctctactaggaatatgtaataaaaaaagaaattcttttaaaatgggtctatgggtgacaaaaggaaaaaaacgccaaaattttatattacattcaaaaaaagaaaagaaattattataccacttttcgcccatttgtttaaaccaaaaattccagaaatattattgtaaaaacaatttgaacaatgaaaaatgaacgcgctaaatacacacacacacaaatttcgatcacagatttctcagcaaacataacaaaaaaaaaggcaaaataaataaatttacgcctcggcgaatgatttttgatgattttattttattttccattttcttttttttgtttagagagaaaaaagacgaccaaaattgcacaaggctgaaaatgaatgcaacgaaagaatgaatgaatgaataataatgatgaatgaacaaatgtgactaacaacggcaaaataaattttttttttaaacgaataaataaaagaattctcgaaaaactatcaagaagttttaaaggatcaaaaaagctttgaattatatatgagtaagtttaaaataaagcggcaccttttgtaaggctttttacattttaacacaaacaaaaaagaaaaaaattattaatttattcaaaaatgccgttttttgtgtgttggttaattttgtgtgaagtttttgattatttttctagggttccgaggctaaatttgagaaaaatagaatggtgcttccatgggaatttagaaaacgaagtctgtaaaaaattttgccgtcgaaatattggagaaaaaagtgccaaccattgatcatgttggctttgtggtgggtctcattttgtttgttaaatgcacttaaatgcccactaattactttttttcaatgaacttcttatgcacattaaagaacacaaaaatttgaaatgtgaactcttaaaaaataattaaattgagacaagatttgtttttggggaaaaaaattaactgaaaatgagtaaaaatatttctcccaaaaaaggggacaaattggtgtaggaaagcgaaagtggtgaatgaatatggagaagttattatgttacttacccttttatgaaagataataatcacatctttgttctgctactgaccgatattttaagtgtgggaaaatgttcaaaatttgtacacaaatatttgggcaaaactgctgagcaacaggagggaaatggtttaaatttgaacataaatatgagtgtacattttgccaaaaacataaataaatttgccaaaaaaaagaaaatcggtacaaaaaaatggtgggaaaaaagtgtcaaaattcgtaccggaaatcctgaacaaattggggtgaaaacaaatggaaaatgggatttgattagtcatcggcaatgtaaatatggttaaaaaacactcccagtagcagaagggcaaaatgcacaacattaattggttcgaaaaaaatcaaaaaaaaaaaaattaaattaattataatttgccaaaattaacggattgtattttgtgcaaaaaataataaaattatgcaaaataaaaattttattaaaattataaaaaaaaacgattaagggcgaatcctaaaattttaaatataataagacaaaatgaaagaaaaggcaaatagtgttacataaacggcgccaccgttttcttttcaaaaaaagggattattttttaattgctcaatttgagtgggcccatcccaattttctcagcaagaagtaatttttgtggtgggtgctgctggtatagcaccccaaatttgacaatttgagttccgttcaccgccctccgccggtggtggccgattgtcgggtacaaaacgatgacacggcacaacaaacattttttttgttggatgtcgtcctaatcccttagatccctatatttgcggtgagggttcaaacaaaaaatccgggggaaaattgcgcgcgcattttgtcggaaaacaaatctttcttttttcgaaaattttcagtatgggaacggagacggacgggcggacaattttaggcggaaaatggacaaaaagggacgaacaaaaagtcactcatcagcagataaagtggactaattgtcctccccagatttcctcacatccgtcaattcatttcattcattttgtgagccgaccgacactaaacggaggactgaatgaatgacagagtctcccaaaacgatattgaacaaagataaaatttgttggttggccccccaggggagaaagcgggggaagcgcggattaaaaatatttttgggtgctatggtggccacatagaaaaaagattaatgatggtttgtggcacatcctcaacacagttttagagatagatgagtaaggaagtaagtggtggtggtctctcatcacttaaaagttgtttagccaaagaatgatgggacgaattgggccggccaaattgtgacgctgccctgtggccaatccgaaaatctcccaccccatcttactcaatcaaactctgccgaatttccaaggccaaccaaaatatatttattctttccatcgcacttgaatggaatttaattgaaagaaattaggaaaaattggtggcatttaattttttggtccttttgcttttgtcctggaattcaagtacgcctaagggcaaatgtcccatggcctttgtgggttttaaggattatcattttttggtaatgataaaaaagtgtaataccttgaaagtttttaatcattctgacggttttcctaatttatacctatttaaaaatcaaccaaactaaaatcttatttgtcagcaaatttttttgtgaaattaatcattcatttcagtattagaaaaagagtgatttttgatttttaatcggattactcttaattcaatagaagtgcataaatttggtgtgtgctgcttcagaaatttcatttatcggaaaattttacaataaacctatcaatcaaataaatagtaattatcattactagcataaaaatggaggattgcttctctgacgtaaatgaattgtgaaaatcatttgttataaccaaagagtttttttgttttaataatcatgcaatttttaaaaattattttaaacaaaatcattaagaagaaaataaaattatttcaaataacgaaacattgaataaaattaattaatttattattttgttaaataattttattttacctttaaaaatattttcttattaattaaatttaaaccgtgagtgttttgttagatgatttaatataaaaaagacaatcaaaaaccaaaacttctgtgatatataagcaataaaaaaggataaataaattatttttttagaaaaaataattgtaaattatgtactgtataaaatactaaaagatatacaacctcatacagtaaatgcatatattgtaaaactcacaaatcctacacagccacaaaattgtattaagagctaaaaatacaaccaattacagtatgacggtttaataagcctatcccactgaataaaagatcaaaaaaacattgtccaacagtcaataacaaatgccccattaatgacacccaatcccaccatacagtatgccgtaaaacattggctaatcccctacagtataccgaataaaatgaactgactttcgttgttatgaagaaaaatcaacaacacaacaaaaaatatgaacgaatgaattcaaaatggatgtgttattttgtgggatttgtgggatggttggtggcggtaattgtggaagttgtggtgatgtgatgttgatgatgatgatgatgatgatgataattgtgcatcgtttgtccgtttttgaactgactgtgtgagaaagaaagtgttgacagaatgaagaagaaagaagaaaccgttggaaattgggcggggtgaaaatttgggcgccgggggggggaggggagaaaatgcgattttcggcaccattcccaaggtatcatcatcgcccccccccgtccccccaggggcggcgacgacggcgcggtaggcattttattcatttgaattcaatggagaaaggaagaaagaaagaaggaacggacgatt

SEQ ID NO: 5219 - DNA, 3252 bp, Heterodera glycines
  misc_feature (3123)..(3123): n is a, c, g, or t
  misc_feature (3231)..(3231): n is a, c, g, or t
tgtttattttacaggcattctccagctaccgtacaccaatgtttggtccatccttttcttctgtatggtcctctttttgggcatcgattcgcaggtgcatttttttgccactaaattctaccgtattatcactgtgtgtgtgtgtgtgtcggttgtttgattacagtatgccaaatacagaattttttgtccgcttttttaaattttccttgaatccatctcaaattttggttaaaatttccgagtaaatacttttccggaattccatcggtttttcgaactttttctctgtgttttccttactgtttcaccaattaattccagtatatcatcgtaccgtattttcgggtcggggacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcatcctcttatagcctaaagtctttgagtgactagatgacatatcatgtaagttgctgataggtttccagttttcccctcctaggtctgcatattgtacttttcctcttactcgacttaaaccagtaccaacccgagcttctcaacggatttataccatggcactttaaagccagcatcactgacaatgagcggtgtggtgttactcggtagaattctctcaaggtcgtttagaaattggtcatgagctttatttgaacattgctcgtaaagtgggaacgctttctcataaagagtatcagaacgaccgtgtagtgagactgaagctcgcaattccataagtcgtttttgctctcgaatatcataccagtcaacaagtacaatgggcatcgtattgaccgaacagataaagctagcatgccatcggtatacagcgagtcactattggtggaggtgacgcttacctaaccatccgttgatcagttcgacgttatgtctgctatggctctggttgcaaattcccccccccccccatcgcccctccttccaccaataaaagttttgcttttgtgtgatgcattttaagacggggcggcgattgcatttgaacaaagcacacataggagaaaaaaagccgcacaagaacaaagtaagcattgttaaggggaaaattgaacaaaaaagaaactttttataaaaagaaaaaatttgattcggcaaaaaaatgttataaaaatttgtttgaccaaagccgaaaaagcattaaaatgctctccctcaatcaatcagccagttgttggccaaattgatggcaaaatgatgctaaccctaacgggattcacgtgatcatgaataagtaagtcgttcgagattcccggtaccccgagtcagtctcactcgagaaaagagtcctgagttttttttaatcatgatctcggtttttgagcgcctcggggcaagtttcttggtcttgaaccccgaggaattttcggtcttgaacttcatagaaagtatgaggttgaattttcaggaatttaaagaagcattaaaatatttgaaaaaaggaaatagtcaggattttgttttagatataggctcagtttgtaggagcaaatcagattaaaagaaattaagattaaagcataattgcgcaaaattcaaatattgcttgaaaacaaatgtttttttttgaatgggtgtcgttttcgtagtgacaagtgaccacaaaaaaacgattaaaatatttctaatcatttaaagcattgttacgattgaatacaataaaagaaatttttctatttttcctaaacattcacacccacccgtttttacacaaaaatattatataattttttagcacgattgtgtgatttttagtctactaccatacgcgaatgtttggtgagaagaagaaaaagaacgagggaagaggagaggatgaaatttttaacattttaagaaatagaaaaaagaaaataaaaaaggacttaatgaaaaaaatttaaaaagaaaatacataaaaaacattaaaattttaaagaatttcaataaaagtttaatagaaaattttgtttcaaaaatattattgaaatttctcggaaaaaattaacattaaaaaaataattacaacaaatattggaaaatgtaagaatttttcttaaagatgagagggattaattgtgtagaagaattaagcgttttaatttttttaatagaagaaaactgggttatttttttttccattgttcttttttttaaagttttttttttataaattgagagcaaagattgtggggaggaaaagccttttcattcgttgcatttaactcatttgatcgtgtaaaagtggcgacaaatggaaaacgaaggagaagcaaatttttaattttttggtttaaaaaaatgtaaaagcatattaaagctaaaagcaaagcgtttttttcgttttttagttttttgtcaaaattagaggaaattcgtacaattttaaattaaaatttattttataaaagtgagcaaaaattggaaggaaattcattctcttttttcaaatttagatttttttggggtttaaaaaatttttttttaatataaaatcatatttaaagccttaaacaacagcgttttttttgccaaaatcagatgaaactttgtacaattttaaattgagaattaatttttgtaaaagtgagcaaagattgggcaggcgcattttcattcatttattcattcattctcattttggcccattgtttgattaagtgacgacggcagaagaagaagaggaagaattatataaataaagagaaagaagaattgaatgaatgaatttgaacaaatgattcgcccatttatttatttataaatttgaaattattgtgcaaatttgcggcgattttaggggggacgaggaggggaagggggacactttgtgtacacaaacaattgaaacgatgatgatgattattgtgatggacgaaggacaataatttgtgttgaggagggggagagctgcagtataatatttgaataattttgaaatgacgattagaaagagaagaatattttgaattcgttttanatagttaaactattggtgagtgctaattaatttttttttggtgtgtcaatcgattgatcatactaattaattaattagtgcaattagtatgtcttacccacagactancagtgaatgaatgcagtaatc

SEQ ID NO: 5220 - DNA, 1334 bp, Heterodera glycines
atgattgattttttgggatggtcggatcgattgatcatgttaattagcaattagccttttattgccaacaaggcttatatctgagtgcactagtgatccagaaaagcatttgaaactaattttcttaaaacattttgattatgttaagttgtaaagtgacaaaaaagaaaatgaaaaaattacagtaaatgagaaaagttttttaattgctgcctcatggtcatttgcttgaacccaattaaattaaggattcattaccagaggcagcaacgacagatgtttttatgtgtaaaaatgcggcagtggtaaagtgtcaattacagtacaaatatcgattaggttacattgcaccagactaattaagcattcattagtagcacaacaacaggtggccaaacaacattagaattccataataaatagatgtgccttcggcactttagtggtggggggcgggagagcaatgaattggaaaatttatttccaaaatattattgacgcgtattttcaaatgtgcggcggtgcgcccgccggtgcgcaaaagccaatttctctccattttttttgccattggcaatttgtttcccatttttgtgttctttttgtaattttccgacagcctaaatttgcagcaaaagcagcagcaacaattcttcccaacagcagagggcaagcaaaaaggacgacgacgacgcccgaggggtttttcctcctttctctttttttccttctcatttttgtccatttctttgttccacggcacattgtgtgcccccgggtgtccgcccaattcattccatccaattcattcattcccaccaattcttcttcacccacccgctcccctttttatgtattatgtattcatcccatcccattcattcatttattctttcattcttttcatcgcctcgtccattgtattttggcatccccattcatttattcattttgtgttttgccaaaagatacaataacaacacacaatgaatgaatggtgcagcagcagcagcattttgatgaatgaatggcatgatggtaaaggaaaattcgccttttgatggcactgtttgaggaagtgcccccccccaatgtccaaccctttgggggcagcgttttgccatgggttggaatgccttccggcgacgaaaaatgtctgggtggtgggtgagaaggacaagatccgtgtaagtatactggtgatgggtgtgaatgctgaatagtgaatgtccgaccattgtaggaagctttttcggagggcagcattgcttgctttgtatgaatgacattttggaggtgacaaaagccgtgatcggaatgtgccgttggaagga

SEQ ID NO: 5221 - DNA, 2167 bp, Heterodera glycines
  misc_feature (2112)..(2112): n is a, c, g, or t
  misc_feature (2128)..(2128): n is a, c, g, or t
agtttagaacactttttaagccattatacggtcatttagagtcagaaaaaaaagtcattgacttaaattcccagccctaattattagggaaacggcggcggttcaatgggaaaatgacgaaaattgggacgccaatttgaacattgtccaatttgatctgtggtatggcaataattggattgggagaacagcgaaggtcgaggcctaggcttaggcttgcttgggcctaggcttaggcttgcttcggcctaggcttaggcttgcttgggcctaggcttaggcttgcttcggcctaggcttaggcttcagcttaaaggcgtgggcgggtggtgatttagtgatttgtgttcagcagacaaatctgtgcaaatggttgtgaaggagaagacgcaattgatgacattttgaagaaaaaatgttaaatttcaggacggattttttctcattttcacaccaatttttaagttacatattttataataaaaatttaccactattttgtttttatttcaagtaaaatataagcaattttgatgcttttgattgaatcaaaagtgattttaacttttttggaatttatttaattgcttttaaagaaaaaattaaaaaatgtagttttggcataatgctcattttgaaaccttttgaagaaaaaaaatgtacattttctggatgattttttttctcattttcataccattcaaaattttcccgccttctgaccacctattccctggattttcaaaattttgccaaaacttggtttgtcgaaatctgttataataacattttttgaaaataatattgcaaaaacatagtgaaaacaatgcataaataaagtgttttttagtttaattacctaatttctttttcgcaatcacaacttacgacaaaattgtttgcttctaattgccgcaaaatgaaccgacgtttgtggaaaatgtgaggaatttttaaatgatacgattttcggcacttttgcagtttattgggcccttacgaaaaaccacagggatgagagattttgaggtaaaatcattagtaaaaaccaactcgtactgtgaaaaaaaacaaggtaatactatagatggtggccccctttttgagaaaaatttttttttgttctaaaaactcgtgaaaacatgtttatggtggttttcgaggtcggagaacccgaatccaacattaattttgagcaatttcgaatcccggacccgaattcgaacaaaaagttgaaaaaatttgtctcaaatcgtagcacgagttgggtttccggcttttgattttgtaaattttcaaaatttgctcaccacttttgcgtactgtgaaaaaacagaaatttacctcaaatcgcagtacgagtttgcggtttcaggcttttgatttgtaattttttcaaaattacctactccatacttttgtttttcattgggcccttaaactataaaaagtgccaattttctctttttaagtaattttttacgtttgcatttcagttggatttgtggcgacgtttggatggacattctcccatcttttgaacgtgctgaacttggcctcaaaattgcattgctttcttaccgttacgatgctttgatggacaaacattttgacggaaaaaaagaattgacaatttggaggacaatcaaaatttgcgacggcattggcccagaaccgaaattgtctgtacagatcgaggacaaaagggtggaatttccatttcccgactgtccgttgcccaacaaaatccgctttaagcatctttggattacgtaataacatatataattgtgtgtttactaatgcattttatatttcttcaggtacattgaccgctccgtcattgaatttctccgtgccaacaaacaaatttgggacagatgtggcaccaaattggagttgtctattgataatgaccaactgatttgggatgttttttgccgtgaaatttggccgaattttgcgacaaacatccgccatttgagctttactaatgacaagcatttggacaatttgcgccatggcatttcactgacaattctcactgatcttgatcaattgaattcaatcgattctggacttctattacccgatggaattgctgacgacggnccaatgcaactgctgngcaagcattgttcaaatgggtgcacactccgagcaaaaa

SEQ ID NO: 5222 - DNA, 3675 bp, Heterodera glycines
aaaaatttgcttcacaactttttggggtcggtggaaaaaacagaaaatttacttcaaattcccagtacgagtttgcgggtttcaggcttttgatttgtaattttttcaaaattacctactccatacttttgtttttcattgggcccttaaactataaaaaaagtgccaattttttctttttaagtaaattttttacgtttgcatttcagttggatttgtggcgacgtttggatggatattctgccatcttttgaacgtgctgaacttggtctcaaaattgcattgctttcttaccgttacgatgctttggtggacaaacattttgacggaaaaaaagaattgacaatttggaggacaatcataatttgcgacggcattggcccagaaccgaaattgtctgtacagatcgaggacaaaagggtggcatttccgttgccggagcgtccgttgcccaacaaaatacgatttaagcttctttggattacgtaataacatatataattgtgtgtttactaatgcattttatatttcgtcaggtacattgaccattccgtcattgaatttctccgttccaacaagcacatttgggacagaaatggcaccaacttgctcattcaaatagaatcagacacaaatgttatcaagccgatttgggatgtttttaccagtgaaatttggccaatttttgctaccaacattcgccatttgagctttgccggtcactatttggacaatttgcgtcgtctcgtttcaccgacaattctcactgattttgatcaattgaattcaatcgattctggagttctattacccgatggaattgctgacgatggaccggatgcaactgctggccaagcattgttcaaatgggtgcacactccgagcaaaaatggccaaccgaagcaattggtttgtgcggattatgacgaagaagtgaacatcgactgggtcaacagtttcaaggaggtgtgtttgttcacattctcataaaatttgggtatataccgctggtaccactcacttttttgaaaaaattttcaaaatttttaatcagatgggtcaacaatttgaaagtggtgtgtatgtgtgtggtcggtcacataaacgattgactgattgattgcctttgattttcgcttccttttttaggcatttctctgtgccaccgcttcagtcagctataatatccgacttgaactttatgattcgtcgacgccaattgagccatttgaattgatgaacgaacggactaatgagaagctgacattattacttgttggagaagatggctatgaattcacagaaaaactgttgaagcgatgtccaattagtgaaaaggcggcgacggatcaatgggaaaatgaaaaaaattgggacgacaatttgaacaatgtccaattcagtttgttgggtggcaaaagtgggtaagtgaaagataattcacagttcacacctaatttgtgtttaattacaggccttatggccaccagcggatgaagaaaaagaagcgggtcaaagcatcgaaatatcgtcggactgcgcggaagtgaattaattatatttgagaaaagccgatctcacacaattggaatttgatttgatgccatcattttctctcagaaatgcttttgtaatacatttatttgcttgcttttaaatgaatgtttggttatatgacagacacagcaatatgtttcggattacaatgaagagattatccgcaaagtttgtattaagcgagccattcattttttaacgattaaaatagaaagtaaatgtttacctgtttttttctcaaaataagcaacagaaaaatgttaattctaagtagtgatgttcgagagtctcgactcgagaaaagtctcggttttttttggtctcgagtctcgggttttcagtctcggtctttgagactttcgagaccgagacttttttacacccctaatgatcggctttttgtttagaaataaatatacttttggtatatttttgcttcgttaccttaatagtgtgcgtggctcagtgggttgtgttcttggtcatgtcttcattttagcgttggatcagtacccctccaagtatttaatttttcttctaatttttcaaaattattccttttaaagtgaatctaatcaaattaaaatcataaaatattgtcatttttagtactaaatttgttcacaaattgcactcaaattttaataccctttatttttttaaattgacacaaaaactgcgaaaaaatcaaactaattttttgttttgtgcttttttgaaatgataaatattgtaccaaattgaatcaaaataaaaaaaaaccaaaaattagttaagaatagagtcaaaaaaaatttttaaacgatttttaagcgaataggaaaattttttgaaaaaagtctcgggtctcggggttttcagtctcggtctcggggtcgggtctcggggtcaagtctcggtctcgagtctcgggaaattttcggtctcgaacatcactaattctaagaaatgaacccaaactaaagggcattgtagccatttgaattgatgaacgaacgactaatgagaagctgacactgattaaggatgaatatggagacgggctgttgaagcgatgcccaattagtgaaaaggcggcgacggatcaatgggaaaatgaaaaaaattgggacgacaatttgaacaatgtccaatttaatttgtgtggtggcaaaagttcgattgggtaagtgtggtaaacgataattcaattcactcaattcaaatttcacttaattttaggccattggccaccagcggaagaagaaaaagcggatcaaagcatagaaaatgtcgtctaattgcgcggaagtgaattaattatatttgagaaatggccgatctcacaaaattggaatttattgcttttgttgattttttttctttaatacatttgtttacctgctttgttgctgtgcaatttctttagaatcaattgaaacgattgtctagagaatttggtaatatgtagttaggtaatatggttcattcccgcgtttagtaaaaaacaaaactcgaaatttccaaaaaaacggccagccgaaacttcgcctggacataacgtcaccgtaaaaaaatatttagaaattacaaaggcttttggtcggtccagtggtgctgttagttttcgacagtgattgatttcgacagtagaattttgtttttaaaaagtatattctatgtatgtatatggttatagtaacttgttagaatttaaaaatgtaaatgataagcgcaggctctcatgtactgcagagggtcgcgatttgcgaaatcggctacaagggcttgcagatttgcatcttgacgctgatacttcgactttcttttttcatacggcccccttattccatttgcgggagcaacttggaattcagcaagacgggttcgccacatatcttcttctgctacaatttttcggcaaaatggacttaagcgctgtgttccatttaaatgcgtgttccaaaccgaatgccatccctttaaattcacagaaatcccgaaaaatttttttttaaacctctaatgaattgttgcttctgctgagattttctgcaactcggtctacaatattccacaaattaattggaaaaagggcagcctgttgtctcaaattgagcacttcaatttgacccctaa

SEQ ID NO: 5223 - DNA, 990 bp, Heterodera glycines
aaaaaagtttaaaatgtatagctttataaatgatctctttaaaatacgtattatagttgaccgttgttgttatacccatgatgtatatatgttatatagaaaaattaaacaattttttcgcatcaaattaataatattagataatcaccaatttttgaataaatattatattaagcgagttctttctgtaaatatttttatcgttttgccagttttaccaaacgcgttagcacttccccgcttatattttgtgttaaaattaaaaaaggacggaggcagcagggatgggccaaattgaaaaataaaaagcgaaatgggaaaagcgaaatttgggaaactgaaaaatgcgaaatgaaaaaaggacggaggcaggtgtctaaaatacttttccgttatggttagggatgatatttataggcactaaaaaccgtcaaaataggtaggccttaggctctaaaaaacccccaaaataggccctaaaaatggaaaataggcactaaaaacctcgtttttaggggtgtaaaatgacaaaatgtattcaaaaaagtaaaaaaattaggccaaatcagtactgagatatataatttttaaagcacaaattattgtcaagaaaataaataaataaatttatgatatgaattttcaaaaagtttttcatttcttataagtgtatttttgaaaaaatttcgggtcgattcttaagggtgtattttttttttaaattttagtcgattcttaggggtgcatttttcgtttttattgcatttttgttaataattttgggcaaaatgccaaaataggcaaaaataggctctttcaaaattttttaggctttttaggcgctaaaaataaaagcctagaaaataggcactaataactcgaaaagtagcttaacaacagcccaaaaaaacatgttttttgtgcgtttcaggccacggagagctcaggaaaaaaataggcttttgcctaaaaatatcatccctagttatg

SEQ ID NO: 5224 - DNA, 2415 bp, Heterodera glycines
  misc_feature (2259)..(2259): n is a, c, g, or t
  misc_feature (2272)..(2272): n is a, c, g, or t
  misc_feature (2374)..(2374): n is a, c, g, or t
  misc_feature (2377)..(2379): n is a, c, g, or t
  misc_feature (2389)..(2389): n is a, c, g, or t
gtgctggcgcgtttgttaaaactgccagtacgataaaaatataatttatatattttacattttaaaatattaattttaattaatattatatttaagactgacgtattataataaaagaatatgaaaatatttgccaacattaaattatacatttaaaacgattgataaatgaaaattttatctaaaacatatatcctatcctatctttaacaaaaaatattttagcaatttcttttaaaaatggatacaaatattttattgtgatattggtgtcgacttaagcttaaggactctggatagacatctttcaaaaataaggagtagaaaatcagaatgttcaagaagatatgtaaaaggcagaagtgtcccaatgttactcaaaatttgacaagttcctctttgtaattggccatggtaatgcgtatcgaacatttaaacagactaatgaaagggccggcaccagggatggcattccgaggccccaaaatttttcggaaatcggaattccgaggcccaaaaatttttcggaagtcggaaatcgcgaattccgacgaaaaagtacaatggcttagcctttaattaatatttggcactttattaatttcataaaatagaaaaaaagaatattggaccatgggagagtagcaaaaaataatttaaaaaattctaataaaatttaataatttaaaatcaattatctaaatttgctaagaatcaccttttattattttaaaaataaatttttgaaagcccatttttggaaaaaaccgcttttttatggttacatttacaaaaaaaatattttacattttcccccagaaatttgtatttttttaaatattcccaaatcgaggcggttcatttaaccaaagtggaccaaaaaccgaaaaactattggatttttgatgaatatgaatagaaaaatttatgaaattactgtaaaaaatttaatctataaggaatttaacaatgaaaatatttagttatttaataaattcaattaaagttttcaaattcattaaaaaagaaacaattaaatttattctataaaaattttcctataaaacaatcatttaagattaaaggaaaaatagtttaaaattttggtatttccaattgatatttaaaagtggccatatcgtggaataaatctaactgtgaaaaggagcaaaagattaattagaatgctaaatatttaattgattgtttgaaaaattaaaatattaaatggaaattaataagaattattaggatggaataaaaatattttaaatgaaaaatttaatttttgagtatttaaacgaatgtaaagagctcttgtaattattatttataaatattcattatttttagaattttattcaaataaatttatgtaaataaaagaagttatattaagcttttttaatatcttcaaaaatatttaaaaaagtgcttctaggttagattatatttaaaacaattctaatataatgagtttattaaaataatttgataaagaaaattgaaaaaattaaaatgtaactaaataaatcttgtcatatatcatatcgaagtgaatgaaaagtcaaaaattaataaaatatgaaaaaataaaaattaaaaatgatattcgaatcgataaaatttatttgttttacgaattaaaatagtttatgtgatattttccactttttaatacattattcattaaacattaaataaatatacgaaataaacttacacttaaatattgaaatgtttttagtaaataataaactataatgaaaaaacaatttaaaaataaaaataattgtcgataaaaatgggtgacggagtgacgacgaggaggaaagcgttggcgaggaagaggggatgaggaggaaaggaagacgagaaatgaagaggaagagagtgtgccgagaagggaaatgtgtgagtcgagggggggaggacagtggcggttagagccactaattgaaggtcaccggaggggcagcagatggaagcaaagcgacgggaaagagaaaataagggaccatatcttttttagcccaaaaattaacacattttccgagaaaaaatttaaaaattggtatggactaaattatataataacgagggctgggaatttggctctaggaaaatcggacactggaaaatcgacaccaactttaaattttaaaaataattttttgattctttgctttaatatttaaaatacatataaatttagcataaatacacatcacaaattacctataaaaatggacaatttanacaaatctcttgngatagggattatgctttctttacgtaaaaatagcaattggaaaatgcgccagtaatacagtattttgtaaaataatattctgtagcaatatgtaataaaggntannnctgtagtcgntactgtaagtctgtttcttactgatt

SEQ ID NO: 5225 - DNA, 2633 bp, Heterodera glycines
  misc_feature (7)..(7): n is a, c, g, or t
cggcatntcatcggcgaaatgaatgtccagcgacacctttccataaaatgagaagtcaaaacccaagcaaaatgtgaatcgaattaacacatttgaaactgcgacatgtaaccggagggaagtgcgcacagcgtctcaagcaatttgcaagcggccaagaacagctgcatgcactgctcgtcacgcaccgatttctgttcatcaacggacgaagaagcgcctccggaactgcttgttggtgttgttgaagtgagttggtggtcaatttgtgccagcacatggacctggacaaaaaatttaaattaaaacaattttactatgaaattggcaaggcaataaattaggaattaattattaatatcacaccaattcggtgaccatcgacggccaaatggacacaaatgaactgggactcatgcggaccaacagcacgcggtagcacgtgaacacctgcgtgtggatcaccggcacttggcaaagacgtaaattttctgtcagccgttctgcaaattggcaattcagtaaaaacggtcatttgcaacgacaaaatgccatgctagataacatttttttcttaatatgccttggatttcgtttaattggcccgcatattggtccagctccgagctgagaatgacgaacgccagccgcttcaggtactgggcacgcatctcgtactcctgctccttgctggtgatcagtgttgacagagtggtcgacgtggaggtggtgatccgcgctgaatttttccgtttatttttacaattattaatcgttctgaatcaatttttttgaaacatggtaaactgcttatacgtcttgttggaaaatctgttcatgttttctttttttcggttcaaaaaccaaattttatttcattatgtttgctaaaaatgcaaaaaccgactaagcaattccttgaacgatgttttgtcgttggtcatcaaattgtcgattacgatcagccattggcgcaacgcgtggatgtccattttgaagaatgctgcagaaaaaaaggtaaatgatccgaattgtttttgaatttttcattattcccatacaattgtcccacagcaaatccatcgcatttttcttccacaccgaacgcatgtaattgtaggaactcatcgaagcgagaaattgtgaactggccaagaaaaagcgcacattcttagcactaaaaacagaaaatgaaattcaaaagcaaataaaagggactaaatttttcggaaaatgaccaaaacaatggcaaatttatcattttaggcaagtatctgcaaaatttgtaatttttcccgggtcaaatttttaagaataaaactttgggcaaaaaatccattcgaatgtccccgacaaaccgtaccttttgggagcaggtcgtcccccccccccccccccgtcgtttccaagaatttttttatgaaaaatttctaggtttgaaattttttttttaaaatttttcgggggggaaacgaccggggggggggggaaacgaagtgcacccgtaccttttcgctttcaaatagggcaatgtgttgttccaaactgcttgcagtgcgggcaacagtttttctttgtcctcacttttgcagaccgagtcgataagttcagccagattctggaagagtattaggtatcagatttaagtagccgttaatttgattagccggccggctaactactgacctcagccagcagaaacagcgcctgcgtcgagtcggacgggtcctttttgttggccgcaccgccgctgctgtctttgatgctcgaacgcaacacggaggcggaagacgaagcagcgccaccaccggcagaggttgtggaaggcaaagctgaagtgaaaaattaaataatttggcagagaaagcagttcaaaaaattaatgcacagaattttccaagagatttttgggaatttcttttgtggatacattccaaaacgtcgcctggacataaccgacgcaaaaaaaaaaaaaaaattttttcagatttttccctgctcccttcttttgtaaaaactgcaattttcggaataaattttcaatataacaatatgaaattccaaataggacaattcaccggcaaaattaaaatgttaaaacgatgaatttgtcgtcactcgcctcgtcctccacctgacgccgttccaacgccacaactgctcgccgtcaacgactgagtgtccagcggcgcagagagtcggctcggcggtgcgtgcgtcgaagtggcggcagtgccactgccagccccaccaagcccagcaccggtcaacgaaatggtggagccacgcattgaattggcctccgatgccaatgccgaggcggatgagaaaaactgcgccgtcgccgcagttgacgcgccgccaacggaagagacaccgccgagaacactgccgccggcgccgctccgctgctccaacacggggctcagatccgacgagggcagcgttttttgggctttaatgtaaaaatgggatttgaaaataacaaggagagaatgttaaattgagaccaaatttggattggtatgtttttctctatttgttcaagaaattccattcacgggcacccaatttacaattggttcccgttgtacaaattgaaaaataaagttataaaatggggtcattttttg

SEQ ID NO: 5226 - DNA, 4743 bp, Heterodera glycines
  misc_feature (51)..(53): n is a, c, g, or t
  misc_feature (64)..(64): n is a, c, g, or t
  misc_feature (70)..(73): n is a, c, g, or t
  misc_feature (77)..(77): n is a, c, g, or t
cgatgatcgactgactgccgcaacggcgcacaaaatctattttaacagccnnnaaaaaaacaancacaannnnaaancccctctatttaaacaaaaataaactgacgcaaattccaaaaaggatgctcgggcgggcagttggacaagcggtgagtcgttgaagagaatggcaagcgcagcccacgactcgcgcagctcagtgaccgtcacttggcgagtgcattggtgcaacagctccaacagagcaacctccaaactgaacccgccgacgcccaacttcaaaagcaacaaatttataaagaaaaagtaaatgaaacgcatgccttttcactggagttagccgatgatgctgaagatgatgattttgtcgttttgttggccgactccttcagcgtgtcactgaccgagcaaatgatggaagtcagcgacagggcattcaaattaagcgccaaattggccacttcaatttgctgggcggagtaatcgaaggagcactgaaaatgcagaaatggttattggtagaagttcaaaaagaatggagacactttaaaaaatgccgaatttcttactcggcatgtgtccgccattttggcacctcctccgtaactgttgcggaacatccaaacgacgcccaacgaattgatcagcgcatttttgtgccgctttgctaccggattaagaatgtccaggatgagtgtgctcaacgactgaaaagacgttgtacagattgttctctgtttatttctgccccagcgtttcattggcaatttttataaaaataaaaattgtatatttataaaaaccaaaagctctctaaataggattaaataccctaaaattttgtccgtcctcctctccttactctgaatgtgccaacttttggcgtcgaagtgtttgttgaacaaaaactgcccaatgctgtggcgcctcccttccgctgctgttcagtgaacgcccatacgtcgatgagaattgccaacgcactgggaaagcgtttgatcagctcccgctgtgcttctaacatttcagccgatttgccactggcatcggtgcgcgacgcaatattcgatggattctgaaaggatttttttaatccagaattagcccgtttttgagattttgtgccatgcctcgcccgacgtgaacacacggccgaacaggttgttgatgagccctgtgcctggaatgacggaaatggcagtgccaaccatgctggtcatgttggaagacgaaaaggtgccgccgccaccaccaccgccggcacccatggcggatgccgcaagggcagacgaagaagaacgaagcggagtcatcgagccggccatgggtgctgttgaggatgtcgaggattgccggttgaaatttggtgttgcaaatgggtaggccaacgcggaaagcaccgagtgtttggtggaggccaaaaacggggagagcattgacgcgttgcgcacatccaacagacaaaagtgcatgatggacatcagcgattcgagcaactaaacagaaacattcatatttgatttactttataaaaactcatttagtttcaagcgataacaataattagtatcaatattgtctcatcattgccctttgattggttcaaattagggttgcgcggtaccgatactggtactgaaaaaacggacaactgagtacctaagtaccggttccgaccggcacttgtaccggtttttcaacccgaaaattaccggtaccgtcaaatataaaaaattgctctttggagaatgtggattttttggatcaatagcaatttatatttttacttgaacaaaataagaaaaacacgataacatttttattttctgaaaatttcagtagaaatttcttttttaaattattgtgattttaataaaaaagaagtgcaaaactaaagaactcttacattcaaaatgtaattggccgggtaaataacggttggcattgtgccatcgtcgccgactgttgttgccacgtcgttggtccgattgatgcggtagtccacaaattgaatgggatttttcggatgttccatcacggaggcacccattggctgttgactgttgctgaccaatgccaacgccgcactgttcaatcccgccacggaagcggtggagccgttgatgaacacacattcgtacagatttcgacaaatctgctcaaccgtatgcaccacaaaagtggccaaggctctgaaatattgttttcgataaacagaaagatgcgtataaaaaagatccaaaacctgtccaaatatggcaaaatcccgacaagaaaatggagccacagttcatgccttgccggacaccgtttcaacgcgttcaaaattacgccgaggaacaggcggagctcaacgacggagtagcgcgcctcacgaatggtggaccgattttgggaggagttgtagttgatctggttttcagtgatctgagaagatggagaagcgttgcgattgatcggaagggccaacaaatgggtctgaaaggccaaaatatattattctttgggagaaattttcatatctttataaaatgaatagaaaaaactttgatttgatggaatttcaaaaaaagaacccataaaaagccatggaaatatgatgtttcaacctgagaagagaagtgccgagtgccaacatgaagactgtactcgagcaccaccagcgcggaggccaaactgagcagcgaccgatggtaggcaaagatcagatcgcgaaaatgtttgctgtgtggtggtccgttgttgaactccgcaatgtccattgagagaggcatcctgggaaaaagcaattagttaattataatttgaaaaaataaaaacgaaatttatggggaatctggcaaaaataggcgacgtcaaatgccagacaaaaaatggggattttattaaaattaaaaggtttttacaaagaaattcgaaaaattttaaaatgggaaaaattcaaaaaatggaatatgccgctaaaaatgggagaaaatctgcatcccggaaccgaaccaaaccatcattacacacctccaccctttttggttcggtggtgtcggaatggcggccaacatcagagtgagaatgactttttgggtttttgtctgccgataaatttgctgcacaaatgtggccaattccttggagctggcctccctcacagtgtcgtcaagaatgtgcagcaattccgtgaaacagtcgagggcggcaatctgtgaacgatcgagggaaaatcagacttttaaagaaataatgctgttcattggttacagatttagaatcgttttgcatccattcgaacccatacccccaaaattcatcgaaattcatgtttctaaatttggcccgaaccctaattggatagaacaaattcagaatcggattcgtcagtcctgaactatttataatgacaaaaaacttggtttttctaaaaaaaaggaaaaaggttcaccatctaaaatattgacaaatttttttaatcgaaggctttgtaaacagcgcgaccttacacttccacgaaaggaccaagtcagtctcggaaacatggttgatgggcgagttcaagtagtaagagcggaagaaatacagcacaaccttataaggcaaataaatccaaatttcagcaaatataacccgaaaagataccgttgagaaaatttcgaacagagtcgagtgccgttgttgttgcccggatttgctttccgaacttgttgaagtgacagccgctgtcccaccactaccaccagcaatgccatcctctttcttctgtacactgaagttctgctgatcatgtgccgtttctgtacaccaaaagccgtcgccctggatgtgttggtagtggcgtgccatgaagtcgagcagttgctgagtggctgctgtggaagcgccgccaatggtggccatgctgttgttgaccgagttggtgccaatgtttgacaaattgccgcctccagtctttccgctgctggtggtgccggtccggttgaccagctcggacatgttggtgaacagcatgctgttcaccagatgacggcccaacccgttgccactgcgcaacagtgtgcccatggtgcggaacagcttctcggcacggcccaagtcaacaatggacggactctcggcatagaacagcatgtgagagaatgtttcgtccagcaacggctgcttgtggtcgccgggacatgtcgagttgggcaactcggtggggtcgaacaagcgcaactcctgtgtgccggtgctgaaaatggactcctgcagcgagtcctggcgccggtgccccgttcgaatccgtcggatggtgtccccgccagcgtaggaagtgatccggggcattgccgctgctgcgtcaccgggtccgagcagtgagccgaccaggcttgtctggtcatacgttgagtcgcgcgcagcggaggaagcaacacgtttccgtttgtcggcagacctaaaaagatgaaacttgtaatttacgaaaaaatttcgatcgagcaaattattcgtttttggcaaatttaaaaagcaggggaagggttgtgcttgtagggtgcactacgtttctcgcccctgctgccccccccccccctgtatcgttccctctaagattttttaaataaattttcaaacgtagaatttccagaaaaatcttaagaaaaagtttcataaaaatttctatcgtttgtcttaaattttattatgaattgtaaaccctttttcttcatccattttgttagattatttcggtattcccataccttgccgatc

SEQ ID NO: 5227 - DNA, 1341 bp, Heterodera glycines
  misc_feature (33)..(33): n is a, c, g, or t
  misc_feature (1286)..(1286): n is a, c, g, or t
aagtcacaaatggacggactctcggcatagacnagcatgtgagagaatgttcgtccagcaacggctgcttgtgtcgccgggacatgtcgagtggggcaactcggtggggtcgaacaagcgcaactcctgtgtgccggtgctgaaaatggactcctgcagcgagtcctggcgccggtgccccgttcgaatccgtcggatggtgtccccgccagcgtaggaagtgatccggggcattgccgctgctgcgtcaccgggtccgagcagtgagccgaccaggcttgtctggtcatacgttgagtcgcgcgcagcggaggaagcaacacgtttccgtttgtcggcagacctaaaaagatgaaacttgtaatttacgaaaaaatttcgatcgagcaaatgtttaataagcaaattattcgtttttggcaaatttaaaaagcaggggaagggttgtgcttgtagggtgcactacgtttctcgcccctgctgcccccccccctgtatcgttccctctgattttttaaataaatttccaaacgtagaatttccagaaaaatcttaagaaaaaatttcataaaaatttctatcgtttgtcttaaattttattatgaattattatgtttttttcaaaaaattttctaaaaagtcgctgcttttttttgtaaggtttttgttttgaaaaatttcaataattagttagatttttttaattttctgggagggagatcgatacgtgggaatgggtggaaaagggggtggaaaacgaactgcttccgtttttgtaaaccccttttcttcatccattttgttagattatttcggtattcccataccttgccgatctcgcagtacgatgcactattaatttcatccgccttattcagaaaaaaattaaaatggcaattatcgacattactgatgccgtgtgggggaacattctcccatttattgaacgtcctcagctcggcctcaatttgtcgttggtttcccatcattttgatgtgctcgtcgacaatcaattcgattctaccgaattaatcaacctaacagaactcatggtctgccgtctttttccatgcactgttgcggggattgcgattatacaacacattaacatccgcaacaaaacaaaattccccatgccagagggaccgctgcgccaaaacattcgcttcaccacactctccatcaggtaaattttcatgttcctttacattcaaatgcaaaaaataacaatgtacacaattgcctagtttcctcgaccgagatgtcatcgcatttctcaattccanccagcaacacttttacggtggcattgctctgaggttgtgcggctgttaccctcgg

SEQ ID NO: 5228 - DNA, 4229 bp, Heterodera glycines
  misc_feature (64)..(65): n is a, c, g, or t
tcgggtcgcttccgcacgacgcagcggtccatgtggtcagagacgtggacaaagtccacttgtnncagtgtgggtcgtcgaggagcgcgtggaatcagccggagtccgtgtgtagcgaatctccgtctggcccacacgctgcgcaagtttccccctgtaggtatcttttttttttcaaaattaaaagccaaaaatctttaccacaaggagtttgccaaggttttggcaatgaggcgcaggccggggttgacctccattttggacgagtccaaccggatgtcctcagtgcgctcaaagtcctccacaaaggcttgacgctgctcttccgtgacacacccctcgggccaaccagtcgcctgcactttgagaccgacgaacgtgttgacgtagctgctgaacagcgtgccgtcccactcgtcgtagtcccagacctaatttgtgttttcgtgcacaacatttttttttttttttaaatgagtgactacctcaaataggtcggtgaccacatagccgagctggagtgccttgttgagttcgacgtgcgtgtaggcggtcacccacgagcgcctgtcgtctccgtggcggcacttgccggcgcgctgtaaattcactacatttgtgttcagctcgccatagctataaataacgcgttcaatgggggtagagatcattttgtccacatttcgcaacagacgcattatccactctgacttcccactgcctgtgctcccagacacaatcattgtgaatggatgacgaaattgtccatcctcccttttaaattgttggaaggcgtccattttattttttttaatggaattttctttttatttatagttttacattttaatagatttaaaaaaatggatttaattcttgcaaccgattggataaacaacgcttatcccgaaatggatttacaggacaccaacaaagagaacaaagagccaacgaaaaagcaagaggaggaggcggatgatcccagttggatcagcctgattgacgaggagatgaagcgcgagccgctcgctccaattggtgaggaggcgccagcaacaagttttgcttttggttttcatttggacattacaattttaaattaggcactccaaaaaaatgtgcttgcgctgaacgccgtcgccccgtcccgctcgtggaccacctctgcaagcggttcaaatgcagcgcccacgagctgcatgtgcttttcaaaagcttagagaaacgccgggacattgtggagcatttgcgctccgtccaactgcgcaccgcccacctccgcccggccgtgcgcaattttccggtccgttgcaacgatctgtccatcctggacacccactccgccccagcttaccgaggctacctcggcataacggtttttttaaattgttttatttgtctgtaccacaaaatttaaaggttaggatgcactactacataaagcatggcatccgcttgcgccaccctaatttgccttgcgtagttgaatttggaggcggagatcacaaacttttttccctcttgaaattttgtccattgttttgtagatgtgttcaatttccaattgtactgtggtttttaaaataaatgttgaacccttaactcgagagcaatttttggcaattgcgcaacgtggcgcaaacacggagtacaacgcacggcgcttccacgctatcatcatgcgcatccgtacaacaacgggcaaaactgtggccgcactcgtcttccaatcggcgcgtgtggtcctcaccggagtaccccacccaaacagcgcaaataaaatggcggcacgcgttttgcgacgcatccaacacacacagagcatcacactgggcatccaccagctgcgcgtggtcaacattgacggcgttcaaaccttccccaagcgaatcagtgtggagcgacttcaaaacactctgggtggcacatatgaccccactatttttccagcccttcgttgtaaattgtcgaatggagtcacgtgcctaatttatatttcgggtaaggttattgtcactggggccaaaactttggatgtcatccaacattcatttaatgatttgtctagtattttaccaaattattatcgttgaataaatctattatttacaattatttgaatgaaatgaacaaaaaataaaaagacaacatcaaaaccacccggaatgccctggttgggcggggtcatgatcaacaaaatttctctttcgtcgctccgtccgttgtccatcgttcggtggtccatcatcctccacatagccaaagggacgcgtctgcattccgtggcgtacacgtcccttggcgtagtagggccggtaatctttgtgcgcctcgcgtgtgaagaggtcggcgtacacattgcggtcaatttgcgggaaattcacccggatggcacggtgttcgccgccgccgtacacgtaagggtcatcgttgtccaacacatcatcgctataaaaaaatttgactagcaaagataactttaattaatgaactcacatgggtccgtcgatgttgtaagtggatagcgtcaggtccttcatcgcctcaaaattgatcacccgctcggccgcgtaagataggcggaagctgcgtatcttgaggttggctcgttcatcggtgccgtcccgcgaagtgtgccggatgccgtagttcttcggcccacccgcaatgaattcgacgatgcggcggtcgctgtgctcacgcttcatttggccaagcgcttctccttccgctacgcacgggcctcccatcttgttgacgtagtaaatggagtccgtgtctaaaacatagtaatgtccacagaaagttttattttgtgacaaacataccgcagtagagcagctccgcaccgtcgatggccaaaacatgctccatatagctgtacagctgaagccggccgtacgatgtgacgaatgcagcgaccgggaggcagttcgtcagtggcgccttggcgaactcgggtcgcttccgcacgacgcagcggtccatgtggtcagagacgtggacaaagtccaacttgtccagtgttgggtcgtcgaggagcgcgtggaattcagccggagtccgtgtgtagcgaatctccgtctggcccacacgctgcgcaagtttccccctgtaggtatcttttttttttcaaaattaaaagccaaaaatctttaccacaaggagtttgccaaggttttggcaatgaggcgcaggccggggttgacctccattttggacgagtccaaccggatgtcctcagtgcgctcaaagtcctccacaaaggcttgacgctgctcttccgtgacacacccctcgggccaaccagtcgcctgcactttgagaccgacgaacgtgttgacgtagctgctgaacagcgtgccgtcccactcgtcgtagtcccagacctaatttgtgttttcgtgcacaacatttttttttttttttaaatgagtgactacctcaaataggtcggtgaccacatagccgagctggagtgccttgttgagttcgacgtgcgtgtaggcggtcacccacgagcgcctgtcgtctccgtgtcggcacggccgctgctgtcgtcgatcggcacaccagccacacaatggaaaggtgaagcgcccatcctttgtgcggtagccgagcagaggcacacggatgttgcgtggcgcaagcactcggacaagcagcaaccctcggaagctgttgttttccggagatgtccacggaagtggtgctgttggtggatggagcaatacttcacgcgtcacgacccgtgggttgcccacggggaagcggttggccttctgaattttttttatccgtaagaaatgaacaccttcacagaaaacccaccatgacgtgggggtaaaggctgacaatgtcgatgcacagaatctcttcgtcgtcgctgcacacgtggtggagcttgaacggctctgtgcggcctcccctgagtgcgtcgttgcgcgggtccagcgggcaggggacgaacacggcatcgtacctgcgcttcagctccgggtcgtgacgaagacgctccatccactgacagctccaaaccacgtgcagttcacatccgtgcaggttcgtcaactcaaaaaggcgttgctctgttcgttcgtacaagagtagtatagagtaccaaaagcgagcgggttccgagcgggtgtttcccgcacgaacccgtgcctatgggaggggtgcaaccctttgatgttgccgccaaacgagcccgtgcctatgggagg

SEQ ID NO: 5229 - DNA, 1640 bp, Heterodera glycines
caatgtgcgcctccccgacgggacccagctcgcgcatgccacttgcgccccggggtgctccagctcgaagaagcggatgtaccgctgagactcagccgatgcgcggcgcccacgcaggtagccgctttctggtgagtgaacgagatggttgccggcaggaagcaccgacgaagcgtggcaagcgcaagaccagccgccgttgatgccacaatgaatgggtcaaggccttgtgcatgctcttcgatcagatgacgaaaacggatgaacgactcgcgcagaatggcaacgtcgttggtgcagtacatgatcagctgctcacgaagctgaaatctgttgccgttgttgttgttttcgccgtgccaacgaagaagtttggcccttttctctgccttcatggtgtccggttgatagtagtcaagaccgggaagtccttccagccgctcaagcagatgttgtcgcttgatgaacatgtacgggaagaagggcttaaccgttgccaggtgttgtggcaggttgaagctcttcaccagcgcatccaattgacagacgaaaaagttgacggagtccttgaaggtgatccgcctttggttgtatccgcccagcttcatcgagtagatcttcaggccggttgtgcatagtcgtttgggcggcatacttcgacggtgaagggcctctagcacgaggtgaaaatcgtacttgccgccgttgtgcgcgatgcacaccgtatgcgcattttttggcccatgacgcgtcaggtagtccaaaaattgttccactgggtctgccgctgcgttgtcaaaggaatggaagaacagccgcctgaagttgtagagcggtgcacccgggggtgatggagtgttgtcccctggagcattggcgaacggaggcgacatccactgacgcatctgttgaccccttacagacccacacatacaacacaaccgagcgcacgttgtccatgaccgtcgtgaacgctgattcccaccttgatacaacgatcgcaaatcacctcagcgacgatgagcaacggaacatgcttttgggccacctggttgttgttgttgttgagctgaagtggccggtcttgtgatgtctcggcatcaaagaagcaaaaacggagtggttgttcgtcgtcatcttcatcggtgtcattctcatcatcatcttcagaagcaacgtcgatgttgatgctgttgttgttgactcgcgcagcgcgagatggtccagggccaagtggctgtatgaagcatggctgatcattcgtgtgaggtccggcacaaagacgacagtcttgcgctccctcatcggcttggccatgtggtggacactggtgaaggccaagataggcaacacggccacagtctcggcaaaatcgtcgccactgacaaagcgtacgacgctgtcgcaaaccacggccgtccaatgggtcaggtgcctggttgacaaggtggtagttgaagcagtcgtcgcaggggaagacgaagccacactcgttacaacgacgggcactgctttcaccgtttggcaactttttttttgttgaaaaaaataattacatgattgacaacaaattaatacttacttgttccgacttgcacgggtatccggcaccaaagcggagacagaggcgacacgcaact

SEQ ID NO: 5230 - DNA, 5314 bp, Heterodera glycines
ttcagaagcaaaggcaatcgaagcgacaagttcttcgaggccagtgaattcgattcaacaaaattcaaagccgaacaattcaacgaacaaatacgtcaaggaaagtccaaagccaaatcatttgccgaacaaattcaaagaaaggaccaacactgaggcaactacaatatgttggcgatgtggcttcggcgtgcatcgacctgacgaatgccgttacaaaacgagcaaatgccgcaagtgtgagtttgtcggccatttggacaaacaatgcgagcgtgtccaagagtggcgcaaacgccaaaatgccaaaaagaaaggcaacaaccgcgttggccaccttcgtattggaatgaccacgcatgccgtcaattccatttcgctgctaaaaacagcggttctgttcaacaagaagccagtcgaattccatctcgacacggggtcggacattgtcgtcattgatcaattgacgcacgaatatgttggacgaccaccgatcgaaaaatgcaacgaaattggcaaggctttcgacggcacaaaaatttcctttattggaaaaggattcggtacattcaaatttggcaaaattgaagtggagcaaacattttttgttgccaaagcaggctcactaaatttgttgagctgcaaaatgatggatttatttgggcttttagacgaattaaagctgaagatcagcaaccctgcagtaaatgcatgccacgcgaatggcaaaaaggctgagaattttatcccgaatgaagcaacgcagattgctgggacaggaaccgaaattcaagccctggaaaaagaatttcacgaaattttcagtgaagaattgggccattgcctaaaggagaaggctcatcttgccctaaaagatgacgcaaggccagtctatcgcaaagcccgaccagtaccctacaattcgttagaggtggttgagagcgaactgagccggttggaaaagatgaacgtcatcaacaaagtcgaacatttggagtgggccgcacctattttgattgttaaaaaggctgacggatccgcccgcctttgcattgattactctacgggcctaaacgatgcccttctcgactgccaatacccacttccaataccggaagacatttttgcgactctaaatggaggaaaaattttctcacaaattgatttgagagacgcctatttccaagtcgaattggacgaaaattctaaaaatttgtgtgggctggcaacccacaagggcaattaccggatggaaagattaccgttcggtgtaaaatcagcccccgccatatttcaatcaattatggataaaatgttggcaggattggaatttgccaccgcctatttggacgacattataatcgtcagcaaaagcattccggaacacaccaatcacttaaaagaagtttttggtcgaattcaggcatacggattccgcgtcaaattggcgaaatgcaaatttttccgtgatcaaatcaaatatctcggacagattatcgataaaaacggacgccgaccggatccagcaaaaatctatgcaattagccaaatgcctgcaccaaacgacattccatctctccgatcattccttggtatggtaaatcattaccaacaatacgtcaaaaacatgcggttcatccgaaaaccgctcgacgatttgcttaaaaaggaaattgattggagttggagtgaaggatgcgaaaatgcatttcgaaaaattaaggaaattttggcatcagatttgctgctaacacattatgatccaaatatggagatcattgttgcagctgacgcttccgaattgggcatcggagcggtcatttatcacaaatttcaggacggaaacatcaaagcaattgcccatgcttcaaaatcactcgcccctgcggaaaaaaattattcgcagattgaaaaagagggcttggcgttaatttttgcagtacaaaaattccataaaatgatttatggacggcatttcactctgcaaactgaccataaaccccttgtcagtatttttggcagcaaaaagggaattcggcagtgcagtgccaatcgtcttcttcgctggtctttaatccttttggcctacgattttacgatcgaatacatcaacacaaaggattttggccaagccgatgcgctctcgcgcctaatcgccaaaggaaatgagaccgaagacgagaaaatcatcgccatgatcaatgccgaaacggattttgaaacaaattttggccaaacaatttcaaaattgccattaaaattttcggacctagtcgctgcttctgagcgcgatgaaaatattattcaagtcaaaattttgtcaaaaatggctggccaaatgaaaaggccatggacaaagaaaaccaaatagtccgtgatttttgtcgaagaaaggaagaactttcaattgaaaaaggatgcctcatgtttggagaaagagtggtaatcccgaaagtcttccattcaaagattttaaaattgctgcacaaaggacatcccggaatgaagaggatgaagcagctggcacgccaatatgtgttctggccaaaaatcgatcaggacattgaagattttgtccgtgaatgtgtgccatgtcaggctgctgcaaaagcgccaattaagacaaatttacagtcatggccaaaaacatcaggcccgtggcaacgcgtgcacctggattttgccggaccgtttttcgggaagcactttctgattgtggtcgactctttttcgaaataccccgaggtattcgaaatgtcaacaatttcaacggcaatgacaattgaaaagctaagatatttggcttcacggcacggaattccagaaacattggtttctgacaacggcacacaattcaagagcacggaattcgccaaatttacagcggccaatggaatcaatcatttgttctcggctccatataatcccatgtccaatggacaagcggagagatttgttgacacgtttaaacgtgccttcagaaaattaaaaggggagggaatgtcatcagtgaaagaaataattgagacatttttggtcacatatcggaccacccccaatgattcgttgccggactcgaaaagtccagccgaaatgctcctgggacggaagccacgaacaactttggacctgctgaagccgcctccaattcagccgatcgaacgtgatcaggcaatggagaagaaattcaatcgccgatttggcacgcgtcctcaaattttcgcttcaaaggacgcagtttgggcccgacatcgcctttcacaaaattggaaagccggaacgatctgtgggtgttccggtgtcatctacaatgtccgatttgaagatggatccagcggtcgctatcatgcgaatcagctgaggttccgaaaggcgaccgaaattgttgaggacccattgaacattttgaatgaggaatttaaattgccaattcaaatggcaccaatggcaaatgggcaccaaaatgggcaggtcctagagaataggcctgaccccgtcaatgctgaagaaggagtggaagaaccgccgatcagagatgagcaacaggacgtcattcaagccgctcggtcgccgacacctgctgctcgatcgccgacgccacaacgacgctaccctgatcgccgacggcaaccacctgtgcggtattcgccccgttagatcatttaaaaggggaggtgttcgggtggtcaaccccgagagatgaaagttcacaattgcatttattttccctttgcatttgtctctttcttttcctcttattttccccactctctaattgttgtgtcttcctttattaatgtaagacactattgatttattttgtccaatgcatgtccattcccctcattcattcagttgctttttatgcacttatttctcttcgcctaaatttttgttctcctccaatttatttattccgcctccgacttcgcccatttttatttaaaattgtttaatttatttgttcatcaaataaacattttattgtgtcggcttgaagaccgaacaattacgtttatctcaaattatgcttttattcatttagagagaatttttcatttttttgtgaatttcaaaaagattatttatttatttattttgttttcctttaataaaacattgctaattaattttttaaatattaataattggagtataatttttggaattcatgatttctattttaggtcaatttttaaatttttatttgccttttttgaattttattttttataataaatattttttatataatattttgagttttgtattccgattgcaacgaaggcactcccaacgcagtcgaattgcatcgtgcgtcgcatcgatatttaataaattttgaaaaattaaaaaattttttttttgttattcttttgttaatcagatttttatgagggtttttccgaccatgtcaaaatttttttgggaaaaaatgaagaaaatataaaaatgaattaattaatgtttttacatttatttaacttttgcttttctaccaaattattttattggcaatatgtagagaaagaatctatttgtaggtaaattcgaaatagtaattttattttttataatttctgttttaaatttattctttctatgtaatttattttttgattgaaaataataaagaagtttaatttttttttaatatttaaatccatcatttcgtcgttaattaatatttatattttaaataaattattaatttatattaaacttttatatacaaaatttataatttttttaaatttcgctcttttttataattgcataggttaatattaggtaattgtaaatttaatttaaaaaactatttatttaattttcatgcgctttaaagatggtcttccttctgaaaagttgtccaaatttttatttaataattagagaccgagccggaccggatccggtaccggatttttctggatccggcaatccggtccggagactttgtagaaaaatccaaattgtccggaatagcggattgacacgaactttaagagactggattctgatttcccgatattttttaagatatgactaatgtcccctataaaataataaattgcccgattcaaataatatatttgtgatagcaagatggtgtacggtacgtataaattactttatcgtaaaggatgctactgcaatggcaatataaaggcacatccaaataataataatatttgacatgaatttgtaaatacttctgtatgtttgtttgatagtgaacaaagacgtgcaatacaaaattaccgcatttactttcattagagccaccccccccctgagttatagcctccctatg

SEQ ID NO: 5231 - DNA, 3632 bp, Heterodera glycines
  misc_feature (42)..(42): n is a, c, g, or t
  misc_feature (3350)..(3350): n is a, c, g, or t
  misc_feature (3482)..(3482): n is a, c, g, or t
tcagctcccccattagcgaattaataacgctgtcgtatattnaggctttaacacaaaattcaaatgtctcaacagcaccggaacatgaaaggcgacttttgctacgattgccaaatccctataaacagcagacaaatcaaccacaaatgtaatttttgcaaaaatataatttttatttaataatgacaattaatttatagggttaatccagcgctttctgctgactcttccagtgcaatgtctcaaatagcttctgctccgcaaacacgccaagtctaataatgaggaagcttaccaatttctctctatccaagtaaatttaggtggctcaacaacgacaggatttggacgcgtttcatcctgtccagcaacaacaaatcccatctcgaccatcgcaaaaaaacccggtcttagttgaattaatggacgacgatgacgaggaagcggacaaggcaacaacaaaaaccctaccttctcaaagccacccgccaaatccgggctgttctcatatgttggattcgcatgaagaaaggcagctgatgaatcactcacaaatctctcgcctaaaggcacaaagtgcagctgccgattctaccgtaaatgctggaaatggctcttcaggttgttgtcatttattatgaatgttgatgctcgacttactgctgaatttatcaatcgttctgcagatgactcatcttctagtccatgtccgtcaacttcacttccaaaacgaccacctgctccgccagttgcagtgccagaaccctctcataagcgtcctgcaattgagaattctcacggcacaattggaatgaatcgaattgttcctgacaatgaggaggggtcaacacggtcaccgtcaattagcaccacaatgatcgaaggaaatgccaaaggaaccgggcacgaagtgaattctcaaggaacaaacgacaacattgctttggataatggttctgcaaatgatcaaactgaaatggcagcggaaccaaaacaaaaaacaaattgtgaaactggtgaccctgtccaccgaggaggaggaggtatttttggacatagaaattaacttaaatcaaatacgttgaaatggacgaagaacaatcgacaagcaaaatactagtatgtcacatcaccactatgaatgccacaaaatcaccgtccaaagactctgatgagaaggtgcacggagacgactggtgggacgactattgctacgtgtgctcccagggctgtgatgaaacgacgggctcattgggttgttgtgacacatgccctaaggtgtttcacgccaaatgccatgtgccgatgatcaaaaagactatggaggaattgccgtaattattgtctttcttgtttacatgggttgcacttttcttattttagtaatggttggcaatgcacactttgtttgccatgcgatcctctttcgcaaataagtcaatcgtttggagagcgtgaaaaattggtatacttttaagaatatgtaaataattttgactttgtaagtgcttcttgctcttttagctttgctccaaggtctatttggcatgttttgtggacttttctaatgtcgaacactttctgaacgccgtatcaactgccgaatccgattactattcggttatcaaagaaccgatttggttcaacaaaatagcgacgaaaatttcttcagacgaatacaaaatgatttctgaggtgctttttgaactttagagaatctgatttaacaacaatcaattacagtttgttgaagatatgaatcttttgttccgcaattgttcaacgtttaatctggtgattttttttctacgataattatttacttaaccaaaaaatattttcaaatgaattttataatttttccaacggcacctattgataatatggaaagttatctagttagataaaaacctttttgatggatttggaaattgcaatgaaatgccatttcagtgtgtatttaaactgggcattctcacttacaattagtattgaaacgggtgaccccatagggccctcgacaatgggaaatgagcgaaactgagttgttcgattggttaaaattggtgtggcttcaaatctgtccactgcctgtctgtgcaattatttttccaatccccccacccctgccgattagtcttaaaagcttttatttaagcccacaaatcctttgtcaaactctgggaagaaggtttacacattatatatgaaagcgatgcgcgaatttttgccggcttatgagaaacaaatttggatttatgtgtctttatataacggaagggtttctgttgcgagttcggtgagtctacaaaaattactattttcattcaacttttatgattatttcagaatgacgaagaatctgtgcgaaggcgtggcggcaaacgtggaggtcagaaagcaaagtcacaaacgccgtgttgatcttcagtttggcagagaaggacgaaaatctcctcatttttatttagccaattgaaaattattagggcttggaattatatgcaaatgcatttttcctggattagctaaattggatttttcgggattttgaatcattcattatacccatataattccggtccctaaatatgatgatgctattaaaaatttttgttctgtaatcttttacctacgcttttcaataaataattgctatgtgtcgaataattttgaattatatgtacaaataacttcgaaacagtatttttacgtatacctaattcctttttaaccacactgtctcggttcttataatttgttagtttgtttgcccttattgtcctcttttcccctccttttccctatttccgttgggcgaatgcttcatttcattcaatttagcagatggctttccatcaataatgttttaggaagatggggacaaactttgcttgggttttgcttatgctcggcgagggaaaaagaatgcatgggaagggagtggaagagcggcagagattgccttgggcatggcaatggaatggccagagggaataatgggcggctcttctcttttgttgggccgtgcctttttgagaatttggtaaaatgccgggaagaaaagagagtgtttaacggaggcaatgagagagttttcatctcaccataaaaacattctatgcccaaaaggatggaattttcatcttagatttctctcccatcaaaattaaatcagaaaaaatctgaaaaagtcgtagtttcttctgttcgaatggatcgtctctcgtggtatcagacgggcgagtcgatggaggaaattctctgccaagcgggcagtgttggcatttacgacggggacctcaaacaggtcgaagcaatggactaccatatgatttatttgaatttanaaacaattgtgcatttaagtcgtcgttcgaacagggcaccgcttcactgacttatcagcgaatcatttgggccgattcgactgatccggtgggaagagagagaccggttttgagtttcgacccccaaattanaggattgtcgccttgttcttcaccattcgatggtccacaaaatagaaaaacagcacaaaacaatgtttggacgtggcggcaaatcattgtgacggtaaacccgtgacgcctggccacgcgcaagggcccatcgcgcgagcggcacaaatt

SEQ ID NO: 5232 - DNA, 5341 bp, Heterodera glycines
  misc_feature (5319)..(5319): n is a, c, g, or t
tggctgaacaacaccaacggacacatgaacacatcagcgtcgcgggcatggatcagggtgataagtaggggaattaacaaaaagttttgaaaacatatatttaacagcattgaatagagtttgcaaattctctattccgaaatggacatcttttaaggcttttgaagacatgagcaaactgatggagcaggccagggaaatggtcgtgttgtcgaagaatatcaccgaaagattgcgacaaaaaaagggcgaaataacggaggacgaggcaatcaatgcatttttacttattattatttttcaataatataaatttgacattgtcatctctttaggccgaataataggagcaaactcattaatacctaattgtttttcagactgtccaacttaagtcttatttgctctcgttgggtgttaatgaccccgtcacaaagtcatctttcggctggagttcagtgttcttcgacaaattggcagctgaactcacttccgttttattggagccgataaaagttcgcatttccaatgcaattcaacagtaacaacattaaaacccattcttaggaaagtgggggaacgatgacactccccgaagcattctgccgaatgaatcgggcacgcggaatggaaatgatttcacccgaagatttattgaatgcatgccaaaggctggacaaaatcaattctccgataaggtttttgccagaaaattcaaattgaaaatgtaccttgatgtaacatttctttcttccgttaagtctcttcaactttgacaatggcgtctccgttctccaacttcgctctctcaacgcccttcaaatttccgacgagattctccaaatggtcgagtccgccggtgcaatggatgcttcacaactgtccaaagcatcgggcgtccccttggttttggctgcagaaaggtgtggttgtcttttcaggttgaattggtaattgggttttcgttttatttaggctccgttatgccgaggaacagggaaagctgtgcagggatgacacaatcgaaggattgttcttctacccaaacaaatttcttgacattgatctgtccattgataattgatcattttaatcgtttcttcaaacgggttaaacattattattattattatttaattacacaatttttcattcggaaaaggaaaaagacaaaattaattttcatttagaaaaaaatttgaatcaaagaaaatctgacttttctacgtagggttacacgggcccagacccccggatacccggctttttcatacacagacccgacactttgaaaatcgaatatccgacacccgacccggtagatctggatccaaaatgcattggtaagaatggggatcttggtctaattaccgatcaaaattgcgcgaaattaaaagcgccggccccctgtccctcccccaaaaaaacgggagccctgtatttaaggtgtatttttaaagggcttttgtcattgattgtgtggttattatcttcggttatttccatttttgtttgggttcatttcgctcacataacaacgatgatgtttaactagagctcgcattttgaggcatatgcctttttttctgcgaagtagtttcgatatattaagcataaataacaccttttccgcttgctttgaggcttctacgttgacttttattatgccttttttgcttttttcgggattttcgtgccttaaatgcctttttttggcattttgccgttttagtgcccttttttgcgttttttccgaaaaattccactaaaaatggaataaatcggcaaaatacaccccctaagaaatgacccgaaaatttttagaaaatacacccctaagaattgaaaatttttctcaaaaattgatcaccaaaacttattttatttttttcttgtaaaaattttaggcttaaattttacttattcgaaaaacattataaagtatttcataatcatttaaaagacgaaaatatagttttttggttaatttttacgtgttttgctccctaaaaatccgtaataaaaaaattttaaatgccttttttcatgcctttttcgggattttcgtgccttttcatcccttttttgtgagctctagttacaacagttcttttttttgaaaaatgcatacagtcagattgcatactgtatgtttgacaccactagccgtttcgagaattggtcttctcaacattcatggaatttttttgccgtatttcaatttccttttcaacaatcgaacctttattttcggcatcttgctggaattcaaattttgtctttaaaatgaaaagtacgaaaagccataagcgtaaaaagccaaaaattcaaatctcaaaaagaagacaaaatagtcaaaccttgacccatgtagccgtatttaaattaaaaaactttgtttagtgaagtgatacgaaccttttagcttaaacttatttaactataaaagggctttataatgccgctacgacaagatgtttggactcatgattcctgtttggtctgttaatatttaataatttttggtaaataagccaatttaaaggtgtgccagtcagtgcattctacggaggaagacaaaaacaaacacgaattggatgcatcgcataagaaggcataaatctccaattttaaaatgaaaatccttttttatttgaagaaagttgtagtctacgattttctgtccagggagctttcttgcttgacggcaagcaaccaaagatcctttctttatgaacgatattatcgtgcgaatgcctccgttgcgggtcagtcggatttacgatttatggcactatctgatgataaacttcatgaatttaaataggtctcgactgcatttgtgagctcaacttcagctggtcggctgttcccctgtgggcgtgtacaatttgttacgtggccggtgaaacattggaatctgcggatgaccacatgcacagttcttatcacaaaagaaattacattgtaagcggcggaggtgggggtggttaatcgttaattgcattttaagtgtgaatatcaccccgaccgatacgcggaccttttgaaagtgcaagaaaaaagcgccaagaacaaacagtcgttgcttgagcaagaggccatcgttgacacgttgctggaggccaaaggattgctgtccccagatgtttatgtgctgaacggacgaagtcaagaatgggccttccaaaaactcggtctcagtagcgaaccgcgcaaagatccattcatcgcagaggaagtgacggacaatcacaaaatcgcactttgttatgtgagtggcattaaagttttaaatttttttaaaattccaaggtttgtggtgagacgttcatttcgttttcaaaagaggaggagttccgcgatgcgtggttttcccatttgtcaacgagcattcaccagcgctgcaaagcaatgcaaattttggttcatgaaggttctttttttgggactttattttgtattgtttgttattctcattgtgcagataatctggtggaatgcgaaggggtccccgctgaatgtgaacttcgaacaaactccgaatttcgacgcatcgacgactcgagcgacgatgaagcgaattatggacctacggtcggactcgactatttgatcatctacaacggttggccataatttcgcctataattctgcaacaattttattctcttcgaatgatggttcatcagtttatctccgactacgaaataaatttagtctgcaaaaaaattaatttttaattaaaaataccgctgtgtattgagaaatgcttttgtattattttttactctcatcggtccctttgctttttctattgccacatttgtaattgttaatttttatttgataatgtttttccatttcattgtcattcccttttctgcgtttgtttccccatttccattcgaaaatttaggcaccgattgcttttgcactctttgcttcaccattcttcccaagtcttcaataaccaatcatttctcatctgagtatcacatagagcgtttttttgtatgttttatttctttaattcattatatttcctgttttgattcagaaaagagatgacccgggcaaacttctgaatacgcaatacttaagtgtgtcggaacggcatggaattctcgaattttgctacggagagttaaaattgtcttcgcataaatatttccgctcgacttcacaaattccgattttgttgcaaaaatatgcgcttcaacaaaggaatgctttggtcaaatacaatttggaggaagttgacttcggccacaatttgaaagctgtttggtgtgaggttgtgttaatcaattgttggttcagtaagtgatccacatccaccattctcacaggagtgcaaagagtatgtgaatacggtgggcgatgagaacgcgtggagcattcacattttcgacgacgcgcacttcgagagagcagcgagaagagcactttatcactatggtcacttcgtttccaagcagtgttttctttttttgaaaatggttttgttttagaaaggtcggtcgtgacacggagttgtgatgtgctggacaatttcgcccattcgtaccctccaatttgggacgaacaattctccgtctcactcggcgtgctttccatccaaagtcgatgtgaatttggcttggagttcatcattcgggacacactcagctccaaattgtactgcacctgctgctttgtgcaatgcgatgacaacgacacgcaaatgttttccaaacacgcgcggtcgctcgaacacatcactcgcgcaatggttcttatttcctcttttgcgcttatttatgccttttaagctttttcattactatacttttttgaggcctttaaacgttgttttcattttcagcactcaatgaacaaaagaaatatgatcacattgagctggcgctttccgaatgcaaatgaccgaaaaccgttggtcatggactacttggtgaactgccggaagaaactgcggcaggaaaaacatggcatttctgtgtacaatccagcattggtctacaaaatgaactgctcgtcagccttgccgaaacgattgtttaagttggctaaaatagcgccgaacgaccggatcactttcattgcggaacacaaaaaaaagagacagcctcgcataggtaagtgggatatttagcaacaaatgccgaatattgactcaaatttacagtccctttaaataatgctttgaatgaattctgcagaattgaggtgaagctggagaagaaagaagtgattgtctgccattgtgaggttggtcttcagatcggatgtttttctttttcattttaaacttggaanattgttattttatttattcatc

SEQ ID NO: 5233 - DNA, 4195 bp, Heterodera glycines
atcacgaatccggcatccatttcgacatatatcgagccccgacgcgaattcgaacaaaaagtcgaaaattcaaaaaatttcaaaattcactttgatgttcgaatctatgtagaatgattattttcacgtgttcgcaatggtttctagttaacttgcttgttttaatctatttagaaacaaaaattgaattttgaaatttttttattttcgactttctgttcgaattcgagcctggggttcgaaataggtcaaaatggatgccggattcgtgatcaacgactctcgaaagccctggaagcatgttttcatgacttttgaaaacaaaaaaaattgcatcaaaaaaaggggggcaaccatcggcagtattacccaaattaaaaaaaatttcgttttattaatttttgtctaccttctgacaaaagcactatttcctctgtgtctcctactttgttggttcccatgggcagagagtaccaacaaataaattaaatatatttcgccaccagcagtgctaatttgcacaccccgaaaaaagcactggacaatttcgcgtaaaattgccaatttttgatacaaaaatctcaagattggcataaaaggatacaactctatcttcagatccttgacattttaattctcgtttatttatccaagctgtttgaaaaattgtgaccgattttttaatgatttaaggaaaaatctgtaatttttcaaaacgctcagtttcattgaaattgcgtttgcccatcgttgcctaaattcatttgaatttgtaacttttgtacaaattttttctttactttacattttgttcgtttcctctcttatctttcttccatttgctatttttgagctacccatttccttttttgctctgtcatcattttttcgtacaaattttgttttttttggccaaaaaatcatttttcaggaaatgttcatttattactgttgccgaacaactgaaaaatgtacatagcaacttcgcagtcttacaatggaatatcgggcgagcccagtgagttatattttccacttccaaaatccaagacattaaattgtgatggccatggatttgacatttcatgaacctatgaaaaaattcaattggtatgacggtcctgccactacggatgccaatccatggccacagagacccaaaaatgccacaaagttacgaatttttaaacagaatttcctcaaaaaatgtgtcggggatgaatggcatcaaatgttggcacattccttatctttttcaccccattttcccaggttcgtcctctccgccggtcaattggcgttccggcgcattgcgcggtggtcgaaaagtgaccaaagagccggcctacgccttcattttgcccaacttggagcagtacccggccgacttccgccactttttggagcgggacatcatcgaaatcagcacactgagggtcaaacttctgcatttatttgccatttgccctatttttggcgtaaatatgaaatttgagtgccacaattgtcactcttttttccttacagttctccgctgttgctctgttttgatcagtcgcatttcattgcgcttgtcgcaatgcgtcgtcagttaatcaccatcactttgcagggtaaagccatggcggggtcacccgtcaattttccccataattaattgcaccctttttgctttttcagtgattccgatgaccgacaaaaaccgcaatttgccgcccgtccatttctcagtcaattctggcgccgatttcacttggttcaacgcatctaatacggatgattgtcgatgatggaaatgatgtttcattttgtccgcaattttcattttatttatttgtttccatttattacgtatttatcaataatggttttctactcgcttctccaccaccataagtataagtgtgcctcggcattttacgtaattccgacatgcttcttcttttttacatattggtcaaaccgttaatttcaatttcttgttttgtgatgtgtttttgtctgaatttgtccgtaatatttgcgaattcaatgcgtgtgttagacacggtgtttcatcgctctctgtcatttttagtgcgcctttaaggcaacaacaaataatcgatagtcttctatttctctgtgctttgtgttggctctattaggtcattttctctgctctgacccctcctcctttgttcagaatctgtccgccctcactcattcattcacttcatttgtcagtcattcattcatttatccgtccaatttttctcatttcttttctgcaaatttctttcgaactgttgaagcaaaaaccacatcaagcaatgatttgagaattcattctaaatccgaaaatatattgttttttcgaatcactcactttcaatgatcccttcatattaaatatctaacgaatactttttgcgactgttttacgattgtgtcatgccaactcgtacaattgcttaggccgaatctttggctacgtctaggcttggtcttgcttcggcctaggcttaagctttgttttgtaaaaatacgagttgacttttgacccgaatagtaataccattcattgttctaaatcaacattttttttgttaactttgttctgctggtcgatctgattttttcactttagccatcactatttttttaacacactttaaacatcaccaatttgttccaaatggccgtcccattgcccttctctgttaatgtgtccaccatcggagtatgtttaaaaattgatatattcacaaatttacaaaatatttttaactgattattttgtcgttttcaaagtttgatttgtatcaccttatattttcccctttttcgggccaatttttatgtgaatttgacctaaaatcgctttttagaaaatccaactgattgatcccttttccgacgttttgtcggaaatcctttccccttgttaaccctttggccctttactaatgaaacctaaaattatccgcaaacttcccgcagaattaaacaacgaattgcttcaatttgcccccgagtttttgtgtcgaagcgttttggctaactctaactttttgttttatgatttgattcggaggagtgaaagaggcaaaaaatggaaaaccaaagtatggaaaactgaaacaccatcacacaatggacatgattttgggtccacttgggcaaatttaattgtggtttcaaatagcgataaacatatccaagaaattttcgctttcctacgcatttagcacaattttcttttaagtctgtggaagaaagcgaagcacggaccacgtacacgtacggcaatgtcacagtccggcctttcatcctacgaaaccgacgccaccacaacttcaatttcttggtggaagactttatcaacaccgatgtgtttctccgctcggaccaaaacaacggacgcattggcctagtgtcaattcgtgtcggtaacgctgcacaggtgaacgaccataaaaataagtgcaaattaagtcatttttcacccatttgatatgtcttttttaatgtcgttggattttgtgttcggatattttggttcccaccttacgattagcttgtttttgttttgagttttaattacaaaatctaattatgaatttttacctaatccaagacctggtttcattcggaatccttttttattgctcatatgaaaaaaacgcccaagtgcgaaatggattttgtttatagaataaatttcaacacagagacaagaactccgacagttcttcctcaactcttctcaaaatatcatggaaacgtttgaatgcagcattatgttcttccccctcaacgcctacgtaatgtttactctttaaaggtcgtaaattatttaaatagtagtaataatacgacgattttggacaatttaacagattatgcccaatttgaattgttgagattttagtctattaaaaaatatctaatatatttttatccaaatgctaagaaccaaaaactttcatttggaaatagcgcgggaatattgaaatttaataattaaaggcgtgggatgtagtccaagtacgctttttgtctgacagtattgtgggtatgtggactgatgtcatggaatgttttgagagggccgtaacggcagtgagtttccattaatcacctctttctgcaacttgggatttttaacagattgaggatggcaggccgccaacgccggtgaatagtccaagtc

SEQ ID NO: 5234 - DNA, 3672 bp, Heterodera glycines
ccttatattttcccctttttcgggccaatttaatacgaactcttaactaaaataattttttagcacagattggtccattttccgacgtttgtcggaaatcctttccccttgttaaccctttggccctttactaatgaaacctaaaattatccgcaaacttcccgcagaattaaacaacgaattgcttcaatttgcccccgagtttttgtgtcgaagcgttttggctaactctaattttttgttttatgatttgattcggaggagtgaaagaggcaaaaaatggaaaaccaaagtatggaaaactgaaacaccatcactcatggacatgattttgtgtccacttgggcaaatttagttataatatccaagaaattttcgctttcctacgcatttagcacaattttcttttaagtctgtggaagaacgcgaagcacggaccacgtacacgtacggcaatgtcacagtccggcctttcatcttgcacgaccgacgccaccataatttcaaattcattgttgaagacctggtcgaccccaatttatttctccgctcggaccaaaacaacggacacattggcctagtttctattcgtgtcggtaacggtgcacaggtgaacggccataaaaataagtgcaaaataagtcatttttcacccaatgttttattttgatccgttttttaatctggttggattttgtgttcggatattttggttccaacattacgatagcattgttttgaattttaattacaaaatctaattatgaatttttacctaatccaagacctggtttcattcgggatccttttttattgctcatatgaaaaaaacgcccaagtgcgaaatggattttgtttatagaataaattcaactcagagacaagaactccgccaattttttctcgactcttctcaaaatatcatggagacgtttgaatgcagcattatgttcttccccctcaacgcctacgtaatgtttactctttaaaggtcgtaaattatttaaatagtagtaataatacgacgattttggacaatttaacagattatgcccaatttgaattgttgagattttagtctattaaaaaatatctaatatatttttatccaaatgctaagaaccaaaaactttcatttggaaatagcgcgggaatattgaaatttaataattaaaggcgtgggatgtagtccaagtacgctttttgtctgacagtattgtgggtatgtggactgatgtcatggaatgttttgagagggccgtaacggcagtgagtttccattaatcacctcttctgcaaacttgggatttttaacagattgaggatggcaggccgccaacgccggtgaatagtccaagtccagtgcaagaagttgtttcggctaacaattccggcgagaaattgccatcgctcaatggaagcaacgaggaagaggaggcgaattgaacggacaattcattgttgtgtttaaatatcatttgttgatttcacaatttcaaaattttacataattgaataaatttccacaaagtggaaaaaattgattcaaaaagggatagtttagtaattttgcgttttttgctgtggttaggtcgcaatgattttctaccaaaaattgtgtgagcaaattaaaaaatattttcttttgcgttttatctatttttcgtctacaatctgacaacaacactatttccatttcctctgtgtctgttttacattgtttgttcctaatggcagagagtaccaacaaataaaataaatattttacgcgttttcccaccggcggagacgaaaaatttgcacaccccgaaaaaagcactgctgcttctgccgattagtcatgtttcttctcctttgttcgtcgtcataaatacaaaaatgtgatgtgtccaatcgctttttgtttttctccattggttcacttacctaattaaatatttccctacaatttcgcgtaaaagtgccaaattttgatgcaaaaatcgcaagattggcataaaaaagacaactttaccttcagatccattgacattttaattcccttatatttatccaatctgtttgaaaaattgtgaccaatttttaatgatttaggaaaaatctgtaattttacaaacttgcccaattttcattaaaattgcattggccaatcgctgcccaaattcatttgaatttataatttttgtacaaaatttttcattattttactttttgttcgtttcctctcttatctttcttccatttgctatttttgagctacccatttccttttttgcactgtcatcattttttcgtacaaattttggtttttttggccaaaaaatcatttttcaggaaatgttcatttattactgttgccgaacaactgaaaaatgtacatagcaacttcaaagtcttgcaatggaatatcgggcgagcccagtgagttatattttccacttccaaaatccacgacattaaattgtgatggccatggatttgacatttcatgaacctatgaaaaaattcaattggtatgacggtcctgccactacggatgccaatccatgaccacagagacccaaaaatgccacaaagttatgaatttttaaaacagaatttcctcaaaaaatgtgtcggggatgaatggcatcaaatgttggcacattccttatctttttcaccccattttcccaggttcgtcctctccgccggtcaattggcgttccggcgcattgcgcggtggtcgaaaagtgaccaaagagccggcctacgccttcattttgcccaacttggagcagtacccggccgacttccgccactttttggagcgggacatcatcgaaatcagcacactgaggcgtctggagaattcgggtcagtgtacagttctcagaatgtctgataggagaaagcatattccccatgattatttaaccaaaattttctagaactattgattggcatcattcagttttataccgaccgttaattacgcttttgttttcaaacgattacaaaaattttattttgtttctgaattttggcgatgtttccaccttcgttgcccaataacttttgatttttccgcaattttctccactttttctaatttgttgcatccaaatcgctcaatttcccctttttgcaggacatttgaattggtggtgtcaacatgacagcaaccaacggctgtggcccctggtgacaaccggcgatggcaattgtctgctccatgccgcgtcgcttggttggtggacgggaaacaaaaaggggggggggcaaatagaataatcttcgaccataactggatggatttttcccgattatcaaatttattgacaagactgccaagaaattcccaaatatttttattccttttttggcattatgttaaacaaaattaaggcatttggggtgtccacgaccggcagctgaactggcgcaacacgctgcacgatgtgctgaaattcgggagccgaaaacatgccatctaccggcgttggcgttggcacgagtccaagaacaatttggcgtcgggtttggtgctgtcggaggaggaatggcgccgggaatggaacgccgtgttggagttggcatcgccgacaccgcgcccaaagtaaattttgtggaaaaacaaactagaaaaatgggactgcagggacggtcccaggatttgggcttggggggggg

SEQ ID NO: 5235 - DNA, 1524 bp, Heterodera glycines
  misc_feature (1424)..(1425): n is a, c, g, or t
ctctctctgcgaggaaattctcgagatggcaggccaccattctgacgccgatgtggaagaattgatggcaaaacacaaggccgtccttgagcgtgaacagcgagcgctggctgagcagcagtattggcgagactttgcgttccagccatcaggtaaccggacgaagcaaataactgtttaaatttctaaaatttataggagagtcaatcgcagagcaggctttacacccgacaggactagaaatggagatccagcgctacaattttgagcaccaacaacaggagagaaggcttcaacaggaacggatttggaaggagcagagggaagcagaaatgcttgagaaaaagatgcgccggatccagctcgaacaacaaaaaagccaacaacatcaggcaaaggactcaacacggaagcgcacacaacaacaagcgcaaatttctacaccaacaaaggctgaaacaaaaagtaaaaatgacatataattttttgtgattatttcgtattatttgaagattgtggcaaaaatggaactctgtcgtcaccagggaacgctcggaagcaaccacaacatgcagttagtcggctttactttagcgaagccaatgccggtaaaaaaaaagttataataattaaaaaatactaattgcaataaatcagaacctgagcatgctgcgccagcgtcagctgtgttgacgactgagcaacccatcgccatcatccagcccgaccctgaggcaatccgggcccgagagatcatcgaccagcggctcaacatccaagaggcagattttgtggaagatgtccattgcggcagtgacgataagggtaataaacttaacagaaaatatttatgaaaataaaactttcagcgcctggtccgcaccccaactttaatgctgtgcacatggagatcgtgagcagtaaaaaagaaggaagttggcgagacaacaacgagacgtgcggtgtctgcactgaaccactgcttcgcggagacctcgtcactcagctgccctgtgacgccaatgtcaagcatatcttccacaccatctgcctacgccgttcgttgacaatcaaccggacatgcccgaagtgccgccgtcccgtcaacatcccagacgacatatggtgaaaattataaaaaatataggcataaaaggtttgcttaggccgaccaaagactcgcatagtcagtcttataaagactactttgctgagcaaagtcaaagcgcaacatcagcccgacctccggacgatgactttgtgatccgagcttggtaataaaaaattgaaaaagtttgaaaaaatttatcaaaaaatacaggagtgtctacgaagaccttcgcaacggccagagagacgcctacgggaatgtgattcgtcaaccaatcgtgccccgtagagctttccagctcgtgatcgaccannatccgggaggacagctctgaccttggcgaccgtcaactgggagtgggacattacggacccacggaatgacgaaagcacagggctccacatgtgcgagac

SEQ ID NO: 5236 - DNA, 1041 bp, Heterodera glycines
tgccgcccctgctcatggaataccctcagccgtgccttggcattgtcagacagaaatttgaactcacacaacgaactcagtaccactggggggacatttctgccgttattagtcatttggccaatgctaattaccctttgggcattcaatgcgatttcgaacttgccatttgccggcacggcaacgccactgttcgaaccggtctaatcggagctgattgctcggactggcacacttcacctttaataatgggaccggcgttaaaatgcaaaaaaaaacaaataaataaatccctcagtctaattacccttaattattcttaattacaaaagctcaagctttttccttaccaaaagtgcggtgccggatggaaatcgcactaccgtacttttgtcggtccaccgtccgatgttcaacaattggtggtcgtactgtaacagtccgtccgtcgctggtgcgcctgctgcactgtccaacaagtgcaacgcgtgctcctcctgcagttgtggcgcggtgcacgtgccgcccgggtcacgcatcggcactttggtgagcaaagactgtgccgcgggaggggcgtcactgggggacaccgcgccaatgccaacgcaggacaaaagaagcgcagcccaaacgccacgaaggcactggcaaagaaagacgaagcattttgagtagttcaaaaatgaattcaaggagaaccaggggattggcttaagggtttgaagggataacaatgggtggactttcaggcgattattgcatttttagaatttcactaatggagggatacgactcgcctcccctcccttccccgcccctcccccaatggggacgaccgtccaaaaacatcgtatcctaaactaaaacacttctaattttcatatttgatattaactcgactgaatattagtgtagtaaaagtacctttcttatgagtattatcatgtatattttaccttgatgtttggtatagaagaattttggaaacttttttagaatccaaaatctttggattttacacatgtgagtgaattgtca

SEQ ID NO: 5237 - DNA, 2255 bp, Heterodera glycines
ttaaatgttatttcattttttaaatgccaaaattgtcttcaaatttacctactccactcagcagatggcggcgtcttcggcgccgtcggcccggccgactccacagaatttggccctcaactgccggatggacttgcggcacacattccggcttcagtccgggactccaatcgccacgcttaaaattaaaacaaaaaattgaaataattccacagtattttgtttatttgttgttgtcacctgacatgttgccttaggtggtcctaaattacttccacaaattaataaattgagttaatgaaattaattaattaatgtttaatcgatttgtctgaccaacgagaaaattgcccttttcgcagcgaaatgcgattgatcgcccttccggcactcggcttatgtaatcggaataatcgtaagcgcccatttggccctccagcataatgtggccaccgattaaagtgccaaaagcttttgtcggatgctcacaagacccttttaagtcaaaaacccttttttgagtgcctttgccatgcttttattttactcgctaagcatcggaacggcggtccgtctctgacccatttgccgtagagacatttcatggaattgttcggcgacgacggacgaaagccgtgcagacagcggaatttggccactaattaatgggtaattagttgtccaaatggtctaatatgacaaactcgagccatgtgttgactttgtgaagacaattcgcgaattggacactttggccggccaatggacacaacgaactgcggcaaaaagaagagtgttctttcaaattttgacttatcaatttcacttggcgaacactgcggcatgtgggaccaagtgccattggcacacctagccgatgccaatgccttcgagtcgtgtttcgggtcacacaaaatgctggcctacttttattttttaactaattttttttttgtttgaatttgcctctgttccgtgcggcaccgcttcgccctgctcgaattggtcgagtcttccgtttcgaattggcggcaccgtacacccagctgaaaaggaaggcgaaagtgccaatgatggaacgacatgacattcgttgtgcttcccacccaaacatttcggtgccattgcgctccatttgccgctttcctcgcattttgcgaacggcgcccccacgtgggacattccctcgaagcagcggaacaccacaatggcaccaaagctggtgtcctcgccttcgatgtacccattccaaatgaccggcagaggagggcatttgatctctgatgagaaaagggggattttgacagagaatgttgatcagaaatgaatggtatgatctgatcagttgcattgatcagttaatactacacaatcagtgtgtggatcacaatgattggcattatccaattacaaattattaccctcacaatacggttcttggcccgcccaaatgccttccgccaagcaaactcgttggaccgaaaaattcaaaatgattttatgatttcttaaaatttttgtacctgcccaacaaggcgatagccatcgttacacgaataagtgaccaccgattggaaggtcagtgaagagccaatgacagcgccgtgcaacggatcatccggacgagaacattcggtcgctaaagcgatcggaattagccaaatgatcggtcaatcgctgacgatgggataaacgaaattatctgtttttatcaaccaaataattattattttgagtttttttaaaagggtcaattttaccaaaaatatataagaaaacaacggaataatcaatcaaataaaatttctgttttaaatggccgagcgtacgataggcaatctgccaaaaaggtgtttgtttcattccaaaataaataggtaattgaattttaacaaaaatccgtaaaagtatttttcctttatatgtacataattatgccaaattggcactttagaaaaaacggaaaatttctgatcagtgattccattgattttcctttactaataaattctttggggccattcctagaggatacttgtgttgtgactgaacccaccacaataccattccccaaaattgaaataatatccctttattcctaatgtgtgcacacgattacgtaatgagtaaatgagggaaaggaacggccccccgatccgtacgggacagatggtggagggaaggatcggacgtgcacttggcccaatccccccgaccagaatgaatactaccagaagagaggggagcagattaat

SEQ ID NO: 5238 - DNA, 2709 bp, Heterodera glycines
atcatggatcatctccacggatgatcacctcatccatcgacccacgcccctgattcatcttcagcctcagccactcactcatccgtcgatccatagagaagaggagtctctgaagagcggtgggacgtgatctctcccctcccctccccctccgctccccccccccccaattcccctcgctccctcaattcctccattttccccaaatatcgccgcctcaatctcgacttttcattctgcccattactggatgtgaaatttatgcaagagcccatccttctgttgctgattcttccaaattttgcgcaagtgaattaaaccattgaaaaacgaacttttcttagagcaaattaaaaatatttattggtaagctcctaaagtgcatatttcctcctccccaatttgttttgaactgtttgtctgtcattgaccccaatttgaattggtcagccgaaagaaagcgaaaatgggcaaggaattcgtcataaccaagctgttcaactgaagggtcaaaacaaattcggctaagaaatgttgacataaaatgcgaattgtacccatcgctttgatctttccagttttcccttgctccgatcagcgattgatcactttcatttttattccctggcccaatgggcgtgaaaatgacgtcacatctcccgagggcttttggcaccccccgccctcccccattcagttattcatcatttacttgatgacgttgtccagcgatatgaaagggaaatttggaggacattgttgtcccacctcccacccgtaatactcgtccaataatttttgaagcaatataaaagcaccgactcgttaattagttaattaatggcttaatgtgcgactgaatggtatttaagcgatcgtttcttttgccaacttcaaagccctctttgccattccgcagattccaatttgaccattcgcttcccccctttttgtatatgacccaaattgcgtcatttaaccgtcgtccgttgaccgtctcgcgccccttttttattgtgctgtacatcatcggtctgatcatctgcgtgcccacctctctgttcatttggtcccttcgaagacgcttcaacgaacggaacgtcgtcggggtaaggaaaaaggaaaaagcgactctcgagaagggtgccgggtcggaaaatggcgaaaccgactcggcacatattcgcccattctgagggacacgtcgaaatattttgccaaatcaaaattcgatcgaagaaagtgcctgattctcgagagacaaactttccccctttttccaatcccactttttgttgtttcagcaatgctcgttgtcatcatccatccagaacaatggaacggcggctccgaccgatgcacaatcggtgggccaaatacacctaattaataactaattaattaatatttattcattgatatttaatgattttttcaaagtgacttttgccattcgttgtaaaaatgcaaaattacggcaatgcttattccttttaaggattgctccgacactttgtccaagccggtcataaggtgttctggctgaccacaatgattgacacttattgggcatccgaggatttccacggcgttggcacgttaatttaatgaattgaaaactaattaaaaaatgaatcggaaaatctttcatagaaatcatcggcccatctctgttcgcccatatgcccctccatccgggcgattggttcgcttttactttttttgttatctttttaaatttattccccccgccccaccgttcgtccaggtacacacagaacaccgccttggccctttactatctgttctccaagcgtggcatgggctcgcccgatttggtggtggtcgaccattccgcctcgtgcgtccccctgctcaaatggttcttcccgcgctgccgcgtccttttctactgccatttcccccaacaactcgtaaatttgggattttcaatattatttattttcaaaatacccataaatttcgaaaaaaaatctaaataaaaatgattaattattgcgaattagtcattgttcataagttaaatgtttccggatttgaataaattaaatctttgtcccgcccaaattgagtatttgccaatttccccttatttgttaggtcactccgtcccgctttttcctctaccgttggtacgcttatctgatgggtttggtggagggtcgtctgttcgaatacgtggacattgtgttggtgaacagcgaattcactggtcagcaaaaagagagagcattgcaacgtaaaaagttcccaaaattcaatttaggtcgccaatttcgccaagtaatgccaaccgtttcgaatgccaaaatccgcgtcgtttacccgccgtgcgacgtcgactcgctgcgttgcgggtgggtgcgtccgattagtcgtgcggaccgtccgcccaacgaacgataccttttcctgtcaatgaaccgtttttggcctgagaagcggctggaaattattatagaggcggctggtaataacccacaaacttttttggcatttcatttccattttcagctgagttaaaacgccgcgggctgcggccgcgcattcaaatggccggctctgtgatgccgcacattcccgagtctcgaatatactaccaagagaggcaaagtcactgcaaacagttggagctggacgacctggagaggtgatgatccatttaaatttaaaatttttcaatttaat

SEQ ID NO: 5239 - DNA, 1274 bp, Heterodera glycines
ccaactgatgaacgcaagttcgagctgtatcggcagtgcgattctgtgatttacacgccccccaacgaacactttggcatcgtgccaatcgaagcgttggagcagcgacggcccgtcattgtgaacaacagcggagggccagccgagacggtgttggaggacatcacggggacacgagtgagtaggggagggggggggggggggaatagggcgagaatgggttgaatgacgaaaagaatttaaaaatatttattattattaaataattaaagggggtcatagggatactaaaataactaattattacaaattacaaaccaacagaatgtgtatttctcgattttttagggtttatattgaaaaaaccgatcgaaccctttgtttggtttttgatacaaaactaaaaattaataatttaaaaatcaaatcacctgctgatcagattgccgacacttgcggtgttttgctggccaatgcaatggcatcgcacatgggccgcaaagaatggccccaactcgacaaggacgaactttacgcgaaacaggcaaacaaagcgaattaattaagccaatttaaatggctaattgccctcttttagcgcattcgcttcgatgaaaaatttagttggaagggattcggacgacgcgtggacgaagcaattgccgaattattttcggtggaccatccgccgacggaggaaatggcgcaaataatggcggaaaggcgtccccagcaaaatgaaactgtgcacgtgcacatcaacggggtaactagcaaaactaattatgccaattaattatttcctggataattcataatttatatgaatgaacactcccacaaatattcatttgaaaattcactaattgcttgagactttcctcagttacttcataagttttcgggccctaaaatattttaaatttttaaattaaaaaaaaaatttttttttttgactttgcaatttgtcccattactcccaactttcatctgctcccacccccattgttcagcacagcaaatgccaccaacagaatggcatttccgactcgaacacagacttggaacggggcatcattccccccagtcgccgtggcactctttctccccaacgtgtaaagtttctgtcgcccaatggcacgcatttgccaccgcagacaaacggaggcgaagtgccggcgacaattggcagcaaatcatcggcattttctgctgtccttacaaatggccatcggaacacggcacttcaccgacgccattcggaggcgaagggc

SEQ ID NO: 5240 - DNA, 7940 bp, Heterodera glycines
  misc_feature (9)..(9): n is a, c, g, or t
gagaggaanattggggacgattttggagtcatttttatatcaaaatgatttgttagtttatgaattatgtataaattattattttttgcttattttgattaattattattaaaattttaaggtttaaattcttttctacctcaaaattatttcgttttgaatacgattaattactactattaattattaaacatgccattttgtttcaatttcaacttttctagttcgttttaaaatatttttctttaatttttccttaaaataaaatatatttttttaaaatatcgctactaaattgtctgcaaacgggtctatcaaacgtaacactataatttgtttaattagacttatgaatttttatatttatccagtgttttgaattatgctttggtttgttttttgaaaataaattttatgaatttaaattgattttttttggcaataaacatctgtgcattttccctaaaaaacgaaataatttgagaagagttattacttaaattttgggtttttaaaaatttaaaagtcgggttaagaaatttttttttaaattttttttctcccgaaaattatggtaagctgatcgtttatacattgctgcttgggagtctcggttcgccagctcatttagctttacttatggattttattaaataaaaacaaaattaaaatctaattttgtattattttcaattgaaataaattaaaattaaattttttaaaaatttttttgaatttttgaaatttcccggttggtcccggtccccggtcccgaagaaaaatcgaggtccaggtcccgtcttctcaggtcccggcaagtcacggtcccggttttggcaaacattcccggtcccgtgacactctagaataaatcagaaaatggaacatttttcacgtcaattaaatcctgaaaagttacactatttttgcagaaattttattaggtgtttaaggaaattaaatttaaaaaaatgtctttttcattatcaatttctctatgaaaaaatggtttttcttgcaaaatgaattttaccattttttcaattaaattcatcaaaatttattatcattcgaagcccaaaatgtttagaaagtaattaagacattgaaaatgtttagaatgtaattaaaacattgaacttttgtcagtgattgaacagtagtctgaaaagaagagccagcaatagaaaactccataaaaatcataattttttgttaattttatttatttttacaatttgatcataattttataagaaacagagtcaatgcgaaataaattttattcctccaataataacaacgtgacaaaatttcgaattgaataataaattcgttattcggcgaaaatggacgtggggggggcggggagttgtaagaaaaaagatcggattggaaaaatccacggaatcctgggactacggaaatcgtgatcgtgtcaatcagtttccggactcgagaattttattctcggatccattttttcaagaatcgagaatccgatcatttttgcatttggtgttgcgtacattaattatgccgaccgattattggtcttcgtcgtcgtctctgaacaaatggagagagagactgtacggcacggaaagagaaacaacaattactgtaattatgtggaaaatcagaggaagcttaaaaaagaagaagaccaaggacaattaaaggatggaattacctatgaacggattatgatagtgaagaagagatgttgacgagaaatatatgatgaagggaaaaaagccgagagaatggataaataaatagaaacatttagtttgacgtgcttttgttttggctccaagaaatatatatgtaaagcatttcatcgccataattaccccgatttttgatgaatctgttatcactcccaaaagatttcctctttttttttagtaaaatttatagaaatgtggtgtcatgacaactcgcacaaaaggcaactcgtacttttgcataggtgagatttaagctttaagcttaggcttaggcctaagctttcggctaggcctaggcttatgcttgcttggttctaggacgcccgtgcccttgcgtctcggggttttcctttgttcatttcttctcgttttcagtgccatttgctgccactccttccaaattgcttcctcaacatccacacactctggctttttaacggtcgactcttccgattttgtgcccgtctttttcttctaaacaaaaaatgtttaaataaattaagcaaaaaaaaaaaaattttctaagtggaaaatatgaaacaaaaatctctgagaccttttgtttgttcagtttggccacaagcttcgccaatgccttttcattgctaaagtattcaatgttaacaatcaaaaataagaattaaaatacattttgtctctctttccggccggcacattcaactttgcatggaagcaaagcaacaacttggcaatttggaatttgcctgtttcatccttaatgtgtgaaaatataatttttggtaaaactttctcaattttaccaaataatacttatttggtgatattttaattgggaaaactctaccacgattttcaaaaagtcaaaaaaatcatggaaacgcattaaggggttttagtaattgctgaatacgattcactcaatagtcattctgcacccctaactaaatccggaccccaacaaaaattcaaagaattcacagtaaaaatgcaaaaaacggacacaaattaattattagcccctcgggcaatttgttttttgcccgctaacgaacctccaacacatgtgccaatggcgacatggcagcgctgtcagtcgcgttcgggtccgctccgttcgccaaaatcatcatcgtgcacgcaagaggtgctattaaaagtgcaaataaaaattatttttaaatagaaaaacaacaaacattcaactaaatgtacatttttagttttacgctcaagggtttttttcgcaaacttccttgttaaagcgttcgtaaatactcattggtgccggctgctgctgcggctggacaaaaaaaagtttaagacaaacattaaaataaattgcaaaccccagcgaagaaacgaagaaatgcgtccaaatccatgaaaattttttgtagaaaatttgtaagctaaaatcaaaaccgaaataagaagagaattttatgtgaaaaaaggaaaacatatgtatgagaatgattgttaaaatgatctaatctggccatttttatgcaaaactgctaccaaaaacttttattcaaaaaacaaacaaatttttttttgaaaaatcgcaaaaaatttcgttttatgacttcaaagtgcgtgcaacattttcttaactaaattcaatgaaaatcaaaattttctggcatcgcctatcggcaccatggcgcccaaagttctaccattttcgaggggtcataattagggattccaattatatggaaatccatattttttcctggactgtgggaggcctgaaacgcacttaaattttttcgattgaaaattttgagtctaattccaaaaaaacaattatttcagaaacaattgtgaggaaggggaaatatacaaccccagcttgaaattacttttaaaatgatttgctttacacacacatatatatatagtgtgtgtgtgtgtgtacctgatccatcaaaatccccgccagattcttaattgctccaataatcccaatctccaacgatgttgtgccaaccggttcagtcggtgccttgccagtaccaagcgaaacaaaacactccagctcatactgaggttcctgaaaatgtaaaaattgaaaaaaactaaataaaactggtcaactgctgcatacattgtgttgttttgccaatgcattttccttgcttatttcatccaacagttccaggcttggattgtttgcgagcagacctcaaaatcatattttatattcactatcaatagtgaatgggaggggggaagtttgggtgcaaaaacggtattactttttagcagggatgggccaaattgaaaaataaaaagcgaaatttgcgaaactgaaaaatgcgaaatgaaaaaaagcgaaatgcgaaaagctaaaatatgcgaaaatgcgaaattttttctaccactttttaataattaaaatcataaagcaaaaatcattttttaaaattttattccaaatttaaaaatcaataaaacgcttttttgaggcgcgctttttcaaaaaaaacttgttgggaagagggggcaggcggcgccgggaaaaaatttgaaaatttgattaaaatttgttgacagattttcactaaaaaatgatcaaattttgtgatttttatcatttttcatgcatcgatagttaattatttatactaattgaatagtttctatttttgcctacctccatccatgaatttgtcccgactttcaaagtacgttggcgccgcagttgaatagcgcgccgctagccaaatgttggttttgtacgggtcgtattcgttgagcgccgaaatgaagttgcgaaatttgaccagtcggggaggtttttggccaacgtatgttgcggtagtaaacaatctgcaattttttttttgaaaattcattaaagcaaaaccaaaaaaattgaaaattttctaatagcaaaattttttcccaatttaaaggctaacaaacggacgggcttacccaattttcagccctctgaaaaaatattcagtttggcagagaccaataacaaatgttctgagtcatcaatattttaaaaatttcactgatgaccatcactcaaaaacaaaaaaaaaattaatttttcaaaaagttcaaaaaactataaatggctcttctgcgactatccaattttaaaatggatttcccaaaaactcacttaatgtttccacgcgataattcggccatttttttgttttcgccaaactgcgcttggaggaatgtttccaaattttgcgcgttgtaaccgatcagctgcgcccgggcgccaaacaccgaatccttcaggcgcaagtaaagtcggagtgcgtcgatcagtgagatgcccgagacaagtgccaacgcaacgatctgaaattcgcaatgtccaacatctttaattgatcagttcaaataatttttttaattggaaaatgcattaacaaattttcgaaaatttctcttcaccgccaccccccccccccctccaatgtttgcatttttttgaaatcagacccaaaattgcacaaatatgatacttagcaagttaaaactgataattttaatttttgctctcaccgctccggtgctcgtcccgataatccaattgaagttcttttgtacgaagtttttttcatggccacccgcttgcaaaccctcgccgtacatcagcgactccatttcaattaacatctgcaaattcgataagggataagcatagcgaaaaatatggtggtaagccgctctattgcattgacatgaccataaaaaagacacggccaataaataattttgcaaatgaagtaaatcacaactttttaaagaaacactcaaattaaacattctttatattattcgataactctattaggatgcaaaattttaaagaatattctctgtttcggaaaatttataaacaaaatgcttagataaaatttttttttttgaggttttcgggcaatgacttttttgaatgatattggtgtttattttggatgcttctttaaaaaatatggtttttatggaagttttttttaactgtttgtcaagaaagtaaaccccaatttttcatttgcaggaaaaaattatttaagtcgcaaattgttaatcgaaaaatttaatttttaattaaaaagtcccgaatcaaaacctgcactaatacaatgcctcgaattccgccaccgtccagtgaaagtgctcgaacgcccgtgcccttgcgtctcggggttttcctttgtttatttcttctcgttttcagtgccatttgctgccactccttccaaattgcttcctcaacatccacacactctggctttttaacggtcgactcttccgattttgtgcccgtctttttcttctaaacaaaaaatgtttaaataaataaaagcaaaaaaaaaaaaagaattttccaagtggaaaatatgaaacaaaaatctctgagaccttttgtttgttcagtttggccacgagcttcgccaatgccttttcattgctaaagtattcaatgttaacaatcaaaaataagaattaaaatacattttgtctctctttccggccggcacattcaactttgcatggaagcaaagcaacaacttggcaatttggaatttgcctgtttcatccttaatgtgtgaaaatataatttttggtaaaactttctcaattttaccaaataatacttatttggtgatattttaattgggaaaactctaccacgattttcaaaaagtcaaaaaaatcatggaaacgcattaaggggttttagtaattgctgaatacgattcactcaattagtcattctgcacccctaactaaatccggaccccaacaaaaattcaaagaattcactgtaaaaatgcaaaaaacggacacaaattaattattagcccctcaggcaatttgttttttgcccgctaacgaacctccaacacatgtgccaatggcgacatggcagcgctgtcagtcgcgttcgggcccgctccgttcgccaaaatcatcatcgtgcacgcaagaggtgctattaaaagtgcaaataaaaattatttttaaatagaaaaacaacaaacattcaactaaatgtacatttttagttttacgctcaagggtttttttcgcaaacttccttgttaaagcgttcgtaaatactcattggtgccggctgctgctgcggctggacaaaaaaaagtttaagacaaacattaaaataaattgcaaaccccagcgaagaaacgaagaaatgcgtccaaatccatgaaaattttttgtagaaaatttgtaagctaaaatcaaaaccgaaataagaagagaattttatgtgaaaaaaggaaaacatatgtatgagaatgattgttaaaatgatctaatctggccatttttatgcaaaactgctaccaaaaaatttaaaaatttcaaaaaacaaacaaattttttcttgaaaaatcgcaaaaaatttcgttttatgacttcaaagtgcgtgcaacattttcttaactaaattcaatgaaaatcaaaattttctggcatcgaaaagaattttccaagtggaaaatatgaaacaaaaatctctgagaccttttgtttgttcagtttggccacgagcttcgccaatgccttttcattgctaaagtattcaatgttaacaatcaaaattaagaattaaaatacattttgtctctctttccggccggcacattcaactttgcatggaagcaaagcaacaacttggcaatttggaatttgcctgtttcatccttaatgtgtgaaaatataatttttggtaaaactttctcaattttaccaaataatacttatttggtgatattttaattgggaaaactctaccacgattttcaaaaagtcaaaaaaatcatggaaacgcattaaggggttttagtaattgctgaatacgattcactcaattagtcattctgcacccctaactaaatccggaccccaacaaaaattcaaagaattcatagtaaaaatgcaaaaaacggacacaaattaattattagcccctcaggcaatttgttttttgcccgctaacgaacctccaacacatgtgccaatggcgacatggcagcgctgtcagttccgttcggatccgctccgttcgccaaaatcatcatcgtgcacgcaagaggtgctattaaaagtgcaaataaaaattatttttaaatagaaaaacaacaaacattcaactacatgcacatttttagttttacgctcaagggttttttttccaaacttccttgttaaagc

SEQ ID NO: 5241 - DNA, 1525 bp, Heterodera glycines
ctttctatggactgaacaacgcctaaggccaaatcatacatctaaatttgacgacaacattccgaacggtgcagaaaaaaatttacaccgacgggcgaggggttgcaaagggggatgtactcattgacggatgttgttaactttgaacgaacgaggcaaatgacctcgacatgtactcacggcggaggggacgaattgaggagtttgtacccagggtaaatgcccttattacgaaggaatgcggaggataaaagtaccgaattgaaagaaatgagaaaggaaaattaaataaattatcgcaaaaagaatgaatttccaaatcgattaatggattgaatttaacacaattttaaatgaaaaatgtaaaaaaaaaacccttcaccaaaagcccataattttaacagtttttccttttctgcctttgtctcttttgtctcattctttcttcttttctgtctcttttgtctcattctttcttcttttcttccccgtcatcctctgagcaaatgacaagccgacgttttggcaaagtgcaggcttcgctcccgcccgaccatgtgctgtcgtctgaactataagcctttttgcgtgactttgccgacgtagcagcacatggtcgggcggaggtcgatggcttttgtagaaatggcggcagtggtgggggaggaatttgcgacagcaacgccatcggcggaacagcagatggttgatgagcagcttgaaaacccaaacgcggatcggtaggacgagtaacaattcgatgaaaaagcgggactggctgcggattcgtaggcgaagtggcaagagtccggtgaagaataggacctaaatagctagctcatcagtaaaaaataaaaaagattatgttgatggtcgaacggcagtaccaaattgcgtattagagttgagagcagcagtaacgttggagacagcgtcgtcggagcgtggtagcaaaggaacaggagcaggaagatgaggcacaatcgtttgttggccaagaagcggcggcggcaccacaatcggtacatttggctcatagttgatcacggatgtgaatggaacagacggttggccacgcacttgcgtctatgattttaagcattatattttaatggtgaaaaatacaattgacttacgatttggggaattgccaaaaaagttgttgttgctgtcaccgacatccggtattgacctgccataacagcgtttcgggcattacggtagtcagtgcgcagccgaattagcgcccgttggcgctgtacttcttcttcctttctgcgctgccgccttcgccgcttttcttcgcgcagtcgctcgagctcaaggtcagcaggttgtgctcttttgcgcccgcggtttgcttgggccggaccgttgttacggacagcgctgtagttgttggcactcatttttgagggtgataatatactgcctgttactgtaatatgtggataagattgaaatttacgaactgaacatacgcaagggtgggttccgtccatcataaaaaatgggatacgttggg

SEQ ID NO: 5242 - DNA, 1204 bp, Heterodera glycines
  misc_feature (1144)..(1144): n is a, c, g, or t
  misc_feature (1165)..(1165): n is a, c, g, or t
ctaatcaaaatggaccattttgcctgggggcaataaagcctttccgaatccaaaatgaccccaatgaaaagcgggatttaatgcccagagggcaattgatctttctttaaatgactattttgcctggggcaataaaacattaccgaatccaaaatgaccccaatgaaaagcggaatttaatgcccaggggcaactgatctctgaattaccattttgcctggggcgatgaattcagcatataaaagacattgaattagcctatgtgtcgcattctctcttaagcaagcagtgaaaatacaatttattgacaacccatcgatggacaacataaacaataattgctcaacagagtaacggtgctcaaaagaacaaaatttggttgctggacaatcgacgactgcagaaaaaaaattgctggacgatccgtcaaataagttgtcggtgggttacagaatttgcgaaaagtttaattattgaatttggccactgaatttgctttaagcgttttagaaaataaaatcaatatacgaaacacaaacacaaaattttttctactgaatgtccttaaatggcaattcggtagtcgccgaactttccgcaggggcatcagcgcttaatagcgaaataaggcactgactttttaatgtcatcacattaactcttgtgaaaagtttttgtatgccatttcaataaacgcaatcttttgtagttagaaaaatacaaaaaagaaattgtcgctaaaatttttatccatggcaaattagggatgtttattttgagatttaaaaattacgttaacgtttcagtaccagcttttttcttgacaaaccatcattggacaacaaaagcgagcattgctcaacaaagtagcattggttaaaacaacaacaaattttggctgctgcacaatcgacgacttgagagaaaaattgctggacaatccataaaataaccgccaatcgaaccgtgagagttgtcggtgggttacagaatttgcgaaaagtttaattattgaatttggccactgaatttgctttaagcgttttagaaaataaaatcaatatacgaaacccaaacacaaaattttttctactgaatatccttaaatgggtaatttcggtagtcgccgaaactttccgcaggngcatcagcgcttaatagcggnaataaggcactgaaatttttaatgccattacattaactc

SEQ ID NO: 5243 - DNA, 3675 bp, Heterodera glycines
gagattaaaaatattttagccttcggtaccacttttttctaggaaaaaacctttattggtactgaacggtcagacagaaaacgaaaatcttaaaaggacaactcagtaccacttattgcttgggaagaaaatcaaaaatattttttgtactgaatactcagacgaggacaatacagtaccgccttttgatttttaacgaataagcattttggcgcccaactgaaggctggcataaattgctatgaagcaaaaaccataaaattttgtacttaattgcccgactgggacaaattcagagtataaatgtctttactgtctcgacttggtcatagaacttgagatttatctgaaaagcttcgtaatcttaagtacttcttcaaatggaccgacgattttatgagatcgataccgacttctcgggtaaaatttgcccgcagaaactccaacgggcattgacaaacggcacctctcgcccttttaattacgagacttgccgcttgctcgtgcttcagttcgacccaaaccgagcaggatttgtcgatatcgagagatttgagtcgctgtggaaagttagttagtttttgtacagtcttatctcttatctgtttttcagcatgtaaatgattggaaagtagacttcacctgtcttagtgaaaatatggggtttcttacgatgagaaagtttcaacgagcattatcccattacggtaataaaatgtgtaggcttatgttgttgcgctctttaggatataattttacaacaccgtttctgcgaattcttttgcaccatttcgatcgaacacagacaggtaaaggtttaaaattatggtggttaccaatgcttaatcaatcaatatgtaccggaaggttttctatatttcgacgacttcatgcatatgtgcatttttttgcaacgactgacttcacctttccgtcatgtagacttagaccgggacggacgcgttgacattcgtgaacttagcctaacatttataatcgtttcttgggtggtgtttagatttcgaagaatttcttttaatgattatggcaacaaacatctaagtgttattccgctacttatcagctttgaccttatcaagtcattttatctttaggaccgcctccttgctgcccgaaaattcgacataaatagcgagagatgattagctttatttcacaattttcaccgtgcataaacgcgattaatctttaaccgagagcgaaccgctgttgattatttctttctacctttgctaacattacaatcaatcctcgcaccttctcttttctcaacagaaactcaatcaaaatgagcggactgaagcgcttccaaatcatctcatctcctaaaaaaaggacggccgacgactttccagccaaccctaaacagcttcaggatatagttaaatttaattcacctggtctattttatgttcgtgccaaagttgctgaccttcaattttccttatacaaggtattggttttccggtttatattaatagttgaatgagtttaggcgtgccctttaaaaaactttggcaaattatgtaagaaaaagcttgacagtgaaatgtattgcgagagttgcgcacatcatgtcaagaaggcaagcatcagtctctacatgaaattagagctccgtgattgtgaagacccggaaataagccaaattgcgactgttttttccgttgtcgcggaacattacatgaaccttaaggtggagcaatttgccaatatggtagatgagcatccagaacagctggaagcgttgctcaaatctaaaattgagcagactgtcattgtcaaactcaatataaaggtatccaaaattctctatatgcttgctaaaaatattgccattttgagtttaaggcaaaaggagagctcgagacacttgactggatcatttcgtccatacagcaggagaacggggaggaggggatgccacaagaaggaaaaaagtccaccgacgcaaataccgaagatggagaaataatcgagatagacggcccgctaaaaaaacgtgtagcaaaaaagaactgagtccaatcaattggcttagttgctatggcccattatctgtaggaatctttgacctaatcgatgttaatccggataaatattatagagagggaaaggaaaagagacataaatcatacatttttgtttttaccaatgatcatatatttcctttgtaaatttcaagctaaaatagttttcaagtaatcacagcttaacctcgatgaaaagtgggccgtccaccggatcgaccattcaatcatcatcgtcaagagcgagcgataagcacatcacgacgactgcggcctcatccactgatttcattaccaaacggcgaaggtgcaatagttgggacttcaagacaatggcacactttgaggcaccgaaggcggatgagaaacagcctcagcagcgaacaccattgtttgagcaaaaacagcactatgtgcaccgagtggagcggttcgctctgcagcgtcatgtcaccgagtttgtgctcaatggtcagtacgatgaaccggaagaagcgcttctccgcgcttttgagcatatcattgctcgtgcagtccggaacgcagaagactcccagcagcagacagatggggcaggaatatcagcgggtgacggtgcacgtcgtcaacagcgagtcaccagacttggaattttgcttaacggccgaggtgggaccgatcgggagtgtaatgcgctcttttgttaatggaaaattttctatgcaaacaccagggctaactgacccaattgtgctgcctattcgcccgccggagcaaaacactgcggaagtgcttatggctgagttggacaagcttggccagtcggatggcgatgaggaagtgcatggaggaggaataagcaaacgttcgctgttgctcagcgaaccaatagaagtggtcatcacatgtatagcacctccggttggtgcagcaccacggttctatcagtatcagcattggggctatgacgatcggcaaatgatccgtgtgacaaacctggatgacaacttttgtctattccacgcgctgattgccacccgtgcttacacagaccaagaatttttaaagacgacttcacaacgacaatcggcaaccgatgcagatcatgggcatcaatcgaatgccgtgccagctgagattgcacgaagagtcatgacgagaacggacttttgtgctggatatgaagcactgaaccgtctggtgtccaaccgtgaacggatgaacgctgcagtgacggagctgatgcgtgctgcagacattccagcagaccaagaggcgtatggactggagcatctcgaccaaatacagcaattatgggtcagttgttggtgttggaaatgaagctgaacggaagtgcattaaacataaacacaggatcaaacgtaccctggcatctatagaattgtactgttcgaggatcactccgaggagctgcctcgtccgatttggaaaggtccgatgggccggcgcctctgtgtgtcactgtttgtatcggatggacattactacggtatcaagaagatacattgttttttcaaactgggccgaaaatattgcatggactgtgaatgtgtctacacccgtgacactaagcacactattacgtgtaagagtcgctgcccccaatgtgctaaaggttgatagt

SEQ ID NO: 5244 - DNA, 3311 bp, Heterodera glycines
tttaattagagttgagcggtaccgggaattttgggcaaaaccgggaccgggaccttttcgagttgaaaaaccgggacttttttgctgggaaaaccgggaaaaacagggaatttcccggtcccggtcaaaaccgggacttcggtactcaattttccgtgttcaggtcccggtcccgctcaactctagaattgagtgaaatgatggaaatgcgttgaatattccttacaatcaatgtagaaaaattcttgttttttttgtgtctaaaaattcattttttttatagattttttaaagtttttttgttgatagaattttaaaaaaatttgcaccaaaacatgaaatgactaattccgctaaaaagttttgtagaaaaaataaaataaaataaataaatatacaaaaatatgtacggttaaataagttaaacacttctgccttttgtccgtttttgttttgcttggttccaatcccattcatgttcttcatctactggtgatgttcgtcgatgtttctgactttctgttgtaaattggacagatttttttgatttcgttttattgcctaaaaatttttaattttccattattttaaaatgaattaagttgactgattaatttttattgaaattttgaaaaattaattaatatttattcttgtttaatttcaattggctctgtcttgatttcttttagctcctctttaaatatcttttcatcattttggctttctttttgcttctctttgattattttttgacctctttggctttctttttgcttctctttgattattttttcaccactttggctttctttttgctcctctttgattactttttgtccacttttattttctttttgctctgttttaattatcttttctccacttttgctttctttttgcccttttttgacttctttttgtgtcttctttttcttcggaatttcttcttctgttgatgcattactacttttgcttaattcttctccgttttgtctgtcattaatttgttttttcttttttataatttcttttttctttttaccatttggtaatttctctttctttgttgcctcttcctttttattgttagtgccattttggatatgccctaaaaatgaaaacataatccatattttttgaaaaccctaggcctgcctgctgctggtcaacggtgttgtttttatgctagatttggacctgattttttgaggaaaaaacccagaaaaattccggttccgaaaatccaagcctggaccaaggcctagccacaaacatattttaatcttcagataaaatgctctgtaattaatgctcgttttttaattgattttaccgcatgtctttttcaatagcttcaaattgttaattgaaatatctaattgttttgctattgcaacatccgaaagtttttcttctccatttttcaatttataatattcggccatgatttcctctctttgcacatcgtttagtcgttttcctaaaattttaaatttaatatttttttagcccataaaatgatagcattaaaattatttaaataaaataaaactttgtaatgaaaagcgtcgtttccattttgtaattgtgccaatgttaactccgataattttcgaaatcatttctgcccgttgttcttttgaataatttgcgaattttgtgttaattattttgctggtttgagcatagttttcgattatttgaactctttcttcatcattatatcttttattatgttttgtttctgtaaataaattaatttttaatgtaaaaaatttacaatgattaaaattataattatttcaagaaaattaaacaaattcaatttttcgaaataaaatttacacattttaaatatatttttataggggccaggaccgttttggggacgttttcgcgtgagtgcctattaggactgaaattggtcggatgtgtgccgaacatacatttcgacctatttcgaatcccaaacccgatttcaaacaattttttgcttttatttactcgaaagcgtcctcatttttaaaagattaacaacttcaagtattgacaacgtgaatgagacacagaatccgaccatcggcatcacgacatttctttaatttttttctttttccggggcggaggactcttcttttcacatacatatccaagagattaacccattggaaagtcaactgttttgtccaattttttgccgtacaaaattaatgccccaaacattttacataaataactcaattttatgtagaaaaaattctgtaataggggttggaaatttttttaaattatgataaataactctgacagaaagagagaaaacaattttagagtgaaaaaattttccaaactataaaaaagtaaaaattcgcttaccgtatatactctttttatatgccatggtatattatttttcaacctcctcagaagggggtagataattggaggccggcagattaatggagactgggagattatttttcagctgatttatttagtggaaaatttttgaaatttttttgaacatgtcgccaaaaatgtcatcgcgtcaaaaaaaaattatttctattgcatttctgttaaacaacttctgagaattgaccccaaaatggcaaaaatgtgtcattttcttgcttccaatatggataaaaattgaaatttttaatggtgaaagatggacgaaacgatcacgaagaagccttttttatttttgtgcacagattttgttcgtaaaatgagtcaaaaaattagagccataaaaaattggtctcgagtctcgggaaattttcggtctcgatagtgaaaatttactatttcgacatttttaggaaattcctaaacaaaaatgcaataaaatcaaaaaatacacccctaagaaacgacctaaacattttggtaatactttggtttgtcccccctatttttcaaaaaaaataaaaaaaatttaaaatcgcttaaaacatctctcctggggtttttggggccactgatcacgaatccggcatccgtttcgacccatttcgaacccggacccaaattcgaacaaaaatcgaaaatttatttttcaccaaaattcacactgcagcgactcgtggtcacaaaagacgttcaaaatgaaagagcgacggacaacggccaatagattttgaatggagaatcgcacgactgccaacgaacgaccatttcgtgtagggttgcaaccccgacgtcggggttggaaaattcggggttgtcggggttggaagtgtcggggttcggggtcggggttgccaaatcgttcggggttcggggtcggggtcggggttttt

SEQ ID NO: 5245 - DNA, 3404 bp, Heterodera glycines
tttaaaattcttcccacaattttttttttagttaactatttcgagattttccgtcactaaaagtagcgaccctactctgatgatgatgcagggctggatggagtcggagatgggaacgaattgttcatttattagcccctcttactgttgaattgagtttaattttttttttggaaaatgtgccaaaaaaaattattttaaaaattctatttatcccccctggcagataaatggagactggcatataaaaagagtatatacggtatatgcaaccacgcgaaaatggccacgcgaaaacgaccccgaccgtacattacttatttgacttttttcattacattttacactttgaggacttagacttttttccatttctttagtgctttttggcaaaatatacaaaaaatctgaaaatatgtacaaaaaaatgtcccaaaatatgcaaataaaagtccccgacttttatgcgcaaataccaaaaaacaaaatattttcctactatatagagcagggttaccctttgtccttatttgtaagatttgtccttatttaagctctttgtccttattttagtcttattttttggattcagggagaaatttagatttttaatgataatttttgaaagaaatgttttttgaagcgaattaatatgaaaatcttaacaagattcagttaaatattcaaatttttctctcggcggtttcttattctcttaaaaaaattagctcaaaatcgtaattttgtctttttttgaacaaaatcgttaagaattcgtattaaaaattacaaaaatttttccggcagtgtctattagagctgtctgtatctgttcttatttctaagaaatgttctgatttggggtagtgtcttattttcatttaaaagaggaaatttctgaaaaatttggctaattcctaacaaaattcattaaaaattcttaaaatttcccccagcggcgcctatcggcaccgccggccccccaaaactcctattttttctcttaaaattagcccaagatcgcaaattttggtcattttttggacagaacttgttaaaaaattgcattaaatttttaaaaaatttccccgcggcgcctatcgacaccgccggactctcttccctcacccatacccaaaaatttttcggaaaaatgcgccgaaaaaattgttaaaaatatgtttttttaaattttaaatgcactgaaatttaccaattgcttatgtttcgacaaaattgttaaaatcttaaaattgattttcggaaatgtataaatttctcattttaagccgaaattgctcatttgtcagaaaatagttggcggtgagtaatgcatggttttgttgaataaaaatgcgaatcaaagttttcgtagcgtgttttaaaaaatgtcctcatttttgaccctaaaatcttatttttgaccaacgatgttcttatttcgggaaattttcaagggtaaccctgataaagagcatgggaaagccagaaaaaaaaatttgcatatttttgacagccctgttaatgacttatttaaatatgaaattaaattgtttgaatttgttgactgtcattaatcggtcagatatgaaaaaatggcatttctgtgatgtgattcaaaaaagaagcttattgttcattctcatgctctaaactcttttcatcattgccaacaaaaagaaagtggtgcctttttgggtggtctctagcaattgtccaaacattgtaaaataaaattatggatgggagttttttgcagaataatatttcgattttaaataagcttttatattttaaacattcaaaaaaccaaattacaattgaagaagaaaagcataaaaaagaaacgaattggtcaacaattattgtatgttcttcatccgagtttccaaatcgaacttgaaaatgggcacaaagttcgcctcaattttgtcaccaaaggtggccaaagtaacgaatggataataaggatcacgagcaaaagatcgaggaacgaaaaaatcggagaaatctgtgaaaaagttaagcgatttccgacatttcaaatatcaattagcataataattataagttaagattttgtttaattatttgccaacccaaacgaagtccattcctcgtgaaaaagatctgtcgcgtgatggaattaacaccaattcctacggtatcgccaacaccgtaggaatattcggcaattgatccctttctttctccgttaatccaaacacagccattactttcatatgcataagtgtccttttcatgtcgcactgattgatacgattcatctgtctgctgtataatggcgaatccaaagctgatgagataactgtaaaattaaaaataaaggaatagcaataaaaaacaaaataaataaatcgcatactcattcattttttcgattgaaatttcgtagtaaaaaatgtcggaaaaattattgcccagccaaatttcatgttgagcgaagacggaacgccaaccttttaaggagaaatatacatatgtataacttaatttgtaagtaaattatgaaaaatacctttataatctcccttataatggacaatgagttttttgtcgccaatgatttcgagtttctcatcacaatcattggcaacccaataattttgtttgaaatttaaaagtgccttaaaataaataaaatagtataaaaattttgtttttacccttacaaattaattcacctttctctgcttcggttctttcttcaattgactgatttttttcaaaagaatcttccggtcattttgcatttctgagaattggtccgaagttgctaaaattaattttaaaaaggcaattaatttaattaaataaaattatttttatttttaatttcttctcctgcctttttttgctgcttctccaattcactgattttttccaaaagaatcctctgaacattttgcatttttgtgaattgttcctcaacagcttaaaatataataaattatttatttcatatggactaaatatcatattaatcaaacaactcaattgtgatactgtatcagtcagtcaaacattttgcgtccgtaaatggtaatttattaattttaccaaattattcaaataaataattccataaaataatttactaattcctttacttatttatttaccaatgttcttcttttcctgttcaattttggccaatttttccttcaatgcgttctgttctccaatcagttcctgctgctgctttaacttttgttccttctaaattaaaaaaaaatgttggccaatgttttttaatagtttttactatattttttaaacaaaaacttacattttcgagttccaatttggccattttcaattccatttccatcttggcaaacttttcacggaattcctaaattaaattaacaaaatctcttttg

SEQ ID NO: 5246 - DNA, 9351 bp, Heterodera glycines
aaaatatcgattaaatttaaatattcttaaaaattagtcaatttatgtcaaaaataagcaaaaaagcgaaaatttcgctttccaggtttatttttcgctaaaatgagtgaattttaagctatatcttgtttttttcttctaaaatcatttttaataccatatttagccatttttgaaagttttactttgcgttaagcgaatttgaaaaaattttgggaaacgtaccctcaattgggaaaaattgatgtccatatttttgcaaatttatgtccatatttcacgatttcttgtccatgttttgtggccatatttcgcgattttatatccatataattacaagccttagtgatcaaaatggattttgttatgccttatgataattgagttttctgaaacaaatctgaaaaatctgaatcaaagttcgaaaattttttggacccggaatccgataatacattattagccctcgaacaccttgaaacatatttgattagcacatatttttggcatttttttggcggttttagcacataaaaattcggtacttttctattcacaattcatttacaatttatcgtacaaagaatgtcatcctgatcagtttgaacaattatagcagacaaatatgacaagtgaattcaattatgagaacaaatatacacagcaatacatacataagacataagtgatcgaattccttatgaaagtcggcacatccgtccaattcttttgatcagcgatttcctctctcatccgaccgatcacatccgccgctgttgctgctcgttttgttgcctgaatttttgtacttttttttaaaatcaaaaaacactttttacccgtcgatgttctccctttgctgctcagccgccacggcacggaaaatgtctctcatttcggcattttcgctttcttcggccaagtcgcgcgcccgtttgccttaaatgggagaagaaaattaattacgtataaaagtaggaggacaatttgaacattgtacccaccatcagtgccaatttggtcagtgctcgtgccgatggccaccaaatgccgtgccatttcagtccttcttttcttcactgcgcacatcaacgcgttgtatccgtccatgtcggtgtggtcaaggttggcgccacgttcaatgagaaaattcactgaaaaattaaccgaaatttttgacacaatttttttcctcaccaacgtccacgtgtccctcaccgctagcgtctaacagaggagtggtgccgtcgattgcttcctggttgacatccgctgcccattcgtccaccaacagacggcacacttccaaacgggcaccaatggcggcacccaaaagagcaaatctcatccctgaaattgaaaaaaggggaatattttaatccaataattagggggcaattgtaggtcaatacacagtacccatgtcctctcatttctttaaagcaatcatccacggtgttgtaatcaattgttatatttgaacagttaattagggccatatgtttatgatataatccagcactaattgtagaaaaaaaagttttgttttgcggcataatacacttaaattacttgtcatgctttccactggaattgaagtcgtatgtccgccagaaaatttgttcacaaattcggcattattggttgtttatttaaagagtgcacacttcttccctcgaaaaaataaaaaaaaactttaaaactatttaaataagcaaattttaaaagctctttttttggttaacagagagaaaagttatgacctaataaatttttcggcgattttttggttaggctacagaagcagcagaattctgctgggatggggtcaggttcggattcccctttattttcaaattcaaaatgatttttaatcgtaatccacgctaaaatgacggccctaaaatagaggtgtgaagacactagtgaataaatttggaccatcttaagaaactccctcttcccctatcggttcactttggttggcccctctcttttgggccccaccatgtttttggctatagcttttttcttatcggtaccaaataattaatgtaaaatgggtacttgttaattatcggtgtccagattttcaaaaatttttttttagataaattcgttttataggttttcggggtcgggaaaaccgattctggcatctgttttgacccaattcgaaccccgaacccggattcgaacaaaaaagtcaaattccatttttcaagaaaattcacattttatgcacaaaatcgcttcaattatttcaaatttgtatgtcagaatcggttttcccgacccggaaaacccctaaaaatattttgagcaatgaacgtgaattttggtgaaaaaagaattaggcatttgaaaatgtatgtgaaatctgtccggtaagctggaaaagtacctgataaacatcaacatcaaactgctgaataaaaagagtgatgaatgaattgatttttgaattgattggattgcgaaattggcaaaaaacagtcgtggtaaaaaaattaatttaaaatttggtcattgcataatgacatcaccgcgaacatagacatggaactgctgctgaaatggagaaaatttttgaggacagcagggttgggattggaaggcaaattcgggaatggtccaattttcgtattcgtaaaattttgaaaaaaatgggatttattcctaaactcgggcataaatccatgttgatcactgatcaattccaacgaaaaacaattttttaacttcatatttttggttcaaattttgttttgaatgtcacgaaaggaagtgaaaattttcatgcaaaaattcaaatttttctcataaaataatttttcccgtttcccaccgcgggattctcatttacaatttatcgtacaaagaatgtcatcctgatcagtttgaacaattatagcagacaaatatgacaagtgaattcaattatgagaacaaatatacacagcaatacatacataagacataagtgatcgaattctttatgaaagtcggcacatccgtccaattattttgatcagcgatttcctctctcatccgatcgatcacatccgccgctgttggtgctcgttttggtgcctgaatttttgtacttttttttaaaatcaaaaaacactttttacccgtcgatgttctccctttgctgctcagccgccacggcacggaaaatgtctctcatttcggcattttcgctttcttcagccaaatcgcgcgcccgtttgcctgaaatgggagaaggaaattaattacataaaagtaggaggacaatttgaacattgtgcccaccatcagtgccaatttggtcagtgctcgcgccgatggccaccaaatgccgtgccatttcagtccttcttttcttcactgcgcacatcaacgcgttgtatccgtccatgtcggtgtggtcaaggttggcgccacgttcaatgagaaaattcactgaaaaatgagtgaaaatttcgaaatttttcatacacacacttttttcctcaccaacgtccacgtgtccctcaccactcgcgcctaacagaggagtggtgccgtcgattgtttcctggttgacatccgctgcccattcgtccaccagcagacggcacacttccaaacgggcaccaatggcggcacccaaaagagcaaatttcatccctaaaaaaattgaaaaagggggaaaatgtattaatccaataataggggcaattagagacaaattgcacccgtgaaatccgtctgttcaacaatggcaccatgtgaaagcagcaagcgtacaatgtcgatctaattgtaagaaaacacgagaaaaaaaacagttacaaatcatccatccaactcttccacctgtcccgaaaaggaagtgacaattaatggcgtcattccgtcagtgtccgcgagattagcgttggcgccattctcgacgagaaaagtggctgaaaatgggaaaacattgtggcaattacgcagcggcaaaacggcatccattcgagattgattcaccgatctccaaattgccattgaaacatgcgcacagcagtggcgagtggccagagtccgtgcccatttcaatgttggcaccatgggcgatcagcgcacggcacagctccaaattgacaaaaacgacagcggcccaaagcggtgtcacatctgcaaatttggggggacacaacgtttaaataacggctcaattgcattctttatcagtccaatcttcattttctttgcccataactttttttcggtacttttctgttttgagaccccccccctgaaattattttcaaagaaaattttcaattttccccccgttttttgaatttttttattttagtcataaaaaacatgttttaatgggctttctggatagactctgatcacggatttactttcttagtataaaacaaaaatgctaaagtccggccaattcataaatacaggaagaacaaatactgacaccaagaaacaaaaattatgccaagaatgttggcacattgaccaagtaaggttatgtatgagcaaagaaactgaagattgaactcataaagagtgcatatagccaattctgctgctgtttgctactcactcatgttcaagccgttcagttggccaatcatggtctgatgcggatcagcacccttctccaactgaatgaagaaaaatggggggaaatcaaattgctgtcgtcgaaatgtcggcggaaactttaccaagaaaacagccgtttctgtgtgccgattcaaaattgcgttcacgagagcgggccgagcatgttggacatccggttggttcatctccagcaaaatgctcagctcatccgcgtccagcgagtcgaccagcgcacgcaattgtccaatgtttccctggttgacgaaggcgaagaattgacgagtgcgctcctcaaaattgtcttcctcatcagcagccgcgacggaagagccaaaaacatttcccttaaaattgaaaaaaaaaaaattaaattgcattcaaaagatttaaaatttaaaaaattggggttaccattgcctgccgaaaatggggggagaagacaatgagagacggaaaacggagagcggagaatgaatgaatgggaaagggaaaaatgcaacacttttatactccgtcgaatctcgctcgaacaaaaaatttcggtacttacataccagcaggggtggtgggccaggccgttttcgtacgagcacatgtttttggctataacttttttctttgccaaccaaatccaatgttgttggtatcattcaagagcccttcagatgctctattagcctgcaaaattctaaaaaaaaattgttaagtttaaaaaaagttcgagccaaaaaagttgaaaatttggttttaagaaggcgtcgaatacgaacgacaaaaacgtcgctgtgccaatgtttatgatttgttgtgccattcttttgaagtattgggaccgcctcaaaaaaccaccaaaacaacgaagccatcgcaaaattgaaaaagtgccggaaattgtcttaacaatttgccccgacgaaatgtcatcagacaaccaaaatgaagcagaggcgaagatggcaaacgcgatgtaaaattaaatgccaatttcaatttttaattttgttttcccttttttcagctttatctccgccgattgttggctttgtgtcttcgatttgcttgcgccttctcaacttggcctcggaattgcgctgatcagccaccgttttgacttttacgtcgacgaacatttcaaaacgcgaaaatggacattggcatttattcgaatttggcacaaaattggagaaaatggcacaaagaaaatggaaattgtcaattttaaatggaaagcattgccaattccgcaaattcaaatgtcacgaaaagtcatcggattcaaacggatctacatccagtaaaattgacactaataattagaatttaggcaatatttccattttcacagatacatcgaccaaaatgtcatcgcttttctccaccgttttcgccaacttttcgccgcctgtcaaatcaatttgaacatccaaacggacaatgatcgcatttcggagttcattttgcgcaacatttggccaatgctcgggaaaaacattcatggcattgaaacgtccgcctcatttttccatcttttgcgacaaatggcgccatcaattcttagcgactgtccatcacttcgttttgtcattttttatgctggtgatttgttcgccgaatttccgcccgatgacagtgccgcggcatcggatggacaatctgtggccaaatggcttttcactccacgtccagacgatgtgccaaaagtgttcaaatgctggttgttccccaaaaacttacatttatgcaacaaaactagagctgacaaatgagcgggaccgggacctgaacacggacaactgagtaccaaagtcccgggtttttcccggttttcccagccaacaattcccgggttttcaacccgaaaaggtcccgggtttgcccaaaattcccggtcccgctcaactaaacaaaaccaatataaatgcactacttccctgagtttgtttggcgccaatgctttggtgatcgcaaaaatgttataattttttggtggcatgcataaaaatgaattttgaaaaattgggtattttcgattttccggggttcggaatcatcggatgtcagattcgtgcaacggcgtcgaaaacttttaaaaattgttttattatttttcaaaattccacaaaaaaaaatcagaaaagtacggtattattttgatggacagttgtgatcggcggcaatattttagcctccatttttttcatcaaaaattcgtataaaagacagtgaaaaaaggcaatgaccgtcatttttttgtacaaatattttggccaccattcatactgcggtggccatgcaaatgctttttaatgcccttttggaagccatggtttaaaaaggaatctccggactccataatttgtatttcatttttactaagctattttcaaatccgtcgaaaactatctttaaaatcttgccaccaacaaaatgtcagaccgccgaaaagaagcggaggaaaaaatggaaaaagcaatgtaaaattaaaatttaaaatgccaattttcaatttttaattttgtttccctttttcttcagtttcatctctgccgactgttggctttcggtgttcgatttgctctctccgcgtaaacttggccttggcattgcgatgatcagtcaccgatttgacttttacgtcgatgaacacttcaaaacgcgcaaatgggctctgaaatttattgaaattcgaagcaaaattggaaagaatggcaccaaggaaatggaaattgtcaattacgataaagaaacattgccaattccgcaaattcaaatgccacgcaaagtcatcggattcaaatggatcaacatctagtaaaattggccaatgtcaaaattttttgccaacagttcccatccatttttacagttacatcgaccgaaatgtcatcgcttttctccatcgttttcgtcaacttttcgccgcttgcccaattaatttggacatcgatatgaggagtgatcgcatttcggagttcattttgcacaacatttggccattgctcggaaaaaacattcttgtcttgtaattgtctgttggaattttcccccgtttgcgacaaatcgccccgtcaattctcaacgactgtccatcgcttcgctttgtcttttttggctattgcgatctcttcaccgaattccctgccgatgacagtgccgcggcatccgatggacaagcattggccaaatggcttttcactccccatcccgacaatgtgccgaaaatgttcaactgctggttgactttggatgacgggaatttggcgtcgagaattgaacacttcaaagcggtgcttattatttatttagtactcattctgtggttgtcatttactacttaaccaatttttccacattttaggcatttgccaatgcttcatctcctgccaatttcattgccatcatttcgtttccgttgccttttgctgattccgttgtgccatttgcgctgaccaacgaattgactcgcgaacaattggcattgaaagtgattgacaatagccatcgttttctgtttgtccgttgtccaattgcgcgagacgaaagcaaatggaccaaatgggaagaagaagcgatttattggcgaatttgtgatcagtggaaccaaacagaaattcgaatttgcgacgggtaagcgaatgcttgatcacaaattcaaattttttttgttttttctttttttagctttctcgacgaaattcccggcccaattgatcagcaacagaagtgaatgaatgaatgatttgttgagaagtgatcgatcaatttgaattgagaaattggagaatgaatttgagactattttgacgtgctcataaaaatgatcttttttttgttgggaagagatcagtagggccgcgacttttagtgacgaaaaatatcaaaaaagttaactaaaatagtgagtaaaaatgccaaaatagtgactaaataatgacaaaaggccgaaatagtgacataattttcagcaaaaataatttttattcactgattgcagttgcaaatgaggtacatttcttttctaatattttcttagtaaatattgacaatttttaaatcaaaattttgccaagaaataaatttgggaaatgaatttttgagaaagtttctaaaaaaattgagattttaaaaaatgtaatatcctaaattttaaattttttccattttcaatttttaaattttgttttcctttttctcagtttcatctccgccgattgttggctttcggtgttcgatttacttttccgccttctcaacttggccttggaattgaattatccaaaatgggctaaagctggcatggaatatcatttaaaactttgcaaatacttattttacgttttgctgtcccaaccccccccccccccgccacaccatttgcgtagtaaaatttcatgtttttttaaggaaaagtgagtgaatggaagaaaatgggggaggggagagagcgttatataattactaaaaatttagaaaatgggaaaccgtacaaatgaaccaataaattcatataaaagtggttgctgctcttcctccatcttccattattattcattcgccattattttcgtctctctctccaactttttctccatgacaatgtcttcaaaaatgattctgtacgtttttcgttatttcttctcaacatttactcttttccatctcatttttagtctcttcggtgtgccaatgtttgtcggcggttgtgccattctttggatttattgggaccgtctcaaaaaacca

SEQ ID NO: 5247 - DNA, 3728 bp, Heterodera glycines
gatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgagtctcctattattttatttttttttcaaaattttgaaggcggggggggggggcgggttatttttaccaaaaaaaatcattcttaccagtgcatttttactcccgtttttgggtaaaaatttccgggagcggaatcgggagttcaaaattttccgggacgggagtcccgaacgggaatcccgtaaaaatcccgctcccgttaaaaatcccgttcaccgaaaaaagcgggagtcgggagcgggactcccgtaaaatcccgcgggagtcccgatcccgccgggctctagttacagttgacatttagaggaaactgaaaaggatttgaaaataattaaattttaaatttattttttgccgtattgtctaaaattgtatgaactgaacttgaactcacgaacccacagtaaaaatattgaattctatgaatgtttaattaaatatacgtctgatcgtttaacaaaagtctcaattttttttttgagctttacatatgccttcattgagtgtgaatccagcacattctgtggaacccgcgcaggaagaggaggacgattgggaaactgacccggattttctagtcatttttaatgtcattatttaatctttaattttgctctctttatagaatgcagttaatgaaaaggaaagtcggtggggggcaaagacagtggccggctcgggacaccaagaatcgattaggctcgacaaacttcgggaagaagtgttgaaaagtgaccaagtcgaaaaggcaaccaccccggattctttttatagtaaaaaatgcttgttaatttaaggagagaaaattggcacaaatgccgagggccagcgatggctatggcggtaaatttggagtccaaggcgaccgggtcgaccaggtcgcaacaattgtgatgcttaattaactgattttgagccattttagtgcgccgtcggatttgaatacaaaggaaaagtcgaagcgcacgcgtcgcagcgcgattattcgcatggctttggcggtacttttggcgtacaaaaggaccgtgtggacaaatcggccgtgggctgggacagtcgcgagacggtggagaaacacgagagccaaaagggtgcggaaatttggacattcagtagcagcatctgttttttcacatctgtttaaacaatccttttcacaattccttttatttttagattataaaatgggctttggtggacaattcggtgttcaatcggaccgacaggacaaatcggcggccggttgggacgagagggaaaaggcagcaaagcatgagagtcagactggtaatagcaattctctgattgttctttctaattgcttaaaccttccatttcagattacaaaaaaggatttggcggacaattcggcgtccaatcggacagaaaagataaatcggcgctcggatggaacgaagttgagaaggtgaagccacacgaaagccaaacaggtgcaggaaacatcaatgttttactcaaaccattaatttaaattaagactacaaaaagggctttggagggcaatttggggtccaatcggacagacaggacaaatcggcactcggatgggaagaacgagaaaagctacagtcacatgagagtcagacaggtcgaagagaggcatttgtttgtttggtgtgcaattttaaattttagattacaaaaaaggatttggcggacaattcggcatccaatcggaccgaaaagacaaaacggcgcacggatgggaagagcacgaaaaggtggaaaagcatgaaagtcaaacgggtaagtgcttgattgtcgtctcatatgttgttcaatttcaaaaatagacttttctcccgttcattgacagattataaaaagggatttggcggacagttcggagttcaatcagacagacaggacaaagcagcgcacggatggaacgaaaaagcgagggaagaaggagacggagcagccaaaacggcagcagagacgcagaaaaatggggcacaaaggcagcaaaagtccgatgggccgacccacggggcggccaaaagtctgcgcagaaaattcgaacagatggcctcgcaaggggagcaacaggtgacaacaatgggacaatattgtgaaaacaatcaaataattgacagaatttggaccgagttcgtgaggagagagagcgccgaaagcgcgaggatgagcaattgcgagaacgacgaggggaggaggaacgccaacgacagcagagattggaggagcaatgggcgaagcaaagcgaagagggagaaaaaggcgaagagcaacagcagaaagtacaacaacagccgaaacaacggccgaccatcggtcggacagcgaatggggggggggggaattgtgcctaacaatataaatattgaccagaaacatacattccccaatcacacgcatattttgaacaatttcgataattgttttactgttgaaatgtattttactaattctcatcaacttgaaggtgttcgtttgccatacgctgctgccccagtcccagaacaacaacagcagagaaatagtcgcctcgtcgaagaaaattcggccgaaattgcgtcggaacattcggttgccgagactgaagtggaagaaccacaacctccgccggtgaaggtccgtttactggttccactcacaatcaacgcactcaacgaaaaatttatcatttaattcaaaaaatgactgtttaaatgttttactcaatttgaaaagatttttaaaggttttgccatctgtcgctgacattgcgcagcacaaaatgtttatgggcgctgtttctcacgacgaattgaaaaagcacgcgaatttggacaccaaaggcgaggaagagaaactgagagacagcggagaatgggcggatgagccgaagaattcgatgccaaaagaaacggacgaagagcaaaaggaaagggcacagcaacaacaggtggggagggaaaagcaaagagaaaacagcaaaaataaggaaccaaagataaaaccaaagctgtacttaaatggcagatgataacggagtaaagggaaaaaattaaaaaatttcaaagtttgaaaaattctaacaataagtttttattttattttttcggggcgaaatttaatgactccttgctaatgcgtatgcctcaaattagcttaattagttttaaactgggaattggaatttgtttcaaccgtttatccatcctaatcatggccacctccctacagcatcaccagtacgaattgcctccgattgtctacgacgaattgccagatggtgtcacctcttctgctattactcctgctgatgctgcactttccacccactcggaaatgatcagaatgtgcgccccccgcgaccgacgccgcggtgaaggaggaccatcggcggggaaagcaccgc

SEQ ID NO: 5248 - DNA, 3206 bp, Heterodera glycines
cagcagagaaatagtcgcctcgtcgaagaaaattcggccgaaattgcgtcggaacattcggttgccgagactgaagtggaagaaccacaacctccgccggtgaaggtccgtttactggttccactcacaatcaacgcactcaacgaaaaatttatcatttaattcaaaaaatgactgtttaaatgttttactcaatttgaaaagatttttaaaggttttgccatctgtcgctgacattgcgcagcacaaaatgtttatgggcgctgtttctcacgacgaattgaaaaagcacgcgaatttggacaccaaaggcgaggaagagaaactgagagacagcggagaatgggcggatgagccgaagaattcgatgccaaaagaaacggacgaagagcaaaaggaaagggcacagcaacaacaggtggggagggaaaagcaaagagaaaacagcaaaaataaggaaccaaagataaaaccaaagctgtacttaaatggcagatgataacggagtaaagggaaaaaatttcaaagtttgaaaaattctaacaataagttttgattttttttaaattttcgaggcgaaatttgtcttgttcccaatggtgttcccccatttaaacaagtatcaccaaaaaaaaaaaaacaaagaagcataaaaggaaaaaaaggtcgtctaccgggaaaggagggatttgaaatgatccaccgaatgaaaaattcattgccgaatgactctttgctaatgcgtatgcctcaaattagcttaattagttttaaactgggaattggaatttgtttcaaccgtttatccatcctaatcatggccaccttcctacagcatcaccagtacgaattgcctccgattgtctacgacgaattgccagatgttgtcacctcttctgctattactcctgctgatgctgcactttccaaccactcggaaaatgatcagaatgtgccgccccccgccgacccgacgccggcggtgaaggaggaaccatcggcgggggaaagcaccgccgcccctttggacacttcggcgggagcaactgcaatcgcactgtttgagtacgagcgacaggacgacgacgaaatcggattcgaagtgaacgacataatcaccgacattgaacaggtaataacattttaattgatgaatttgagtcacaaatagtccgagagtacaagagtggtccaatgactttttccctcgtgccattaaattttccaaaatttgccgtccgttttcagatcgatgttggctggtggcgtggcgtgtgcaaaggtcgctacgggctgttcccggccaattacgtgcagctgaccgagcgaaagtgaagcgaacggaaaaggcaaaagcttgtgcaaaaagacgactaacggaggatatgctttgatgtttaaatcttcgcactttcgcaaattcaccctttttgagtgaatgtttccattttttttatcaaatcagtcacgtaattaattaatgggttataaatggaaatattttttcccctcccttcccatatcagttcagataatgcctttttttattctaattgtccagctttgacaggtgcttatttttcctttttctcctttcgacttacccaaaatatttttttcatattaaataataaaataatttttaataaaatgttttaatttttgctttttgttttgtgtgttatttccacattaaatatttacattttgagtcataattgattgttgatatttttcctcatttttgctggtttttatccgtccgttttaatgatccgtggcttttttaaacaatatgataagaatttggtggccaaatttaattcgctgaaaaacaaggcttggcgcgttgcgatgcccggctcaaacatccgaaagttggacactaagtgttagcttttgcaaatgctttcatttttctttaattgattatctccccgtcattctttagccatcagtgggtggagtattgtcgtggacatcgccttcaatgcactaatgaagggccaagtggtggccgtgccgaccgacacactgtacggcttggtggtgttggccgagcactcggacaaattgtacaaaatcaaacgacggtccgtccaaaagccattgggtgaatctttaattgtgcattttcttgggtttaatcctttctttccattgccatttctttcggcaaaacatttgctcatcctttgtctttagggctgtttctcgacaggcccgagagcataaagaagtgagtttgttctttgaattatggactttccatttgccaaggccacctcccaaaaataatttttttttttttttaggaagagaaaatgcgaaaatctttaggaatttgcgtttttcattgtcacccctcccaatttattttggctttttttaaaaaactccttaagattggttttgttgtaaatacttaacaaacccatcgaatttcgctgaatgccgataggcgccgccgggaaaattttttaaaatttaagtggattttgtaacagattttcatcgaaaattggcagatttttgcgatttttagccaggcgcgcgggaaaaattttgtattttagtgccattttgctaccagattttgactaaaaatgaccaaattttgagattttgggctaattttgttaagaaaaatgaccaaattttgagattttgggctaattttgttaattgtaagaaaaaagccaaatttttcagaaatttccttcttttcccttcgctacgacccccccacctcttttacaccggcccccctcgatgcgaaatggtccaacattttgggccctttgcgggcgaaatggggggtttaatccataattttaataataaatttataaaaaatataattccgatcagaatttttttcataaaaataagttacaaaaattaaaaatttttctgaaaaatttattctcttcatgtgtctctattttattttattaaatcatttttttactttatagcaattattttaatttttttttgagtaattaatagttttaattagataaaaaatatagaaaaaattcattcatgatttgctttaatgattatttataaatatgatcaatttaaattatttaattaattgtaaaattagtttatttggcattaattatctctttttactctttaatctcacggacaaaagggggaagccgtaataaacatttcttttttaagacataaat

SEQ ID NO: 5249 - DNA, 2756 bp, Heterodera glycines
cccccctttttgcatgtataatcatattgcttgtttaacttcaggtactgtgaccaaactgtgcccgatgagtttctccacctcatttaccccggccccgtcactttgctgttcaatcgcaccgatgccgtcccgtccgacttcaaccccggctgcagcaccgtcggcgtccgtgtgccgcaggcgaagttcgtgcgcgacttgtgccgtcgcatgcccttccgactgctcgcgcagacgagcgccaacgtcagcggaggaccgaatccattgtgcatccgagtgggtgtggtgaggggaaatcactttgaacaacgaatgcacttcattacggtttcccgaaaacttaaaaatttaataagtccaaaaattccaaaattccaaagaatatggaaaaacaggaaaaaattaaaactattcccaaaaaacctataaaaatttagtaaatttttcaaaattgatatttaatgttttcgggcgggaatgagctaaccattaagcaaaactcgcggctctattttcggatcatgcttttgcttgcaaaatttttttcaggattttgaagagatttgggacgacatcgatttgatcgttgacgcgggcgaaatcatcgaaaacaatggggcggacgagggaagcacaggtggacggacataaaatgttgttgcttttgctctgattatgaaaggcgtttccccttcgaagttgttgacctttccgtgcccggccaatacaaaatgatcagacagggatggtcagttggccaaacggatgcaaatttaaacgaagacattcaaattacagcgcaccgatcgagacgatacatttgctgagagagttcggactccgatcaacggacgaaattcagagggaacggctgatcgaagcgggcaaagggctgaaaatgttggaaattgaggcccgtgaaatagcacgggaagatgagagtgtggaaagggaggaggagggaaaagacgcaagggaagaggagagagtggcagagaaagagagagacattggaagaaaagaaggaaagagggaagagagtgctgcaaaggaggagaaagacgctggcagaaaacagcaacaaaaagccaattgaggctaattacagtgaacttttttatgtgtaattaaatgatgttaattaattttgttattttccgttttgtctgtctgcggtgggctgatttcccttaatattaatcacagtgacaaatgaattcaactttggaattccatttgtttattgtttatattcatttcaacagagtacaaaacaaacaaaaaataattgaataattttatggctttacaaatttattaattaatttatgaattttcctttggtcacccgcttcgtccgatgttttgcttacactctctctcaaactattgagtcatttatgttaatgttgctccgattccgtcgtcgttccgtcgcttcgtccgctgagtcgggccttcgcgcccgtggcgactccccgtcggatggtccgtcgtctttggccgttcgccgtgccgtgccatgggaacgtgctgatgggggcggactgtgccgtcgatgctcacgcaattgcaactcatcaacgtgtggggaatggggttgaactctgttcaaatagggcaaaaagcattgaagaaatcaaaggttcgcggtacaggcaaaggatttatctttcttcactatatcttacagtgtctctccaatcttccgcctactttaatttcccctctctttttctttactgtctctctctctttctctccccttctctctctctctttctctccccttctctctctctctttctctcccctctctctctctctctctttcttgcattgtcctactgtattattttatgtgtttgttccgtgttcacttactttgtgttccgcctcatccgactgagcagtccgcctccgcttctgctgctgttcggcacttgcactgtgacgggtgcccatgccgtgccctgctccgattcgtcgtcccctccctccccttcattttcctctccctcacgtgcctcttttacttttctgtcgtgcgtttgctgcgtgtgccatggcttcgcctcctccgccgccgcatgttcgtccgcggtgtttgccgttggtggtcgaatcactgtgatcggtcggccgaacggaatggcaccgttgccgagaacgccttcagagggagggaggagagggcacattcaatgggtgccattttggcatttcaatagcaatggcattcgttagttaatgctttgaaccgttttgcactccctcctccgccagtgacgtgttgctcaaattgtgcctctgctgttgtatgacggcattcatcgaatgagttcgatgtgtcgacgagtgaatggtcggcggcagcgaatgcttttccctttcaattgggtgccttcggttggcccgtgccgttagagtaccaccgccaccgctggggaacgattgctggtcggagtcgcggcgaagtacgcctaatttgacggggccgagccgcaggggttccaactgaactttggcattcattgcctatttggcgaaattattggaattcaaaaagtggcgaatggcggacgaaatcacgccgtcagatcaatttttacatctggcttaatttgagtattttatatttagttagtcgctagtttcgaaaacggctaggaaactttccaataacggtttatcctgtcatttccgctctcatttctgatcacaaactattcagtatatcagccgataac

SEQ ID NO: 5250 - DNA, 614 bp, Heterodera glycines
ccccccctcccccgccactcacgcgtccgtgcacgtgtccggtggttgcggcagacgcacattcgccccgcgcggccgcctcctccgccagtcggcgctcgcgcgtaagccgcgttttgcgcttccatttggcgacgaatttcaccacactataggcattccttaaagttttgcctcgacccgacgtggccaacccaaacattctttgcccatcgtttggccaaaaagagaaattccaaattttgatcaaattgcactttaatttttttgcgattgaatttcgatgagcggagaatttggcggaggtcgtggcaaagaattggaaaaggcgggtgcaattgcggtactcacctcacgttcagcttcttctcgatggaatatttggcgatgttgtgtccggccaggccgtgctcgatcagatcagcgcccagctgctcctcgtatttggtcatgcgaaggccccacgggaattggttcattgtctgccaatggcaaatcgcattcatttaaaatcaattttaaaagtttttaaatttttccaccgaccgcaagtgaaacaaaagtgaccaccaaagagaagacaaaaatgcacacgacgcaaatcgctggaccag

SEQ ID NO: 5251 - DNA, 4967 bp, Heterodera glycines
  misc_feature (4671)..(4671): n is a, c, g, or t
  misc_feature (4674)..(4674): n is a, c, g, or t
  misc_feature (4680)..(4680): n is a, c, g, or t
  misc_feature (4683)..(4683): n is a, c, g, or t
  misc_feature (4691)..(4691): n is a, c, g, or t
  misc_feature (4712)..(4712): n is a, c, g, or t
  misc_feature (4718)..(4719): n is a, c, g, or t
  misc_feature (4731)..(4731): n is a, c, g, or t
  misc_feature (4734)..(4734): n is a, c, g, or t
  misc_feature (4748)..(4748): n is a, c, g, or t
  misc_feature (4750)..(4750): n is a, c, g, or t
  misc_feature (4762)..(4762): n is a, c, g, or t
  misc_feature (4766)..(4766): n is a, c, g, or t
  misc_feature (4772)..(4772): n is a, c, g, or t
  misc_feature (4780)..(4780): n is a, c, g, or t
  misc_feature (4783)..(4783): n is a, c, g, or t
  misc_feature (4795)..(4795): n is a, c, g, or t
attagggcttccttttttaggcataaaaaaatcgcaaaataggcattaaataggcacaaaaaccctaaaataggcacaaaaataggcaaaaaaaattttttttattaacgcttttttggtattaaaacaggtaaaaacttaaatatttcaattgtaaatgaaattattaaataaggacaaaattttaaataaataaatttttattaagaaaaaatatattaattttgggatcatttttttgaaaattttttcaattcttaagggtgtattttctgaaattttttagggtcatttcttaggggtggttttttcgtttttattgcatttttcttatggattttttcaaaaagcctaaaataggcactttaggcacaaaaaccacgaaataggcattataaaagtcatcgtagacaccccaaaccaagcggaaaacgcgtttttcgtgcttatctttgcgaatttagtgcgcaaaattttaggcatttgcctaaaaaaggaagccctaataataatatgaatttattgcttcaaatgaattcattctgagcaatcaattaaatttaaatttaatcattattttatattttatattttttatttaaaatttataatttataattataaaaaatttccttttgaatttttttttaatgaatttgcttatgctcaaatatatgaaatgtttcgaaacgtaaattaattgaatatttgtgaaatttgttgatgaaatttcaaaaggatgtagttgctgaggataagcacaaaaaaaaaacagattttcttcaaccaattttcgattttgagcgaatttttagcaattattttcaactattttcgtatatgaaactttttaacaactatgttggttttgtgaaatttaaaaaaaatattttttcactatttatgcttttcaacaaaaaagttatgaaaaaataaataaacaattttgaaattttcggcatgtttaactgaaaattggcacaaatgttcactcaattttcaaattttccctggaggcgcctatcggcactgccggaccaacaattttccccaaaaatttaccatcatgattttgggaaattttcacatttttgagcaattatgttccatttttggcaactattttggcatttttttgttttttagcaactattttggcagttttttagcgactacttaggtacttatttcggggtttttagcaactaaaatccgggccctacagaccgcgaatctgacttctattttgacaaatttctaatccctaacttgaattgaacaaaagtcgaaaattcagacctctcattttatgagttttttttggttcaaattgaagttaggaagtcaaagtaattaggtgttcgatgccagaaaggtgatcagggactccaaaaactccaggggcaaattttcattacacaaattattttacaaaaaaattcagagggttccttcccctttgatttttaataaaattcaaaagacacgactttgcaactagcaccggattttttgtttgcattttttgggtttttgaaattttcagttttatttactataattttcctcttaattttttaattattttggacaggtatcactaattaatagaatgcttttttgcatttactcgtcagtttgtccttttctcccacctgagtgcccgtgtcgtagctgtagtcgtcctcctcgtggatgcgtccgttttggttggaccatgtcagctgcggcggcggatttcccccctcggcggtgcacaaaagtgtcacgttttggcccgccttaagcgccgtgccggcagcagacgcactgatcaagtcgatctttggccgatcagacgaatctgtaaaattgaacagagaaacatggttggacggcaagagaagagacgaaaaagagcaaatttgaaaagattggcagccgaaaatttatttatttattttacaaaattattttaaaaaaatgtatcaaaaatctaaatttaactgtaaatttttctctttcgaaaaatcgaagaatttctttttctgctgaaaagttttttgagaaaagtcgaacaaggaaggagtcgacattttttcagactttccggggctaaaaatattcgctgatttcataattcagaactcgaatttatttaatttggatttttttaatttcagatttttgatcagttaatatttttagcctgtaaaaacttgaaaatgaactccttgttcgaccgaccgacctttcacaaaactcatcccgccatccttaaaatttccgccccatccaattataccgcaaccctcaaaatacatttgtagttcatttatttgcaatcaccaattatccgatcatcataacaattaggccaaactcacagaaaacatccaaagtgatcgagtcgcgtaagtttgtgttcgtttccgggtgctgcgcttcgcaggaaatcacttttttatggtgaatttttctgaaaattaattttcatacgcttttaccctgatatttttaatttattcttttttacccttatcttatttaatttttaattccaattttcttttttattcctgccttatttttatttttaataattccattttttcttttttaccccggtctgaatgccaggctggcataagtgtacacggtgccgttttcccattcctgccgtccatacacatgctccgtcgtctttttgccgttcacgaacaaattcataatcacctttacacaaaaaaattttaaacaaaaattaattataaaatgggtaaataaaagactaataataatttaacagcagaacttgtaatttcaaaattattaaatatttgattttttctaattttgcctccggcttcgatcggtcggtcacgcaagtgatgttcaacggaatgccttcgttgaccgcgatggtcgagccggactggtaatgttggaagcgaacgccggacggaggcactgtggaaacgaattttttgaaattataagcaagaaaaaaaaatgaatggacccaaaacggtgacaaaagcattggcacgaaaaaatttgccacccggcttcagaagttggcattggaattgtccgtcgtcatccaacgacacatttcgaatgtgcaaatggaattcgccagggttatcattggagtaactgcaaaagaaacaaaaagataagacaacccaaaattgggtaagcatttttaatttaaaatttttggtatattttattacttgaattggctttttacgagaaaccggagggggggggggggactcccggggatttgcccgcaaaatttgtaccttttggagtcatagttgaagtccttcggtccataaaatatttaaaaaacatttacaatgttttagttggaattattctgagacaaaaaaaaagtcacaaaacaaagaattaccaaattggcactgggggaatttttagtacaattaaaattttgtattttttccagtaagtccattaaaatgttggtgccaccaaatcaaaaagaaagaagaaataagtgaaaaaaatgtctgtttaccgtaaattaaaaaataaatattcaaattttctttataaattaatgtaaattgaccaattttcactcattcaattattcttttatttttgaaactgtttaattataaaaaagccaaaaattgcttccataatctcgaaactcgcctgtatctgcccgaatatccggggatttcgttggaatgttggatttggttcagaatgatgcctcggtttgtcctccactgcatatggaacggctcacttgtgccatggtggtgggcaattgagcagcgcagtgacagatcagagcctggggcaaatagcataattaacgtttacaatagagaaggcaaaataacaataatttgaaaatttacgaatttttttctcaaagggatattttgttattgagtttgttttacaatttagaaaaccgaacaaatctcaaaaattattaaagctaattttgattattttttgagattttgctcgctttctccaagatgtctcggtttaaatttgcgtgtcccttcgcagaaaattttttaagcatatcattttgccttccttttctcttgttagtttcttagttggtattttatgaattgctactaacagtaaaaatttctttcaattttatttttttcaattattttgaattttttcttttttttattttaagttttcaaaaattatggaaatgccacaccaattaggatggattggttcgtcgggtgctccttgaaatgcaatttttcagcaacaacggcacttgtccaaaacaatgacgagagaaggaaaagcagcgaagaaaagtgaaggaaaaagccaccaattcttagcagcgtaaaaagggagtggtggtgatgcctgattaaattttgggaaaatggcctcaaaggaagtgccatttgaccttaaaaagaaaggggtgggaattttgtcattagttaatgataatgataattaagtgtgaaagtgaaaactaaaacgagaagggaaaaggcaattaattagcaatttaattaaacgggtatgaacaaatcaattaacataattaagcacaaaatatgattgaatatatgcaaaataaaatttaaaaaaagaatatttgtaaaattcacaattcattataattttttagaaaatattgatttgagggtnatngaaaantanattgatanttaaataaaaatatataaaanaaattnnaaaaaaaatgtnggnggaatggggagggnangaaaagagccantgtnagtgtnggaccagnganagtttgtggggnatgttttcgcacaaaagaatgggtgggtgatggcgattctcgcgcgggttgacagcagtgggacggacggcgggtgataatggactcggatgggggggggggctaaatttgggcatatgactgacccccggggggatggacaacaaaaggcagaggggagggggggggggag

SEQ ID NO: 5252 - DNA, 1435 bp, Heterodera glycines
ataggtgctaaaaagtttcaaatttaggggtgtaaaaccctaacatcttatcaaaaaagcaacaaaattaagtcaaatcagtattgagatacataatttttaaaatcaaaaattcttataaaaaatgaatttttgagaaaattttttatttcataggggtcgtatttttgaaaattttagggttttagggatgtattttcagaactttttttggccgattcttaggggtgtatttttcgtttttcgaaaatgttagccctaattattagtccttttagctttttgtcatatgcaaaaaataatggatgagaaagcgacgaatttggcgcgattaatttccaatggatccatcaaattgtcgcagcggggaagggagaaaaaagttggagaaatgtgaacacacatcgccaccatttatggctcaatgggtaaaaaatggagaagggattaagcgtgaacaaataagggttaattgctcttaatgaggccatggttggttgggcaaatagcgaagtgccagaaacgatataaatagctatgtcattaagcaaaatattatagaatttattaatggcattttgactgactgatttatatattggggttataaattgttggtgttcttcaaatttccgaatcctcaagctgctaaaatgatcaagctttagaacccaagtcaaatcccgaccgattctctcattggcactttctgtgcacagagaactgaagtgggttaatgcgggaaacggaaatttgagtgtgcggtgatggggggggcggacgagtgggagaccaattagtgggttcgagattataattctcgactgggcggaacggactcgagaataatgacagcagtttaaatggcaaaacgagcagaggactaaaacggcacgaccagtgccatttgaatgggttcacatcagcagcagggccaaacttttttttgtggctctctgattctgtcgtcgtccaagtggtgggtgctgtcacacattggacttgacacttttggcaatgctaatggtggctgattgtgatgagtgatgatggcctcaccccccccgctggtgttagcttttgcaatgacaattaataaggcccaaggccaaacccttgagcaagttggcatagatttgagaaaagatgtgtttagccatggtcaattgtatgtggctctttcgagagcaagagcttggaataagttgagaattagattagatgatggcaatttagagagaaaggtgaagaatgttgtgtacagagagttattagataacagtgattagtaatgttttagactaggtttggatttagataaagtatagtattagaattgggtttgtatagaaaaatctgttgttctttgggctgctcaggacagtacgaacacaattccaagtgagtcattccttttaattttaataatcctttc

SEQ ID NO: 5253 - DNA, 2205 bp, Heterodera glycines
  misc_feature (2166)..(2166): n is a, c, g, or t
cccccccccccccgcgggagatggtgccgttacccccacctccccaggacaactgtgagatagagagtgacccctttgcaccccccccccccctggggcccctcaaaaatataatggcccccgggggcattggggaggaaaaggcaaagtgtttggcttgtgctgctgatgcttctgctaaacgaacactcactttcttcctcttcctccgtatcgattccatccatcatcatcgtctcgtcgtcaaaaaaacaataaattttcatagcgagtatttatacgcataactctttggttggttctgtttctgttggtggcccccctccttaagaatgactcaaaaatggcgggggacggcaatcattgaccaagcaaatgaatgaccaccaccaccaatctgtgggagacttttttttgggtggggggggggggcaaaacggcacggcaaaatcaatgccgataatgatggagtgtaatgtaatgaaatgtaatgtatctgtttgaatgcaatcaaacttaaactgggaaagagggggtaatgagggaggggcgagagataaaagcagtcacagttttcttttttgcctaaaatggcacagtgaaatttgccgacaatgaaatgattaataatttcttattgccatacgcaaattaatattattatcttttaatagaataggggtttttttgtataatttcacccaattttggagctattagtaggattagtcaaattggggggctattagcagaggattaagaaataaatacaaatattatacaaaattaaaattaataatatgctgcttctcatagaatttagggtttttttttgtataatttcacctaatttggggactattagcaggattaatggatgaatacacatattatacaaaattaacattaataatatgctgcttctccctaatcaattataatcagaatcttcaaaatggtggcagtcgctgcttcggccacggccaacaacaacaacaaaatcacaaacaacagccccaacaactgctgcttcatctcctgttggcttttcaccaatgtgccagtcagttcattcactgccccgccggggggcggggggggggcatttgtggcgaggcgtctccccgtcctcaatcattttgcgccggggggtgcggcggcggcggaagggacccggagacaaggggacaagacggaggagggggaggacagattgggattggacgagatgggatgggatattggttgataatgggggaaaggcgatgaaatatgtgccaactgttgccgggggaaaaggggtcaaaatttgtggggggggggggggggaggggatgagtttgcccaaaatctttaaatattttaattgaagaattggtaaatccaatattttttcgaagccacaaaaataaaaaataaaactacctaggtatctctttttgtctttattattccgtcccatcattcatcagtgtttctttatgggattagcggcattcgttttcaaaatcattttgcgcccaaggcaatatcttttgtccatttttgtctgatggggttttcggtggttggggattaaatttaatgggggatttaattaggtatatcatttaatgatctttgatcactgaaatttattcaaaattttagccaaaataattttgcaaaagtgtgaaaatgggttttgttggcaatggtgaaccaacacaactgttgtgctttgctgtggctgttccactctttgaaaatgggtggtgctgctgaggtgacaaaagttggactctgatggggcggtgtttgttctgaggcgattgcccccgggggaagcgatgggattggcccttaggaagtggggaacggaattgggaagtaattggcctttgcaaaaagcaagacggactgatggacggagggacggacggatgataattaattgcattttaaatgacaattcaaatggcgccgccgccgtcgcccctccctttgaaaattgggagctaatgaattgaaaagggagaggaaagaaagtattgttgtaaaaaaaagaagtgtaatgacaagaagaagaaggagaattgtgtaatatttttggtgatgctaacaattaatttcggcacagaaatttgttggacttaaaagaagtttggccaaggctgagaccctggncattgcaccttacaagtgagattccaatcccgatttctt

SEQ ID NO: 5254 - DNA, 580 bp, Heterodera glycines
gatttgttgaagaggaaagtgtcattacgacggacgcctcttacccatgcgcaatttcctcaaatgctcaccccccccccccgcggcccatccctttccgccgctgggaattttgccataattgacccggtgggagctgcctaaatcagtcctggcaaatttaagtgagagaaaattgaattatttaaatttctgttaaaaaaattcaaagaaatttactgcttttggcaccagtgaaagtttttgcaaaagccaataaaaacaggccaaatttcacttggcctcaaaaataaataaaaaggcttttcctctttcttattttggcattaccttttttcttgctcaaccaaccgcacataatttatgttatggtcaggttaacccgaagaaagtaaaatattaaaatttgccaaattttgacccaaaatctgaggagaaaagagcaaattgtgatgaaatgtcgaggattttcaaattggattaataaatttgaaaggatatttaatgaaatttgacagatttaaaaggaggaatgtgagaaaagaggggagaattgtgaatacagctagctataaattat

SEQ ID NO: 5255 - DNA, 1538 bp, Heterodera glycines
tcataataataaaaaattttttatatatattttggtacatattggagctttttgtacatatttattacattttcggggtaaaatggaaacataaaagattttaatttcattagctaaaacagcaacagcgaatggcaccgacggcacttatggaggatggcggaacgtcaacggtgacaagcgccagttccaggtaaaattaattaaatattaataaatgaaaatttgtttggtttcgttaataaaatacattcatattgaaattttttatttaataaatattatataattaataatattttaattttaaaaatctttcagtaagaagtggaaatttagaaaccaaaaaataataattaaactgaaaatgtttataaatttaggaatttaaaaattaaaaattttgtttattttttatttttttttttctaggagggcgggtggttggatctgtcgttatttgtaaaaatttgtttcaacaaatttctcaactaaattttttttcaggtccacccggtcttccacaggttcttcttctggctcatgctgttcatcatgtggcggggagcactgctcacagtgctgtgacgaaacatcgtcattcatatcatcgacaggtgtcacattcatgtcatattatttctttcaatattttaaatcaattaagcatatgcctttggaccttcgtcaagcagtgcacgacggggaggaccctcgcatggtggtggtgttcagtgcccgggggatgccgaatatgtgcagcaacgaaaaatgccaatcatggggccaaattttggttggtttttcgatgaataaattattttggcaattattataattttttttaaaattttgttggatcatcacaacgcactgctgataccgccaatttccatcaacttcatcatcatcaacaacaacagcagcagcagcaaaggggacaaccttcgtcgtcaagaggcacaacatcgcaaccgtatcaaaaaagtgagctttttaatatgttttctattagagtttggaattttgaagaaaaaaaatatagattcgggttttgtgaatcaggccgagtttaatgtggaatatttaaggaaaatttggcaaaaaaaattttctggcggtgtaaaaatattcgaaaaatgtacaagtgaattgaaaaattatttaaaattcttaagcttttccgttttcagcaaaataaaaaatcatatctgcttttttactacttttctaaaaatgcctgatttttgcctaggtccaaattggagcgagaggacacaaaattatcataatcatcatcatcatcatacaagctcatttaatgacagagtgagttgcagttttttaaatttgtttattattaataaattattattatacatttaattaatacataaaataaaatattttaagtcacatacaccgacaacacaaatgtcggcctcagcttcatctatccggagttgggaggtgaaaacaacactcactttaaaacagatacatatttattaatcctatttggtttcaaaatgtttcct

SEQ ID NO: 5256 - DNA, 3565 bp, Heterodera glycines
ttaaaaacagatacatatttattaatcctatttggtttcatatgtttcctaatcttcaaaatggtaaaaagacgagattcgtttttgtacaattaatttttgaccctgattcgtttctataagcccaattcatttttattgttcaaatttgtttttaaccccattttttattaccacattttttgggttgcaacgcgaaaagcgatgtcatatcgatgaaatttcaaatatttttaaattattttcagcatgtaactaaaataggtaggtcaaggaaaatttttgaaatttcattcgcgtttcaagcataaaaacgaattcgagtaataaaaactgaatcgagacaaaacgaattggccaaaaggcaccgccgggcctctctttccaaaaattcaaaagcaaaaaaacaaaaacaggaatcctggttcttctaacatccaataaattaaataagcatttgacgaattttgtttttttttaaatttttggcattatgtacccatgacacttttacaggcaatgccggtgatccgcgcacagcccggacacattccgctaagcgattcggaagaagatgaacagctgatgaggagatcaacaggaatgatcaaaaatgaaactccacaatgaattttgacccaatgatatgtgttgcatttgctcaagcttatcttttttataatttgtttaaatggattttaaaaaaatttacgtgttgaaaaattataaatcgttttaccgaagccataaatggcagaatttaatacagtaatacacggttcgtctgccttcgttggatggcagtgttggtggacatcggctttcgcctcggcacagtctatacgctgctgcactttattggtgtggaattttttaaactaaagttcaaagacttgcttaatgtgaggatcgaacttgtcatttctctctctgtctgtttatcaatctctcttttctctctctctctctctctctctctctctgtctgtctgtctctctttttctctccattcaattagtgtataatgttaattagctggctatctctttctttctactctttcgttttctatctctctcttcatctcactctcttctctgtctattcctttttcgcactctctctctctttctctccctcttcctcattctctcataatttcctttgcatgtctttttgaattatattttttccccatcaaatttctttaaatatttatctttgtttagctctcgcattggtcgtgcaattggaatagagcgtgatcctttcctatacgagttgcagtgtcaaattgttgccgaatttggcgattgcttatctccaagagttatgttcgcgatgttggcactacatcaaaaggtagtgcgcccgataggactcggacccattggcttgtctctgtacccaaattcggcaatttaaccaactgagcccgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgccactgagccacaccgactcacttccaatcaaagcgcgtccattgggattcgaactttagggcctttcatataaaacattttatactgttggtaccaactgaaccatgtgcgttccatttcagcagtaaaatggaaagtgcgccattcattaggactcgaacccgcgagcagctcgcttcccctaactcctcccacccccgaaaacttaacaagctgaaattttacaagaaaaacatgagatttttttctaagaaaattacatgcaaaaaaactcgagaataatttaagtaattttggaaaatttaaaaaaaaattagtaattcagcatataattttttgaaaagcagaaattaaaaaaaaaaaatttttatttactttttctttttttttttgatggtcatgccgatgctgacattttggccaatgctgatgttgtcatcatgaacaacgtgttcacattctttgctgaccacgctgaacaggtgggatatttttaaaaaaaaatttgcgggatttttttttttttgatttttcctctctcattcagtgtgactactgattaatttttttttaaattttttattttctcactaccaatttttcactccttgatttttctcccttcgtttattctttagttttttaaaatgttgttggatgaaaatttctaacttagaaaattttaaaaaattttcgagtgaagttaaacacattgtacaccttttatttatttatttataaagaaaagaaaaagtccacaaaagggataaatccacttactttgtggacatatacatacattaatcgtccaaaagtatcggattatacaagcacaaataaaataaaatcgccaagaaaaatataaaatgaggtcaaagtcaaagagatcacaattaccaaatcacttataaaaaaaaaattttttaaatattatgtagccattttttaagtttttccggtcttattgtcttaatgaacttttaagttttgttttaaattgatttaaagaatttttgtttttattagttctttatctagttgattccacaattttgttaccctccgcgtgttgatggattaaaaattgaaaatagtttcagatctgttcggccataaacaattttatgtgccatgaacagatcaaatagctttcgcctattctcaagtgttggcagttgcaggtattctaatcgattttggtatggaattggcggaaggctgcatttaaaaaatacccttttggtgaaatatttttgacacttttcgatttttttaatatttttttgaagagacggattccaaacctccggagcgtattccaataaaggcctaatataagttttatataacgtaatccaaatcttagatgatttggatttaattattcggaacaaggaacgcatacgtaaatacgcattccttgttatttggttaatatgatcggaaaattgtaatttgttatcaatgattactcctaaatccctagttgtatccacagcatttattgtatttccatcaaatttatatgtttcttttgggttgtttgaacccaactataatacaaaagttttttgaattgaaacttttatttgccatttatttgcccattcgaataaattatgcaatgctttatgcataatttccgtgtcggctcttgctttataacaaatatataatttaacatcatcagcatataattttattttcactcctgatggcaaggcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtt

SEQ ID NO: 5257 - DNA, 3283 bp, Heterodera glycines
  misc_feature (7)..(7): n is a, c, g, or t
  misc_feature (17)..(17): n is a, c, g, or t
ctaaatntcggtatttncaaagggaataacatcgtatttccgttgatatttaaaaatggaatttcttccctttgaaatagcctttttctcaatttgcgagtgaaatttatttgtttgtatttttatatgtaaactaatgctatcataaagtgctttttttgttgggtcagttttacattgcctatacagtctggctttctctttgatggaggccaataaatgcgttggatatttaggggtcaaatcttttttggtaatttttttcattggaatacactcgtttaaggtttctagcaatgtttattaaaggcgttgtatttttcgttcacactaaaatgctcgttagataaagcgctaattctagaagaaaccataatattaaaaagagaaacattcgacggaaaaaaccgtcgattgtaaaagaagtttgttttttgtagtgtttttggaatagacaatgtgaaaatttgcgctaaatgatccgatgaaaaaacaccatcttcaatagtacattgctttacaatttgatcatttgccggcaaaactaagtctaaccacgaatttcccctggtgggtccactagtggcattgaaaaaagtaagcttactaaaaaagtggcaaaaaatttcaccaaatttactcatagaaatgggctgcccttcattccataccaggtctttattcggaaaattaaaatcacccaacacaacacaattatggctatagaatgtttctaaaaattttaaaagttccttggtttgtctatatgttgtcttgggtggtcgataaacaagcacaaatctaattgattttagtttttgtaattgaaaaaccaagatttcgcaattatattttgtttcagaaaatttaacaaaaaactcaatttctttcttaattaaaacaccgcaaccacccccacgtgttaatttttgagattttctatgacaaaaaacaaatttataattttcgattatccatggactaaagaggattgggtttccctcctttgtccacgtttcagttaacaggcaaatttctatgttattatttactaaatttaaagatatttcatcaattttgttgtaaagtgatctaatattaactaagcatgctttaacttcccctattttggttttggggttattgggcttaacatgcttaagaccggaaaagtgcgaatttataaatgttttatgagtgtgatttggtaaaacagcaagtcaattggtgttatttttaaatgccgcaatgtctgacctcagcatcactttgtccgcgtacaccacccactcgccgccatcttcctttcttttcctgctacactcttcttgcagcacacgtcgggccttgagttcctcttggctgagtaaagggcgaattcggatgttgctcatccccaatttctgattgatttgcgcgcgccctttgttccactgtgccaaggtttgtttctgatgtttggagcacccgaaaattactttcatcaacctcgggcggttttgacctgcctttgcttggtctggggaacccattctgtacacagtgattgggctctcgatgccaagctcattgagaacgcctgagatggcagttcggtcctcagcgactcgctcggacggcttttgtttctgcgattcagggagacccattacgacgacgcttcgccgacgctcatggtcttgaatggcttcttccatcattttctgttgtttgaaatgttggagttgaaggtcttgttcggagatgacggcctgttgttgctggacatgctgtaaaagttcgacacaaattttcaaaagttgtttagtgatggggtcgacactgttgttgtccatttgttgggaaattgccgcaagttggtcactaagagcggtgtatgggtagtcagaggtagatttttttgatgcgttgtctgagagaggagaaagatgggaagaaggacgctttccaaacatgtaaactttgtcttttccatgactccccccccccccctctctaaaaaggtttcctgttggcaacatttgcgtgcctatttgcgtcctgacactctgttgttgccactcgccctcgctggagttggtcactgcccatctctgtccgtcggcacttggctttgccttcgacgattggttacaagcggtcggtcatcattttgaataattaattataaacatttttttttgaatgaagatgagaaattgagataaaagtgggaaaaaccaaatacttgaaatttttttttttttgaaaaatggataaacgatcgaactttgtttgtttgttttactgtaccagatccgtttccatataaaaaaaaaatcggaaggtggcctccgaaatttttttttctctttgggccaaatatttttctctagtgttgcaatatttttcaacgaaagatattagtcgctatttgtcactattttaaatgaccatatttgccatatttgggtgaaattttcaaaaaatggtaaaatatgggaccgcggcgctatttaaaaagaggacctttttaaatttttttttgcacttttttttggtcgattttttttttatttattttaatatagaatttgtttttttaatatatggtacgcataaataatttttaaaagaaatttgacgctaattaaaaagtgacaaattttgaattttatcaaaaactataggggggacccttttgttttgcagttttttaagaaaaaaaaaattcgtgaatatacttttactcgccataattgtgctgttaatgtttaatattcattattatttataaaaaattttaaaaaatttgaccaaaaaaaagtgcaaaaaaaattcaaaaaggacaactttttaactagcgccaataatcccccatgggctataattagagcatatacggtaattaatatctgccaattgtgcaaatagcctagtggctagtctccttgactttcccttcttctttcccctggttcaagccctctacagaaattaaattattttttttgaattttctctgaatttctaataatattcgatcacttagtccaaaaatgattaattgttcgaaataattgaagaaaatttgatttcaaaattttcattaatttaattattatcagatgatcaaatatactttgtttttcaatttgagtgtgttggcgttttgttttacgccaattattttttggcaatttttttcgttttttaccgtccatgggcaccatcgacaaaattacaaattataaaagccaaaagttttttgaattgaaacatttaattacccattcgaatacct

SEQ ID NO: 5258 - DNA, 1623 bp, Heterodera glycines
attggcattggcaccttatcgcccgcctcggctcccaccgccactttcaaaaagggcagaaacgcggcccaaatgtctttgaaccattccgcaatttcatcagtttttgccgcttcccaaaagtcgcttccggccaaacctattaattagttgtcaataaacaaattccataatcctttccaacaagtattaccatatttattgcccaaataacgacaaattgtttgagactgggccaaaactttgtgctcagttccctcgtcccattcgaggttgggcaattggccgtaaagatagtctgaatgaggaattaattaattaatggtttccaaattaggagctacattttatgatttgatttagaaattaattaggaatgaataatccaattaaaacaagtaattatataataggtacttgaaattgggaagttaattaatggtctgaaaccgaagctaatcaggtcgattataaatgatttaattaattattattgaatgttttgcttctttcactcactttgtttctgcttcagccatttttctcgcgatgactcatcggcaagagttgagctgaaagtgacgtcttcaaacggaatgcctttgtaatggaggataagacggatctgcgcatttggatgaacaaatatggaaatgtgttcgaatttgctcttacgggttccgcaattcctctcgacgaaaaataagtgagtttataattttttgtttccgcgtccatccgtaaatttaaattgtaaaaatttaatgttgaaaaccaaactttaaaaacaaaattgcgaattatatataatgagtgttgtgcattattgaaattatttgatgataaacaaattgcagaacaaacacagcaaaatgagaagtggcgattgattttatgtatttattatttttcgtttttcctctccctttttctcccatccccaaattggataaatgaaatgcataaacaaaaacaaaacgaaaataaaacaacagcagaaatgtgaatttgtacattctgtaaggggcgataataattaataaaaaaattacaaatacaaaatataaattcataaactaaatggtaaatattgatcataggccccaaactcaaaaatgcttaaaaacagtcagaatcgatgtaaaaaggtttgaaatgggttggaaaaatagaattaggggcgcgcttgccctttttcaggatgaaaagtgccgaaaatggagtgccaaactcagctgggactcaagtgaccgtgctatataaagcactcaaaagacattataaataatttttctagggtaaattgtggcgctgaacacgaatatgacctttaatttgcaaaattccgaaccccgaacccaaatttcgaacaaaaactcaaaatttataaataaaagaaaacatattattaaggggttttgaggttgctgaacacgtttatgacatccatttgaccaaattcgaacaccgaaccctgactcgaacaaaaaaccgaaatttaattttcgacaaaattcaaaattaagcctattttcgcaaaagggagcatgcgaagacggagcaagtagtggtcgagacggagggcggaggaagcagtctgacgagcgccacaggcggttgact

SEQ ID NO: 5259 - DNA, 1981 bp, Heterodera glycines
caacgctcgctagcagctatctggttgatcctgcctgaactgatgtgttcatttcaaagattaagccatgcatgtgtaagtttaacctgccagacagggatactgcgtttggatcattacaccagctataatttgcttgtccttaatttctaacttggatatcagtggtaatttcagagctaatacatacacctaagctactatttcatcatagtgtagagcgttttatataccccggtccaaggagtctcagttgattttggcgtctcctttttcggctcttttcatcctgcaaaagggcaagcgcgcccctaattctatttttccaacccatttcaaacctttttacatcgattctgaccgtttttaagcatttttgagtttggggcagggctgcacgcaattgcggattgcggattacggaaattgcggggtttttggacccccgtaattgcggattgcggatttttgggatttatccgcaattttgatccgtaatttgactattggattatttttcgagacgatttcttgtaagattattttttataaaatgaatttttttctatttttatttaaagaaaatatgtacatttgtttaaattcttatttctttagcaatttaaaaatgtcaaacttaaatcctggtaattggtggtattatttaataattaatttaaggcaacatccaccagtccatctgccttggagacaagacaaaaagccgaagttgaagtaaatgaatatttacgggatccaaaaattaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgcttttataaatttgctttttaatatgcttttaaattgctttaaaagatttataggattttttaaaataaaatttaaaattatttaaaaaaattttttgtttaattgcggattgcggattacggaaattacggaaattgcggagtttttggacacccgtaattgcggattgcggatttccgtaattgtaaatccacttgcgtgcagccctggtttggggcctatgatcaatattttccacaaaatgtatttgtaaaaccctaaattcaccaaaaagggctttgggaatggttaccagaaatttggggaccccaacatttgggggatccgacttttggtgacccaaacttagggactcgacgggttctcttgacttatacgatgtttttttctcatggacaaatctcgactaatatggtaccaatcgatagctctcgatgagacatatcgatctaggggtgggggaatttgatccgacaagtataaaccggtttttgaaccgattcaaaacacaaaaagtgaagaaaattgggcatttttaattaattttttaatggacatttcagtaccaatgaaaaatggataaaaaaaatgaaacaaattttcgcaaaagggagcatgcgaagatggagcaagtagtggggcgagacggagggcggaggaagcgggtctgaatcgttttggcgccgccgttttggcgccagcccaagttttcggactataacttttttatttgttaaccaagtccagcaatcttggtatcaatcgaaagcttaacatgtttagaagatatttctaagctattgcttcgcgattagacaattaacaaaaaagttataacatgaaattgcaaaaaagtcgaaaattttgaggttttttcctaataacttttttagaagctaaaatttttgtttgttttttgtaggggtatgagagcttgggaggggctgtcaattgatacaaagatagatagatt

SEQ ID NO: 5260 - DNA, 3078 bp, Heterodera glycines
  misc_feature (2835)..(2835): n is a, c, g, or t
  misc_feature (2882)..(2882): n is a, c, g, or t
  misc_feature (2884)..(2885): n is a, c, g, or t
  misc_feature (2909)..(2909): n is a, c, g, or t
  misc_feature (2918)..(2918): n is a, c, g, or t
  misc_feature (2994)..(2994): n is a, c, g, or t
  misc_feature (3036)..(3036): n is a, c, g, or t
  misc_feature (3047)..(3047): n is a, c, g, or t
ttaatttaatttaatttaatttatcgagcaaaccaaaggcacatgagtgctcttatatggtgccaaaaagaaaacaacaaataaatttgatcaaaataaaaatacaaaatgaataccgtaataaaaatgaataaaaataattcaatcaaatgttaaaaattcacaggtgataaaaatatagtgtaaatatggcaacatggaaaatcctactcagaactcattgcttttagtaaatccctgaattcctttgccttattaatttgtaccgctaccactggaagattagaatttgaaaattaaatacttgttacatatgagtgatccaactatatttattagagttatcaaaatttgagtaacaaacgaaaaagattcatttctaatccaattatcgaaatggccaaaaataaattcataattattatgaatttaaaatttcgaatttctcatcatccttcgtcactttcgtccccacaaattgtcgaaaattgtgccgcgattgttggccaaggacagcgagtcggcataatacgactggggacgagcatttgtcagagaaactgtgagcagaagaagaaacagcagcaaacgggcgaaaaacattttaaagtttaatcaaattaattaattattatttggagaaaataaaagtaaatatttttgttgtcgcgcgatggaaatgatttttgatgggcaatttggaatttgccgccacggcctttccttttataggcatgcgaatggaaaggcacaaaacagaagcacaaaatagtgcccaatttttcatattttgtgttcttttcaacacattaatatcatttccaaaatcggagttgattcatttctctctcagatggaaatctcgtcgaaaagtgtacatattttgctacaaaatgtgaactaatttggttcatttacacatttttgggtctttttttgttttcataatcttttgttgatcaagtgatgcgcaatttttgggcggaccgtcgtcgtttactccattcttttgcgcacaatgtccaaacagaaaagggactttcccttcctataaaaagggtcgaaagtggaaattgcattcattaattaattaaaccaaaatcattcattaactaatcaatcaattggtcagtccctctcacaatgctcttctccactccaatgccactctttctcgtctcttctgtctttctcttcgtttttcttctcgtcgccatgtttttggccaatccgtccgatgcgcggcctcaatttggctcatttgccgattcgatgaccagcggaacgattttgagtaatatgtggggaaaaaagcgatgagaagcggccaacagcagacggagaaagaaagaaaattaaagaaaactgaagagaacaattggaaataatcaacaattaataaataattgttaattttgtataatcaatcatcaattataaatggttggtaattaaattgattttttattttgctggcggaaacttaaaatcccgaaagggttcccgactgcttattgttcgattaactgatttataattttacgctatttttggggtttgccaatttgtggcattttcgtattgctatttgattattatataattcattttcaaatatcaaatgcatttcgttaataacactgatttttactcttttaaaatggcatttaaatttaattggccaaaaatgtcacttgcttaatcatttacttatgttcaaacataatcttttaatttgtcggaattgaatgaataagccataaaattcactcggaaaccaatgagtaatattcaaaagcatttttttgtcgctcccggcaaatggcaacggtctgagcaatggcggacaaatttggagctatttataagcgaaaaggtgcagaaatgggcatttcttttgttgcatttaaaaattcatttaaaacatttttatgtgtgattaaaaattaatatttcagccaaactcttccaaatggcttaccaattgacgccgatcattatgttgcgttggttgttcgttgggcttgtcctctcctcgcatcaacagatggcacaaatgggtcgaatggaaggggatcaaatgcgcggcatggaaatgggccaaatgcgtggcatggaaatgggccaaatgcgtggcatggaaatgggccaaatgagcggaatggaaatgggccaaatgcgcgggatggaaaggggccaaaagcccggcatggtcatgacacaaaaatcagaaatggatatggcacaaatgcgcggcatggacggcgatgatggccagatgcgtgcttcatgggcagcatcgcaaaaattgttacgcgcagaggaaaaggaaaaagggccgaaatcgcaaaaaaatgaaactgaaaaggtgaagaagacatgcgaaatgagatgagtttggtaaaacggaggacaatttcaattttaaattaaagaccgcgttaattagggggttgatccactaattaattaattcactaattgacttatttgctcttttgctgaacagccgccccagcagaagcagcctcaagaaaagccgggggcgcaacaggacgacacggagacggaggaggacagcaaagaagacaagcggaagccgataaagtgtcaggaggagaggaaatgctacgcacactcggagtgtggcgcaaggagcaaatgcgaaccggcgacgctggacaggaagaagaaggtgggcacgtgcgactgcggcgtgtgcgggggattccaactgttattgctgtgtgagttgggctaattaatgaaaatacattaaataatgatttatgaaattactgcgttttttgttttgtcatttctatttcatcagcngaaaggtcgatcctatggatcactttttgactttttgtttgcttaangnncgtctcacagtggcgccctttccnttgacaaanacatttttgcgcgggagtgtgccggactgaaagatgcttgtgtcgaaaagccattatttcgtgggcagcaaatccnaaaagtgcgactggcgagtgggcttccaaaaggcggccttangaatctgaggnatggacagaagaaagtgtgcacaagcagaaa

SEQ ID NO: 5261 - DNA, 717 bp, Heterodera glycines
agtagagaaaggcaaatcaacatttttctcttagcgaaaattgttttaataaatatcaacattgacgttgatatttatttagggaccagagcgtttgggcccccgtttttgggccccggggtcgtttggaccccaacccaaaaatagaaaaatgtgcttttttaaaaattaagattctaaaaactaagcctgagggatccctcgccacttggcataagttaggtttaattacattcgctcattttttacttattccaaatcctattattttttaatagttaaccaatttgatgtacattctgatttggacatttttcagaaatggctaacccaattgcaaccaaaaaacaaaaagtaaaattgaactctaatgcactttatgagtccaatcaattgacaatccatggtttggtaatagtaaagtttatccacccccccccctttttcaaaaaaataataaaatttttaaaaatgcttaaaaacaggttttagggggttttcggggtcgctgatcacgaatccgacatccatttcgaccaattccgaaccccggacccgaattcgaacaaaaaatcaaaatttcatttttcaccaaaatgcatatttattgcacaaaatcgatccaaatgcacggaatggcagcaaataagagattcacacaaaaaacatgtagtaggaacaacattgaaaggaaaaacactattgacatggataaaa

SEQ ID NO: 5262 - DNA, 4286 bp, Heterodera glycines
  misc_feature (4263)..(4263): n is a, c, g, or t
aaatcattgcttgatgtggatttttgcttcaacagttcgaaagaaattttgcgaaaagaaatgagaaaaattggacggataaatgaatgaataatgactgacaaatgaagtgaatgaatgagtgagggcggacagattctgaacaaaggaggaggggtcagagttgggcagacagaaaatgacctaatagaaccaaaacaaagcacagaagagaaacagaagactatcgattatttgttgttgccttaaaggcgcactaaaaatgacagagagcgatgacacaccgtgtctaacacacgcattgaattcgcaaatattacggacaaattcagacaaaaacacatcacaaaacaagaaattgaaattaacggtttgaccaatatgtaaaaaagaagaagcatgtcggaattacgtaaaatgccgaggcacacttatgcttatgggggtggagaagcgggtataccacaattattgagaaatacgtaataaatggaaacaaatgaataaaatgaaaattgcggacaaaatgacacatcatttccatcatcgacaatcatccgtattagaaacgttgaaccaagtgaaatcggcgccagaattgactgagaaatggacgggcggcaaattgcggtttttgtcggtcatcggaatcactgaaaaagcaaaaagggtgcaattaattatggggaaaattgacgggtgaccccgccatggctttaccctgcaaagtgatggtgattaactgacgacgcattgcgacaagcgcagtgaaatgcgactgatcaaaacagagcaacagcggagaactgtaaggaaaaaagagtgacaattgtggcaatcaaatttcatatttacgccaaaaatagggccagttttgtgggattttaaattaaaaattggtgattaaaattcctgggggtgaactgaaccagtgaaaacagacagcccctgaaaatgtaattaagttgggcagttttctgaaaaattgtctgaagctcgggcggacactcaaatggcaaataaatgcagtttgaccctcagtgtgctgatttcgatgatgtcccgctccaaaaagtggcggaagtcggccgggtactgctccaagttgggcaaaatgaaggcgtaggccggctctttggtcactttgcgaccaccgcgcaatgcgccggaacgccaattgaccggcggagaggacgaacctgggaaaatggggtgaaaaagataaggaatgtgccaacatttgatgccattcatcccgacacattttttgaggaaattctgttttaaaaattcgtaactttgtggcttttttgggtctctgtggaaatggattggcatccgtagtggcaggaccgccataccaattgaaaaattttcataggttcatgaaatatcaaatccatggccatcacaatttgatgtcttggattttggaaatgaaaaaacaactcactgggctcgcccgatattccattgcaagagaacaaacaaagaagaatagacacagaggaaaagggaaatagtgttgtagttagatggcagacgaaaaatagataaaacgacaaaagaaaatatattttttaaatttgctctcaaacaacgctatcaaaagacaaaatcactaaaaaaatatcccaaaaatgcatttttccacttttattatggaaatttcaatacgtaaaattttgaatttgtgaaagaaacaataaatattttaacacaacatgcaatcgatttcccccttcaatttccctcctcaggatttccatcaatcgacggcaatttgttttcgccggaagaattactcgaagcaaagtcagggctcgcaattggtgaagggttctgattcagttgaatctgtgttgaaatatttgtaatcataataataataattagaaaagatggttgcatttatttctctaattttgaaaatggtagttttgtggtttctgcaaaaaaataattttaaaatttaagaagcacattttcgaggctaaaagcgctgatcacgatctgagcttaaacttggcaaaaccattgattttgtatttttattaagaactgattttttcaaaaatttttaattttcaaatttaatcacccttaaaagaatccgctcaattctggacatcattccgcgccatttgttcatggaattagcgaagattttaatcttgacaacatcccattccttaagtgttgtttagttgaataagcaattcattaccccacgaaattcggttttccgattttatgaaaattgtaaaccccgaaagattctttcattttatttttaatcattcaaaattttctttaccaatgcgtttattggaaggagttggatctcacacaaatacttctgattaaacttcactgaattaacggcgaagaattgacgaacactgagtcgctgaaataataaattgtcatttgatgatcaaaaaacaaggatttggggattctcttgtcatgggcaataaaaagtaaattgaatttcaaattacccaacctttttaaaacatatttttgcatgggttttaattttttcgcccattttttaagcaaatatgacaaaaatgttctcagtaagatgtaaaaatctcttattttttacgtattcacctgcatctggtcatcaactcttaacgagaccacgcaaatccttccatcgtcgacgtccgtaccgaaaaacaaattcgggctgaatccgccaaaaatgaatgaggcaaataaagcgcccaaatcgtgatgagtacgattccgtgggagaaacggtcgcagcgtcacatttgtaaaattatatgttgtgttggcctctcgctcggcgaccgtcttaaaaggcattgcactaagtcataggaaggggacaattattagagctcttaaaaaacccccatttttaaaatttgatgtgcttaaatttgctaaataaaaagacgcaaaaaacgtgatggtgtttcagttttccatactttggttttccattttttgcctctttcactcctccgaatcaaatcataaaacaaaaaattagagttagccaaaacgcttcgacacaaaagctcgggggcaaattgaagcaattcgttgttcaattctgccggaagtttgcggacaattttaggtttcattagtaaagggccaaagggttaacaaggggaaagggtttccgacaaaacgtcggaaaagggatcaatcagttggattttctaaaaagcgattttaggtcaaattcacataaaaattggcccgaaaagtggggaaatataaggtgatacaaatcaaatattggaaagacaaaataatcagttaaaaatattttcttaatttatgaataaatcaatttttaaacatactccgatggtggacacattcacagagaacgttgggacagccgcagcagccatacgaattgataatgatcaaattgtatttttgaagaaaaaaaaatgcgaggctaaagtgaaaaaaacagaacgaccaacagacaaacttaatacaaaataaaaatgttgatttagaacgatgaatggtattactaccgggtcaatggcaactcgtacaaaagtcaactggtatcttacaaaacaaagcctaagcttaagcatagaccaaagcaagaccaagcatagtgcctaaagattaggcctaagcaattgtacgagttcgcatgacacaattgtacaacaatcgtaaaacagtcgcaaaaagtattcgttagatatttaatatgaagggatcattgaaagtgagtgattcgaaaaaacaatatattttcggatttagaatgaattctcaaatcattgcttggtggtttttgcttcaacagttcgaaagaaatttgcagaaaagaaatgagaaaaattggacggataaatgaatgaatgactgacaaatgaagtgaatgagtgagggcggacagattctgaacaaaggaggaggggtcagagttgggcagacagaaaatgacctaatagaaccaacacaaagcacagaagagaaacagaagactatcgattatttgttgttgccttaaaggcgcactaaaaatgacagagagcgatgacacaccgtgtctaacacacgcattgaattcgcaaatattacggacaaattcagacaaaaacacatcacaaaataagaaattaacggtctgaccaatatgtaaaaaagaagcatgtcggaattacgtaaaatgccgaggcacacttatgcttatgggggtggagaagcgggtatacccacattatttgagaatacgtnataaatggaaacaaatgaataaa

SEQ ID NO: 5263 - DNA, 2813 bp, Heterodera glycines
  misc_feature (14)..(14): n is a, c, g, or t
cattcatccccgancacattttttgaggaaattctgttttcaatattcgtaactttgtggcttttttgggtctctgtggaaatggattggcatccgtagtggcaggaccgccataccaattgaaaaattttcataggttcatgaaatttcaaatccatggccatcataatataatttttcacagtcaaaaacgataaagttaaacatctgtcattattaatgactcattaagaatcttatttttggcagcgttgggtcaacccaatttctttttgtgccagttttacaactttttttgtatcaaaatttggcaattttacgcgaattgttgagaaaatatttaataagtgaactagcggagcgaataaagtgattgaacagtttttttgtatttatgtcaatgaacaaaagtggaagaaaatgactaatcggcagaagcagcagtgcttttttcggggtgtgcaaatttccgtctccgccggcgggggaaaaacgcgtaaaataatttatttgttgtactctctgcccacgaaacaaacaatgtaaaacagacacagaggaaaagggaaatagtgttgtagttagatagcagacgaaaactgatatatcgccaaatcaaaaacagtaccatttcaaaaaagatttttattcaaatttgctcaaagtatggagccacgcgccgagattttgcgggaatctcagtccgcaattttcatttgttaccaaaaacataggcatttcctaattaaaattgactcttaaatttattttatttagaaaaatcacttttttttctaatttactaatggcagcttcctcatctgctgcttaccccgtgctgtttttcacgcaaaaacgggcgggcgatggtgagttattggcacataaaacaaaaaatatttgtcgccgggcggtccgaaattttggaattttcgacccttttgaatttcatacgaattttgttttttttctcccacttttattcatttttgattttttccccgagtttagacaaactttgggtgttctactggctcagcgatgagtcaaaattcggcatcgccagcttccccgacacagtgtacgaaatggacgcggacagagacacgaggagggcattcctcggcaacattgccaagagtttggtggaggagtactgggagtaagtgaacatttttgctaatttaattgtttttttactcttaaagtggaccccaaaagcttcacggaaatcaaaattaaaaaaaacacctaaaatggggatacaaactaaaatagtccgaaaaatcggtatttgtatcgatggcccctcactttgacgaaaaaatatatgcctaaaaagtagtatagatttgaatttaggttcagaatttttgaaaatttatgtatttttaccgccttccgttaccaacaaattagaaaaaaaagttacgttttgtcaaatatctcaggttttggacatttagcgaatttaaaaatataatttgtttttaccaacaaattttccctacattatgcaatcccttccccggattaggacaatgttcgaggagggccggaccaagatcaagcaggtcaacgacgagtccgccaccgtttgctacgccttcaaacacttcctggagttgccgcgcgtggacgacgcgacggcacggcgccaacgcattgaccgactcgtcaaatttttcattgacgaagcgctggagaagaagcgcatggaggtaaaaattgaattcaaatttgatggaaaatgtctgaattcgtgtaatcaacaaaatttttctaaaaaatatgcgtattttctgcgagcaaaaattcaaaggaattttttaaaaaattttttggtctgttttaaaactaaaaattgaatctttcttaaaaaatcttgaattttccactaggaaatttcaaacacatgcaacggtaaaaaatggcaaaaattagacctattttttgggaaaaaccgctacaaattccttcttttactctccctgggggctgaaaatttataaaaccattgagaaaatttttttttttttgtaattttgctccgaacagtaaacaggaaaaggccttcgggttccgctaatccgaaagtttctggctacaagtttgttctgaatttgatttattccggccaagataaactttttgaaaatcactactttttgtcgtctgtccattttttttatcttttcagcagggcaaacagcagcaggtgtccgtgtccaacaattggtcaacaaatggacaaccacaaaacaaaaagagtccgatcaaggtttgtttgtttaaacaaaaaaaaaaaatttttttttttggggggggggtcagtttttcccagagggggagccctaattaaatggggctaatagcctccggccgggtcacaaaattgtatgaattttgtaaaataagttttgattggcaaccaagcaatgtaatggacagcccatccatttaccggaaattttttaaacataaaaattaatcgaaaacttttagaaattaaaaaaaaatgttttttttttttgttttttttggtttttattttcaaattcggatttttttcagaaaaacgggaatatggtgttcatcgggagagggatttaggcccaacaaaaccatgcgaaatgcaaaataattagcctaacaaatgtgaaatattttcagcgaaaattgccggcaaactcgcgcaaggcactccgcaagttgccgaccatgggcctgaactttgacgacgtaattgaggaggatcagcaacggttgcgcgacatgcacccggtgggtcggaaaatataaataaattaata

SEQ ID NO: 5264 - DNA, 1235 bp, Heterodera glycines
atagctattgcatatttcattcatttattcaaatatattattattcaacaataaaatttattttataaaattaaatgcaaattttaaaaatttgttaaagcctccatttttatataagggctaagataaatggcaaaacgacaaaaaaaaaactacaaaatatagggcacccctaatttgagaaaatataataatgatttctagatgtgccatcagttatatgagatgcaaatagatacataacactaatttatgctatattccaattttaagctttaaaaaaaacaaatatttaattgccttcactgttaagtgctctgtaaatataatggtggcaaactgaattttcattgacccataattaacacaaatttggaaagatataattaatctgctcaatcagtctcatatacagtgggtggcggatttaggaaatgctcaaaggttaaattgttgattccaaaaaaaagttttgaaaaaatcttttttgacctatttggagtttttccaatttttttttcataaaatacaatgattaaaaataattattaaatttttagattttgccgttttggtgcctttttggcgttttttccggaaaaatccttaacaagaatgtaataaaaaagaaaacccaccctaagaaattacctgaaaaatttcaaaaaatacaccctaagaagtgaaaaaaatttcttaaaatttgatcgccaacttatttttttttaataaaaataggtctaaaattttccaaataatttaatgatcaaaaattattaacaaaaattcaatttttgaggactttgccatttctttcgtgaatttttggctatttgttcatgattttttttttttttttgcatttttcctgactttttgacgtttttatgacttttttgtgactttttgtcgattttttataacttttttagtagactttttggaggtttttcgtgacttaaattcccagctctatttatgattcgaaatttttccaaactttttattcggtaggatgcccacttctgtggaaataaaaaaatgctgctgagatgaagcatgaatggtacaaagggatgtgcctaggtttcgcatttcgctttttggcgcgaaacgcgacttttacacccctaagaattggattaaattcccataaaatttttcaaaatcttacctataaattgactaattttcagtgaaaacctgtttataaatgatcaaaatttccaattttt

SEQ ID NO: 5265 - DNA, 4887 bp, Heterodera glycines
  misc_feature (71)..(71): n is a, c, g, or t
atatatatatatatatatatatatgtaaaatttatataatctttcatttattataataaaaaaatataaanatatttttttcaatcaattttaattcaataaatggcccatatgcttacgcaaaacgttaacacgtaatcttacttttatgtttctaccagtatttcattcatttattgctcaaatatataaaaataataaatttatttataataaatattgtaaaatgtataagcaataaaattattttcaataaaaatataaaattatttaagataatttaattcgtaaataataaaaaaaataaatatattaaatatttgttaaaaaagtccatttttaaattatttgtctcacaaaaacagaatgcttcgcaaccaaattttctggattgctttactgttgtcacttcttcgggtggcacaattagctccatctcacggtggcgccgcctacaatggttacaacgaaagcgaaaccgagggggacgaaggtcattagtcattcaaattagtgcttgaacggttttattgcgctaccatggcaattttttggcacaagatttgttataactttcttcagggatttaagtaaaaatatgtaaataaaactcacccctggcactttttttttgttggcacatgccaaaacctgaccgtacaattttaccaactcgaaatcctacccaaactttttttttcggttgaccgtcctgaactccctatccgagttttttcggcccgcaattttcttgggatacagaaagaaaacttcgttaatttttgtataataagtaattttttggttatgccaaatcattgttccgcgccttttggaaatatgttctctatttcaacgcctcaatcaactaatggaggtattttaattagcaaattttacatggaaattttgattttcaagcattcaaattaactctcatgttttaatacctatgactcgaaatccttgtttgtttgtttttatcttcatcagaaattcggctcgtcttttttctgtcgacacgccccgaaacccggtccgactttgttttcaacccgaaaccagacaataacactttagtcttttccattttttcttaatattgagctaaattccttaaaaaacatgattttttggaccaaaaactgttagcgaactgtgctaaaatttacaacagtccccccacccccccccctaccgccgtcccattcaaacatttttagacccgaaagccgaagcccggttttgtgggctcgaaaactgtcccgaacttttttaggcgtcacgaagcctataacccgaccctacatttttcccaaactcgaaatcctatccgaaatttttaatttatggacctgccaactcatggtttcatgatttaacaggaaatattttctctggttcaacacatcaaccaactgatgaagaaggtatcttaattaggaaattctaatcaaaattttgatttttaattatgcaaagaatttaagtacttattttaattttttttttaataaaaatgatttcgttattaaaaaattaaaataattatatttaaacaaaaatattacacagtttttcataatgatgatgatgatgaggagttaaagcaactcaaagatcgcacacgtgccgaatatgatcagcaacaaattgcgaaagccatggaaaagtctatggaagaaattggaaatgatccatatcgtcaagagatggaagcaatcaaacaactgtcattaaaagaacagaaaaaaagggagaaagaactgattaaattggccatacaacaatctatagaggtactgtaataccgtattaccgaaatttcttttttgtttatctttgtatttgtctcggagcgcagagttggggtttttctcctattttcaaggtgttatgcgaagggctcaaaattatatgggtttatagcaggggtgcgatcgaaaatttttcaaaatcagaacatcgggctcaaaaaatcagattttggggtcaaaaatcagaacattttgcaaaattgcttcaaatcagttatttttataatttatttaatcaaaaatgtattaaaaaattatatttttcgcctccgattatcatctttaaaaattttggtgaggaaattagcaaattgaaaatttcagtgcactcgggatgaaaaattagactttttagaattttttttcggcggattttccaaaacttttgggaaatgggcgaggggagagggtccggcggtgccgataggcgccgccggaaaattttttttataatttcgttttgatttgttaacagattttcaccaaaaaaaccgctttttgcaattaaaagctaagcgacgacttttccttgcgttccaaatgttgccacaaatcttatattttcttgacaaaaaagtaacattatgccacaaaatttcaaaaatatgagtttatctaagaaatcagaatcagaacaaattttggtcgctaccccaaaatcagaacatttctgacaaatcagaacatttttattttatcagatttggaccctccaaatcagaacatttctgacaaatcagaacatttttattttatcagatttggaccctccaaatcagaacatttctgacaaatcagaacatttttattttatcagatttggaccctccaaatcagaacatttctgacaaatcagaacagatcgcacccctggtttatacatatttttctgggcatacatatgctatgaagaaaggggctcaaaaaaacgcatttctgcgttaaaattttcttttttggtgaatgtttttaatgtgtagaaatgtatttttttttggggggggggttccgagaataaatgcatatttcgccatttttgcgtttttagtccctatttatgcaaaattttcacaagaaaaatgcaaaaaaaaaaaagaagcgaaaaataacatcactaaggatcgagtttagaaataaaaaaaatacaccccccaaaaaggagaatttttttgaatattggcaaatttttggggtactttgttagtgtccgaaaatgtttgctgacatcaaaatgaaattattacaaaaaatttttttgagatgtattagatttgaatgtgataacatttggcattcttaaggtttaaatccatttttaatagtttattttttaagtttatttgagcaattttgaatatatacacatttttgtaacttttgtgggttttaaactatatatatatattggcagtttttagtccgtattttggtacatatttggtcatttttgagcttttagtccatatttcgaattttagtcctatttgatacgctcataagcaactaaatttttaatttttgatgtctttcgcgagccctagatattctctattagccagtaaaatttcaagaaatttcgttgagtttcaaaaaaaattatgatcaaaagtttcaaaatttttatttgggtcttggtcatgaaatttttttaccccattcttttttttttagtccaataatttgtaattttttaattcaacagcaaaagccaagacaacaggcaattgaagaaaaatctgaacatgaaaaactgtttcatgatcttaatgccgtggaatcagaagcgctgcaactttatatgctcggcttggtaggccaagcgaaggcactgcttagtgaaagtgcgcaaagtagaagagctaaagtgaaagaaagatataaattatgggaaatgcaaaacgctggtggtggtaatggtggtagtgttggcaccggtaacactggtgccgttattggtagtgccggatacggtggtgccgaaactgatagaccgtatctaaacagcaggccggagagcagtaaagcagcggcgcagcgtggaaaagctgtggatcaaccaaatgaagtaaaagcaaaaatttatcatttttgtgatttctcaatatttttgaaaattttatgaaaaattttgaaatttcgtaattttcgaaaattcatgaaaattttacaaaatatttgttttggtaaaatccgttatcggttaatgtccaaattggtcaccgagaaaattttttaaaagaaattaaaaattcaaattttccttaaccgacctattgataattagggtgatggtttatacgggctaaaatattgcataaataactatgatttttgcaataggctttttccaaaaaaaaacagaacttaatttgattacaaaagcttaggacagacttataaaaaccaatttgttctctctacattcaattttaaatccacaaaaaacgcttgccctactgaaaacttttaatagtttaagctaattaaaaaataatttttaattagatttattcgaaagctaattaaaaaaaaaaaaatttaaggcatcggctggtgatgaaggattgaatgaagctgaaaaaactgtttttaagaatggacttaacatgggaacaaatgaacgcgaactatccctttttcagctttctgataatgaaagcaaagataaagtgttcaatgcttggcttaagcaagatataaaggaacaaaaataccgtaaattgttggacaaggacaacgatactagaagggaagtgaagagatagagagagcgagagagtgtagggggatgagtttagtaatgatgtacaaaacggaaattttgccgagaactcaagaccacgactaaaaaaataccccaacttttgtcgagaccaaactctcggaagtgttacttactaatacaggagtgttcttgactggaaagcgagaattgaaaattgaccaagagggctgagactgtgagcagccaaaagatttctcgaaaccctaacatatttcagacccgcagaggtggtccaggtggagcagttcacgcagttttcgcacaatgggatgtcgactgaatgat

SEQ ID NO: 5266 - DNA, 1004 bp, Heterodera glycines
  misc_feature (989)..(989): n is a, c, g, or t
tttataggaaatagaagcttgtgtaatattttacgagattcttgaatatcaataaatatttcaagaaaactgaaaattttgcaatttttatttatttcatgacaaggacacaaattttttatgttttttggattttaaaatacataaaaatttaaaataattttatatatttttaaataaaaaaaaaattatgaaagaaaataaaaaagaaattgaaaataattcttgttttgctggatttcatttgaagattttggtggtttgttaaaaatacgacagatcgaataatcaaggacgacatttaaatgattaaaggacccataaagatctatgttcaaacaaattcactgctataatttaatatcaggaagaagatgatgatgatactgtatcgcatatagggcacaatacagatgaagaagaggacgatgctaccgtattgcatacgaggcgtaaccgcgaccgggaagaggatgttgctacagtattgcatacggggcgtaaccgtgatcgagaagagggtgttgctactgtattgaacacaaggcataatactgatcacaatgcttacagtgacattgtatcgcattcggagcaaagtgatagtaatagtgaccagtacgaggtacagtaccatgataaaattgatttaggcaatgtagaggtagttattaattgtattacaataaaaaaaaattttttgggtctttgaaggttttttttacatgcctaccgaacctaagaaagtatctatgttggctaaactaataaaaaatatcaatgtgtggaaatctaaaaaaaagtatcaatgacagtaatctttaaatttaattattattttattatttaaaatcacaattagttcaattcaaattttaattattatttaaaatgaatttaatttttatttcaaattacaatttaatcaaattcatcagtcttgtggtactgagcgatagagagtggtttaaacttttgtattacaacanaaaatatgaaaaatt

SEQ ID NO: 5267 - DNA, 1702 bp, Heterodera glycines
  misc_feature (1680)..(1680): n is a, c, g, or t
cttgttcatgtcaccaaatcggagagttgtgacgcggccgtacattgcaaatgcatctgtgaagaacattatttcggcgacaatgtgtcatcattttcttttcttttaattccttccgtttgaattcagtgcgaaaacatcagtccgtgtcgcgatcgcgaatgtcttaacctgggcagatgcgaatacaatccaaacagcgacggagcgcagtgtgtttgcccaagtccattacagttttttcacaacggagtgcaaataagcggtgaattatcagcaaaaagattgattgatcataaatcaaactaacccattttcaggcgatttttgtgaagtgatcgattttgatgagaaaatggcgtgtaatccttgcatggaaggaaaaaactttgacgactataacaattgttggaagaacgcatttaaaccaattacagacaaatttgccaaactgtgcggcaaagagacttgtacggatttgctgaaaagggaaaaaaagttttgcatgaacggaggcgaatgccaagtgacagttgctaattgtaaggccaacgagatgatggcttaattatttaaggttcaatattttctcatttagtttccgatctcagccccaaaaaacctctgtttttgattccaaaatgccaatgcgattctgacaaatttgaaggcgacttctgtgaacatctgctgctggacgagtgtgacaaaaaggacttatcgttaaatgtcgatgtgggcaaaaataagacgggtaaaattgtctaattacgttatttaatgccaagatttttatatttacattcgaagatcgtatgaaaattattggcactgaagagtttttgcgggagctcaaaaacactgtatttgacccggcccaaacgaaaacgcagagtgccaatgcccgagcggtgatgagcaaagcattcgagcgagtgcttaagacaagaggtaatagacgaacacacgagccatgttgtttgtttatattttgctcgctttttaggaatgatcactttttgcggacccaacggattctgtcgtccctataacgaaggagcaggctttagctgcaagtggggttttcagcataaattattggctgtctttgagtagattttcctaatccattcgtctgttgttccgtcagatgcgacgccggctacacgggcgtacgatgcgagacgaaggacccgtgctgggccagcagttgtccggcacactctctctgcgtggccatcccagcaattgatgaggaggcatcgcccgaagagcaaaacaccctgaggcaaacatgcatttgcaagacaaatcaggaaatagagggtggttaacttttttattgggacctcactagacgatcgcttacagacaacaaatgcttcgataaaaaaaggggaccgtataaagtgtgtttcgatgaaaaaaacaaacaacccaagtgcgctaatgatggtaacacgattatgactaatccatattaaattcaactgtcgtggtgccaactttccatatcttaggccattgttacccgtgcgagttggacaatcagttgttggagaaagcccacgtcaaagtgtcgcgtatgcctttgtgtgatgcaatggaaagaacgcgtggcttccgttgcgtttgtccgcccggctatgagtcgacttcgaattgtcggaatgaagtcanccgtgcgatttcatcactgcca

SEQ ID NO: 5268 - DNA, 3376 bp, Heterodera glycines
ccgagcggtgatgagcaaagcattcgagcgagtgctaagacaagagtaatagacgacacacgagccatgtgttgtttatatttgctcgcttttaggaaatgctcactttttgcggacccaacggattctgtcgtccctataacgaaggagcaggctttagctgcaagtggggttttcagcataaattattagctgtctttgagtagtagattttcctaatccattcgtctgttgttccgtcagatgcgacgccggctacacgggcgtacgatgcgagacgaaggacccgtgctgggccagcagttgtccggcacactctctctgcgtggccatcccagcaattgatgaggaggcatcgcccgaagagcaaaacaccctgaggcaaacatgcatttgcaagacaaatcaggaaataaagggtggttaactttttttattgggacctcactaaacgatcgcttacagccaacaaatgcttcgataaaaaaaggggaccgtataaggtgtgtttcgatgaaaaaaacaaacaacccaagtgcgctaatgatggtaacacgattaagactaatccatattaaattcaaccgtcgtggtgccaacttttcatatcttaggccattgttacccgtgcgagttggacaatcagttgttggagaaagcccacgtcaaagtgtcgcgtatgcctttgtgtgatgcaatggaaagaacgcgtggcttccgttgcgtttgtccgcccggctatgagtcggcttcgaattgtcggaatgaaagtcaaccgtgcgattttcatcactgccaaaacggggccaaatgcattccgatgcctgagccggacaatgcgttgaactacgcgtgagaggaagcagaatccatgctcgtaacaaatgacatttgcttttaaaggtgcaaatgtatgcccgggtacggcggctccttgtgccacctcgttgaggatgtttgtttggccggtaaacaattcaatattgagcaagccgatggatgcccttttcaggttcgagttgtgggaatggcacgtgcaaattggactcgactttgaagcgtggctttcgctgtgaatgtgttcagggttatcatgggttcgactgcgagcaaatcggcaccacaggatttactgcctttttcaatgtattcattcatttgaattttttaaagtgtatataagggttagacctgtacctggttccaggcctggtttttttgcagatacaggtcagaccattttttggcaatctgggtttttcctggaccttgattttcctagatttttatccatgaaatcaagttccaagttttttttatagtactgaactttagttttataattgaatttccgttccggtaaaacgtcatttttaattccgatttcttactgtatttatgtatcatttacacaggaaaattatcgttggacctatcccttgctggtgttttcattgctcactcccgttattctggtgtccatgattttgcaagaccgccgaacagccgcaaaatacggttcacataatgaccggtcctattatcaagtactgtccaattatgtaaattgaaagataatggtgatatgtaatcatattctattgtatttaaatgttaaatatttatttgttatttgatttcaatcgaacgtgttgaaatgaattcctttatttctcagtgttttgtttaaaattcattgtttcacattttgtttaatttacctaactgctttgcgatgacaaaactttgtttgtttgttatttgtttgatgatttcgcttttttcctgactgcgctttgctccattattgattccctccctccccctttttaatattcacttttctcccttttcccaccatttgtcccatacgcattcatttattcctcgtactgctgatgatttcgtttaccacaatcacaccaatgaatatcgttttgacagaaaggtcgccgccgttaataaaatagtcaaagtgtgattcgataaagacaacacaatccatcccatccctttttccattttacgggtttttgtgcaacgtccacaaagggtgagcaaaatatttaattgatcaaagccgagaatttattttttttttgattgaaagaaagcaattgcttttagtgttaacatcggatttgttttgttgctgcgagttgtaatcaagcgactttcttacgctgatggcggatgattgggctgagatcggatgcgactttaaagtggtgttcattcaccataaaccggaagacattgtcgaagatgcacacacattgctccaggtccgctgctgttagatttggccacactgaaaataagcacagattgcttttttaggatgcccttaccgatatgcagttcattgttggtggggcccaaagtgtactcgtctctgttgcacagccaaaggttcgttgtcattttcgatggcaatcttaaaactgatttcgtttagtctttcaactccatggataacggaacggacgtggaagagttggagccgcgcattgagttttacattggactcatcgagaagttcaaatccgtcggatgtattttcgtgttggatcatttgatgcaatgtttgcgccattaccaaatgcaaaaccgtcgtctgctttacttgcgctatcgtgtggaattccgtccaccgattggcattgatttgccgcccttcaaaaggcacttgagcgccgcggactcggcacaattgggccgcattttgctaggcaatgttatctggcacaatcagttgtacgtgcgtagagtggtcaagccgaacaggaagaagatggaggagatattgggcaaagacattcggcacgtacagataccaaagtctgtttggaattagccacacttaattagcccaaataaataacgttttaaagtgtgccattgaatcaacaacggaaaggcagcataaacagcggaggacggggcatcgatggccaagtactaagtggagagacgccattggaaaagtcggacagaattgtgaattccgctaaatcgtcgattgaaagtgacaaattctcgatggagaatggacaaagtccgaatgacagaaagcgaaaccatgaggaccgcaaaaagtcattggcaacagacagaacaactacaccggaagagaatggattgacagaaaaagcgcctccccaaatgggacaacaccaaggggtaagtcaataaacatttaattattcattttgtcatcctcctttggatttaaattgcatttattttttcttattacttgcagcgtggtcttaatcgcaacggagacagcggggtggagttagtgaacggaaatgcgcgcgatttcgacgagattgacggcattgtgccctggtggataacacaccaccggagg

SEQ ID NO: 5269 - DNA, 3960 bp, Heterodera glycines
  misc_feature (3930)..(3930): n is a, c, g, or t
cgcgtggttacgtggtgatggaccattggattgcgtctaaggagtgtgacgatttcttcaacaatttggtcctatgcaacttcaaagagaaccgcgaagagacgctggaagcacttgaaatgttggccgacaaactgttggacagggcggagatcaaacatcactacggattgggtggaatgttccgtgagatattggccgaagtcagccgaaacggaaattatgtgcagccgttgagagaaggattcgaacgagtgaaaaaggcaaatcaaaaaagaatttattgtgcaaaattagtgaattagaaaaatcaatcggattgccaagaaagtgggggtggtaggtaaaagacaatttgcagaaaatgtaattaaacattaatgggacatagtaatttacaggtcgtcatcaccccttctcggatcattccttgcggtcacgaaattctgatgggcaaccgcgctttacgttttgaccgtgacaattttcctcccgagaaattcctccgcgtgatttttcgcgacgaaaattgggagagagtgcgcaaaaaccaagtcaacgggtggctgctcgagaagtttgttttggagcgtttggtctgcggcatttccttcgctggccaagtgtacagtttcgtaggcacttccaattcgcaaatgcgcgacggcggatgttattttctgcaggtatttcattggattgctaccggaacttgtgtttatataggctattaataattaagactgacctggaaggagttgatgagttccgaaatcgacttggccaattttcgctggtgccgaccatccccaaaatgatgtcccgcctcggcctttgctttacccaaggccgtgagacagccgtggatatgcggctgcgaatgctcgtatgggatttcaccggcatgggctgtaagaatgacgaggaggagccgtacaacttttctgacggttgtggttgtctgagtatgtcagcggcacgcaaaatcagtttcttgattggactcgacgagcacgacccgccctcctgttttcaggttgcgagataaccatgaaaaataatcgtttccgattccatttttcctgattagatattcagattatatagttaaatgttttagtttcgatacgctggttacaagggcgttttggcagtcaatccggtgctggaccagaacaaacagttctttgatacgtgtgttgttgaccttcgtcagtctgaagcggaattcatggcagtggactttctatttcggccatcccaaaagaagtttgaggtgtggcaggaatatgaggatgagtgtcgtcttgacgttgtgaagtgttccgctccaacaactgtcgtgctgaacaaaccattcatcaacattctggaccaggtacattcgtagccattttttaatttttattattaaattcccaaaggtgtccgaaatgcaatccgttcgatgccacaaaaggatttgttcgcgcattcattccctcttggaccggcacatttttgctgtctgtgcttcgctcactgacgaggttttcgctcgtcggaggttgcaggaattgccacggttgatcgactatggtgcaatgaattcggttcaattcacacgcgagcccttcttccgtctcgtcctccgtgctgctgccaaagtggccattcaccgggtgtgccaaaaattggccatcacaattccgcccgagttgggccgaatgatgttcggggtgatcgatgagaccggcattctgcaggttacgactttttaccagactaacgaaacttccataacttgttgtttagtatggccaagtgttcgtccagtactccgtcggcattgatggggcactgaccgaagttggctggcgcaacagaaaacctcaaaatgtgtccaacaaaaaagcgcattttgactggtagagaaagattctgtccaaattaaataacttcttttggtgaagggccgattttaatcaccaaaaatccgtccgtcgtcggtggcgatgtccgcatgtttgaagctgtggacgtaatggccctgcgtcatctcgtcgatgtgcttgtttttccccgttacggtccacgcccacattcagtaggacttacaatttaccttataatcattgaatgccaaaattactatttttaggacgagatggccggctccgacttggacggtgacgagtacacagttatctgggatgaagagttactgctggacagtacccagccggcggcggattattccgcgctcaagggaagtcaagcagtgaccgaggacatgacgccatttgagtatcagagtcaaatggcttcgttcctcgtcaactatctgaacaacgactcggtcggacaaatttccaactcgcatttggccaactcggacctgtatgggattaacagcgatgtccgtttttatttattttccatgtgccttttactgtttcaatgttaaggtgtgctcaactattgccaaaaagcactcccaagcggtggactttccgaagacgggcgttgctccaacgcaattgaccattcaatggaatgaagcggcggatattccgccggagaaatacgaacggacgcccgactttatgggcaaaatgagcaatgaggtggggcgggggagggaagaagcatagattaatggaagaaattgaattatggaataggaatcaaatcagtaattatttgcgtttattccttttattcagcctcattacgtgagcaatcggttgaatgctcaactttaccgtcgcatcaaaacactgagtgactttttgtcctacgcaatcagtgacgaatccgtcaaacttccgcacatggacgacctgttactttcgtcagatgagcactcggagttcattgagttggcggctgttcattaccagaaatatgcctattcaatccgggtttggcataattttcagaaactatattttatggtttgccctctcagagtttgatggactcctacggaattcagtgcgagggtgaactgttctcctcctcctactcgtccctgtgcaatcgcatctccgaccgtgaaaatgaggacatgtacaaagagaaaaaactatttattgttaatctagggcattgtttataggtcattcttcacaacttcgcgggttatcgagcagcgtctgtgggatattcgccaagctgcgcgcaaaacctttttcgcatcctatggaggggacatggaaactctgacggacgacgagggcatttgcagggagccgtccgatcagcttaaactgctagcgtgtgcttattacacaattggatactgtatgtttttaggaaattaaacattttaatttgacttaatagaatttgcttcgttaattttcattcgttctcttctttttcaggttcgctttcccgcaagttcctttccttcccgtgggttgccagttgggatgtgctcgatgccgtgcgtcgttcgcgcatgatgtccgcgcttggccagcctggcaccgccaccaccggaagctgctcccgtatgttcagcgcaatgttcgactcgttcggcgaacgtatctccgaacacattgaacgttttgtttctgcacgacggacgcagttggaaggattcagtgcccgttgttttggcactgatcggacagtaactgatgggacggagacgggggaccattcggacagttgcgcgatcaaacagttgctgaaccgttacgtgcttcgacatgaaggtgaattttcaggattttgacaacggagcttttgccattttcaaaggtcttgccccactgatgttcttctgtgtatcgtgggctgaacacatgggccttttcgcgcagagtccgctcaaggaggaacatatttgtctccttttgttaagcgccggtctgacgaatcagcccccaaacgtaatcaactcggaggagcgtcgcccttggctgagtgaggtaattnggtaattgcccgaaatatttgaaaaaggat

SEQ ID NO: 5270 - DNA, 982 bp, Heterodera glycines
caatggaaaagaaaagagagtaaaagaaatgaaagggagagataatgggaaatttctctcgcatcccttccttatttataacccattttttattgtataaaatatttaacaaaagaatgagcacatttttgtgtttgtttgagtggaaaatccggtatatgaaggttctgtttttgtgtgtaagaaaaaatttgtggttttgctgtttatcattatttttttgtctaaattttgtttttgttaattgatttgattttgatgtggaagcttttgttttgcttatgtaaacgataatggagaattgtttggttaaaaaaatgcattagaatttgtttgaatgaaaaaggtttgttatttaaaaaagttttttgtacttttccttgcttataatatgaaaagaatctgatttggtttttgatatttgttttgaataaaaagcatgttatgatagtaataaaaaatgaaagaaaaagcctttgatggatagaaaaagcaatataaatgctacatctcatgttttgcctgtgttcgagtggaatatttatatgcaattgggatattgacgtgccacttgcgggatcaaatttaggtggaaagttttaaacaggtcagttttaatttgaatttatggggtgggggcattaattatacaccatagtgttttgatttatgggttatatttcaatttctggattccttttaaatagttctgtattccgttgctgaggttgagttccggtgattgaaatgtcggagaattgagtcccagtaattgaaatgcagaagaattgagtcccagtgattgaatgctggtggattgagtcccgttgattgaaatgcttgagggttgagtcccagtgattgaaacgcaggagaattgagtcccagtgattgaaatgcagaagaattgagtcccagtgattgaatgctggtggattgagaaacgttgattgaaatgctggtcggttgagtccccagtgat

SEQ ID NO: 5271 - DNA, 3377 bp, Heterodera glycines
aaaagacttttttgatcaggaccaaaagttagacaaggaggatttttttcagaattttacgtcaacataaaattgaattttggtcgattaaaaattattttccatacttttgcacctgactgtatttgtttttttttctgaaaatggcaatgtcttttactaattattattatttttttgtgtttgtactattatttctaattcatcttcatcccaatttttcatattttctttttaattatatacagttctttagctgaatatttattttccatttacttaatttttctttatttttaatagggatgcgatttttaggcaaatgcctaaatttattgcgcacttaatacgtgtaaataagcatgaaaaacgcattttccgcttggtttttggaaaaattatttgctataaaccaacaaatcactaggtttcaaaagtacatctttgataaattttgacatttaattaatcagtttatatttttactgatttaatcaaattgttaagatggctttctggattttacattattcgaaaaaatgtcaattattgaagaatgttgttagaaaataaaatattaaaaagttctacaatcatcgtgttaagaaaaaaacctttgaatatcgtgattaaattttcacataaattgttcaaaaacgagcatttttagaaaacaattttttcataattttatcccatttaaacaaacataaaaatttaaataataaatatatattgtgtataaaattcaattaacaaataaatatcttttcaatttgtttaatttttatctttttcttcacaaattcctcctcacatccatcagttttcattgttttttcaacacattttgcaagtgttggcacagaacagtctcatccaaatgccaaaacggttgcacatcctactgtaacggctgcacagtcgggcaccaatacggtcaatgcagctaccggatgaaccacctgaagctttggtcgtggtagatgaggtgcttgttgaagtcgaggttgtagttgaagtgctgctggtcgttgatgggcacatgttgcatgctttggcacaatgctgtttaagccatgccgaaaatcggttgcacctattcttgtaaaagttgcacgctctgtcaccggccgcgttggtacagctgctggacgacggattagttgtggttgacgaagtgctggtcgtagttggtgtagtcgttgaagtactcgttgaagtcgaagaactggtcgaagtcggtgtggtcgaagtactggttgaagtgctggtcgatgtactggttgaagttgaagttggtgtggttgaagtgctggtcgatgtacttgctgaagtcggtgtagttgaagtactggtcgaagttgaagtgggtgttgtagttgaggtgctcgtagaagttgatgtcgaagaactcgttgatgtcgatgtactggttgagcttgaagtcggcgtagtcgaggtactggtcgaagttgaagtgggcgtggttgaagtgctggtcgacgtgctcgaagttgaagttggggtggtcgaagtactggtcgaagtcgaagtgggcgtggttgcagtgctagtcgacgtactggtcgaagttgtgcttggggtcgtggtcgatgtgctcgtgctagtactggttgaagttgatgtactcgttgacgagcttgaggatgtagatgaatcgtcttgggatacaacataatccgtggacaccatcagcaacataatgcacatcaattggccgaaccatatttggcaattcattttcaattgaaattgtttaattgaatagtcgaataattcgaaagtgattttttgtgaatatttccaccgcttttatattggtccatgacgacataaagcgggtaatataacaactaaacaaactaattagtttattcattttttccacgttaatggtgaaaagtgtcaaaagtcgtcaacaatttccgcttaattttaaaaactttcccaactgtttgccgaaattagtgaaaattaagctgtttcaataaatactatcattctaacgaattgacgaattttcctttaattatgtaaacgagtgttaagccaacacattaaaaatttaattcatttaatatttatttgccattatgacgggatcggagtgaataatgttaggcttataatattacttcaaaaattaacacattgtttaataattaacagagcttagattttaaggaaaaagcatatcttaattagaattaaagatttaattttaagtacatcttataaattttttaatctaattaggttttaattttttattatttaaaaacataatttatttattctatgaaattgtgtaagcatgattcaatttattcaactaaagagaaaaaaataattaaataaaattatttataaaatatattgtttcttactccgattatggaagttcattttttacttaaaatatacttaaataattaatattttgtttgtttttaaaatgttcattttaaaatcttgcaaaggaaataaaaaagatagattattaaataaattaattttttcataaaaataaaatatatataatttataatcaaatttaaaaaaataaaatcttttcattttgaaaaatacccaatttagccgagtttcttgacaattgttcctttttatcgcggataaaaatataaaatatgtgtctttcaataaatcccaaggaactcttcgcaacttagccgtattttccaagaaacaaaattacttcaagaattcttttggcattaaaacatcaatctttttttttataattttaatttatgtgattttctttttgggtttgcttactttgactattttttacgtcagatccgtcaatttcacaaatgcatattattcaaacaccagggacatttctaattctataattgggaattttgtcctggtcaatttggtgttgagagtaattagtatagactgaaattttgaaaaattaccgattcgaaccagcattagtgaactggatccagaccggattcaggattaaaaataggctttacaacttacggtccgaattccaaaatttgacccggatcaattttttcaaaagtaaaactgaaaaaaaattttcaaaaattcaataaaaatttgaaattcaggcccagagaatctaagacggtgatttgtatttttttttcaaaataagcgcaaagtactacaatttttgaatgaattttttggccaaatttttgaaagatttaggaaacgtggtgaatttgtttttttagaacatttgataacaaattatgccaataccaacatttattggtttttgggcaacagaaatttttacaaatttaaaaggcactaccgatgtgaaatgggaagtttattgaaattct

SEQ ID NO: 5272 - DNA, 1962 bp, Heterodera glycines
atttaataaggatgctacatacacatttttgtgtcaattaatcaactttttcacattttgttccacttttcttcccattcagcccgagccgcagaaattgcatgttcgcgcacaacgctgcgtcagccaagcacggtaaacattgcatgaacgtctatagaaggaacatgccgcagtgccagccgaatcggtacaactgcttgacggcaatgtggttgttgtgctgctgctagtgctggtcagtgttgtctcagttgtactttctgtagttggagttgtggatgtacttgttgaacttgttgtggtggatggcgttgtagacgtacttgttgaacttgttgtggtggttggagttgtggaagtagttgtcgaagttgtgctcgtcgacgaactgcttgagcttgttgtcggtgttgtggaagtacttgttgaacttgtcgtcgtcggagtcgtagtgcttgagcttgttgtcggtgttgtacttgttgagcttgtcatggtaggagtcgtagtgcttgagcttgttgtcggtgctgtggcagtactggttgaacttgttgtagagctggatgtagtaggtgttaaagttgtgcttgttgatgtactgcttgaacttgatgtggttggtgttgttgatgtactgcttgaacttgatgtggttggtgttgttgatgtacttgttgaagttgtcgtggagcttgtactagtagatgttgaagttgtgcctgtcggtgtactagttgaacttgtcgtagtcgaagttgtggatgtactcgatgacgatgtggacgaagtgctcgtcgtttcttcttccgatgaatgagaagagaaccagtgggatgaaaccagtgttgtacccaaagacagcaacaaaactaacacggttttacaaaataaatatttgaaaatcatttcaaacaaaattaattaattatataatgtcgattttcactcatttcgaggcacttaaaaaggctggaatgacaacaaattactcaatattggccaaaactttgtccatgacgcatatttttgaaaaaaaaattttttttttctcaaattatttgttcagcctttttttaaatattatcaaacgaattttggataattaatttgcagttaagtaaataaaattaattcgataactaatttctctaatatctttgaatagcaatactgaaataaataaatttcaaaaattttagtgaatttgatattattaaattagtttctattgacatagtttttttaaaatttatatttattgccttattagttagtgtcggctgtttgttgaagttacttagcagaaacaagaacattatttcatttagaatatcgaaaatgctataatgcgaccatcaaaaaatcggacacaaaaatttaaatttcttaaaccgttcaaattaaatatatattattttgtttaagataagttcgctattttaaaaaattttgttttcccagtggtcacttaaataatttctggtttcaaatcttttgaatttaacggtctattttttgattagtgaaataaaaaataaaataaaataatttctatttttatgttattttgcctagtgccagttttctttattaaaaataatgaattaatttgttttgcttttcttcttgcacttttgtaaaagtacagcttatgatcattggacatactctaatttattgttttcgacaacatcgcaacaacaaaaaaatttttaagctctccggcaaccatatccggtaccctacacttttttaaaatccaaatggctcaaatcgggtcgatagcagttcgtacaatggcgtttcgtacaattttaaatggaaatggccataacttttttgttcttcagttgatttctttaaaattggtatcattcgaaagctctacgtatttagaagctattattaagcataagctaagcgattaatcatctcaccaaagagttatgctttata

SEQ ID NO: 5273 - DNA, 1756 bp, Heterodera glycines
  misc_feature (1674)..(1674): n is a, c, g, or t
attatgcaattttatcataaaagccactaaacaataacaaatacaaaaggactaattaatttctagggttttcggcagaattttaaataaaatataaattttttaatttcggcatttcgtggcggaaacaaatccagttttttgtttaagaagctttgccactcaaatttaatgtgaagccttataaatcccttattcagtgatttgtgtatatatttaatcttcaattatttttggtgaaatgacacataatgcatttcgtgaaaaaatatattatgccaagtatactgtagcttatcaaaattgaaattattcatcaatttaattacgctatcttgtttttttattcaattacataatttttcatagataaatttaaaaattgtccaaaatattatatataatttaaattctttaattaattcaatcgcttttcagccttaaataaatttcgtagtttttaaaacctttatttttattcatatattttatattttatgatgacaaaatgtgtttggtacaaaagaagtttgtggcgccgtcattaatgttattcatttcttgatgacatttctttaatgagtttgttaattaatattcttccttaacaaacataattgacatgtaatgtccaaaatattttttcctttttttgtattcctccatttcaattatttaccataaaaatctttaaagtagacaattagcataaactagagtagacttgattttattttttatatccaatgaatccgatcacataattaatttgttggtgaatatgagaaaattcttagtaatttagacgataatagcttttggaagttttagccataacttttttagaatacaacgaaatttttgaaaattttcttactaatagaggactcttgaggcgctatcgaaagattccaagaatgtttgatttggatgttttagaaaatctaaggtgcattaatattttatgatcgtctcttttttatactcaaatgaatccgataacttaattaatttgttggatgaattaatacatcaaagcacaatatttgttttaatgagatatggtagaaatatgagaaaattcttagtaattgagaatataattggcattagtcacgtgctaagtcgtttcgaaaattcataaagcatcaaaagtgaagtggtcacataaaatggaaaaaaataaaaaaccaatttgttcaactgtttaaatctttcgactttttcctggtttccagaatgtaggtctcatcacttaagtgatttgaaaaaactcacgcatagttaaacacttccattgcttaaatgtgtaaagaggaagcatgacgtatttaaattattaccaccagttttgaaatttcgaaatattcttcaatgtaatttttgatgtaaaagaaacagtaaatttaaaaattttttgaagccatattttcttaagaaattcatatgcaataaatgaaatttaaattgaaatacgaaaaatgtttcaattttttttttttttgctttttcgtcactaatactgaattttctcattcaccataattgtttcattgtaaacctttttctaataatttggcattttaaaaactatgtattcagatggacataaaaaatgtttccgctattttggcttaaaatttcttaattgttactataaaaggaaagcaaatntatgattcgatcaaataattttttaaagaaattttagatttttgaaactatggtaaaagtaaattcaattagtttttctttg

SEQ ID NO: 5274 - DNA, 1379 bp, Heterodera glycines
  misc_feature (40)..(40): n is a, c, g, or t
  misc_feature (1366)..(1367): n is a, c, g, or t
gaatggattcccaccataaatacagtaccatattttttantatgctttgtgatgacgaaatgagattggtacgaaattaattgagtgtggtggtacacgccgtcattaatgtttttaatttcgtgatatttctataatgagttttttttgtagaggttttagctcctccctttatttatttaaatgccatggaatgccgaatttttcattttatatttccttgatttaattttttgacataatttttcttaactgaaagacttctgtcacgctttttcgtgacaaagtgcacaatgttgtgctttgttgtccgatcggtgattggggaggagtgcgctgggattggagtttcccggaaacgatcaaagaacaaataaaattatttattcaccgcacaattggacaaatcactgatggggaaatgcaattggaaaatggaaatggaaatgcgaatttgggttcatttggggccatttaaatattaacaaaattacataaaaaattgaaaaagtggacagaaattgggcgaaaaatgagctgatcgaacggggggcaataattggagaaatggtgaaaaaatgggaaatttcgatcacaaatgtgggggaggtaaacggagtactttgatcactcaaatttcggtttttaccgcacaaatgaacgaaggagggcaattagtgacaaacaattttacggcggttggacgggaggaacggggcaaaaatagtaatgaaattgggtgaagaaaagttgcgatttgatgaattgtcgcttaatttgtgcgcggggaggggaaaggaacacaaaaacaattgacaatttggaggaaaaggggggcagcgggctgaaacggcgaaaacatgttgtccggggggggggaggaggcccctcccgatcgtagccgatcaatttgatcggctgtcggaacacagcaaagttccgacacttcgcataaacaaaaaaaaatagaatcatttcaatggtcttgagaaaaaataataaaagatataagaatttttataaaatacgttgataaattttataatcaatctcatagattaaaaaaaaatttcaaattaaaattttccgtgagcaatgcctatcggcatcacagtgccagaaatagtttgcatttttatttaattttgaattttactaatcccctggttacgttgataatttaaactatctttaatgaaactgttttatatagagactgtattaaatgcaaaaaaacattttgataggcgcttgatgaaaattaattttaaaaaaattttaaaattgccaaaaacattagaaaaattttttttctggtgaaaaatagaaaaattctataattcaactttttttaatcccaaaacannataatcataata

SEQ ID NO: 5275 - DNA, 2014 bp, Heterodera glycines
  misc_feature (1994)..(1994): n is a, c, g, or t
gaggcgtttgtgccgtcgtcggcgtctccggagatgtttgtgccgtcgtcggcgacgtcgtccccggaggcgtttgtgccgtcgtcggcgtcttcggagatgtttgtgccgtcgtgctcgtctgagttgcagtttgggtgctttgttgcgtcgatggtggtgctagcgatgatgttggtactaccgtacttgtctaaatggattgagtctacataatgctgccaatcaaaaatggcacccaaggcacaagaggagggcaaagaacggaagaaatatggagcaattttccaggttaaaatttttagaaaactgcacaggagaaatttggaaaattgagtgtaattaccaaaaaacaaccaattagttttcttatactttgcgactatgccgaatacgcaataaatatatgtataaaatacataaataaacgtagtgcgacatttgcggaccgtcttttgcggaccgacatttgcgaccgtcttttgcgggtcatattttctggatttaattttcaaaaaaaaattcttaaattggatgatcatctcaatattgaattttatatgtgatttttcggagttaagcaagttaatgcgaatgaaaatatgaaaaatttataaagtttttccaaaaagttcttttttcaattcctcttggtgctaaaaattttgatcacttcatatcatccttaagtagtgatctgatcaacttgtgcaatgcattagtttataaattcctgatttacaagaattatgttgtcattgataatgtgagcaattcattttaattttgctttttaaagatataaaatatatttttatatcttttatttgttcttgatattaattgttaggtatatctgatcaaaatctataagctctttagactaaggctagtgggtgaaacaccaaaaattttgcgtgctatatatttgtgatatgatttttgtataaagcattttttaatcaatttgcctaataaactatatgtaataaattcgtttagttgtgggtaaattttccgattaaagaaaaaaaagtatgtcgaaattgacatagcttatttgttagagcaagaagcactattaaattatcaccttcagtcattatttcaatttggtgattacgaaaaattatttgaaaattcattttaaattttttttctttttttttgataattttttagtcacaaatgtcggtccgcaaatgtcggtccgcaaaagtcggtccgcaaatgtcggctaacctaaataaatacttccctttcaataatattaagagctaaaaacatttatttggagcggaactgaaccaacacaaaaacgaggcataaaatctagagcacaacccatccgaccttttttcgagtcgagaacttgagcagccctacatacgaccccatattatgaaaactatctatcactgacgcatttttcggtcacgcaccttttccgccggtgggcacggagttggcggttttggtgcgggtgccgggtagtagtaattgttgccactgccaccgccatatactgggggacgcttattgtagccgtacagcgggccgggcactggtttgtacatcggtctacggtagacgggcggtcggtagggacctgtgctgtgcaaggtaaatgtagaacaaaaacagcacaaaattcaaattaataagtcaccgtcctcatcccagtcgccgtagtgtccaccgctaccgtatacggcacctattgggtacttgtatgtataattacaaaaggattgtacgtgaacattttttatactatgtgagtaaactcaccaccgtatcctcttagtccgtcaccatatgcgccaccacctctactaccgtacacaaaggcagaagccaccgttgcgcaaagacaaaatgacaaatggcgaatgagtaattggggcgctaaatgcgccgtcgcgtacatttttgaccaaatatatttgatgtatttagttagggttacagaagtaaaaaagtgaatacccgantataaaaacatttttttatt

SEQ ID NO: 5276 - DNA, 3134 bp, Heterodera glycines
tcatcgcaaaaacactcaaagaaattttcgttttgttttggtgtcacaaaaatctccccaaaatttccaacttttgctctcctcccgtgacagaaaatttgcttatttgtgtagtgttaatcatccaattctccaactgcccaaacatttgattattcattcatcgaaacttttgtcttttaaaaatgccatcattttttggtttaaaaatgccatcgttttttgccttattcacccaatttaccgccattttttataggtgatttatgtgaaattggaaatgtcacattaattgatgaaaaataaagagcattttacacgagttggaatctcgagcaaattcttgaagcaagcaaaacccctcctcctccatcctcatcaattagtgtcggaaaagaatctttgacccaacaaaacatcgactcatcaagaaaataaaacaaatatgaaaggtaatcttgaaccaaaatgtgaaaccagaaaaatttgaagtttctgctgttttactaacggcattattaccgaactgtcggactcttaatttaactttttagagccacatcctcttttccacctactagaatctcccttctctcagtttgaggaatccaatttaaaagttttattttcttaattgtggattaaattagttctaaaatttcgtgttttttcgttttcgttttcgtgtttcattttcgtccaaccaaaaatttttgtttctttttcgttgtcgaatttcaatatgtactttgaattggccaattttggcaatcatattatttaaaagtgatcattttccaccttaatattgtactcaattttctttattatgtccttagaattggccaattttggccctcccattgtcgtgccagttttggcactcctttctgatttattgatttaattgaagctatttaagtgcgttgttgtaggtggcatttccatgatttacatttcctccttttcagtcaatttaattttcttgaagtttttactcctaagatttgtcacatttaaattagatgatctagcattaaaagctatttatgcaataaaaaaaaatcaaattttttaaaatcgtttaaatatatgccaaaaactaacaaaacccaaaaatattttttataagccaatagtccaataaatgttttagagaccacccgaataaataaattcaatcactctttttagaaggaataaatgaactgaatctttagaattacctcaaaaaagtataacaatttttatttattctaaaagtaatttttaaaattttggagaaaatctgtgatcaaaaattttcatgccggctaatatcgcagaaatgaggcacaataaattgaaaaataatccactaattacatctatttaattttagtttcgcttgcgctgttcgttcaaatgccattggcgacacaaacatcgatcttatatttttaattgtatttattcaatcattttgttttgtggtgaaaatattgactttttgaatgtttgttaattaatagaaagttcaaattaaaaaaaaaattcatcaggaaatttaaaatatttaaacaaaaattaaaatgttaaatttttatccaatcgagtcccgtaaaaatataacaaattcatctcatacagaaaacctccgcctctttgagctcttttttcactctccgaccattcgctttcatcccaaccaattgggccccttcgcaatagccacactccgccaaagcaaatatattttatataacgaaaagtcatccgttctcgtgtccgcgcattgtcccattcaaatggttgtccaccgtatttaaaaccaattccaaaattcagacaaatgacataactgacgggcgattcagcactgatgaacgcctaaaggcaaaaaagaaaattcaaaatttggcttatttaaacaccatttttaagtcttccaaatgcttttcaatgtgtgaaaggcccacgcatttgagaacttttgggcgtccgtcagcgcgtggagtgtgaagccacttggacagtgcttggcctacggatgcgccggtgccgtcgtaggagggactctcgggaaaaacttgggaacaataaatgcatcggagtttggcacactcccgaaaaacggatggggatgtcagcttcatcagttgactcaattcatttccattcagatggacaattgcaacaattccttccgaaaggaatggccaaaaatgctttgcgatttgttgtaaaacatcgtaagaccgacgattgttgcaaaaaagcacagtaatttccactttttgtaagagatgacgaatgttgtgaaagaagccaatgacaatttgatcaatgtaactggaaggaagggaaagaccaatttgttttccggcaattcaaaaaaaatttcaaaaattaaaaaaaaaaattttaaattaatatttttgccatccctagtaataaacagggatcattttttatgtaaaaaaagttacgaattatgtaaataaaatatgtataaaaaatgctaaaatatgtatgaaatatatacaaaaaacccaaaatatgtactaaaatatgtaaataaaatttttttaatggttatttttttggaaaaaattactagtaaatggtgaaatagcggaaaataggcacaaaatgccatataaataggctttgaatcagggatggagttccgaggcactaaaaattttcggaagtcggaattccgatgccccaaaaattttcggaagtcggaattcagatgccccaaaaattttcggaagtcggaattccgatgccccaaaaattttcggaagtcggaattccgatgccccaaaaattttcggaagtcggaattccgatgccccaaaaattttcggaagtcggaattccgatgccccaaaaattttcggaagtcggaattccgatgccccaaaaattttcggaagtcggaattccgatgccccaaaaattttcggaagtcggaattccgaccccaaaaatgtcggaagtcggaatttttcaaaaaaaaaatataataaatttttaaaaaaatatttaataggctaaatttttaaccatgtaaaaggtaatttcaaactgtttttagtttatttctatattttttaaaagatcagaatattataaataattttaca

SEQ ID NO: 5277 - DNA, 2531 bp, Heterodera glycines
cggaagtcggaatttttcaaaaaaaaaatataataaatttttaaaaaaatatttaataggctaaatttttaaccatgtaaaaggtaatttcaaactgtttttagtttatttctatattttttaaaaagatcaaaatattttaaataattttacattattttggattttttttttgggaaagttacaccttttttttgcggcgcgctttatccaaagagaatttgagaaactgtggggaaggaagggtccggcggtgccgatatgcgccgccgggaaaaattttgtaatttttaatgtaaattgttaacaaattttgtccaaaaaatggaaaatttagcgattttgagcaaattttcaagaaaattaagtttttttttgagtccggcggtgccgataggtgccgtcggaaaaaaaattgaaaatttctatgcaatttattaacataaattgtacaaaaattgctaattttttgaaaaaaaactcagaaaaattccgaaaaattccgacttttcatcaaaaatttcggaagtcggaattccgaggccccaaaaattttcggaagtcggaattccgaccccaaaaatgtcggaagtcggaactcggaattccgtgccatccctgctttgaatcacttttttgtattttaaattaatttttgatagctcattttttgaaaaaaaaaatcgatttttagggatagattttttaaaaaattttatttttcacaaaaaatttctataaaaattcataaaatcctcaaaatatgtaaaaaaatgaaaatatgtacgaaaaattgcgaattttggattttagggggcatttcagaaaaatttcgctaagaaaccatcaaaaattgcaaaatatgtacaaaaaaaatgcaaaaggtccaaaatatgtataaaaatatgtacatatgtaatatgtaggaaaatccgtaaataaaagtcccaacttttgttcgcaaaaacaaaaaagaaagtgttttcctactaattagagcatggagaatccaggaaaatgtatttacataaaaaaatgatccctgctaataaatgttcgttttttttaaatggtcaacaaaccgtattttaaaatccaattttttacccggcgccatccgtttgattttttatatcacttttattttttaatatttccatcaaaattaaaaataaaatgaaaacaattgccaaattcttacgtgtttacctcacgagaatggtcctgaaaccgaccaaattgggaggaggtggcacatccaaaatcggtgcccttaccatctgaccatttttatccgttagcataagcttttcgatccacttttgccttttcctttgccaaactcctcgcatttctgtgctcttttcttccttcttttggtaaaacccaagggcgcgaagtgtccattttttggtcctcaaatgtcgttccactaatgcatcaaaacgggcacagacaatcgcaattttgtggccgagttcgggacgcacaaaacaatcgaaaacattgtgccaaacgtcgtcacaaagatggctgaaaagtattaaacatttcaaaaattaagtggtaaaacattgtcacattcttattaaactgcgctcagcttcacgcggatgatcggacatagtcgtcggtgctggcagcttcactaatgcgtcatgcacaatcaaacattgtttttcgtatttctatggacaaatgctttaatttcggcttaaatgctacaaaaaaggaacaccaagaaatataatatttacgggttgttgggtttttagcaattattttattactggataactttaaatttttcacgaccatctcattaagaaatgtattttatggctttaaaattttatgcgctttcgaatgggttaattattttttggaaattttctcagccttttttcaaaatttttttgtccataataaatagtgaaaatttgtttgcagaaattttgaagtcgttgattaatatttgaatcaattccaaatcactttcccaatttgaacaaaaaattgaaattctaaaaatatttcgactttttcgagtttggattagggattggtcaaaattggtgtcagattcgagctcagagagattccgaaattcccacaatttttggctaggatccgttttcgcccaaattttcccggcgttcaaatttaaaataattaaaacattcttcgtcattgaaaaaattgtataagaacctcatctgtcctctaaaaagagaccaaatttattttttgacttatttaaatccgtttatgagcatattacaaaaaaaaaatgggaactgaggtcaatgtttgtgattttcgagtgtccgttgtgctgagaaaatcccaaactttgcccgaggggtctcctcacattcattccagtttctttgtccgcccattcactgttgcgcaatcccaccattaagagacatttgtgggacattcgcacagttactgttcaatttgttgcgtgatgatgggtcatttcccaaaaaccgccaaggggtaggaaaataaaaaatgtcttg

SEQ ID NO: 5278 - DNA, 7055 bp, Heterodera glycines
  misc_feature (93)..(93): n is a, c, g, or t
  misc_feature (6455)..(6455): n is a, c, g, or t
ttttttccaaaatgggttaaaaaattttagaaaatattttggctactctcgcaaagttacataaatttgagtacacacacaaacgggttgcgncgggactgggaaaacattgggaccgggattagggttgggatggatcaaaatctttcgggtcacgacgcagattttggggcgcgaaaaattgggaacgggattcgtgccatgatggctaaaaaattctggtcgggatttgggcagatacataatgggacccgggctgaaatactgatgcatacgaaatttcatacacaaatcagcattttaatgcaattaattttcatcttcatcataccatgtaatttttttttgatttcttttattaatagcgtgattattaataattttttctgaaaatgaagaatggtaaattcattctgaaaattctattacaaaaacatttgtcattttttaatttaaaatttatttaaaacgcagttgaggcgatcagagaccatataaatatattggtcaagttgaactttttggagaatgacaaaggctttaaaaaggacgcaaaaaacatggaaaatttggtatgcaaaagtgtcaatatgttttaaaaaataaacaaataattatagttaaagtaaaaattgatggctaatggatagggctgggaattaaattcacaaatataaacttaaaatataatttttttagatattttaaaggtggattttttgacattttcttttgaaaaaaaaaatttttatgttataatttttttttaattttttgtattttcataagaaagtagtttcttactttttagagcatgtcgaatccagaaaaaatatatattatatatatatttaaatgaaattcccaacattgtctaataaatataaaatttttgtatgtatccaaatattgtaactcgaaaattacagaatgcacttgagaatcagcttatcgccaataaggcatgcttaatcaaggaagatgaggttttttgaataaccatttaaatattaatttttaagctttccacgactaattaagattgtgcaaacctatcacaatgaacgcgctgaattggagcgaaaaatgaagcggtttccaataaacttttctattaaaaatattttctgaaaatttcaaaaaaacgaacaattttagatcattaaatttttcttgattgcttccttttaaaaaattatactttcatttctaagttttctttaattcaatctaaaatttactcattcggaagattaattttccacgtaaatcaaaattttttaagaaacgaaggcaacgaaactcttgatgaatatgaccaaaaattcattgacacattgcaactgagtttggaggaaggcattgactttggaatttctttgctttcattagccgacaaaatgatggaccatttgatagtgcgcgaagaaaagaaagcaaagaaaaacgaacaaatgtcctattataactaattgcctaattaattaattatgtaattaattaagtaattgtttgtgctggtaggatggaaaagggtcattagagcatcggaaaatgttatttttaagtagttacccatgtagattttcgtcgttaattttcagccccgccatttcagtcccaatggaaagggacgtttcagtaccaaatttaaacctttaaaaaacacctataataaatatatccaatcccagaagaggtaaataattgaaaaaacatctgaaggataaaactcaaggccaaatcgtattagagaaggaaagggaggcagaggatgggcgtcagctgtcatgccttatagggaagggaagggacgcatgccacctgagcgcccgcgtgtgggccatttaaacgctcgcgtatgccatttgagccccagatttatttttacagcgcagccatttgagccccagagttatttttacagtgccgccatttgagccccagagttattttttaagtttagccatttcactcccagtgcccacgggatatttcagttctgagacccaaagcctattgagtagccaaagtctacggagggtcattaacattccttttaagtgcattttgaccaacgcagggccgacggagggtcattaacattccttttaagtgtattttcgaccaacccagggcagacggagggtcattaataattattttgagtgcatttctgccgaagcctaagcctacggagggtcattaatcattcctttgagtgcatttctgccgaagcctaagcctacggagggtcattaatcattcctttgagtgcatttctaactaatgcctccgaaagtgtcataaatatccccttaggaaatgtggagtatgttgtgccaaagctaactgactgccattaaccatctttgtgaacatgtctgtccacccgaaactggaatggtcattaattatccccttgggaattcttttggtgcatttctgaccgagccaaagccaatggaatggtaattaataatcccttggatgcattttgactgtataatgcccacggaagtgtcggtaatataccactggaaatagaggtcaaactgtgagtcaatgattaattgagacagtttgcccatgcaaaaccaaacaaccaagtcaaaggacccttttcgaagggacagatagtgtgtagctgttccctattgccggttgactttcaactgtgagtcaaaagggtgattaattgtgacagttgtgcctatgcaaaacccaacatcagatattctgtggttgagacagctactcattttggcaaggtgccaaatttagcccagccgaaaaataagccccgcctactcggtggagtataaatagcctgtcatttccagcaaaagtgcattttttccattcatttggaaattttgaaatttttctgcaaacgactaaagcgctctttcccttttgcttcctcgctctctgcgcactatttaaaccaatttaaccataaccttttgtttcctaccatccctttaaatttttacattccctctttcttcactatttaaaccgaattcaccaaataaaaatataattccataatcttccaataaacctataacaatataatttaaataatattacaattaataattaattacaaaaataaaagttcgtgctcatcctttaattttctacgtatccttacatcttttacctacttacccttttttgcttttgcttttcctctttgctcactatttaatccaatttcaccacttaattttaatataaatccctcaattttaaaaatataaaaaaaaactccaataaacttaattaaatcataaaatttttataaaaactttacttcataaaatttaaaaaaaactttcctttattcatatatccatattttacccaatcaatcaataaaaactataaatatgaagcgtgcctccaaagcccaatcttcatctccctcccccaaaaaatctcaaaccaataaatgcattcgtaaaattgaccaatttacttccaaaagtcttaaacatcattttatccgttccaaatctaaatttgttattgatcaaattgaaaaatgtgcagatccacaggctgaattccgttcatgcgtgcacaaggcggtcgaggaggctattcaagacgcacagaacacacttggcgctgcaaataaggtaggtgtcataatttcttcggaacttttagaccagggagacatcatcctaccaattacgccaattacgtcaaacgtcgtggacgccgttttcaaccagttttgtaaagtggagcaaagcaaaagcaaatacgtcaatttttacggggccccatttgttataaccgtcactgtcctgaacactgatggtctaccccgtcgacgaacgaccaaaggaagtgcccctccaatcttctcttcccaatcacacatcttcaaaattaacaacaatgacaactattgccttttttatgccctggaactgatgcgctactattctctctacaaaagagggattatcacggaaaaccgatggagatggatgaacaataaccaaactactgttcttcgtcaaaaagtactacttttactccgcgatgccgggattccgacaactgaaccggaatacgatgcagaaatatacatccatcaagtgcaagggttatggaacgtcaaatatcccggtgagtacaaaattttcatatttaacgattaccagatacgaccaatcaccaaatctgatgtcaccgactaccaattccccattcttctctaccacaacaacaaccactttgacggcatcaaaactatctccaaattcttcaataaaaattattattgcctctcttgtgaaacttttttcagtaacaaaccccaacattcaatgaattgctcttcactctgtcatggatgtcgggaggtgggcgttgactacccatgcgagccacaacagggatacttcaaaaaatgtttgcactgcaacaactatttctataacaacgactgctatgaacgccacctccacaaggatttgtgcaccaaatttcagcgctgcgaagattgtggggtaatttataatgtaaagtatcacggaaatgtaggtcaccaatgcggagaaaggttttgtcgtctatgtaagcagtttcatttaaaagaggaagatggcgagaacccctgcaaaagctgcttcatccaacccctaaaaccccataaacttaaaccatacaggatcatcgcttatgattttgaagcgacacaggataaaaaagtaggtaataaattcgaacacgaggtaaactttgcagcggctaccatcatttgtaccgattgcatcaatggaaattggaaggactcacttaaaggatcctcttgcaaaatttgtggaccccaccgcacaatcaccttcgcaccattcgacttctcaaacacgatagtggaccaaaaagtcaccactcaacaaccgctacgcgaattcgtccagtggctactctttgaccacaacaaaaagtttccaacagtcgcctttgcacattttgggggccgctacgacatgacgatgatcatcaaggaagttttggcacaaggaattcacaatccggacatcataaagcaaggaaatcgccactacgagctcaaaatcaaggacaatgaacattgcccactcacaattctacacgacagctacaaccttatgcccatcaaattatctggtctcatcaaatcctttggtctcaaaattcaagttagttttatttattgttttaattatttcataaatttggttttaggacaaacaacattttccacacatgttcaagaaatcatcaaactatgacaacattctctcccatcttcctccacgtgaagaatactgtcctgatcaaatgaaaatccccgatcaacagaaatttgacaattggtacaataataattacaactaaccttttaaccttaaggaaaaacttcctgaatattgttgtaatgacgtacaaatactcacccacgccctcgtcgaattacgccgggaattcaagcaactcaccaaacgggacggaaaacacgggggaatcgacattctttggcaagccatgacaatcgccagcgcgtgcgtcaagaactttgcactcaatcatttgaagcccaactcgctcgccatcgtcccggagaaaggctacactcctcaacagaaccaaagtgcactggccatcaaatacctcaactggtactcccacatcaacaatgtcaacattcaaactgcacactcccgctatggtgaatatgtctttaaacgtgagggtcaggtgtatcaagtggatggttatataaaagggactaatgggaagagggataaaattattgaggtaaatggttgtctgtggcatgggtgtggggagtgttttgtggacttggacgacgaaacgaaaatgccgaacggaaagacgctaggacaattaagagagagggaggtaaggaagcacgagattcttcgccggtacgtcgacttggaggttatttgggaacacgaaatcaatgagcagctgaagaaggacaagcaaatgagggagtttttcgacaactggaaggaccactcaccaatcaaaatcagagacgcatttcatggaggaagaacaggaccgatgaaactccttcacacagcaaagccgggacaaaaaatcagctacaaggacttcaccagcctctacccgtggaccaatttctctacaagttatccactcggtcacccaaaaattatcagctttagattaaatgagcaaactgtcaactggcgagctccatccgacaatccatacaagggacttttaaaagtattacttttacccccaaacaggaatatcaatgtgaccgtaatgcccataaaatttgatgagcgactcctctttccactctgcgaaaaatgtgccaaacacatcaccaatgaacacccgaatggcctcaaagacgacaactactcgtgtccacacttcantcccgatgaccgtgcctttgtctctacctgcactcaccttgaattgaatgctgccttggaggtaggctacaccgtcagaaaactcttccatgtcctgcaatacgaccaatggagcgacaacatcttcaaatcttacgttagcgaaatgatggccctgaagatccacgcaaccggcttcccttcatggtgcagcaacgaagaggagaagaaggaatacattgaggagaaccgtcagcgatttggaattttgttagacaacgaaaagatgaaggctgaaccggggaagcggtacatcgccaagctttgtctcaactcactctggggccgcttctccatgcggaacctcctctccaaagcaataatcaacaacgacgaaagcctgattcgccaatataccgacgacaagaaaatcgaattagtggacttggaaatgatcgacgacgacaacgacgtattcatgctcacctacaagccgaaagaggagtttgtcgacgaaaataaatactccaatgttgtcatctccctcttcacgacatctgcagctcgcctctacctctacgatgccctcaaaaaagttgccgacacccccgactgcgaaat

SEQ ID NO: 5279 - DNA, 1261 bp, Heterodera glycines
aatttgccttagaaaaatttgaatttttgaatttagtatgtatcctctcaatatccgctcaattttgttgacttttttgataagattttacgattaccccctaagtttgaaactgaaacttaattacttattttctgtcaaaaagtccctttttaaattttataatatttctgacaaaagtccgctgtcgaaaagtccggcgcctctgctagcatcccgttccgagaatgaaaatgtatattttttggtgtctcgtgctggggcaaagattgacaaattggacaaggagctcacatactgttaaggaggttggttagagaagtgagggaatgctagtagagagtgcagagtgatgagagtgacagacaacgagggtgacagcaacggaaaaaaaccaacgaggcactaaagccaacatcgctcgcgcaacgcaagccaaacggattaagtcagattaagccccccgcccgcctccattaaatgccgtgccagacccgaggaacatgaccaataaaaaggcgatagatagcaaattattaaggttatccccgagaagaagcatacacacacgcgattttgccgtcctattttctctcgcgtgtccctcactcgcaaatgcttttaatattgacgggattcagtttggcttgtttcttgcttttaatgacttttggatgtagcaattagtgaatgtatctcttttgtctatcttttaaaaatgctaaaaattaaccgatttaaaactgacaaagattccattttgattttttcaattatttgggctttttagcaaggctcgggaagccttattctcccatgatttaattccaaaattagctttggttcttaaatttatttttggcgtctttgctttttaattaaagtggagaaattttaattccgcttttgatgcggttgctttcttaaaagatggccaaagcagttataatccactaatggctccattcatttttgttgtaaattaatcgcttaatgcttccaattctacaatttattatttaaaatttttttcaaataaaaaccattgacatcacatatcttataagcagccaaacacaaggatggttaaaaaaaaggaaaattcaattttttgaatttcttattccttgccatgacttttgggaataaccattttggttctttagaatagggttaaaccccgagccctcggggggcaaaatttcgggggccggggacctcggtgagcgacatgtcgggggtcgggccggggggggggggg

SEQ ID NO: 5280 - DNA, 2564 bp, Heterodera glycines
  misc_feature (2271)..(2271): n is a, c, g, or t
  misc_feature (2326)..(2326): n is a, c, g, or t
  misc_feature (2344)..(2344): n is a, c, g, or t
  misc_feature (2359)..(2359): n is a, c, g, or t
  misc_feature (2373)..(2373): n is a, c, g, or t
  misc_feature (2376)..(2376): n is a, c, g, or t
  misc_feature (2380)..(2380): n is a, c, g, or t
  misc_feature (2420)..(2420): n is a, c, g, or t
  misc_feature (2426)..(2426): n is a, c, g, or t
  misc_feature (2428)..(2428): n is a, c, g, or t
  misc_feature (2451)..(2451): n is a, c, g, or t
  misc_feature (2489)..(2489): n is a, c, g, or t
  misc_feature (2491)..(2491): n is a, c, g, or t
  misc_feature (2496)..(2496): n is a, c, g, or t
  misc_feature (2498)..(2499): n is a, c, g, or t
  misc_feature (2501)..(2501): n is a, c, g, or t
  misc_feature (2504)..(2504): n is a, c, g, or t
  misc_feature (2508)..(2509): n is a, c, g, or t
  misc_feature (2514)..(2514): n is a, c, g, or t
catgcttgagagcatttgtgcggtataaaatttttcagaaaaatagatagccatttttctggaattcctcttagaagccaaaaattctctgggcaatataatatccattgcgcaccgctctccctatcatgcttgagagcatttgtgcggtataaaatttctcagaaaaatagatagccatttttctggaattcctcttagaagccaaaaattctctgggcaatataatatccattgcgcaccgctctccctatcatgcttgagagcatttgtgcggtataaaatttttcagaaaaatagatagccatttttctggaattcctcagaagccaaaaattctctgggcaatataatatccattgcacaccgctctctcctatcatgtcggggacccacgatcgcgtagtgatcaacaaaattttttaatgaaaaactcaatttttatttttaaatgctcgtaaatcttccttttttcactttactcatctgatttcgttagcgccaacaagagtgcgttttatttataagaatgttctgattttggggtagcgacgaaaattgttcagatttcttaaatatatttatagttttaaaatttttttatgtaaaaaatgctaccaaaaactcccaattttcaatttctttttacgccggcacctatcggcaccgccagtccgcaaaattgttcttaaaaattttctcaaaatcgcgcaaaagggattaaacttatagttttgctaagaaattgccaaaataggtaggctttgggtactaaaaccccaaaaataggcattaaaatggaaaataggctctaaaaagcctcaaatttaggagtgtaaaatgacaaaatttatacgaaaagtaagaaaataagccaaaccagtattgagaaatataatttttaaaatttaaatccctgttaagaaaataaataaataaattttggagacaaatttttgagaaaatttttcatttattagggggtgtattttcagaaatttttggaccgattcttaggtgtgtctttttcatttttattgcatttttgttgacatagttaaaatagttttttttcaaaattttttttaggttttaggtgctaaaaatgaaaaaacttaaaaatagttgctaataactcgaaaactagtttaacaacaaccgaaaaaaacttgttttcgtgcgtttaaggccacgtgaatctcaggaaaaaatagtgaaaaaaactataaatagtatccctagtcatagagagataattttatgaatctttccttaaaaactaatttttaaaatatggaaattttaatttcgtggcccttaaaggaattaaaattttattatggccaaatctgctaattaaacaaacaattatggaccctataaacatgtttggtggagcacgacgagctccaatgaatcaggtatttttagaaatttcatatttgcgtcaaattttaaataattaggatgaatttgacacaaaattcaattttctcaacgaacggcgcagtagaaatcgacgacaatattcattggtaaaaatatatttatcataaaatagataataatttaattaagaaaaaaattccaaatatataaatatatgttaataataaatcaatttaataattgccctttaattaaaggattccatcgtggaacagtcagacgctgagggcggggcggcagatctgtgcggtgctgcgctgtgttggcgccgtgcaggcggagcggcgccacaccgatcaatttccattgtgacaacgcccgccgtgccatccaagcgcagctgtcagcaacagcacagtgccaacagcggaagcggcggtaaaaacacacacatatggatgagaaaacactgatctggcaaataaatacataatttgatcagacgataattgaaaacgaaacaaaatttgttgattattttattgagatttaaattaaccaattttaatcacttttggagagcatctgcgcacttggttatgagcataccgaaaatttataaatttgcggactccgctgcggaattggaactcaaaattttgcatacggatcccgtgtgattaatcccgaaaccctgcgatttccaacgcgataactgattgataccccgcaaaactcgctcaggatcccgtcccatgccactctctagttatgagctacattcattgaagctttggcttaataaatggggcgaatatttatttgtggtaaaactcgtgggcgcggaaaatgtggatttttgtaactcagtccagacttcgngggggtccttttttgctctttgtcggcgtgtgtttgttgtcggttgtttggcggnttttccgttttgtttttngtgttcgcgctctcncgtgcggttggggnggntgtngctcgtgtgcgcctgtgtctgttcccgcgcctgcctctgntccgtncnctgctgcggtcccgcctgcgctnggtcgctttcggcggcgcgcgtgccgggctggcaagcncnctccncnncnctnccgnnggtcntccctccatgaatgattcgtgctgcagggcgtttcttttaataaattgcc

SEQ ID NO: 5281 - DNA, 3882 bp, Heterodera glycines
  misc_feature (70)..(70): n is a, c, g, or t
atttgtggtaaaactcgtgggcgcggaaaatgtggcccccctaactcagtccagacttcaaagaaatcanttggaatttcctagaaaatgtatttatataaggctagctttatgcaaaaattcaaaatttttgctctttatagaagtgaaaaaattaacagtaaaataagcgaaaacccgattaaaattaagtgaacgcgctatcacgtgcggttggggaggatgaagcacgtgtgcgcctgtgtctgtacacgcacctgccactgatccgtacactgaagcggtacagcctgcgcaaggacgcattcggcgacgcgcgtgccggactggcgctcgcgctccacagcactgccgaaggtcatccatctaattttttttcgtgctgcagggcgtttcttttcttaaattgccccagggacaataaaatatttaaaaactcgaaaaaacaaatttcaggtgactatgaattttttaaaatataaaaaaaaatttcaaattttattgcaaaaaattattaccatttgcttttctgaacatattaaccataagttttttaatcttgtgcatttttttcaacctttgtagacgaatagagaactcttagagctaccgaaatagcaagaatatttcatttggatgcttttagaaaagtcatggggcattaaatttgtcaaatattttatggtcgtgtctttttttttgtgtttgtgtaaactgcaatagagccgagatttgaatagctaaagaatattttaattatttaaaatttaatgatgaattcaatggtgctatgacgttagtcaaaaaccatcaaatgaaaatattttttcatataacttagttcaaaagcaaccaaatttttaatgcttaatatcattcgatagccataagtgatttcgatcatatcattaattccaagaaagttatgaccaaaaatgttcagaaaaacttggttttttgagtttctcaggtcataactttttaagaacttaaggaatttttttgaaattttgcagaataatagaaaacacttggtgctatcgaataatatcaagaatttaaaatttggttgatttatggcgatgttatgaataattttctgtcaaaaattttccatttgatggttttttgactaacgtcccagcaccaattcaatgaatattattttctaataacgattattttaaaaaatgaaagctcacctctatttttcacttgtttaggcttagcaatgtcatttttggctggattgcctccgatggtaaaaaaaaagttaattaaatttttttatatttttcattaagatgggtgtttacactgttttttgtgccacattgttttatatgttctttggtacttcaaaatattcatttttgggtataaatttattttcataattatagaaaatttatttttttaaactaatcaattaaataataattaatttaaggaacaaatttggtcatttgttttttgttgcgcaatatcgttgaaagaggtgccgaaagtttgaatgaaattcagtcggaaaaccggtacgatgatgaacatgtgcaaattgcagtgaccgtcacatttttggccgcaataattcaggcaaaattttattaatatgatttgcattaataattaaacgttggcacaaaaggcaaaaattaaagttaaggaacttttttaaacgcaataaaacccaaacagaaatgatgcagaaaatgcatttatattaagactgttatcttaccaagtctcaaaaaatgctcagatatgaaaggattataagggaattagcatatttttaagtgaaaattaattattaaaaatacgatttttgtaatcaaaaatctaaaagaaaaatatttttaagatgataacccatatacaggtgcaaattcaatgttttttccattgaaatgatttaagttataaaatcatcattttcctgactgaattttgtgcctttttctgccggctctatcaataataatttattattcaattaatcaaattaacaaacaaataatatgaaagataaaggattattttaaatttcaataaaaattaagaatgtttagtcagaaaatattttaaaatttttagatttattcgaaaatcaaattataagcaaagactgaatcgtggattatttagggtctggtctatttgtttcacgccgacttcatcttcagcttcatggccgatgaccaggtgttggccggcttttctgccggcattggcctgcgcattatgttcactcaactcggcaacattattcactttcggtccaatcggatatgtgccgttgatttgccaataaaggcaagtttaaaaaaatttgaaattatttttttctaattttgttatttaattaataattagagctattttaaaaataattttggttttattgcatccaaatgtagcatatattgggcataaaaatgctcctataaataatattaacaattttaggatgcttcttcttccgcttcacaatccatgcctgccaattttggctcattcccctgtgtcatttgggcttattatcgacgattgaatgggcatcgaaaggtaaaaaaactatgacttttttcgataacgtgttttttagcccggaggctacgcaacccttcagtcactgtcgtcaaatattgtacaaaaattgaatacatccgtggctgaacaagctaattcagcgcatattgtggagacaaatgttgcgaaaattattttaaattgaaaaataatattcgaaaaattaattattaaaaacttaaattgaaatatatttcagaaaaaataaaattaattaagtgtttgccctcattttgggagtgtttcgacgccataaatttaaatacactggcgatttcggtaaatttttttatatgattttttacgtttcactacttaaagcatgggtaagctcctataaatttttgaggttgcttgtgttctgctgttggtgttcacccgtcaatgcatcggtccactcactcgttttcgtcttcgttcagctgtgtcctcggaatttttagtggtcagaaaaacttgttttataaatatatttataattaaattctaaaatgatattcgctatagaatacattttttttttggaatattttcagattttattagccggttttttgtcacgatggcttaatgctgagagactttggcaattagagacaatcaagtttggaaacggaaggttaaaaatgctaatgaattaattgttaaatttctacataaaattcatttcaaaaaaggatttaaattattagtatctctaaattttaattttttattatttaaagttaaaagatataattatattacttgaagatttatttacttttaatttgtgtttagtgcttttatgattacagtacctcatctatcgctgataagttcacggtatgtttaaattcttattttaatgaaggataagaaaaatatattgagaaattttcataattttttttcttcatattgttatattttagcttcctgtcccagacgctgctgcttgatgcatttgcgcttgcactgctcgtgcacacactgcacatacgcgctgcgagcgcgcttgcacgcacgcacaaatatcgcttctacgaaaagcaggtatggcaaaaaaaaagagttaaaatcaatgctaattaaatttatttaaattttataaaaacattggctttttatataaataaaatttaaataatgaactaactatatattctttttataaggaacttttcacgctgagcatcattggcattttttgttcatttctttgcgctttttctccgggccattcgccgttgcgcacccatcacggcactcgggcaggcacaaaaacgacggtccttttaaaaattcaaa

SEQ ID NO: 5282 - DNA, 4210 bp, Heterodera glycines
aattttaataagaaatgggcaaaatgtttaaacctcgggtgggaatcgaacccactcatgcaccctttccgtgggcagctctaccattaagctaccgaggcacatccgcccttatggatcttatcaacccccgctttccgcgttttaaccgcccagccagcttcttccttacattttgaattttttttaatttatgctctcaatttccactttacctgtcgcaccatttgttcacgcttttcttgcatgcactgttgttcatgctttaactgctgaacacgacggtccataccgccaatggttgtcgagcttggcgaactgtttactgctgttgaaccattattgtcgggtgtttcattatttggcaatgccccatacggtccttgctaaaaaattattattacttttgtggtacagttccagaaatgatgaaatactgtattccatcatagaaattttcatatatatagaaattgtataaagccataggcataaataggaattggcaaaatgaccataaaaggtcattaaaaagtttaaaaatagactttaagcctcaaaaggtccaggtaaatcccacaccctcccctttggaaggtaaccatcccatagttttgactgttaatgaaacaaaagtgatcaaaaaccatcagaaaaattgcctgaaatgtgacaccgttgaactgttggtgatgctgttgctgcttctggcgttgttgaattttacgtgccaccagctcagtttgttcggcatttggcactcgtgggtcgaaccaagtcgtcgtcttattgttgtggtcaatgaaatatgcctcaccattggaagcgaagccctttaatgggggggagggggaataattacttttttggcacattataaaatatttgaacatacaatattccatccttttggcaatgggccaagtccgtcaccgggatctaccagctcctggtacaaatttaaatttttgaactttttttttatatataaaaaaacatattgttttattaagaaatcaaaaaaatttctggagcaagcaaatgccatgtggccaacaaaatgccaaaccaaaacatgatcaaaaaaatatgcgaattttcacaatttctcataaaaatacagtactttttgcacaatttctcacaaaatacagtaagacccgctctttctcactcacaatgttggattgttgttgttgttgctgctttgctgggttctgttgttggtgcgcttgttgttgttgctggaatggcatttgttgtgattgctgttgttgttgcggctggacatgttgctgatgctgctgttgttggtactttgtggcatcgcatggagatgcgccagaggccacatgcgggctggacaaatgaggtgtggtgaactgctgggcggacgacgacaacggcgacagctgtgccgtttgttccgcaaaacgtatcgggtccaaactttgactcttgccacgcgcaccggcccaataagccacggatgatgacgagttcaactgcttagcagggctaaattaaatttcttttataagcgtaccgtatttcctaaaatagagccatggtattctattttttaactcctctcaacaggggtgggatctaatttaggggggggggggggtggctctgttttagggaatacggtatattcgtaaccaaatagagattgggaaaccagcaaagattttggcacaatgataccattttggaaatgggataaatgtagaacccaattttcaccagctgtatggcatcccgctcggcatttttttttcatccagtcacaagctaggatttaaagaggattcggaaaaagccgggatactgatttttttcaaggtatcagccggtatttctcctccccatcatttggggcacatgctgcataaggaaggacccattcattcacatactcaatgtattgctgttgttggtgttgtgttgctggaaaatagccggtgatggttggatagttgccaaaaaattgtgtgcccatttgttgttgttgaggatgggcactgttctcaccatcaatcatgatgtggctgttgcccaacattgttgcggttgttgtagctgttgcatcagtaccaccaccaccgccgccgagcatgtcaaaatcgcacgactttgccgtccgatggtggtggtggtggtgctgctgaattgtcccagcagcagcttgcggtgatgacaaatccatgcttggtgcgttaccgtcaacaaagtacagttgcgattgggacccagcgccggctcgataccttcaaaagcatagcgatttaatcaaaaaaaaaaaacatttttaaaataccaggattaaaaaaaaaattcatttcaagggtgactggggaggggaggtgtaatgacaaaatgtataaaaggcacaacgtacaaattatattttttcgaaattaagacttaggcaggttgcctagacttagacaaggccttttgtcagtgtacgtttttccattgaatcggctgaaaagtccaaccaacccagcttgattaagagctctgttgaccaatatgcagtataccgtattttggatacgagttgcatatatttaccatatttcttcgaatagttcttcactttctaccttcaataaagcccccccccctcctaaagggattaagaaataatgcattcctccctctctattgtttgaattacgtcatttctgtgccgcctcctccaccagcagcagcaggtgcattgttcgccatcgatggtgtgttcgcgacactggcacttggtgccaccatcgcattcatggacctactgtgcacatggtgatacggtgcttgctgctgttgttgttgctggtgttggtagtgatgatggttggccaccggattttgagcgtgcggcggatggtgcgcaattggtggcaaaccagcagagccacgtgatctgttccaaatatatccaaaggcatttagtaaatggatgattcgtcagtaacagacaatccgtcaggaatttttattttttctgcaatgctcaaaatcgttacgaaaataattgtccgatttaataataatcaaaaatcgaatgggtttttttttttagtagagtagagctgaccagtacatttagcggccggtaattaacggttttttagtaccaataccggttttcaaatgagaagtaccggtaccaatttttctagtacctaggtaccgtaccggttaagtgaaaatattggtacctctctactcattactattatttttttaaatttaaattcattttctcattattttatataaatcctgtgtttaaaaatcaattttgctgacggaatatccactgaccgaatgtccgggcggatggaaaaaaggctataattaataggcatggcttagaaaggcgaatgtatttggtatattactttacagccctaacagcaggtggttgcttttttaaacatatcaaaacccgagtcttaatgcgattaattaattcgtgtgtcctatcgcctctgaatagtccatcaaaaaatcgcacctatgcgctaattgggccgagtccatctgctgctgctgttgatgctgctgatgtgcagctccaaattggtgacaatgtcgctgatgatgatgatgatgatgctgttgttcccgctcactgtttatcaatgctggcgctataaaattatttaatttttgtaattaattttgggattagcattttgtttgaaattaccgctttgttgcctattatggctgacttccaccatcggtcggcatccgtcagaagcaaaattggcaccgacgcctgtgtatcaaaaataaaattttgaattaagttttcatggaattcaattcattttattttatgttttttttaaatcggttccaataaaacccaagagacaagcaaattttgttttgttttttcgactcctaaatttcaatctcgaatttcgtgccatccttggttctagagttggtcctccccgaccagagttttgctacccgatattttttaagttttccccagccattcctaaaaaaattatcgggtgttttctcccctgatccccggcttttctctctccgggggtcgaaaatcaaccctatttggttttctcgaatttttcagcaatcttttttctgattttcttcactatatataccagaaagtgcgcttgcaccgcctataccgccatatgacgtgtagatgaggccacac

SEQ ID NO: 5283 - DNA, 3579 bp, Heterodera glycines
tgcactgatcagctcttcaatgcttttgttgatgtcacagctggtgttgatctgcacagtgccccgcttcttctcctcaacacgtttctttgctgatgatgacatcgcttttcaaaaaagtgattttccccaacaaattgatgacaaatttgagataaaaattatctgatgaaagaaaatttccctaaaaaattaaattaaaataaaatttaatttcattttagagcaaaattaatttggtttttgattatgacaaaattcagtttgattagttaaatttaagacagaaatgccataaaaatccctagagaaaaaagtatgctttagggcagtgccaatgggaaagcggaaggacagcacaggaaagccctcagcggcaataccggtggcgccacattaaaagaattagtgtgggtgggatttgggattggatttcgagggtgatgaatgatgaggttgggcaggcattgaatatgtgggaatttatgagggggaatggcgactggtacaaattggaggcacaacaatcaaaaggtgtagtactgtaatgatgggatggggtggggcaattcaagatatacctagcggcacaatgtcggctactgtataaattgggcaagaaattcaaccgctcgaattccgaatatatctgctgtgcattttaatgaagtcagtatttgatcaaaatagtagttgacttatttaatttccaagaataatgattttaaaaattttattctatttcctaactatttgacccaaaattttctagattttcccggcaacgcctaacagcaccgccgaataaattttggatctttttttttgttgcaaaatttgatcataaaatggccaaatctggcaaaaaaaaataaaaagctcttcggtgcccctcccgaaatttttctggattcgaaatgcgactttaagtggaattagatccaagcgcgagcattagtttttattggacccattctcgacaccgacgagtgtccacgataatgctgccctttatgatcgagaaattgagaaaaatttaatttattcctaataaaatttgaaaaatttataaataaaacatttgcagaataataattctcttttcaataaaaaatgttaaacaatttttttgatgcataagaaatgataaggaaatagcaaaaacacttaagaattttgatgatgttcaactgaacattaattaatttaaaaaatgaatatgtatatcgtaataatttaatagattatgaaataaaatcttttaaatttagtgtagttaaaattgtttaaaaattcatacccaaaaatttaacaaattagttgaaaagtttttaaatttaatggggccaaatgatatcaaacaaatttaaaaaacaaaaatgaattttcaaacatttaatgaatgtttcatattattcgccaatcaaacacaaaaatttatggaatgttttaccgttttgaatgtagatgtgtgtttgtgtgttgtatgtgcaattttcatcaaaatatgtaatggttgggggcacccaccggtgggcggatgggaggaacaaggatggtgggtggatgatgatggtctgataataggtgtggccaaaatatgtatgacgaattttttttcccgttttttgatttattcagcatcacctccaccatcagaaaaaatggtggggaatgaatgtatccatggcaatgatcaaaaaggtggtgatgaaaaagatggctaacaacaaatatggcccgggcgtgcggccccgggacaatgacgaatatgagcagcacaacggattggacgcggataaggggccaaaataaatatggcatcaaataaatctggcatcaacacagcagcagaatttgacgctgcttgcgccccggtgccaaagaaggtgggggatttagtgggaggcgcgccgtcattgccagcgcaccgcccccgtgcggatacgataatattaatggtctttcaaatttatttttgggccaagccaaacacgccgcgcgagaaggtggaggatttggccccggattgatcccaaacacactctcagagtaaaaatgatgataatgttaatttatgtcctcgagaagacccgaaactagaattcaatttttcatagaaaaaagtttaaatttcaaaaaccgtaacttcaataacaaaatattatttctgaattgatccatataattttgtctttaatccatggaattaatccaaattctcattaaaaaatattttccgctacgaaaaaaagatgtaatttaagttccctaatctatactaaaccatcatcaattaaatttgggtgcgccttaaattttgtgcttgttgagtgagcagtttagtggttactctgtgctcatacatagagagagaccaatctttggctgatcagtgctctttagtgtcgtcattcaaacagttaaaattaccgccatttttagccggtgttttcaaaatgggaagaaaaagaggaactacctgcatctttttacaattacatatattaattaggggggagggagcaatgattattaattaattaattattcgactacttttacatggttgaggggtatcagtgacaggactgatcaaatttgcaggagattaaaaatcattttcgtgatcatttgacgagagaatcgggaattgattagaaggaacagaaaagctacaatcttctttttaagggcgctctccaatttttccagaaaaccaatccttgagtgtgcccaatttttgtgggcaactcgttaataatggattgattgatcacggttgagaaaggcatcatcaattcattcatacatacatataacttttgggggcgaatataatcagtagagttgggaaggggaagtgagaattttgggtggagggggtggggggggcgatgggtggactttgaacgtccgtccgtcgtcaatcgcttgcgaccgccgcgggggccgatcagtttgtgtgtgtttgtcgctgccagcgccgccatcgccgccgcacgttaattgattggagaatggggcgggcgagcggggggcgggggcgggggcggcagagagagctttttggtgtggcgttctaaaccaaacacccaccaactgctgctgatgggcggctgcttgcttgtgctgctccttcacacaggtctttttagcggtttgttttgtttgtgtctgtgcgcgcgtatgtaccacacaaatttatgcaaaatttgacgaaatttaaaaatataagcgccggaaatttaaaattgaagaattttaaaaatgccagcaccagaaatttaaaaaaatttgaagaattttaaaaatagaagcgccggaaatttaaaaaaattttaaaaatacaagcgccggaaatttaaaaaaatttgaagaattttaaaaatataagcacctgattgaaattatattatttttgtcttcaagcattcttataggaaaaaaatttacggaaaactaattttttttttttgtttaccaaattagaaaaaaaactttcggttggttcgcgtcggtacagttacttttgacaaaagaggcaaatttgtgactgaaaactgaaatgagccggaa

SEQ ID NO: 5284 - DNA, 1631 bp, Heterodera glycines
actgctgctggtggtggaggtggttctatcggtgaaatgctgtgatgagttgaccgccccccccccccacatcgcgcccccttcggcccccggggaagacggacgtcccgtaaaaggaggcaaatacggccttcatcttttacccacatcaacactgactgttcaagtgttgtggtgttgtggttggtgcaccgacaaagtcagccagccccagcattgtgtgcgacctggcactgattggcaagtgcatcaatcagatcaatcggagtggatttgactcgtcggtacattttcagttttcccatcccgtgtgtaaaatttttgggtttttgttgaataattttaatcattgttcacgaaccatctcgcattttaaacacctctgatcaattcaaattaacataaataggaggattagggatattgtaacagtttaatttaacaaagcaaaaatcagtgacataaaacagtcatgtcatattttctagagtgccacgggaccgggaccaaaacacggacaactgagtaccgaggtcccggttttgaacagttttgaccgggaccgggaaattcccgttttcttcccggttttcccagccaaaaattcccggtttttcaacccgattaggtcccggtcccggttttgcccaaaattcccggtccgtggcactctaatattttctattcaaaacatatgtagcattcgcatatttgaggtggcaaagaattgacaaccgaatttttgataattttggcccttgacactctcggccatctttccatctttggtcatggttttttaaaaactcccggcccgacatatgctcggggaaaaaatactcatatggattaggtcaaataaaaaaattcagttgaagtacatgttttaataattctatgattactaaatattcaagaaatgatctaatttaatatcttcaaatgctgatcaattattgattgaaaagactgactgattgtgtaaaatgtgaaaaaaagacaaaaaaaaaaacagaatttttaacaagattaatttgtttgaaatttaacaatgatcgaaattggaaaattaaaaaagggaatttttgatggaaaaaaaatcggggacaacgacaattcagcctaagcatggatagattttaaataaattggaactactgcttggaatcaattagttgtcgccctataattggccatttcgtaaaattcaacaccactaatgaatgaatgaatgttggctaaatgagtgcgtgagatttggggacacacgggaggcgggagaagacatggacaacaaatatcggtcggcccctctctaatttttgccaccaccaccccacccggtgcgatcgggagcagcggcggcaagcagtcatcaccagtagctagcagcagcagcagcagcagcagcagcagtatccgctttaatgtgtcatctccaacaacaacatctttttcttcggctgctgctgctgatgactgactactgcctgcccggcgggcggacgagggagcagcggttcgatttatggcgttgtgtctgtgtgtgtgtcgtatgtatagatagatagggaggggtaagggggatgggggaggcggagtttgggggtggcgattattcatcagcaccc

SEQ ID NO: 5285 - DNA, 1353 bp, Heterodera glycines
ttttctctctttctctaaatttctctcttttcgcttgtctctcgcctcgtacaattgtgctgcgagggcgcagcttgtacccgccggaggagtgttatgccaaaattcctttggctcttccatttctgtgcccaatcaattcaatttgccaatcacatttttccctttcctctaattacgccaactgttcccttttctctccttcttttgccccgcccgaaaattgtttaggtgggagccatcggaccaaccccggaaaagcgatcacttttgagatcttttgatcaacttttgctttctccgatttcatccgatttcttttgcttcacattttctttgtgctttaataaaaggggctattacaaagccaactcggactcaataggcgggatcgcgcctagcccctgacttcggtcaggggtaggcccaacgatcccacggacacgcctagtatggtccagctggacggatctaatcttcttttcctaccccctccttttttacccccacaattttcattatttacacatttcaaatattaaataatatttttgctcaaaatattaattaattaattagattttcattgttttttcctttttcttatcaacataatattttgttcgggccattatttttcccattttggccattttcctttttttccactccttaattggccattacttttgcatatacactttccatttggccatttttccccttcccatatccatttctttgcattaaaatttcaatttccaatttttctgtttttattacctcgtctcccctaccgttttaacaattttaatttttgaccaacacatttcgcatttatttgccatttcctctattttcactctcttttccccctcccttctcaaattctttgcagtttaacaattaaagttttattcagttaaaaatcaaatgaaaaaaaaaaaatttaacaaatcctgagagtgtcattaacaccaataacccccgccgtaacagttcactgatttcaattggcggagaatcggcggcattgactgcaaaagcccaaaccgcttgtgcccatctgacgacgacgacgcaggagaagcgcagccaaagtcacagactgaatgccgacaaggaaaaggagcacggccattgccgaaacgattaatggggtgacaaaagggtcccagcgtgatgagtcgacacaggaagctgggccaacagagcaaattacagggctcgcccattcgttaatcccaaagcacattgaagtgcagttgtatcccgcgcaggggatcctccagaattccagacgatccaatgctgaataataatgttttgcgcattaacaccatatgcgactaa

SEQ ID NO: 5286 - DNA, 9223 bp, Heterodera glycines
  misc_feature (2708)..(2708): n is a, c, g, or t
  misc_feature (4875)..(4875): n is a, c, g, or t
attactaacatacttaaccaataaccaaaattaatagtaataattaatgaaaagctttgaataataaatatttgaataaatttgtttattaaattaacaaataaagtatcttaacaagtgatgtgttaaggccgtgccaacgattaacccgaaattacattgaggagacaatacgactggacaaaacactaacacggcgctgacattggtcacagaccccaattgaggcaaatggcaagtctcggcggacacggaccacagccaaatggacaaggacaaggacaataaggacaaaattgagcccaaaggacgaagcgatcatccaaatcggccatgccactccgctggtacaaaacgggatggagtcggcacaaaaaacgggattctcccactcttcgaatccaaagcaacggcggctacagtttcggcccgcacacgatacacgccacagttcaagactttcgatgtcttaattgtttaacttgctttaattaataacaatttaattttcctctttttcctctctctcttttcttatttttctctttttttttcctctcttcccttccatgtttttcttttggccggcagaaggaaaactttggcctgtctcatttgcctatggtcgctaccgtatacccgtaccacaagttccatccctcccactccttgttttgcccatcccgccattctgtgaattttgttgcctattgcctaacagctgccccaattcccttccccctcctacgaccaggcagggccccatccctggacgtttggagttttgatcagcgctcattaattaattaatcacaggggaaaaagggttggggaaaagaaatttcagctaacaaatgccagtcccgggacaagacaaaaataaacacaaatggcaaatcacgagaaaagactaacaattaacgaaacaaaaatgcgaaaacgaattcgaagaaacaaaatgaggcaacaactgacgggaaaaatgaagaaaaattgggaaaaacagaaaatggacaattaattaattgtcttcggagggaacgaaaatggacacaaaaatgcacatcaaagagggacggtagacgatcacattgcgatcacattggcaatcatcatccaatcaacgacgaccaattgtttcattatttttattacaccaatcgacgaacaattctttaattacttcatcacttcattttcaaatcaacaattactggagttcaacaaatcttttatttttctgagacacttcgacgacataatttctttaaattttaaatttctcgactacaatcaacaaaattctggatttattttctaaattctggtgttaatcagcgaaacatattccgacaattccatcaaaaacggccgacacgcggagaagaccgaattctttagaggaagatggactaaacgaaggacaaaccgaaagggataaaaggctttggctcatccatcaaaaaaggcagttgcgtaatatggatttagacgccctgcggcgtcgaattgttactctcgagcaagagatgcgtgaaattggtggaactcgctctgggctcccgatgccgaccacctttgacgggacgactgatttgcaggattatttgaagtcctttaatttaatcgcgaccgcccacaattggacacccgcgcgatgtgtgcaagttctcccgctgttcctcagaggatcggcaagggcaatttacgagagcatcgaaccggatattaaagataattggcgaagtctaattgatgccatggcggataagttgaaacaaatgtctccgagtctgacagcaagacagaaattggcacaacggaaacaacagactggagaatcgctggaagaattcgcgcaagcgatccggaacctcgtcttacgtgcttatcccgacaattctctcgagatggactttggaaatttggtgctcggtgctttggaaaatgatgtgaaacaagcaaacgaagtccgacttcgacaattccgttcggaaattgcgcgagatttttttcgggcaaatatggcaccacgactgaaggaaagagtgatgtacatggaagaaccgcaaacgctcgaggaagcagtggcccaggcaaggcgtgttgaacaagttcaaggaaatttggccgatgacatgtggaaaaatacacaagatgcaaaagccgaagttgctttagctgaagttaatgcagtgcgaaccgaattaaatgaaattcgtgaacaacaaaggagccgagagaatccaggacgagatcaacgagaatggcaaaatcaaagcaattcttggagaggaaacaacgccgaaggacaaaatcaatctaatttttggaggggcaatcccgaatttcggccaattcgccgagggaatttcacgccaaggggattcacaggatatcccaggggactcaacacataccgaggaggatttaatccgcgcggcgctaacgcaaacttcacaccgcttggcaacaacttccaaggaacaaacaacaatggaaatttccaaccgaacttcaaccaaaaccaaaattggccaagaggacgtggaccaacaggtcccaacagaggacgcggaggaagtgatgccaatcgaggacggactggctggcgcgtgaacgaagtgaattttccatttatttgtctaatgaccatcatggcggcgatgttcttacccgctgacggacaataccaattatgcccgtcncaaccgacagaagggattactgttactatgagctttccggaggaacaaaattgcactcttccggtggaaaaagcctccactgacggtgaagtcaaatctttacataccaattcggattccgcgagtgtttcccgcatttaaatgctggaatgtgacaacagtcacatgcaccgagtcttttctccgaatcatgacgttggatcatcctgacaagaaaattgaagccgacgcttcagtcgaggactgtcaggcctcaatacaccattcgccgatgaacagagtaagtgagacaagatgggaaagtttggcgccaattcgaaaagagtacggatggtacggcgtgaattgtttcaacaatgtacagacagtgattgaagaaggaaaagcagggattttggatgggaaaagactgataacttcgtggggagactctttaaaaatcgacaaaagtctgggagaagacggcagctggatcagactgccaggagatgtggaattgctcatgtggaaaataccatcggatgaattttggcattcacattttgtgattggcccagtaatcacggaaatttggccaaaaaaggtagtaatcgtggacgagctccaatatacttttccaataagccgaaatcaggaaagaaaatttcctgtgtttggagtgcctgaagatgcgctaaaaacggacaacaatgtttttgtgcatgtcattagtaaagtaaactcaaccaagggagcgcgtccaagacgagagaccgcgagtctaaaacctggacaaagaaagccaaatgtgccgagaattgaaccaacaagaaggccgaatttgcgaagaggtcaaattgctgaaatcgccatgacaacccgtccaactattactaccactaatattccaccgacaattcgtcccgtttctacaacgcatattccatcgacaattcccccaatcgccactcataatccaccgacaacccgcccaatcacaacgacacatattcctccgacgatccgcccaatcgctactactaatattactccgacgattcgcccaattagtacgactaatattcctccgacgattcgcccaatcgctaccactaatattcctccgacgattcgcccaattactacgactaatattcctccgacgattcgcccaatcgctatcactaatattcctccgacgattcacccaatcgctacgactaatattccgccgactattcgccctatagctactacacatattccacccacaacccgcccgattgctactactcatattccaccgacaattcgaccaattactactactaatattcctacaacaatccgcccgacttcaaccattcatagccctattataatcaaaccaacaacgacaatcctgacaaccactattcaaacgccaactaaattaatctctaccacggctacaccaaccaccgtctctcctcacaccacaaagagtgcggatgacaccgctctgaccactgcgtcgtatcattccattcttgatgagcttagaggattggccgatgaagctgatgaggaaggcattttaatttctccgacgataaaagtgacgccgactccatttattctccctgatgaaccaaatgaagaaagcccaaccacagttgttacgaaaagggaaatcccggatgatgatgaatcagaagaggaagaaaatcttgaccacgacaattcccgtcttaattatttgggatggaaggcgcatcggacgaacattcaaaatgcgcgagagaaatggatgcgctactgtcacgaacgaaataatgcgctttccatcgcaaaggcattagctcgtcagatgccagaagacgcagcccgttctctctacaaaagggatgatattacggcattttggaccagatcatcacaacttgaccaaaaatggtcaattgcactttgtaaacaactgaaggctgaggatgtgctatgggaccaaaagattggcgagaaatgcttccgcgagctacccgtggtggtggcaaggcgcacacttttcgtcaagccagggacgcgcgacttgagctataacgggactgaaactcactgcgatgagcagggagggtaacaacccttgggcaaaaagatttcaacaacaatgacacggaactccaacaagccaattcgaaacatcgattgntctcaaagcaacagacaaatttcaaaatccattaattttcttcacccgcggatcaatttttgaatctgagcaggcccgcctggaacagaatctcaaggaattgacgagaaggatcactcggcctgaattgaacttccctgacatagggacagtcgacattaatcagactgaaattcacggaagcacggtcacagacatattttccatcggcgaaatactggcggaaaagatgcagaaagagagcgaaaatctcagaaaaaaggcggaagaaacgattgaaaaaggaaaggcatggatggaagacccaattggaatcatcaaatacatcaaatggatactaatcacaatcgcattcattctaattgtgattggatgcaccgttcttttgtggaaaatcaaaatttattccactttgcttttggcgccaattcatttgctacaatctctggtcaacaccataatgaactgtttaaattctggaagaagacttgccgaacaagtgcgatatccgatcgtgatggaagtcgaactccaggaccgagccaagccatcggcaccacccgaggaaccgttacttgaccaaaaggcttacgtgctaattatcttcctaacatttgccaaattgaacaaacaagacgaaaaaagaaaagatgttacgtcaattttttcatgaatggagtgaaaacaaaggccttattcgacacaggagccgacatcacgtacattggccactcaacggcacaaagatgctttatgatggtccgaaaaggggactatccacaagcaagagcagcgaactcaactcccattcgttttatcggatcggcactcgccaacataaaactgggagattttgaaggcaaatttccaattctcgtcagcgaggatgatagctgtccgtgcacagccataattggaacggatttgatggatttcatcagtgaacagggcgaagaagaaatcggattgaacttcaaaagaggactcgtacgtgttggaaacatgcatctgccaatgatcgccgctgtcaacatcgagaaacaaccgattgaagcacaacttattgagacgcaaacattaccgccgctatctgattcactcgtttggggaaaaattaaccgaagtttgggaccagacgaagtcttcatcaccgctgagcgagatcatgaatatttcccgctgcgagttggaaaatgtctaataagtccaggctcaacgcgaattgtgccactaagattgcttaatttcggaaacagcgtaataaaagtgcatgagggatcgcgacttgcgtggctggaaccaatagctgatggcactgaaattaatgcacagaaggaagatgagaaagaaaacccggaaatgataatgactgacgaggtgtggatgaaattcaaattagaaagtgataaaatttcgccagaggcggactggacggaccagactttggaatttcaaaagaaggaagaagcagtcgcgccaatactggaaagaattcgattaaacgacaccattctgagtcgagacggaattgaaaaacttaaaaacatcatccgacaaaacgagaacgcttttgtgaaacctggagaagtcggactcttcaaaggacaaacgatacaccgcatcgacctaatcgatggcgcacggccggtccaacagaggccctatcgttatcctgtcgcacttcaacccgaaatagagcgtcaagtcaaggagttgctgcgtcaaaatgtcattcgaccatccacttcggcatgggcatctccaattgtgcttgtccgaaagcctgatgcctcctatcgattttgtgttgaataccggaagctcaaccaattgacgaagcgatcgacatattatttaccgaggattcaatcgatccttgatgaagtctcgaggaaaaaatatttctcagtggcggactgttcaagcgggttttttcacatcaaactcgcaaaaggacacgaagaaaggagcgcatttatctgccacatgggactgttcgaatggctacgttgtcccttcggattggcgggagcaccaacaaccttccaacgagccatggaagaagtccgacaaatgtgctcagcgacatttcttgtgtatttggacgattgcataatcggctcaatgactgaagaggaacatcttcgggacatcaatacttttctaagaacgatgactgaagttggattcagactgaaaccagagaaatgcagatttgcattgggagagattcgctatttgggacatttaatttcggctaatggcgttcggatagatccaaaggatttggagccaattcacaaattgaggaaaccgaaaaatatcaccgaactccgatccttgattggaatgctgtcatattttcgaaaattcgtctacggatttgcagaaatacttcaacccatttatgagttgacaaaaaatgaaagcacgacagaatggggaccaccacatgagaaagccttggaggaattgaagacaaagctgatgactgctccagttttggctccaccaaaattcggacaaccattcgttgtggaaacagatgccagcataaaagcaattgccggatgtcttctacaagaaaaccgtgaaggcgaagtccatccgatttgttacttcagccgagtgctaacaaaacatgaaaagcgctattcggtggtcgaattagaagccttagcaatttgtgcttccctcaagaattttcgaccatatttggaaggagctggaaaatcaacagtgatcacggacaattcggctttgacatcattattccggcggaaggacttggaagggcgactcagtcgataccaattggctatcatggcattcgatgttgaaatcattcatcgccctggaaagcggaaccaattttgtgaccatctttcacgatacttggacgacaacgacacacaaattaattggctgaaaattgaaccaaaaatttcacaaagtgaaatgcgcgaggctcaaaaacaggagacggacacacaaaagagacgggaaactttgaagaaggatcaaaattcagaggagccaaatgaatttactggaaaatggagaattactgaagatcttttgtgtgcaatggaccgaggcgaatggaaaatttatgtgccaagcagtcttagacaaagagtgatgaaggaatatcactccgacccattccaaggaggtcacctgggcgagaagcggacaaaagacaaaatccgacgaaatttgtactgggaaggaatggaaaaggacattcaaaaatttgtgagaacctgcgacgcgtgccaaaaacggaaaataattgggaaccaaatgagctctgagcccatttgtccaattgtaccagcgtcacagccatgtgaaagacttcacttggatttgatgggaccattgaagacggcaaaaggcggatttcaatacatcttgatgataatcgattcattttcaaaatatatgacggcactaccactgagggaacaatctgcgacgacggtgacaacagcattcgttgacaaatttctatgccaatttggaattccaaaaatcgttgtgacggactgtggaacacaattcctcagttcgacatttgagtcacttgctaaaacttggggattcaaacaccaaacgaccgtgccataccaccaatcagcgaatggacaagtggaacgattcaaccgaacacttgcggacatgctagtcaccacgactggcggaaaagattgggctgccgcgcttccgatgctttgctttgcatataatacttcgattaactcacaaataaatcattcgcccttctttgtgcttcatagatttgatccacggcttcccagtaagatgctactcgaaaaagacggcgaagagtacaatgacatggccatatacgtccaagagctgaccaaaaggatggaagaagcaaaatctcggatcagagaaagtctgaagaagtgtgctaatcggatgacccagcaacaaaagggcacgaaagaagtccgatggacggaaggaatgcttgttttgagacgcagaaatgacaaaaagaataaattggaaccaaattatgaagggccatttcgcgtcatcaaaatcgagaagccaaatttgcaaatccgagaacttgaccccgatggacagccatttacagtgcacatggaccaatgcaagccgtatttcacagatgaggaagcaagacaggacacagaaacatccgagaatgagaaatcaaaacataagaatgggaacaaaaagatgggagattcaaaattggaagaatcggacgaagaaatgcatgatggggaaacaattgtggcatgtataagtgaggggaatccactggaccaaccaaaagacaaggaag

SEQ ID NO: 5287 - DNA, 2074 bp, Heterodera glycines
ttctttctttctattgctatgtgtgtttgattgtgagagcaaagttctcccttaaaatgacaagaaaaatcatttgggaaccgaaaattaaaaggaatcgtcaaaaagcaaaaatttgacaaaccttcgagcgcggcgctttggcgaaatttctcggcgtggtgacggactggaaatttcagtgttaaaaattgcatggcatatacaccgatgaaaaatgtggacacttttatagtccagtgggcccgatagaatagggggaggaccactctttctgcagaaattaaattgtaaaaaaatccatatggcttttttcctatcgggaccactaaactacaaaagtgcctgccaaatgtgttgtaagacatccaatattcggataatccaaactcagatttttcataaagtcggtcagaacacggagacagacaaaatgtagggaaatttagagtttagtagaaaaactgaacctgtaagtgtgggaacgagaacgcgccgggctcacacttcggttcttctccctttttgtcctctttctgctgccactcgacgattcgtccgccaacggactgtgctcctaaaaaacaatgggaagagttcaacgaaaaattagacacaaattcaaatgtcaaaaactaatttttgagtaacttagtggaaccaaacatggaaaaaacaaagcattgagtggtaaacaaattgaaaaagccaacaactggcgaaacaaactttctcatagtctcgtttgcggtcagaacgatgctcacggcccattttgtgtaggaaaatgtagagaaccaaggaatattatggttttttgctctgaaattggtatttaaaaatttattgcataaaacacattaagaaatttaattactgcttataaaaaaagacaattaggtagcaacactatgggtccactatgggtacgccccagtgtcagacaaaattgctcataacgccaaatagtgcatttgacgtaaatttttgcgcgctatttcaaaatttacactggaaaatgccttttttgtattttttattttgatctgccataactcgcttcatacccaattaaactgatcaaatttggtatctaaaaaaagtttttgaaaagtagaatctttttctgagcgaatgctaatacgattttacacctaagaaaaaagttgtgggagtttcaaattttcattacgttataactcaagtcctaaactgctgatttcaaccaaaatgctaaaactattcatttctttattgattctaaatgtccaagatgattttatacccttataaccaaaattattagaatttgcgaattccgtgttttttcatgtgttagagacatgaaaatagtacgccaaaaggagagaaaaagaaatgcaaaattttaatcactctataactttttagctaacccttttttgctcttaaaaaccacttagattttgttcgtaatttttttctctatcgctatgcaaaatttggtgcggatttaacaaagagaaaaaatgctagacatagaaaagtaaatgctgttttttccattaaaaattgaagaaatagtacgccaaaatgtgagaaattacaaagaaaaagagaaacgacgagatagtactagactttctctgcacagtagagttgacccataatagtgtagcaacgtttaattggtgctcattgtgctaacatctaacaacacacaaagtttcgcaataaaaacccattttccaaataatgccaaaaagagttgcattaatttaatttgattttttgcatagaaaagtacttattttttcgtttattagaccttgattataagaccccttctgcgagggattgaacaaacccgggttaagcaaacacgggtttattgtagagaccggcggggccggctgaaattttgcgtttgtcgtaaaaaccaatcagaattttcgagacaaacgacaaacgcctaatttcagacgacaaacaacaaatttcgggagtcatacgacaaacgacaaaatttttaattctgattgatgtgataaacgacaaacggcgtatactaacgacaaatatatcgtttgtcgtt

SEQ ID NO: 5288 - DNA, 2515 bp, Heterodera glycines
  misc_feature (2411)..(2411): n is a, c, g, or t
  misc_feature (2489)..(2489): n is a, c, g, or t
catttgtttgataaattattttttcagctttttctttggaaattttgtctacctaattacccgcaaaaaaatgtcgcacaatccgaaggaagcaaagaaagaaatggaaaaagcgatgtgatattctaaatttgaatttccatggtaatcattttgcttttccttttcagcttcatcgctgccgactgttggctcaaagtgttcgatttgcttccacgctcacagcttggccttggaatttcgatgataagccgccgatttgactatttcgttgacgaacacttcaaaatccgcaaatggacatttgacaaattggaaattcgaagcaaaatcggagagaatggcgcaaaggaaatggaaattgtcaattccgatggaaaagaattgccaatcccacaaaattcgttgccgaacaaattcatcggattcggatgcattttgatcaagtgaaaattcaatttagaaatgatttgtaaccatttctggttttcagctacatcgaccaaaatgtgctcatttttctccgccgttttcaccgttttttcgccacatttgaaacaaaaattcacattggcactgtgaatgttcgcatttcgaagttcgctatgctcaccatttggccaatgttcaaggacaccattcgtgtgatgtatttcaattccatcactcttcgtcaaatgcgccaatttgctccgtcaatgctcaacgattcgccatcccttcgcgttgttgctttcgatgatggcatttcccccgaatttccgcctgacgacagtgccaatgcgacggatggccaagcggtggccaaatggctgttctcacctcgccatgacaatttgacgaaggcgctcagccttgaaaatttagcagtggagcaacaatggttggcaaccatggaacaaatcaaagcggtgattattacccattaattttctattttttttttgcctttaggcattttccgctgcttcttctcctgtcaatttcgtcatttctgttggcttttcgtcgtcctctccgattgattccgttgtgccatttgaactgaccaacgaattcactcaagagaaattgacactgtcaccggaattggttaacgtttataggcttactcgtcgttcaattgcagcagatgatgagggaaaatggatgaaggaaatgaatgaattgatgagaggacaaaagaacaacaaaattggcattttcatcggagacgacggaatcgataatgagtgaacatttaaaaatctgctaattttctcatttcattttgttttttttttattcagtcttctcgacgatttgccggggccgagtggtgatcattgatcagaaacagcaaaaaatgaattgattggatgattttgactgatgcgattatatgtgtcctaaatattgagatcattgttatttaaatgttgttgttgtatttgatttttgctcattcacaaatcaataaattagggctttgccaatattttcatacataaaaaggtgtgtcagtggccaattttgcgaagtgatccgtccggccattaaatcgatgcttttttttttgcttttcaaccaatttttttttgctaacctggaaccatggtctggataaaaatttcctaaataaacaacttccccacaattttgtgcaaaccaagagaaatttgatcatcatttcatgttcataaagttttttgaagagctaaatgatgggctaaaagcaacagacaaaaaaattattcttgaatacactcgaaaaagctgatttcatgttttcatgttctgtatattttggtctgtaaaacttcaaaaaaaagttaggttttcaaaaaaggcactgatcaaaaattctaagaaattaattaaattattggaggaatttaagacagggcaagttttttcaggttaaccactaattagtaacgctgttggggggtctcgactcgaggaaagtctcggtttattcgagattctaaactaaggattttttacacccctaatgagtgtatctaggcaaattggttctaagaaaaattataaaaaacatttttattgaaaaagactgttcgcaaaaaatcgaagtcattggaccaggcaaagtgccttcgccgttggcatttccgtcctggacggcacgttcagcagcagtagcgattgtcgtcaaaatgttcggttggccaacgtcaaaaaactacagccgaaatcaagcaatcagcgacgatgaaagaacaagcagcacaacccatccactggatttctgtgacgaacggatgctaaggattagacaaacatagacttttttcttttatccccaaagtgctccgaaatcaaatttaatcaggtttcgaatgggacaaactccctttccaaggacgggtataccggtttccaaggacataaggggaaaattccattanattcaaggacatttaaaaattttatcatatgtaatgaaaacgattaattttatcccaatgatttatatttttcgccgnaatgaaagtgttgccaatgttttttt

SEQ ID NO: 5289 - DNA, 2119 bp, Heterodera glycines
agttattgtataaaaacccggggaattgtcaaattgattggactcataaagtggcattagagtcagttaagctgccttccgccactttttctaaaaaaaaaaaaattcaaaaattttaaaatcatcaaaaatcttttcggtgtcgctgaccactaatatgacatgtatttcgatccatttcgattttttccaatcagcagctgccaaaaaaagatttgttgacgatattttcttatgagcacatatttatgagcatttaacacatttcttgtttatcaaaatgatcatatacactacacaagtacttaatatcgaattttgtcattttttgcaatttttcctgccaaatttccctttaattaggtatttattcctacattttgcaaaataagtaattttcttctacctctccccctattggtgccttctattcaaaggaattcatcagaaaggattttacctacagtaaatgctcgattagaagcccactctcgaacatagcccccttttggagggggggggggggggggttgaacaatataaccccatggggtctaatcgagtatttaccgtaattccccgtctgtacccgagtatataaagcggacctaatccccttccactcatatctttcaacccattcattccatccacacctatttgataattttttattcagttcacttctttttataattctgcttgattacatttcaaaaaatgtctgacaatccaaaggaagcggataaagaaatggaaaaagcgatgtgatattctaaatttgaatgtccatggctaatcattttgcttttccgttttaagtttcatcgctgccgactgttggcttgaggtgttcggtttgcttccacgttttcaacttggccttggcattgcgctgattagtcaccgatttgactatttcgttgacgaacacttcaaaatccgcaaatggacatttgacaaattggaaattcgaagcaaaatacaacgatggacaatgggcagattggaaattcgaggcaaaatcggagagaatggcgcaattgaaatggaaattgtcaattccgatggaaaagaattgccaattccgcaaaatccgttgccaaaaaaagtcatcggattcggaagcattgagatcgagtaaaaaatgaattgaatttgtacatgatttgtttccatcacattttctgattttcagcttcatcgaccaacatgtgctcacttttctcggccattttcatcggtttttctccgtttgttcgacaaagttgtacatttccactggaactgttcgcattgcggagttcgttgtgcttaccattttgccgatgttcaaggacaccattcgtctgttgtatttggacatcactgatcttcgtcatatgcgccaattggctccgtccattctcttcaattgtccgtctctccaagttgtcactacctttttcgattttttgcccgaatttccgcctgacgacagtgccaatgcgtcggatggccaagcgctgaccaaatggctgttcacgcctcatcccgacaatttgccaaaactgttttttgtccacatttgggaggatacggggaaacaatggtcgacaatcgtgggacaaatcaaagcggtgatttgttctaaatttgttttttcttattttttgtcttttaggcattttccgctgctgcttctcccgtttctttcaacattactgttgcctttatgccgttttatacgcttcctgatgttgtgccatttgaaatgaccaacgaattgactggggagaatttgaaaatgacaaaatcaattggaactgaggacgatgaagatatttttgagatcatccgttgttcagttgaagaagggagtgagcaaaaattggaaaaggcattgaatgaattggtttatggacgaaagaacaacaaaattgatttttccatcaaataccgcggagtcgacgaaaggtgaacaatttttaaaatcccaatgctaattttttgttttgttttttaaggcttctcgacgctgcttccgccgggccaagtggtgatcagaaacagcagaagaaatgaattgattggttgattgatgcgattatatgacataaatgttgatcattgttattta

SEQ ID NO: 5290 - DNA, 1013 bp, Heterodera glycines
attaccgttgaaaaaatgtctgacaatccgaaagaagcggagaaagaaatggaaaaagcgatgtaacaattaatctaaattataatttccatgctaattatttgtttttttagctttatctccgccgactgttggcttgaagtgttcgatttgcttccgccctttcagcttggccttggcattgcgttgatcagtcgccgctttgactattacgtcgacgaacactttaaaactcgcaaatggacattggacaaaatggaaattcaaatcaatggagaaattggacagaatggtgcaatggaaatgaaaattgtcaatgccaatttggattcgctgccaatcccacaacatccgttgccgaaaaaagtcatcggattcagatcaattacgatccagtataaaatgatttgtgatttgatacacacattctgattttttgtttcagtttcttcgatcaaaatgtgatcacttttcttggccattttcaccgttttttcgccaaatgcgcaacaaatttgtcaattgagacagagaatgttcgtatttcgaagttcattatgctcaacatttggccaaagttcaataacaccattcgtctgatatattttcactccatcgcttttggtcaaatgcgccaattggccccgtcaatgctcaacgattgtccatcccttggaattgtcagtttccgtgacggaattttccccgaatttccgcctgatgacagtgccaatgcgtcggatggccaaatggtggcaaaatggctgttctcgccacgtcctgacaatttgccgaagtcactcagaattatgaattcattggttgaccaatggttggcaatcgttgagcaaattagatcggtgattttttgattattcaagtttaattcgttttcctttttttctcctttttaggcattttccaatgcttcttctcctgtttatttcatcatttctgtttcctttccgccgtcttctctttcgtccgttgtgccctttgaactgaccaacgaa

SEQ ID NO: 5291 - DNA, 2743 bp, Heterodera glycines
aaactgcactattacgtgcttttcagtatcaaaggaacctcgtgcctcggccgagctcatcaataagcaccagcgaatgtcgcgtcgcctgcgacaaaattgtgttcgtctctgacaattccacgaaaaatgtcgattgtccttaatgagtcgagtaataaaacaacaggcacgaaactgattagccaaaggacacctgcagataatctgtcactggcgccgatccgacaaaaaatgcgatcgaccggcgtaagtcgcatcgaatcagccggcaccattgagccctcaaatagcgaacggcaaagattaattagagaacagttcgccaatttgagaacccacaatgtgtgcaagtgccacaagggtggccacttgccgcatgaaagtgcttttcccgcccatattcggccctgtcagcaacatcgtgtgggccgtgttcgagccacagcccagcacacagctgttcggaatgtaattgaaactgccggctgacgccgacttaaggtcggccaacgacggatggaacccacgctgaatgtcgacgaacggctaaaaaacagtggtcgaataaacaatcaacgtattattgaaccatgtcaaattcgaacacaaactccggaaaacacattttgtgaggcgatgactgcgcgtacagagaaaggcccattagacaatcgaaagtggcaatttggtgaacaattgaagaccatttgtcctttctgatggtttataaaagggaattaattattaaatgcgttttgtttcggcgtggtcaaccgaccgcacatccaaatcagcaaaaactctacgggtgacctccgcactgatcgtggcacagtttgtctccgcatcgttcagtttgtccaccagtttttgcaggttattagtcgtgtagcgtttgtaccccttcgttataaatggacaaattgtttacgtcacctccccctcccttcgaatttccgttttacttttcgttgggacgtgaattggaaatcgtccgtcaaattgtgacatgccgactcggggatttccaattggtgtgaatttctgcctgtgcccacgaatttcggcgtgcatttcaactttttgcttgcccagcccaaatacgcctccaactgttctttgcaatgttcaatttctcgacatgtcccgtcgtattccgagtcaacgccccgtcgaggcaaaataacgccacgctcgagggcattctcacggtcaaatgcaccctgaaaatgaaaagtgatgcagtgctcacaatcagaaaattcggaggggagggggggggaagttttttttttgctctgtgccaaaatttccaataaatatttccaacaggcaacgcttaaatgagaaaaaaaagcttttgcccatttgttattaaaatgccaaaccaaataatgaccttaaagaagcccaaatcttccaccatttctttgtaattggcactcaaacattcgtttaaaagaggcggtgcactgaaattaatacgtaaaaaagtacaccaataaattaatttttcatttttaaaaacgaacttcgattcgccctgcgagtttatctcttcgaataaaagcattagtttccgagtgtcttccagaccatcgaggacaatgagcaaatctttgattttgcgtttgttatatttgtcagcttcgaagagatttgcccgggagtccgggtgtccgttgctcgaatccatccggtatttaagaccaattgtgtgaattctgaaaattcaatgttttaaattaaaactttttatgcgcaagtgcaatcctcgggtcagtggccacaaagttgcacagggaatggtaatgggtggaaaagagcgttcggcagccaatgctccgcatgatgtgtttgaaaacggcacatgcaatggcagtcccgtcggtgtactgaataattgacattaaagggattaattaacgagtgcttttcagaggaacctcgtgcctcggccgagctcatcaataagcaccagcgaatgtcgcgtcgcctgcgacaaaattgtgttcgtctcagacaattccacgaaaaatgtcgattgtccttaatgagccgagtaataaaacaacaggcaacgaaactgatcagccaacggacacctgcagataatctgtcactggcgccgatccgacaaaaaatgcgatcgaccggcgtaagtcgcatcgaatcagccggcaccattgagccctcaaatagcgagcgcaaagattaattagagaacaattcgccaatttgagaacccacaatgtgtgcaagtgccacaagggtggccacttgccgcatgaaagtgcttttcccgcccatattcggccctgtcagcaacatcgtgtgggccgtgttcgagccacagcccagcacacagctgttcggaatgtaattgaaactgccggctgacgccgacttaaggtcggccaacgacggatggaacccacgctgaatgtcgacgaacggctaaaaaacagtggtcgaataaacaatcaacgtattattgaaccgtgtcaaattcgaacacaaactccggaaaacacattttgtgaggcgatgactgcgcgtacagagagagcgccattagacaatcgaaagtgccatttggtgaacaattgaagaccatttgtccttttctgatggtgttataaaagggaattaattataaaatgcgtttttgttttcggcgtggtcaaccgaccgcacatccaaatcagcaaaaactctacgggtgacctccgcactgatc

SEQ ID NO: 5292 - DNA, 2240 bp, Heterodera glycines
  misc_feature (47)..(47): n is a, c, g, or t
  misc_feature (115)..(115): n is a, c, g, or t
cgtggcacagttgtctccgcatcgttcagtttgtccaccagttttgncaggttattagtcgtgtagcgtttgtaccccttcgttataaatggacaaattgtttacgtcacctccncctcccttcgaatttccgttttacttttcgttgggacgtgaattggaaatcgtccgtcaaattgtgacatgccgactcggggatttccaattggtgtgaatttctgcctgtgcccacgaatttcggcgtgcatttcaactttttgcttgcccagcccaaatacgcctccaactgttctttgcaatgttcaatttctcgacatgtcccgtcgtattccgagtcaacgccccgtcgaggcaaaataacgccacgctcgagggcattctcacggtcaaatgcaccctgaaaatgaaaagtgatgcagtgctcacaatcagtctcacaagcagaaaattcggaggggaggggggggggaagttttttttttgctctgtgccaaaatttccaataaatatttccaacaggcaacgcttaaatgagaaaaaaaagcttttgccaatttgttattaaaatgccaaaccaaataatgaccttaaagaagcccaaatcttccaccatttctttgtaattggcactcaaacattcgtttaaaagaggcggtgcactgaaattaatacgtaaaaaagtacaccaataaattaatttttcatttttaaaaacgaacttcgattcgccctgcgagtttatctcttcgaataaaagcattagtttccgagtgtcttccagaccatcgaggacaatgagcaaatctttgattttgcgtttgttatatttgtcagcttcgaagagatttgcccgagagtccgggtgtccgttgctcgaatccatccggtatttaagaccaattgtgtgaattctgaaaattcaatgttttaaattaaaacttttgtgatgttacctttggaaaaggcgttccaagtccggaattttcctcaataagtcggtcatttttgtcaaatttggacgcctttcgtcggataaaagccactcgacagacttttgtctgcccaaaagcgatttccgatcgctaatcggcgcacagatccattgtcgaagcaaacgttttccaaagggagtttggcatcggtttatagtgttatacagcgaaaaatttgcattattcattcggaaagaggatgcagcaaaggacgaagaagcggaggaaaggccggagacggaaagagaagggataatgtgcaaattggagagagagacgccgtccaacaccctaattatgtaatttaggaagataaatgccaattccaagaaaacgaacttttcattcccattcccctaaaaagcattctcgtgacccttcccgataagatttttgcctttttactcacatatgttttccttcccagaatgcctcgtcctccatgccatttttcgctcctttcacaatttctttgctttcaatgtacggcggaatgtacgcggaaaagcgacgcatggtgacagtgtccacgtctacaaggcaatgcttaaggtacctaaaatcaagaaaatgaaaaagtataaatgaaagtggaatccaaagaaaaaaacgaaccaaagaacggctcccaaggaggacaaacaaagtctgtgacattctgagggcgcggggattgccacgtcgggcgaagccaacatttgacggacagtctcaggccaatcatccaaatgggcaccaaaataattgtcatcgcaaagcttaaaaaaattgccttattatttaaattatttgttttgttggcatttcttccattattccctttttggcactaccaaatgccacccactcactgttgttagtgttgtttcggcacttaaaaactgacgttttggcagcaatgcttcctttgaaacggcagaaagcattgtgctaaccaaagccattgagggggcggagagggcgcccttttcgtagagcaactgaattagtagaaaatgcaaaggttaaaagaaacaatgaagtcgacctggacgggataattatgtgccaataaagttcgcaaattgctctgattggcatcatcgtcaaactcggcaagtttaaacgcggcaattgaacaatcgacgaagcaaacgccgaaacgaagggaaccgcccgggggaaacccacaaaaaaccaacattcaaaaacagactagagacgaagctaattgtaagtaaatatactttttccgccaatgccatcaaa

SEQ ID NO: 5293 - DNA, 959 bp, Heterodera glycines
ccatcagccactttaaatgaatacatctccagcactcatatttctttttcaaatgtcaggcattttttgatttttaggtattttttgaaattaatttaatttttcgaatttttcaaaatcccgcacgcgaccctgcaaattttaaatgcgggattaatcccgcgggatcccgttccgcaaaaaattttaagttccaatcccgcagcgggatccgcaaatttaaaatttccggtctataattgaaatgcaacggttggcgaaaatatttagcataaaaagcaatcagataaaaaatttaatcgtcaaatgaatacaaaaaattacggataaaaaacaagaaacaatttacgggattgatgtctttgggttcacctcaattggcacttcgtggaattggctgacattgggttgcacatcgtccggttccatacattttttcggatttcatcagttctatggcttctccgtgtctttcttctacagccaatcggaaaaaattgtgcaattttaaaaggaggatcagcgtggaaaaggaagcattctcttcgttcatgtttggttgtccgaattgttgggccaaccatttggcacattcgaccatctcacaagtttctttggccattggattggacacgcacatggagagttggcaatttgccaattttatggctttttcgtgacactaaatcagaaacggtttattgtgattagtaaattaaatgttttttctaacctttgccaatgcgtaaaggtgacacgcagcaagagagtgtccctggacatgagtgtcgaaggcaatgctggcaatcaattcgcaaatgtccatggcgtctttaatttgtcaatgagaccggggactctgttcccctgagagtccaatcggcccaaaatcgcttcccgatggccggacatgaacactattccggtgacagcagccacaaaaacactccgaccttttt

SEQ ID NO: 5294 - DNA, 2812 bp, Heterodera glycines
  misc_feature (106)..(106): n is a, c, g, or t
  misc_feature (2685)..(2685): n is a, c, g, or t
atttgtcgcactgcaaaaacagtttagatgcaaatccacctttctgtctaattgtggcatgtccgcggaaggtgtgtccaacttaaagtcgcgcgcaaaaaaacangtaatttattgcgtattcgatattgctcaattcaaagtccttgacaaagagaagcaaaagacgggccaaattcagtcgacaaacactcggctcatgcacatcggtggtcacttgaatgaaaagcaagtgcaaagcagcacacaattcagtacactcacacaactcatcggacacttttggtacggtcatcagcaaacgtaattgatgggccagaatagccaaatgtacggcatgaacaatgtattcggacctgaacagcacatgcacggccctttcgatttgaccggtgagcaaaaggacggaaaaataaatcaaatggctgccaccttcgccaacaaaatagcgttcgcctgaaggccttaaattggaaataagtggaagttggaattaccatgctgagtgcaaagtgtcgtttggagttggcgaagtgcccgtgccgggtcaacggcaaatttacaatggaacaatttggcccaaagccaatcctcgatggtgccatttatttcaggacagtcaaagccgagaaacagtccgtagatggcctttttgtgcatgtcttggcaattctgggcgttccattccgcgcgcaatttcaggcgtcgctcgtcgtttaacaaatcgctaaagagaattcgttttttgggcaaaggttcctaaaaatacgatttcggcaaagttttcagaatcccgacaagcgatgcacagtgcggattgtttgacaactctttggcctccttggcaactcggccagcctcagccatgtcgcccacacgaaggcaatagaatagcaatgtccaaatagggtatcgttcgaacagtccgtcctatccaatggaaatttggaaaaatgaaaatgacaacgaattgaacctcgaatgggtcacgggaaggcattttcacgttcaaataagcaagaatccttgacaaagtgccgggaatgcctccacggcgtgccttttccaaattcgcttcgatggtggcttcggtgtgagaaataaatctaaacagcggatgaaatgttatcaatgaaacaataataaaaaatatatgctcactcattttgcagaaatttggtgctattgtcgattatatgtcccatccaattatgtgacgatcttttctcgtgccaattttcaccaattgatgacggaaacatggcccaagctttagaccaaatataatcggcttccttcgatttcaaattgctcagtgattctttcacggcaagtagaattaaagccgaggcgttggatgtaagggtttcgttaacctgacaatttacgagaaagaattacaatgggatgaatggtcattaaccttttgtgcaaatacgctctgttcgtgggacagtggcgcattcggaagatttatgaaacgctttattccaccacttgctgttctgtccggttgtgccgagcccattgcccttttgttcacggggccaaacaaactttccccgggtgcaaagcgtcgctccaaaatttgctggttgaggaaggtccgctccgcctcaatctgagctcgttcaatcgtacgttgcacaaatttgtttgtttctgcatccgtaaatcgttcattcaaaacatcagtgtttatatcctcgtaacggtcagaagcatcagccgacggaggcttttcggcaatttttgatatggggagacgggtggatgaaagctgactctgaatgattattttgaattaatctttaaacagtgaatgaacagttccaccaactaagtcctggttggtctttagcgaagcgcccattccgacggccgtcggccgcagtgactgttttctcgaccaaatctcttcactgcgtctgaatacatcgtctaaaccagcgtccaacaaagcagcggcgcatggatgacacgcaaattcgtgaagcgttccaaatttttttttttttttttaacatgcacatgtggtgtagtggttaaactttctacctttcataatttttcgcctgggttcaattccccacttggatagaatattcctcacattttctttaccattattttaattaaaattttaattttaaaaaatattccaacttttttctttcatgttaagcatcctaaaaacccaaaacttaatcaattggtcatttttttgataagtaattgtccaattaagccctaaatgcaaaatctaaattcaatttcccgccgcagaccctccgtcactatccccccaattaactccaaaaaacagcgaattgtgcaccaattggacaattccgcctcagcaattgaacaattccacatggagcatcttaccgatgcgcctccatgggcttccgcaatgttgggactggtgaaccaaatggttggaatgtgccgcgagctgatctccatggtacgcgagcaggacggaggaagcaacccgaacagtgtttttgacgaagaacgacgactgcacagcgttgtcatcgcgcaattgcaggaaagcaacagccaaacgccaactcaacgtgcaaccgatgacttggcgaatgtcaaagaactgatggaccattgtgacatcgaatgcctgccgacccaagtgtacagaatgggcaaaaacaagccgancgacgtccaaggttgctcaaagttgaactcccgaccaattccataccaatttatttttgcgcaacaaaaacaaatcaaaaattttaacaatttttccaaaagtttgttgcgcccctccctatctaaa

SEQ ID NO: 5295 - DNA, 2719 bp, Heterodera glycines
attaagcacaaaaagcccgaaataggcaaaaaataggcattataaaagtcattatagacaccccaaaccaagcggaaaacgcgattctcgtgcttatctgtgtgaatattgttcgaagaaatttaggcatttgcctaaaaacgaattcctagttctctgtccataacttttttgaatgttaggaaaatccggtctcaattattctaaaagtttaaaaatattttccaacaaatccaagcattgttaagcatttcaaattgcttttttttcttttttaaatatatattttaacaatgaaaaattatttaaaaactatttgatgctacatctttttcataagtgttaacctgaaaaattggggtgctagtgcatttcgtaaacgaaatggggtgggtgtggtagaaaaaaaaaaattgtaaaaaataaatttcatatcttggcccaagttaaacaaatataatatttcgtggtattttttaatagatatgggggtattctttcagaatataatattacaaaatttttatcttaagtataaaaaagttatcgtcataaaatttaaaaagtcttatatcagaattttttgtacagaacttttttgaaattcaattaaattttctgaaattttaaaggtaaatagagaattcttagagctatcaaatatataaattaatttggctcaatttcattttatagatttaaaacattgtgtttataattatatatgcttgaccattgcaaaaaacctagaatgttcaatgatttataacttttttatacttaagataaaaattttgtaatattatattctgaaagaatacacccatagctattaaaaaataccatgaaatattaatttggttgaacttgggccaagttatgaatttttatttgttatacatatttttgttccgaacccattggcggatttacgaaacgcgctagcggttttacgaaacgcgcatgggtggtggctttagcaaaatacccatttgacggttttacgaaacgcgctggcggatttagaaaacgcgcatgggtggcggtttttacgaaatgcaccagcacgaaaaattatcaacaaaaatcgactagagagaagataaattttacataagtatagccgtgacagcatctcgaaaccataattatttgtgactatttttggctagttttaatcaataaaacaaaaaagtgaattctgaattttgttcgaatttggattggcaatttagaatagacataaaatgaattctattttaatgttcagtgtgacccagaaaatccctctgttttttcatgatccggttccatgcccggcaattggaaagtctggtttgactagttttcagatttgccggttatggagaagccgaactcgaaagccggttgcttctaaaaatatcaggcggcccagctgatttgaaaatctttggcctctaatcattaccgtctaaaaccatgcaagaggctcattttcacattttcgataaagcattgtggacggggcaaaaaatatttcataaaatctttaatagattgacatttttcaaaatctaataattgtctggcataaaagtgcatggattgcattgtgactgagactgaattagacttaagtgcattagaatgacaaaagaaaaaatattttattgaaaactgaatcagctgactatcaaaaaagggcattgagaaatctgttgacagttgtctggcattgaatggcaccacgcattatcaaatggaaaagtggcattgggaaaagggcaataataattgtctgccataaaagggcatggctggcattgtgacttcgcgatggatttaagtgcacgcaaaaattttagccatgtatttaagcaagaaaatcaacggcataatcattccaatgtttctttttcttcttaaaggactaaagtttctacttcttttttttgctcaatttccctaatatctggtcatttaatcagaaaataaataaattatgtcgagactctttgtttaattcgaccttctaaggaattatgccttaggaattaaccaatttaatattaattatattatttctcccgaatttcccaatgattcaacaaatttatttgcacaattgaatgatcaaatgaatgatgaattgctctctttttgctttcttaaatatgattttccttccccattttgattaatcatcatctctttcctttgatctttcgtcgcgcttatcggcggcgacaaattatttgaaaataattaccttaaaattttttgattaaaaatatttttttgctttaactttttgctttccagacgtttaaaacgaaagaaaagtttccttttatattttttagatgataaaaaataaaatttaaaaaacttttgggtttttcatttcttttttcttgaaaaattctatgttgctccagtttaccagtccttgttccggttcaaaatcgagtcctggtcccggcttttctggtcccggcaactcccgatttgcctaaattcccggtatagttcgccccaaccaaatattttaaggaatttctttcccgatccccgattttctcttccaaaagtcggggagcaacccaacttaaacgcagggagcggatgatacttgcatttgaactcattttgtggtttttgattgattaatgcggttttatttttaaaagcagttagttttttgtggttttgaaaagtttaaattttgcactttttt

SEQ ID NO: 5296 - DNA, 1566 bp, Heterodera glycines
  misc_feature (31)..(31): n is a, c, g, or t
  misc_feature (55)..(57): n is a, c, g, or t
attagaactcgtaaaaaaaccaattttgctnttgctattcaagatgatattaatnnntcaagtgtagaaagaacaaaattccaatcattaaattataattctttttttcctttactagtttttttaaataaaattatgagccgaggtcaacaacaattagccataataatacacacacaattcatttaattaaaaatttcttataaaatgtccaaagtttcttttttgaatgatatattcgcaatgaatttcttaaatttatgcagtaacaattttatttaaaaaataaataaataaattttcatattttattatgatttttttccggtctcatttctcaacccttccgaccttaatggccaaccacccatcgtgcaagtgttaaaaaattctttttcagagatgaatccgatcacttttttgtctgcggtttgctgcttcctttttctggccaaccatttccaaagtgtcgctgctgcttcaacgaacgtgttcgttcagggaaaaaaaagctacacaattaacttgattcttgatgatagggaaggtggttatatacaacaaataacaacaaaaaaagtcaacggaaaacaatgtctgacgcttaatcaaaacctttggaaaacgtaccaagacgatgatgtgattgcattccgtcatggatcgacggacgtaattcaaacaaatcaataaataaaaaaaattcgtattgtggtttggcgaaatgaaaattttccggcctgtctcgtctcgcttacacatttatttttaaaccttaatcttattcaatattctaagattttttcttcttttttttttgttaatttttcaaaaataatataaatatttttcattttcaggcgctgattggtagcatcactgtcaagttattgcgtgcggacacttcaatagacatttctgctgataatactcatctctagtgctgctcggtccaaaattttccgagaccgaaaatcccagagacctagaccgaaaaacccgaaaccgagactcgagaccgagagcaaaaaaccgagacttttccagagtccataatctcgagcagcactagtccttatagtatatctgaacacagagaaagccaagcagcagaatgggttgggttggatttcattttttctcatattgatgcaattctgttagttagttgcttttgttgatgcccctttgggctttgttgcgataaaaaattcttcaattcaaaattttttggtaatattttagtgaagatatgaatcaggttcttttcgactgaaatccaggtcaacgcggcattttggcaatttagatttttcctgacctatatttccgagtgttttgtcaggaaatccaggtccatgttaaacacgaaaaaaataggcaaatgtaaggcaggaaaaacctggatttcttcgtaatatattatttatttcgaatgaccaatgttttgtctaggcttttttaatgtcgaactttagtggttatttagggatgtcatttaaaagatgaattaattgcctgaaacaatatttactttttagattttttgttatctcttatgtattt

SEQ ID NO: 5297 - DNA, 1931 bp, Heterodera glycines
  misc_feature (1918)..(1918): n is a, c, g, or t
ttaaactgaaaaatcattaaagatataagtaaaaattgttatatttatttcataaatttaattgtacaatttgtgcatataaaaataatcaaaaatttatggaataattaagtttgttttttaaaaattagtttttcaaaatcctcccgttttgttccaaaattgtgtatagcgttcgggtctgatcaattcaaaaatgtgtgtttaaattttgtccttggcattctgctgctgatcagtgccatcctccaacaacagcaattgttccggcaatttcctgctattattgatcatcatttgatcctgatcagtcatatgctgatcagtttttgtccctccgctgatcacttcctcctcctcatcgtccgtctgttcccgcttggcccatggctgcacatcggcactggccaacacagcaaatgccaaagcaccaagcaccaaaatcagttcagtgatgccaaatacggtcaaccattccgtcttggagccctaaataatggaaaaattcaagaaattttcaggaaaaaattttgttactcgagtttcagactcaattttccaatttaattgaacccatttctaatgttaatatctaaacagattctcaaaattccacaataaattgtttattcgagaagaatttaaaaatatatatttcttggcgtagtgattacattttaaaaattcttacggttggcgttagccatcccatcagaattgggccaagaaagccggccaaacaggagagggtgtttccaagtccaagcagtaggccggccaactcaggtgcaatgtctaggtagtttatcacaaagccagaatactgtaaatgcaattttttgaaattttatatctttggccctttgcctgaaatccggaaatgccaatggacagcgtcagaagcgtgatcaccaatttatcatagccgcaagggcaaaagctgatcagcagcaggaaaaatgcttggccaccgagtgccaatgccattgccaaccgtcgacagttcagcgttgagagcagctgacgttgtagcaatgaatcggacagctgcattgaaaaattgatagatggcatcgtcacaaaaaatttttttgtgaataaataaaaataaaattatttttgaaatatttactcatttttagtaatatgaaatggattcgcccgattcaatggcatttaatattttaaaatttaataaattatcaacttgatatgattctgatcaaacctaatgattatacggataatctttaataagtgaatacagcataacttacatgaccgccgagattgatcaccgcaaaatagacgacatatggtatcgctgaggcaaaacccatctagaatattaaataaaaataaatctaaattaattaattaaattatttttgaaacttactgaagtcatctgcattccgagcacgtcgttcaaaaaagatggtaacccttaaaaagcaaaaatgcttttgacaacgaaatggatacgactgaagcttaaacgagtttgatattctgatcagaatagaaattcataaatttattcttgttttttatttgccaaaaaatgcatggaaaattttatttattttttattttgttaatttttgaaagagtttagaatggcataactaataaaattgaaaactgagatttttgaaaaaaaaaaaattttttttgtagaaaaagatgtttttacatctatgacctatggcataaaaatgatacccaatgccatcatgtatgcgccccaatcgccggcaaagtgcccgatcagaatggcccagacggcttttgagcgaacaatggcaccgatcggaattggacgagatggacgacgaatgacggattcttcactatcctgatatggataataataccattttcataataataatttttataaaaattattggcattntaaagccctttaa

SEQ ID NO: 5298 - DNA, 1522 bp, Heterodera glycines
  misc_feature (15)..(15): n is a, c, g, or t
  misc_feature (43)..(43): n is a, c, g, or t
  misc_feature (48)..(48): n is a, c, g, or t
  misc_feature (50)..(50): n is a, c, g, or t
  misc_feature (61)..(61): n is a, c, g, or t
  misc_feature (97)..(97): n is a, c, g, or t
gatcaatgaaatccnttatgcatcattcatttttgcaaatacnaaacncnaagcacttgcnctcgactttgcttggaccaatcaaattcaccaggcncaagtgggaccggaagatattgttcaacatcagcatcatgatgaccaataagagcctgaactgacaagatattaacatcagttatatgatcccgagcttataatttttaccgtgtcttggaaacggcaaaaatgctttcaaaataattatttatcccttaatccgagaccttgtcacaatcaattctcgttatttcatgctaagctgaggccaaaagttgatctcaaggatgtatccaagatcatgtgacttttttttttcttgacccaagaattattctcggagttgactctcgactaatttttttaggctaagatcaaaaatattttcatcgttaaaaatttgagcaattaaatgattatggataatttattgtagcgattaccgatcgattagtctgcctcctgaacctgctaatggccatatcactttcattaatgggcagttgtcgttgttgctccgttgtcgcatgcgcggcaccgcatcccttttttgttgtgccattgtcgtccaccgtaggcgatccctccttgaccatacaaacgatggcaaatgacaaatttgagcgcagcgcatagcaaagtgcgcagcccgcaaaacagatcagtgccaagctgaaccgtttggagagaagcagcgctggaaattggcaatttatttttaaatttacatggtacaacaaaatgccaattttttgtatgcctttatgggtatggagatttttattttttatatacagggatgcaaaaaatatggacgaaaagtggccaaaatatgcacataaatatgcaaataaagtcgtgaaatatgcaccaaatatgcattaaaaagttgaaatttggggtgcaaattaattaaaaaaaatttttttttctcatagagtttatcggttgtttttgcaattacagatcaaaaatttctcgattttcggcagtgaggcttcctgtttacccactcgcgcatccattcagattttgatttcattttaggcataataaaaattttttcctaagagatattaaaatcggaaaatatttgacgaaaaatggcaaaatatgcaaaaatatgcaaataaaagtcccgatttttatacgcaaacacaaaaaagaaagtgtttttcctgctatttagagcatggagaagccaggaaaaaaaatatgcatttgcatgttttttgcatccctggttatatactactgatcttagtctaagttatggaattttttgaaattctgagccctgataaaatttagtcaatcaaatttttatccgaatttcctgcttgcctttagaatttatctaaacccatttttggctttttttttaaatttttcaagccatttccccaagtattacataagtagagaccgacttttgaggcatatgcctttttttctgcgcactagtttcgatatattaagcata

SEQ ID NO: 5299 - DNA, 2083 bp, Heterodera glycines
cttttggagagaaaaaatggacgaaattcgcgcagagattggaaagggagggaattcggtgaagaaaacttacaaaatgtggcacaaattggccaatttgttcaacaaaattcccatttcgaagtcgcagcaaaaaattggcataatttacgacaaatttggccaaacgaagacggaatttttgtggaaagcgaaagaccaaatgatggaagaacacgcgaaaaatgtggccaaattggcaggggacggacagaacgaacttagccgaactttggccaattcaattggccaaatgagaggggccaaacatcggctcaaaagctttttcacctccaaattcaaaggcaccgaaattttggaaaaattaatgggagaagacgcgaattttgcggcagtgtttcgttcaggtgaaagtttaaaaaaattttaaaatgtttttgttaatttgtctcgttcccatttttcatagatttaacttcaaacgaaataaaggaattacaaataaaattttacctaaaatttttggacagtgaaagcgaaacggacgattatttgagagcaaaattaattgtggacaatttggcattttatcaatggtaaataaaaccattggccgttaatttttatttgttttttaatttttcaattttaggttcaaaaataggcgacaaaaactgccaaagaatggacagtcccttctcgagcagcacctcctccaaatcgaacttcgcttggattccatcgccgaaatcgaaacttcggagggaacggaattggcacacgaagcgaaaatgatggcactgaaaatgtcaaaagacaaacttttcccagaagaaaacccaacggaagtgaaaacatttggcaaaagtatgaaaaatgaggcaaacaatgtgaagaagactctgttgatgatggaaatgcattgtaaaatcatcgaagaatttgcggaaaatgagcagaaatttatggacggagttaaaagtggggaaaaactaattaattaataaacttattagtgtgatttaattattaaataattagtttctaattaattaattgtaattaattattagtgattgatttagaaattgttcttgacagtcaacgtttgcacaaaatgataccacgactgagcaaaacatgccaacttttgaaggaaaatgccaaaggggagacaaacggaagaaagaaaagcaatgggaaaaatgagacggaaaagcgggcggaagcagaaaaaggagaagcaaacggacaaaggggcggagaatgcgtcgcttcggacggtaagggaaaactaatgggcaattagtgttaattatcattaattgcttttgccatttgccattgatcactgaagaggaatccgacctgatcagctgctatcgccatttaatgtgtgctgatcagccaatttcgaaatctgacaaaacatttttaatggtcaattcgctttttttccatctgaaattagtgataaacgaacttttattagtcacaaataaaatcaaaagcgacggacggaaaaatgaaaaaatgaggcgaaaggcaattgaaattgaagtggaagtgcaaaagaggcaacttttggcaaaaacggaaaatttggagcaaaaaattgccaaaatttgctatttgacaattatttgggagaaaagcatttcgaatgaattttttgtgaaaaaggcaaaatttggagaacatttttggatgtcaaattcaataaaaaaggtaaatgaattaatttatataaaaactaactcttttaatatttattccatttaatttatttatttttaattaattttttaacagaaagtgtctttttcttcccccgccgaaagtgacgaaaatttggacttttctttttgtgaggaaagtgaaaatgcccttaagctttcacaacatctgatgaatgcgcaatcatttgaagtaacgcaggaaatagtgctgaaccatttgctgagaaaggacagagaattcgctaattttgtgtgtttcaatcgaaacgaaatgccaatgttaagaaaatgcggtaattttcggcggggggttcgatgaccacacggccttcgagaataacgtt

SEQ ID NO: 5300 - DNA, 3420 bp, Heterodera glycines
ccccccctcggcttggccacaaaaatgtgccaataatgcattcgttcctccttttccgtctcactttttcagcagaatttgatgactccgatcagatgcatcgtttgtatttggctttgtttgcctccgatgattctgagttggcttttcgaaatgagacgaccctggccataaaactgatggattcgatcattgccaaaggcgaggaaacggtgctcacttttggcaattacaaagaaattgcggtggcacgggccgaagtgagggcaatggcggcggtgcatttgaactttctgaaggaggagcaccaattccgcatcatttgtcgccagtttgccaatctgaactttttgagccgaaagatggtcgatccgtccgccttttggcttttgcccattgattgttcggccattagtcgcgaggagacttttcgcttgcagcgtgccgtcctcaaaatatctcattgggattttctgcacgaccattttgataagagcccaacagaggatggcattttgagaacggtgcggcaaaagcgcggggcattcgctttggtggccaaactgatcggaggggaaaagctgttggaactgtgggaggacaaagggatccgagcgaagctaatggacacgaattgtaagtgaaaaacggagaccattcagacacttttgcatactgttgtaccgccttaccataaccatttttttcatttttcaacaacaaaaaccgactcttggaccattacgtcggcgctttgcttgcggccgacacgacggaaaattgcgtcgatcgaatgcgcgaaataaaagcgaatgatttaatcgtatggacgcaatggttccaagcgaagcacggagaacaagcggaagacattcagaagcaaatggatttcctttggctgtatttgcgcattacgtacgaatcgtacgaaagcgaatcggacgaaatattcgaaaaaattgccgaaaatatggaaataacacggagaagtagttaattagttaatgggtgggctaattatcaattaacaaacaaacagaactcacccaaatgctttcttcggagcgtcagaattcatcgaatggcactttgggtaaatcattgaaaaattggcgcgacataattaggagggcgttcgacgcatggaattcggcggaatgggacgaatggtgatgcgacatttgcggcgctgacatttgcggcgttgacacttgcggcgcagacagttgcggcgctcagtcaaaacgacacttgcggcgcagacatttgcggcgtgacacttgcggcgccgacacttgcggcgacgacacttgcggcgccgacacttccggcgcccagtcaaaaggacacttgcggcgccgacacttgcggcgcccagtcaaaaggacatttgcggcggcgcaaaattcaacgaccccaaaaatatttcaacaatttattttcatttaaaacattgataatgactctctcagtcccattcttcaaagcctttcatccctaggcgctattgcaacgcatgaatgtgattaattatatcagcttggtttttgttttccttatggtcaaaatcgatgactaatcgtcggatcgcttcatcatttctcaaatatttttttaagcgtggcctttcagcaattccacgagttgggtcaatttcgtaaggtctcagacggttttgttggtgttcttcctcatttttgatggcgataatgaaccttattgaaattattttattacagtacccatttatactttgaaaatgatgtgtgtggcgaagtgaaacgttttctgaagctgttatgccacctaagaaattaattattaataaaaatgaataagataagctttagtcaaataaagattaacaaatttaagaccccaaaaaaaccaaaaataaataagttgttttttgaaaaaagtaatcaattcagaaaataaaaaatgaaaatatataaaaagacccattcacccttcgactccattattcgtacgctgctgtagaaaatttgatggaaaattaaaaatcaactgataaaattttatcaaataccacataaatttaattttattgaattaggcattgttaaaaaataaactattaaaataacaattctgttaactttaataaattgttgaaatatttttggggtcgttgaattttgcgccgccgcaaatgtccttttgactgggcgccgcaagtgtcggcgccgcaagtgtccttttgactgggcgccggaagtgtcagcgccgcaagtgtcgtcgccgcaagtgtcggcgccgcaagtgtcacgccgcaaatgtctgcgccgcaagtgtcgctttgactgagcgccgcaactgtctgcgccgcaagtgtcagcgccgcaaatgtcgcatcacctcctatattatgtttttagacattggtcaccgcttattatttccaatttctttattgctattaaatggaattaaaataatttatatttttaaataaatttgtccgttaaacatgagctgcatcatgatggatacaatggaaaggatgccgtcctttgtaataagtgaataaaatttgaataattacataataaaacaaatttttttgttaaatatttttttagttattttaaaattttgacaaaacttctaattatttttacataataaatattttaatatatttttcacattttattaaaaaaaattaataactattgattcgacgttttaaaatagcatattatgcgattttgccgagttttgccaaatcaaatatttatgcaattattgttgttggcatgcgctaaatctgtgaaattgaccaaaattatttttgccccatgttgcggcaaaaatcctataaattaaatatcaaaaattaaattttaatgttaaaacaccggactagtagcgttttgctacaaccagccgagcctcagaggacaattccctttttcgttgtaatttcatcgttgatttatattcgtaggttatcaacacggcaatccaaaagctggaattttttttaattctgcatttcctcatacattctttttaaatcattttattcattttacaatttagtttacgtcagcagttctctacgtcagcaacttggccaaatgtttcgtgccgcttttgttgcccgtcccgtgcgattccaattccttgtcgaacattgccaacacagtcagaatgtcttccgtgatggtctgctccttctcacaacgattgcctggcacatagtcatgcctatgacaaaaaatccgaattttcgtgatattttctcgaaatttggcaccttaagaccctcgaaaaaaattatcaaaaattttttttttgaatacttaaaaaatgcccaatttttcgtgtaattttctcgacttttggctccttaagacttcaatcccgaaacttgagcttaattaaaacgaatta

SEQ ID NO: 5301 - DNA, 1449 bp, Heterodera glycines
  misc_feature (855)..(855): n is a, c, g, or t
ttttcagatggtcaactgcaacaacaaccactgcagcagaagcaacaacagtcgcaacagcagccgcggtacagtgcgggcgggagcagcagcactttcttcgaggcgatcagaagtgccgctgaagagggacagcagcaccaccagcaacaacaacagcagcagttgctgcagcaaaaacagtcggctccgcccagttggcttccggtgccgcccggcttctcgccgctgttctcttcaacaaacagcaccaccaccaccgcgcacaacaacaacagcaacaacaataataataagagttccaactgacattggacggaccgccgtcgaagcgattggagggaacgaacgaaccgaacactgctgcagacagataccataccattttttgttgtttatttgatttctttcaatgcactcaaacaaaacacacaaatgttgtgttgtgctgctgcacttttgaccgtgtcccttttcttcctttctttttgttcgctctttttttgtgtttgttgtccttctgctgctgctgcaagtccatgcgccgctcgctctttgtttcctttgcgtataaatgagtcaatcaccgccgccacctaaaccgaatgtgatttcccccaccctctctcccttatcctatcgtattcctttttctatcccatatgtcccctttcgcaaatcgttatacattttgaaaatttgacccgtggtggatgtgtattgacgattttaaagacgaaatgataaatgagatggagtttccgagcccaaaaatgtcggttgaattttaaatttaatttgttgatttgaagaaattgaaaattatttcgaaagactattatgttaattatttgngaattttgtcagcataatcaatagagctcgacttttgaggcatatgccttttttctgcgcactagtttcgatatattaagcatataacacattttccacttggtttgagccttctacgttgacttttattatgcctttttttcctttttcgggattttcgtgccttaaatgcctttttggcattttgcattttagtgccttttttggcgctttttccgaaaaaaatcgattaaaaatgcaataaaatctaaaaatacaccccctaagaatcgaaactttttttcaaaaatacactcctaagaaatgaaaaatttttcaaaaattttttttgataaaaattctaggattaaaattttccttattctaagaagctataaaatattttaataatcatttaatgaccaaaaaatgaatttttttttgattaggttttacgtgttttgctctctctaaaaatctttaataaaacatttttaaatgcctttttcatgccttttttgggattttcaagcctttttatgccttttttcgattttttggtgcctattaaagtgcctttttggtgatttttggtgcctttttagtcgtgttcta

SEQ ID NO: 5302 - DNA, 3600 bp, Heterodera glycines
gagatgggaacgaattgttcatttattagccccttttactgttgaattgagtttaatttttttttggaaaatgtgccaaaaaaattatttaaaaaattctatttatcccccctggcacataaatggagactggtatattatttttcaacctcctcagaagggggtatataattggaggccggcagattaatggagactggcatataaaaagagtatatacggtagacggtggtgtgcaggcacgtggttgcccacgcgcacattgcactttctgaattttcctgcatctgcgggctctcggtatactcgccggtgcatgcagaaaatcatcttaaaattgctaatcgaggatttctcgcagtgtaaccgattcctggacctcgagattcaaatatttagaatagacaaagcgttgagtaagaatatccaaatatagggcatcatatttgaaggcgcaagtgtagaggcgcaaatgtccgcggcgcaagtgacgattttgctgagcggcgcaaatgtcgcggcgcaaaagtcgcaacacggcaagaagcaacaaagtctaaaataggcaaaaatgaatgaggagagagtggtgccttaatgggtactctttgcgtttgtatcccccttttgggtcaaatttaatttttcagaagcttagccagacagtcagacagtgcactatttccttcttaatttttctcacctcttcccttttcccacacacaatgctgccagccagcacacggctgcttactgtctacccttccacccgccgcagcccctcgccgcagccccacgttgacagacagtcagacagtgcactatttcttcctttctccagtgactaagctgaagaaaagaaggaaatagtgcactgtctgactgtctggttaggcttttgaaaaatttgacccaaaaggcggacccaaagcacattagtaccgcaaagtcaatggaaatgatcttacaattagttttggtattgtattgaaaaagttttggttcgagaaattgttttgactttgaaatggagtttttttgtttttgtaattaaagcggatgtcaattatgcctcttttaatggatacggtttaattggatggatttatcgtacttattgtttgttttgacaaaaagaacggagatttgagtcccagtgattggaatgcaggagaattgagtcccgatgattgcgatgccgaagaatccgtgaaattgagttccagtgtttggaatagtgaaggattgagtcccagtgattggaatgctggtgagattgagtgagtccctggaattggaatgatggagaattgaataaagtcccagtgattggaatgtcggggaattgagtcccgatgattgcgatgccgaaggataaggtgaggttaggtcccgttgattaggatgttggtggattgagttccggtgattgaagtgctggtgggttgagtcccaatgattaaaacgcaggagaatagagtcccagtgattgaaatctggtggggttgagtcccgacgattggagaaaaagcaaaaaaaaaggatgcgaggccgcgaagcggccgagccagtcgattttatcaaacataatcttacaatacaatcgtactacctagcgggggatgcgccgaaggcgctgaccccgctaggtagtacgcacaaaacactcgtctctcatggaaaagagcttttacctgtcaaattctttggacaaaagaatggagaagaattgtagttataaggcattcataaattatttaaatgacaaaaaaacatttcgccatttaattaaaactaataattccatccagctcactgtcttgtcagttttccaatccgaccaataatccatcgcccaaaaagttggtttatttagattcattttaaaaacggctctgtttacccgttagctcttgttctttttctcgtcataacttttctcaaacgtttttgaacaggaattcgtcatggagtccgctggcagcagctcacagccaattttaaacagagatttgcaaattttggtcggcgagcaaatatttactgggatatgtggtcctggccaatacattagcaatggatttttcaatttatttgttagttttttaaaattatttttgcttttgattcatgcaattttaggaggcgggaccgactgttaaaagctctgtcgtctcagttcttagcaaaatgactgtttttacaatgaatgaatgccgggcacagatttcgtcgccaaccgacaaaagggtccatttttaatttattttaaatgatattttgtaattccttatttttcagaagtttctttgtatcgactttcgaaaatcgtcggggtatttgttcttaaataagttggtccaaattatgaatgaaagcaaagggaaattcttcgaagttttgcatctgatctgtctgaaaggggtttacattgagcgattgttcgatatttttttgatgctgaatggttaccattttattattttgtccaatttgtattttttttgaacctccctttccttcagatttgaccatcattaatcttccgtacgaattcgattccttttctcgcaacggggaaaccaaaatattggacaaattaatcggaaagaatgccgcgacattacattccattcaccatttggtctatccgttccaattgttcccaaacattcgcaaccgaattgttgcgattaattccgcaacattaaggacagggacaatggaacgggtgagttttgaatggtccgagcgggtgagttttggaagctcagcccctcgaagaaaaaagaaaagaaacggggggggggaaatgagcgcacataattcatttctgctttctaataatttaagtcacataaattttttagtgttatggattgcttaaaaagggctagaaaattgttagttggtcatatttccaaatttttaacacatttccaaaaagtaaaattttttgagaatcccctaacaataagatatttgaaaagtagatattttcaaaagtgaaaaacacaattaactacccatggcattatgctccattcgcctgtgccttaattttctcactttttaggaatgcgatttctttgccttttacatggatccgagtgattgcccaaaagaacttttgccgcccaaatttggaggcatttcgatgagtatcagcatcaatcggtgcaaagaagtgttccgctcaataaaacggttgttcctttgagtcatttttcggatcaccgcttttgaattgttttttgagagcattgcaacgggacaaactccgttccgaaatcaccaagctcagactgttgtccaccttcgattttgatgaaaagtccgcgcagattttactcactcaaatcgaacgcattcgcagcactttgccaaaagtgcgttcactgaacatcgaactgagagcagtcgaattcaatgcaagtttatggaaattggaaaagtgccattttgaaagtggtgccggataaagcgctgtttcagccgaaccaggacctttattcgaacgacgacttcgccgactccaatctgatcccatcctccgcttccgcttgttcacatgtagcacttttctttttgaattggatg

SEQ ID NO: 5303 - DNA, 2684 bp, Heterodera glycines
aaaagatgtccatccgggaaagtgtcctgttcaggtcggcaaggcccgctttgctcacttccaacgccaaattggagttggaagtgcacgagggtttgtcctgaattggcatttattgcttttgccggtgccatttcggcataataaatgactaatgactgacaatggtctgtctgctggccaacagttcgagcgttgagaggaatggacgatttgagaaggtgttacgccgtttgtgagcaaatgactgtttgtcaaaactgaacggggcattccgtcggagtgtccgttcgttggccctccgaatgcaccgaccgttcgatttcgaccccttgggtgacgagtggcatttggaccgcctcgacggagtctctcttttggggcagcggcaccgacagcctttcgttggatgttagcatggcggccctttcattctcatccattcccatcagttcggctgtgatccgaacaacctttactaaatccaatcacttcatccaaaacaaaatatgggataatcttttgaaaatgcttaaaacaattcacttgttccaattgggactttgacggttttaacggcttgaagaaatagccgaaaaaggcgcagaaaagggaagtgccggacaggaagagaaggaacagacgccaactctcctcctcccccgccatatcggagaacaaatcaagcaaaaatgggttgagctaaaaaaaacaagcggaattggcaaatggaaaaaccgccgatggcacctttccaaaaatggccgtgccaatgccggaaccacagacggcgatgcccgtggccaatgcccttctctcggaaaagtattggccaacaattacaatggcaggaaggaaaatgagaccgaagccgagaccttggaaatgtggggaagaaacgggtaaagaacagatgcatcggcaaaatacacacctccaatgacgccaaaacataaatagagaaccggaagggcgggcaaaagagcgctgatcagaaaaccaatggcagcgataagagatcctccaaatggggatgaatgcattacggtaattgctaccgtattgcgactaaggacaaatgactaatcagtgagtgatcactgcttcacctgaaatcgcgacgacagcacagccaaaattgttggcaagagccgaagctaatgggccggaaaggaggtaaaatccggccaaaagggaagtgattgcggtgacgccgttactttggaacactttttcccaccgcggcaccaaactcgcgctgactgaacgcacgatgactgaaaagagccggcggggggggggggtgaaatgacggcacctgtgaagataatgccgtccacgacggcattggtgcagaagctggccaacacgaccacccagccgtaccccccgtcgggggccttcatcagtccggcgtcctccagccggtcctccatttcgtcgatcatcgccacgtccttcaaagagtcgccgacccttttcctctgctcctccgccgcagtgccatcttcggcccctctctcttcgcgtccatttccaatgggcatcccttaaggaaattcgttttctttgctcaattttcattttgcgactgttgcgaaataaaattcaatcggtcggacggagtttcgtcaaattgttatcagatgcacgcaaaatcattcactcattccaaaagactcttttggaggaacgcaagcaaagaaagggtccaacagatggggcaaatgggcgataattctttattttggtctgtccaaacaaaaaaaaggccacaaatggcgccaataaacattagcaaattgtacgaaaagttggaataatttgcaaccatttaaatgtatatttatttatttattcatttgaatcgaaaagctaaacaaatggtcaaatgataaggcgggggggggggagacccttcacattcattcgccggtgggacaacaaaaatgaataatttgtaattaatgtgacagttggcggacgcattgaaaagggcgctggggcgaaaattggaggatggcccaagcgaagtgatcgattctcagcagcagaaacagaaacatacaaacgaacgaacgacgagaaaatgggggagacaaaaagggaaatgataaattgaaacgagaaaattgaaaatgaggtgataatcggataaagggggatttaagccgaaagaccctcatcagacaaagcgaaaaagagcaaagttcgctgacagaggagcccaacgaacagagaaaattagcagtgaaaagcgtaatattataaattttaacgaggaaagggaggggggggggcaaagggagtggcagccgatggggggggaatcgattgctttgccgaaacggggaaggcataaaatcattgtttgttcaccgccactaactttttgaattttcaattcgatgagaagcagcaaaaaatgcttctcctaaattaaagaacgattgagttgacaatacaagagaatgggcatctcatgaagagcaaaaatgttttctaagcaattgaaaaagcgatgcaaattgctaaaaagcaccaaagaatgttggtgtcaattagagaccggacgggatcgggatcccgcgggattaaattcgggatccgtcccgagcgattttttaaattcatcgggattgatcgggatcggatttccatcgggatcccgaaccgggatccct
